United States Patent 9,328,346 (POLYCOMB-ASSOCIATED NON-CODING RNAS) - sequence listing, part 7

SEQ ID NO: 879 - RNA, 43944 nt, Mus musculus
uauaaggggccucauccuaucuucuucugaaggcauuuuggccaucugcacacgugagugauaaaguccuuccucgcugugaauaaacauggucccuccuaaggucagaccaagccuaucugucuuuccuucuuccaucucucuacagcugcuuuaaauaaucuaacagaaucuaacaguuugugcuuugagcauguguugugagcauggguuucauucuugugugcgaggggaugcaguaaagaaacugcugacaugauuguuccaagauaugguuaaguuuuuauuguaggcauaagagagagaggagagagagagacagagagaaaaagagagagacagagagagagagagagagagagagagagagagagagagagaaagaaugaacaaacagccagaggcaucuggaggaguucauagcagagggaaaaagaaguagaccgaacauggccaggagacuugacauggccagggcuagggaagcuggagagcagggagaugaguggaaauagugggagaugaagacucaaggacacagacacaccacacacacacacacacacacacacacacacacacacacacacacacacguggggggggggugagagagcuuugaaauucguaaaaaguacuugugaguaggagcagaggaaguuuggaggccagcaugggcugugauaugcagccguagguauaugucaauggagccaucugucacuucugccagaaguaagggaaaggacaacuuuuggccgaugggaacugcuuucaaaaguuccggaggcaugguggcuuuuauuuauccuccagaaauccuucugugguccagcuugagcucauuucuguauauuuggacagcugagagaacuaauaguuccagccuuuuguugaugauaaagggugauguagugucucucuuccguagcugcuucuuagguggagaggguuguccuggcaggcuaggaaagcuggaauuccagaguugcaggcugggaugggguggguguggauguggagguggggguggggguaugagugggggugggggacagggucugguuugcugagugaaccuaaagagagagacaaagaacaauuacauuggcuuaccaguggcaagggaucuucugagcaaugacagauggaagcccugaaguuugcaugaacuguuuuaagcauauaaaaagagguuaaagguuuagauagaaugaccacugucuguguucugcaaggaaguacucauuguagcaaagcaguuaacaaaaaucuguaaacaguuggaauagaccuuugagccuuagcaaaacaaagcuugaaaaguuauuagcauaauaggagcaugaacauuuauuuaucuguaauaagacagagauuucuugucagggaagagaacaaaagaacagagguguuuuuuucacaaugauaagugccuuuauuuagaaaacaacuaaagaaaauuaacaauuuugggccugugacuaugauguuuuuaaaaaguuuaguagccaguguuuuaccagggcuagauucaucagaacuccacugagugaacccugaagucuucacaucguauaccaucuugaaagucucauuuuucacgcaccuuaaaucauuuucacauacuuugaaucccuuccucagaccuuggcaaguugcauaaacuuuaaacuuuuuuuuuuuuuuuaaaaucuggaaaacucuaauacuuugaggcauagguguuugauuagugaacaaagucacaaaaaaguaagcucuuuugaauaaaggaacagcagagagcaaguuuugaguaacaacacgauggcuugaguuugcucucacacugaaaucuguuuuugugaguuuaucuuucucagcaggaagccugucagcgaggcaaacgugucugugagcuugccugucucagcuggagaccugagcucuggaaaaggcaaggccuuaggaaacggucugacuaagcagcugugucccugagaaggcaaggccuuaggaaacggucugacuaagcagcugugucccugaggugagaggcuaagauuuaucagauugcugcucccaaucugauaaaacacgcagucaacaucaccccagaggucugaggguaaauuugagcaggaaguauagaccaaauggccucugggccaauuaagaaugacagauuuaacugccaccugaacagucaguauggugaucuguugugagcagaggugaaccgaguuuugcagccacacacacagggcagcguuaagucuucaguuaaccacagugggcagcaaucagcccucagccaccagacccagacggucuaagagauuuucccguggaacuugggaaaacuaccuuagagaggcagaguagggcagaauaggaucccacaguguccacaguuugggcaggacccaggccucgggugagccuggggcagugcuuugcuccaggugaagucuguggccgcccaucuucuuuccuguuaccagaagcuggguauuguugucuauuaggguaaaaguuugacagacuuccugguaggcaccagauagggagagggccguggcuagauaauggcuagcuuccucaccuauugacuuugacacaaaagcuuccaggggagaauccuuacugagggacuggcucaacaaggucaagaccugaugaggacaugucacacauaguuucacaguuucauaguuucggaccaaucaacggcaaacugaccaacccugaagugggggaggaagacucuucgaaugcuuuaaaaccucaggacucgagagaagagacugggguuuucggcuucccgagcaaccuuuacagagaaucuuuuucuccgugugucugacgcgugaguguguuccccacccuaaguagaugcuugccuuuaacuccuacuucucucuauugcucuucugaaauuuccugccuuuaauuucuuuaacugccagagaaacggaacccaauuaagacccucuaaacuauuauuuuuagacuguaucacuuucgggaccugucuccggauuucuucugaagacgguauaauuuugggaccucaucuccagaucucauuuaaggacuacugacucaucaagguaagaaacccaagggagaugguggugguggugcgguggaggugugcuggccaguccaguuggcccaacuacaagguguccaggugcauugcucagugucagucacgaugucaccgucgcuucugggcagaggugcucauucgggagauggcacagaagcaggaagcagacuucugcguuggcacucuuggugcccugcgggggcauucugacaaaugcccuuuuauggugccugcccacccucacuaguuguuaucccuugcucucaucacaaccucaaacugagaagaaaggccagaugcaggggcacuccuguaauccuagcccucugaggcagagugaggugggucuguaaguuucagucagccuggucuacagugagacuagccaccgauaagaaaugaaguugugguccagauaugcccucccacccccggauugguuucuaagucuucuaagucuugguuuaacuauaaaauaugccagaauauuucagauacuuaugaauguccucuucucuagcaguacacauugaauaaccacacugucgauaaaaguuuuuuaaucguuuuuaacaucucaauuuguccaugcuauuuugucgcaacuuaagaguauucucuuuuuuuuuuuuccccaugaagugauuuccauuuuuacuuuguuuguguuuugcuuuuguuuuuugaaacaggguuucucucuguauagcccuggcuguccuggaacucgaucuguagacccaggcuggccucgaacucagagauccgccugccucugccuccccaagugcugggauuaaaggugugcggccaccaccgcccgguccacuuuuacuuuuuauauuaugaauaagugguuagagccacaugaucuaaagaguuuagcaucuuuauuccaagaggagccuuauuuauuuuauaaaaccauuucugucaacuacuuuguaccuaaaagaaaaaaaaauaauccuuaaaauggccacaguuucaaauauggacauauuaugacaucagggaauuuuauauugagcaauucuccagaaaauuacacccucuguaacuaaagucaagaccaagucaaacuaaggccaagauucacuauuggauuggucagucucucaggaagaugaugaaccagagccaggagccauguguuugugugcuuucauuucugguuuguuuuaaaacugcuucauguucuaauauucauucuucggguccaaaaugguuuauuucauugcuccccauacuuaauuuuugagcaggggagucuuuaaaaauaugaucagcugggcagugguggcacacgccuuuaaucccagcacuugggaggcagaggcaggcugauuucugaguucgagucagaccuggucuacagagugaguuccaggacagccagccagagguauacagagaaauccugucuuggaaaaccaaaaaagaaaaaaaaaaaucaacuggguguggccagaucucugaguucaaggccagucugguuuauggaguucuagggcagccaggcuacacagggaauccuuaccuuggaaaauugaaaaaguaaaacaggucaacuuagucuccccuuccuccucugccuaaguucaguggguuaauuuagacugcaguauuuguguaacaagugccuuuacugguugccgcaucucacuggcuugcaacacaguuaaagaaaagaagacuuggcuaggccuugugcacuauauaguaucaauuaucaauugucucaucaccuucaacggccucuaacuaaaaauguuuuuacaaauugauuaauagcuuguuuaugaaagcacaaacaacaauugccuaguuauauuuuguuccuaaaagaaaaauaaccaugcuaguuagaagcuuaaauuaauggggccaguuauuagccccucuuacuuggacucaaaacacagaggcaggauauuucaagauuggcuaccucagcaugaauucaggcucuuuccagaacauucucaucauuuacaguaaaucaauguacuuagagcugucuuucuuaacaucauguggcagcuguuugagucacagguaugacaucauaggauaaguuaaaggcgacucugaguggaucuuucuauauagugaaauuagaugaaggaacauuuagaaaaagcccccuaucuucuacccagcaagauacaucacacagaucccccuagaccggugcuucucaaacugugggucgugaccuuggggccgcauauuacauauuuacauuaugauuuguaacauuagcaaaauuaguuaugaaguagcaaugaaauaucuuccggcuagagaccaugaggaucuguauuaaugagucgcagcaugacgaagguugagaaccacuucccuaggcacagaugaucauauccugacaucuaagucaaucaccaucaaucacuuaucaccaugaugagugcagauuaaagcuuuguucuugggacaggcauaggcuagccugugucaccacgcccggcuuguaucuucucuugucaaaccguuuuguauuuucucuugucaaaccacguaucucuccucgaacaccauucccuuccucuccaccaguaaucuucaaauacacuuuuuguugugaaugugacgagcuuuuaaaaugaauauuguuuuguuuauuuccugcauaaucaccuacuugucauuaccaagcaguuucaagcucgaauauauacacugcuuaguuauauaauauuauuuucuuuggcuaaaauaaacaugaagguauaucuggucaucuuuguaauauuuaguucauaaauauaauuuugguuuuuuaaaaaaagaauuauagguauuucugaacagugaacauucacauguaggacaaugcaugacuuagugauuauguugcaaaccaaagucaugccuauuuuguauauaauaaccacuaucugguuaauaaaauccggcugugaggcuaaaucaagugucuaaugggaaugauugcugacauaaaggcaaacauuaccaggaauugauuggcugagcucacaacagcccaggaaucauuuagugagggauuggcaauacuuuguauuaugaagaagaaaguguuaaacguucacuacugcuuaucauuuugaaaaacucucuccucccccucccuccccuaccuuucucucccucucuccucuuuuuugucuagagacaaagugguaacauaauuuuuugacaguuucauacacguauacaauguauuuuaucaaauccauuuuccacucccucuccuguaaccuuuccauaaauugcugagucuaauuagggcugucaggaugcacauggauguagguccuauccaaacuccaacuagagguucugggguuguucagagauucaccagucugacucauauuuugauuuuaguuaauuagacuuauuauuauuauuauaaaaagagacuggccaggacccaaucagagaaaauuuucuagacuaggcccuagcuauuguuagcccucggaggauaaaggcaagaaccaugaaguaaaaauuuuggggagccaaauuaacucacucuguuugagugcuggcaaggcuugauuucguaacaaacguccagcagguggcucauccauccauccauccauccauccauccauccauccauccauccauccaagcaagcaggcgaggaagcaagcaagcaagcaagcaagcaagcaagcaagcaagcaagcaagcaagcaagcaagcaggcaagcaggcaagcaggcaagcaagcaagcaagcaagcaggcaagcaggcaagcagacaagcaggcaggcaggcaggcaggcaggcaggcaggcaggcaggcaggcaagcaagcaagcaagcaagcaagcaagcaagcaagcaagcaagcaagcaggcaagcaggcaagcagacaagcaggcaagcaggcaggcaggcaggcaagcaggcaagcaggcaagcaagcaagcaagccuuucauuaaaaagcaaagcuuagcaguuagccuguauagucuugugacuuauuaccuuguaggaauagcugaggcaaugaaauauuuugcaacuaucaaaauuuuuuaaaaaauaguccaacugugccaggaagugcuccaucuugggccagcugauaagguacauucaagguaggagcaacuuccuuguagcuuauacaagcuaaaaacacuuuuuuuuuuuuuuuuuuuuacaagcccagcacaguuaaauuuauccgguaaacagcguucaccaucacacuaucauuagccaaacccaugaaaagagcucuccagccaccaucacuaacaauaccucagccaccaucacuaacaaugccucagccaccaucacuaacaaugccuuucaggcugagguggggcgucgugaguucuuuccuuaacuaugcuaggcuggcuugaucuuguacaggucuuaugcaggcaacuacaguuacucugagauuuuugaguauaaaaaccuugucaaauccagaagacuauuucucagcagucuucccugagcucuggcucuuaugaucugccucccccagcccccaucuaguuuggcccaaacaugggagcauguuguaauguagaugucucaucuaaagaugaguacuccgccaucaauuacuuucuguacucuaccagcugugacucuuucuaauaacagaagagagaaucugcucuggucgagggugaaagcuucacuaaucuauguuuguaaguauaaguaguuagaagguaauuugauauuuagcagaauaauaguagugaguucuccacagagccuacgccgaucucagccucaugcucuggcaaagauuuacaguacugggcaugaaguucuuccuguggagugagccugaaaauuccaauuagaaagcuauugguuacccccauaccauucaugaccauauugcgcaaauaggcaucucuugccagacuaaucauuauggugucucauaaagcaucuagguaagacuguuggugacuuuucucccacaacagcaagcaaaaccaaaccaaaccaacaaaaaagcacaacagcaacaacaaacugaaaagcuaguucagcagguaaaacuuuuguaagcaagaagaaguuugaaucucccauauccauauaaacacuggguggucguggaggucugucugcaauccuguccugugggaagcagaucagggaaucagcaaguugguuagacuagcuaaacagugagcucuggauucagugagagacccuuccugaacccugaagguggagagagauugaggaaacacccaacauuaacuucaugcuucuauacacauacacuuguaauuccuccccccaacacucacauacauaugcacgugcauacaugcaugaagacgacauagauauacauaucuauggaacuauuugucuucuguguucaaacuacuuccacaagacaacauuugaagagaaauuugacuaggaagcaguguuuuccccguguucaaaagauuaagucaggacuagauuccaggaggcaaugagaccucggcaagggaauuggucaacaguuucucuuuauuuauuugaaacaucucuuuaggaaauauauauguauacaccaagaagaaauagaaaaggcuggggugagguggggaaugaagauaauaugggcaaacuagaaaguguuuauacuccguauacccaugucuucuacauccuacuagggauaugauaaacucuggucagccaugccccgaguuucauaaugcaggagcaaacagaacuuggaaaucuguagcuauggaaaaagcauugguuugagaaaaucgacugugggguugcuguuguauugcugucuccaggcaacugauauauauuagugccucucgcgucugacacaaauuccuacuauagucugacgauaguucuccucagaguuguguguugaagcccugccucaugugugacaauauuugaggauacauguuuuaagaguuaauuaaacugaaauagaaguaaggugguguuucucaucccgugggguuguuuucucugugcacacguaaagaugccaaaugaggccuugggaagaggaaguggauauuugcaagccagagagcacccucuccaggaaccaaagugaccaguauuaauacaggaaacagcagccuacacugccacacuuccccgcuguuugagcuguucacugugugguguuugguuauggcagcccuagaucagcuucuguggcuuuagacauacaaucucuuugccuuuaccuaugaagaugaauuuuaagcuacgcuaccugguuuagaaugauaucaaaggaaagcugucccagacuggccugauucccacuugccacagacuaaaucaucacaguugucuaucuuaaguacugaaggugcuaugcuauguuguacuuuacauccaucaacguaaauuuuauccauuauaaaaaaguccuguaacuugguuuggaauacaauuccauuggaagauuaugacugcccuuuucagaucuuuucuccucuuucuagacuuugaaaaaaagaauuauuuauuuuauguauaugaguacacuguagcuaucuucagacauaccaguaaagggcaucagaucucauuacagaugguugugagccaccaugugguugcugggaguugaucucaggaccucuggaagagcagucagugcuuuuaaccacugagccaucucucuagcacccucuuuucuuucuuucuuucuuucuuucuuucuuucuuucuuucuuucuuucuuucuuucuuucuuuuucuuccuuucuuccuuccuuccuuccuuucuuuuuuuuuuuuuuuuuuuuuuuuuuuuuuuuuuuuuuugguuuuuugagacaggguuucucuguauagcccuggcuguccuggaacucucucuguagaccaggcuggccucgaacucagaaauccaccugccucugccuccugagugcugggcuuaaaggugugcaccaucacacccagcuuagcacccucuuucuagauuuuuauuuugucacuuucacuaaaacaaauccauuaaguugcaaacauacuuauaagaguauuuaaaaaucucaccagugguguauuuuugacuauccgauuguaaaauaaaaagugaaagaccuauacuaguugaagagaaguauuuuacuguauagagaacugauuuuagauaauucuacacuguuauaguuagcgaacuuuuuuuuucuuuuugacaauucauuucaucauuuugaaccaauauauuuguuuccuguauaaaacagugauaagaugaucccccccaccccaacacacgugcaagauacaaaggagaaaaccaaagugaugcuaaaggcucaguaauggaaccucucauuugugucaccuccguuuuaauugacaagcugugguuuuagcacgauuaagaagugcacccccaggaggccaucgaaacuggcucaacaagcuuuacauacaacacaagguuaaagccggacaaggcaaaccuggauaguaggcaggugcuugaaagagacucaagcccaauaggauccgcucuguccagcucuucucuucagcugacuccuugaugaguacacuuaugguucuucuuccccccaaaguuuagagaaaaaagaaauuaugauacauggcacauuucuagucucuugacaacuuuuuugggggggaggucaggcuuagcuuugucuguuuauucagguuuaucacugggcaaacuucugccccauuuccauggaaguaggugaggaauucuuagauuuucuuugaauugggcugaaacuugauuuucuguauuuauucguauagauuggugggaaauauuuuucacuaguaaauguaauugcuaauaaagcauagaguuuaaauuagaagaauaaaacauuuucucaguuuuaaaaauuauaauaauaaucacuguguaauuuauauuaccuaauacauucuacuuacagcauuagcacaucagagaaaccagauuuuauccuguuguaacagauacugccuagguuucuuuugcaacaggcaguuuaagauaguauuucaagggaaauaaacagagacagaaauaauacauuuguuaguuuuauauuuuccuguguuaaaauuugguaccuguuccauacaucuuaguucuuuuaagagugccgcagacaaaugucuuucgggaucccuucugcuucuuccucgccaucuaggcuuuugauauuggaauguacauaacguacagcaagcaucagcucagcaugccugccugguuaguuacacagcauuaauaucaagauacagcagcuuaucaggcaggaaaucccucugaagacaucacuaaaaaaagguacaauguuauauaggaaauguuuuuugugcuucuaguaucauuuuuuaaaguuaacauuuaucuauaucuuauagcaagagcuccauuuagcucaauuuaaauucuaugucaucaaggagccugaugcucgcaucuugcuuuaagcgaugaccaugugcacuaggaauguggcucccagggaaguuacaaggagauaaaugaggccccguguggacucacugcucugugguauguggcaaacgugcagccucucagucaugcucuucccuggaggauuacccaaacguuugcauucccacaauguauuuuuucagaaaauacucuuuuccugagacuacagcccugcuucacagaccucuuccugaggcaagccauuccuacacuagggaaugcggcuugacgaccucaggggggaaaauauugcuaacaauucauuuaccgcacuuaguuauuauaaauguucuggaauuuucagaugagaauacugcuuaacuucagauaacuucagaacauagaaaagauuugucaaggcagccucucucugcagcugcagcaguagcagcaacaacagcagcagcagcaacaacaaaaaccgaacauagaggaaaaaacccgagacaauuaugagaauagcuauauaacccgucucccuucaaacaccuuaguuuuguacugauugcuuuccuucauuguccuuggcaucagugugcugcuaacucaccaaaauugagaagcagcaaacaaaaaggcacauaguuuaagaaagcagacuccugugguuuaguggguaugaccccccccccacccccaaccaggcucagccaaauugugugaauagaguaauaaacacacagagaaaacagcauuagccacugcugcugagaaaaucgugugaacccagaagauguuucuccaaaauguuuccccuuuucuaguagucagguuugucucuuaugccuuucauccauagaccaugugugaagaauuagccaaaguaaaaucucucuucuucuagauauaggaaaguacucacuaacauauauucaucaugaaacuuucuuucuuuguuuuugagauagggucucacuauucaacucuggcuguccuggaaaucacuauguagagcaggcuggccauagagaucugccugccucuguggaugggauuaaaggcguuuuuccaccaugucuguccagccuauaaaaguuuuuuuaaaagaucaacaauaugugugaagugauacaccaggaagcucagauuuaauuaguagcaagcuuguacuguccccaugccuauccccaaggcaggguuuuucuguguaguauugauuguccuggaacucguuuuuuguaaacuugacuggccuugaacucacagagaucugccugcuucugucuucugagugcugugauuaaauacaugcaucaacacagcggcucauguguaagauuaauauaugaauuuccuagauaauuuacagaugacaauguauacacugcuucacugcagggaugcuggaccagacccgagagugucuaguuguaucauguccauucaugaguaauccuuuucacgaggaauguauuagaaagcuauuccucaaaucccaccccccccacuuccaugaggaucccguagucuugggagggccuugcuauagauaucucauuuagagcugagcaccucaucuuuagcugaaaagauaaacauuucccuacugaguggucuugaaauauuugacacugucaguuguuuguagacaaagaucugcuuaaugacucucucaguucuccaugaauccauacagcugccaaauacauugauuacuguagcuuugaguugucuucaccuuuugcauaugauuagcacauugaauaugccaacgaguggaauuuucuuugucaauuucauguauacauaugucaacacuuauccagauccacccgccaugcaacuuccuguccacuccuuacucagccccccuccccuuguuuguuaauccugcucuuaggcugcccuugcuguuuucuaugcauuugcuuggcuucgucuacuuaacacgaugguuuucauggguauccguuuucuugggacugacuugauuucacucuuuguggaugaauaagaacuccauuauacauauguggccuauuuucuucuuuauuuucucucucucucucucucucucucucucucucuuuuuaaauuuuauaugccuugguguuuugcuugcuaauaccgucuuagcacacagauguaugucagugucagauccccuguaacuggaguuacagacaguuauguguugccaugggggugcugggaaucaacccuggguccucuagaagagcacccaguguucuuaaccauugagccaucuuuccagccucgugacauauuuucuuuaucuguucaugugacaaagacacccacauagaucaaaaaguaugagucuuucaaccuugcuuuucuauaggauugcuuaagcugugguaaauagcuagaaucucuacaugaauuuuaagauuuccuuaucaauguugacaaaaaaaauuuaccugggauuuguauagagguuacaugaaauauguagacuacacugaggaauauugucaucuuaauaguaaaguuuuuguucuggggacagauggguauauuuuuaaccaguuugggucuugaauccgucucuauuuuuacuagguuaaauauacaucccugaauaauagcucagacacuggcaggccucccauccucucacucugcugucugcuaaaauggauguagaugggaggaaguggauaaaacagaggaauaugaaucaaaagaacgucagucccccuauauucuuggcaugccuuauuacgugugacagucagggauguugguuuugugaggauuuuugaguauuuaucauuuaauauuccaagagaaagcuuccucaaugaaaccgcacauuuaaaaaaucuauacacaauacauaugcuuccuauuuacauaugcagaauauuacaguauauacauguguaacagcauccgcaaguuguagauggaaacacacugauuuguuccauuggugagcuauuucuggagagggaagaucauggggugaagaaggaagaggcuagggcucugugugcauuuuuuucuauaacaguguuuucagguauuucugucauaacuuuagauuugagguauuuuuugucaacaucugucauaauaagacuaaaucacauacugaauuugagauccagggugauguugaaagcugggugaaguugggaucacaggaguggaguggguauauuuaaugcucuuucaacuguggccaugucuucagcagcuuguaaaggucugcuuccaugaggccuuguauucuacguauauaggggucuuguugucugauggcugacacucagacagugucacugauuccaguaacagucucacgacugaagcacaggaagauguugaucucugaguccucuggccaucaguguggucacaaacauauucaucugggugauagauauucaaacugcuaccacagucuuuucugagagucuaguaacaaguuaguuguauuguucugggaaaagcagcacacccuggggguuuaaugggggacaaaaccauucaguucaccucaagcaagaaaccaaggacauauugguaaacuauguaucugauaaugcaucgauuuacauaagaaucccauucuuuuaaggacuaucuauuuauccucuaugccaacacacacauacuuuuauuuuaagccuggccauguuuguuuggggccgcagagaugacuaggcuguuaagagccauugaugcuuucucagaggaucagaguuugccuuccagcauccauaucaggcugcguacaagccccuguaacuccagcuucaugaccucccccacccucuucugccacucucaccccacccugcuacuacagacacagauacauacguucucauaaaaaaaggaucagucaugguuuggauauugccuuugcuuaugccagaucccuuguagcuuuagcaucauuugagucagguuugcaguucaugaaauccaugcagguccccacugugucccauuuuaaaggaacuccagugagagguuccaguguuuacaaauugaaauugccagcgcuauuuacuggcuguuuggaccugguguauuaagaaaguagccgaacucuuucaauggcucagaauccaggaauggugaggcucauauucuaugcuguguggaggggaaaaaaggaagaggcuguccugagacagagaauaaagcgauuagagaucccugauggugcucagucacuugguucuagcuguuucugagauuaauacaaaucaguccuucuaggcccagguagcuccacauugucuggaacgugguuagugacauuuugaccgaauucaucuaagcugguuuugacuacguuggaaccaagcacagacuagaugacuaaauaagugauuuuuuuaagcugcagccuuuaaauaggauuaacuugguagacguagagucucuauucuugaguuuuuagcaggcauucuaccuaagccggcauucugaaccaggcagacaaaaaccuuaccucccaguacauucaaaacacagcugcaacggacuucccguggaaccaaauggaaucaaagcgucuccgaaaguauuugaaaaaaaucaaauuaaaaccuagauguuuaguagaaauacucuuuauaaucacauguguggaucagacucucauaauggcaugagguauguuguaugaauuauaaauuuguaacauuuucaaugggcacacauuacuucacuauucauguauuucaguccacccaugccuuuuuuauuucuuuuucuuuuucuuuucuuucuuucuuucuuucuuuuuuuuuuuuuuuuuuuugagauaggguuucucuguguagcccuagcuguccuggaacucacucuguagaccaggcuggcauggaacucagaauauuuauguauuuucuauuugucaguauucugauuuggcaguuucuggaaucaagaauuaugacagaaauuucuauaacuuaaaaauuaugcagucuuaguuauucuguuauagaaguaaaaauugagacaauaacguauaugauacaaagacaggcauuugaagggguagcuguagaucacgcauuugcgcugacucugaagccucaacaucccguuucccgguccuuucccgguccggcaucguuuccuuuccccuuugagugcaaagaggaagucuuuguguguguguguguguguguguguguguguguguguguguguguguguguguauuuuguuuuuuaaagcuacauguuuuucaacuucuuuuccuuuuaagauccagaucuuuaaaucuuucugaaacaggaaaugucccacuuccuacgggaauccauuucccucgggcugcaaaagggcuggcucaucacuugccugucuuaaaggcggacaacuccuuaaaccagggaaaggugacuugaugagcugcagggagggaguggcugggguccauuguguucagcuacucagugcuuaucucgcagaaaaccugguuaggaaacgggaguucucaaacaaauaccacaagagacaaggaggggauuugugacaaugcuuccuucugaaggagggaccaaagcaagaggaaagagagacaaaguugagagcugccuucagaauguugacgucaagaacaacaaaauaauuggaaaauaagaguucugacuaagaaagcaaaguugcugaguggcauggaaagugcaaccuguuuauacccaaaccaguuuuuaaaaacauacuaauauaacaaguauaauaagcagguauuuuauuauuuuaguauauauauuauauauacauauauguguguaauauauuauauauaauuauauauauaauauuuuguguacauauacaaaaucauauaaaauauuauauauaaucuuuaaugauuuuuuuacuauuuacauuuuucacacuuuuucuaauuagauauuuucuucauuuacauuucaaaugcuaucccaaaaguccccuauacccucccuccugcccugcuccccaacccacccauucccgcuuccuggcccuggcauuuuccuguaccggggcauaugaucuucucaagaccaagggccucuccucccauugauggccuacuaggccauccucugcuacauaugcaacuagagacacagcucuggaggguacuaguuaguucauaucguuguuccuccuauagaguugcagaccccuucaguuccuuggguacuuucucuagcuccuucauuaggggcccuguguuccauccaauaaauggcugugagcauccacuucuguauuugccaggcgguggcauagccucacaggagacagcuauaucaggguccugucaacaaaauccugcuggcauauguaauggugucuggguuugguggcugauuaugggauggauccccggguggggcagucucuggaugguccuuccuuccuucucagcucugaacuuugucucuguaacuccuuccaugggucuuuaaugauuuuuuacaguccaguuguuaccccauucuggucugccucugacaguuccucaucccauuccuuccucuuucccgaaguccccucucaaagaggauccccccacccccacuucuccacucccugggaccucuagucccucaaggguuauguguggcaucucugacugaagccagaccuggcaguccucugcuguauauacaugucaggggccucaguccagcuaguaugugcugccugccgaaccaguuuuuuuauucauucauuuuagguugcauuuacagcaucaagccaucauucugaccuucccuccccaccaguacuucuauuuauuuccacauacgagagauaguaccaacucauaucaaccugcauuuacccaucucucaaacauuuuccguuuaccuuguguuuucaaggcuacaagauggccuccugcugaaugcuauuacauguucagauguguuuguaacccuagaugcuucacguucaugucuuaaaggugaccuuuagaacugucagcagcuugggagaugcauuacaugugacguaguaaauucacccggaagcuuuugagaacccugcuagccuacagaugcagccacacugauugcuuauuaagcauguuuguguucuguauuucagaaaugacuuacaaaaugaagaaagaauaugccuuuugggccacugugugucuguugcuuagccuuguucccgaguuucuuaaugcucugucugaggaagcugaugacacagguaaaauauugcaaagguugauuuuaguuuuuaccuugucaaaguucucaacuuaguaugaaauucacuaagcuagaauuuauacuuuuaacuuuuguuuuauuauuauauguguauguguguuuugccugcaucuacgacugugcgccaugcgugugcaguguccccagaagacagaagagagcauugagucucuugaaacugguguuuuagccuguuacaacccagcuugauagauaaagaacacaguuuuaauauucaaaauuaaaguuuugggugcugggagucaaacccagguccucuguuagcuguugagccaucucucuagcccccuuaggcuuuuuuuuuuuuuaaaaacaaaaaaaccaaagugauaauuuucuuaagacaauuuuuguauuguguguguuaguuuuuagacuacccgaaaucaagucauuucagcaagagaggcgucuuagguaagcaguaaagcuccgaacuagcucugaaauacugcaagaacugucugaaggagauucuugcuaacacgguuuuaucuuugagcucggagaagccagagaagggaagaacuauaaaccugagcgccagccacccucuccuucuuaccaguguguucaagauaacagugucugagaugagaauagacagacaucaaagggauugguguggacuggaguuccaauuucaugaggugugagauaagaauauuaauaaugaaaaaaaugugagugguuauaucauuguagauuuauauauuucccccacaguaacacuuugcacaaaacuauugauagaacucaaguuauugauaaugggaaauauucacaauuugacagauuauaguguaguucuaacauauauuagagucucauguaugcauucucaucucuagugaguuuguccaguguauuccccaggaacaagguuggguaaacccaacuccugagccugaugccuuaguugaugggagggagggaaugauggcagccgagaggagagucuuaaauccccacagugucauggaggguucccaacuauacggugcagcuugaccuuccuugcacuuaugagcuuuugcuucagucucagagggcuaggauuagagggcggaguccugcagcuagcuacagcuugauuuaacauuguagacuugacacucuuuugaucaacuaguugcacagucuuaucuagguuuguuuuauuucuguuuaauuuuuaauuaguuuuacaauaccaagaggcacgcagcaugggacccuuaguaagcuaccuguuggcccucgauccacaaacacucuccaggggagggacacgcuaucacccaggcaucccgugacccuugagcauucuguauuucacugagcuuuuuauuugacaucccaagacacagggaagaaaaccagauuguuacccuuaugcuaggagauacaaaauauaaacacucaaucacaaauauucaaauguaaauuauaauucuauuuuuuggcuaccucggaucagauucuuguuauaauauucggcaaauguucuaguuucauggguacagaaggauaguccuuauuuuuaaaaacauuauucucaacucuuccaaguguaagaaaaauuauccuuacuccuucccugagguagucugcuguucgcucuuuaguaagcucuucaauaaauuacuauuguaauuauuguaaauuagugauugcaagcgucauuaaaagggccugcugcccgauauauuguuguaucugcaauaacaacccaguucuugauagauacguauucagggcacaauuuuaauacucaaaaagguuauccccauaaaugaaaaccaagacaggcauacaccuucccaagaguggauggcuguggauguccgagauuaacccgaggucuuccuguugucugggacauccugcuuaggugugaacagcaacaagaucaaugcauagaauauacugauauaaaauuaugguaacuucauuaauaugggaauucuaaagaaauaagguaauaacgaaauaaaaaguugauaguguuuuugucuuuacgugguugcuaugaauuuagcaccagauuuucaucaaaaaugaguuccagcuuuauaaagcaauuuuuagagugcuauugagcagacauuacuuuauuaaauugaauuguuuaguccaaguauuugggugaaaucucagccuuucaggucugugauaaucuuacucuuauuauugugaauuauaccugguauaauagcauaugagagucaguucucucaucugcacguauaagucuaagcaacuugauaaaaccugcaucacaaagaacaucuacaaaaguagaucugcuuuuuguuuuuguuuuuguuuuugagauaggguuucucuguguagcccuggcuguccuggaauuaacucuguagaccaggcuggucuccaacucagaaaucugccugccucugccucccaagugcugggauuaaaggugucuggcaucacugcugggagaucauuagaugauuuuauaacgaaguuccaugagauuguaauuacucagaggaaaguuugccgguaauuacuguaacuacaucaacagcacugaagaaacaacucuuuugugguacacugucucccucuuguggccaacuuauuaaauagcaggcugaacuugggcucugugucuuccugaacacauaccgacagaaacgcucucucucucucucccucucucccucucucucucucucucucucucucucucucucucucucucacacucacucacacucacacacacacacacacacacacacacacacacacacacacacacacacacacacacacacacacacgauuucaguaagcaagagcugauauaagucagccagagagaagcacgacaaaaucugugcuuagcucuccuuccgguaacacugucuaguucucagcccagagcgugggagucaaagaaucaaucagugcuuccccgccauaccccaggccugcucaguagccaucucucagauaacucuugauucagucaacuugacguuugacaccacagauaucugauuuuaccaguacuauaggugauuggggcugaggagacaggaaugagcuugacuuguaagaccaggaacugaguuuuauuccagaaugaauguaaaaauaagcuggacuuuggcggugcaugucuguaaguccuguagugggaagccagagaaaggcagauuccugaggcccgguguccccagagccagccagccagccuagcgugccuuuugaguucuaggguagugagagauugcaauugaagagagacagucagggaguaugugcaccccuccacuuaugcauaccugcaagcauguucgcaaacaaguaaauaaguaaaaaaggaagaaauaagugggaacauuccaaugucuuuguuagaaucauaacuuuauuaaaauauggccagaauauauuaauuaauauuuaacuauaguaaugaauugcaaauggaagaagauaguugaaaguagccuagaucaaauguauguaaaauauuuuccaaaaauucacauuuuaaaauuguagggaauuaaaaaaauggauuuauuacuagauuaucaucuauguacaauuuacacuuuguuuuaaaauaauuuuuaggugagaacuuugacgugauguccauucauguuuuaguauuuaaaauaauggugaaugaagagaauguuuuacaguagugcucauagauugucucuuaacagagcacugcugcccucuaaaggacaaauugguuuaugccauuuaaagccucaagugccuuccuuauagaucauauauaaauuaucaaacacguggaacauauaggcucgcucacucaggucguuacuugcauggaacccauaauaaccugaauuuucaguuuuaauuuucucauuuaaaaauugacgguggaaauuguauauuuggcaaaacaacagcaaggauguuaucauaguguugggagagagcuacacacgugauguuuuaaaauuuaccuuguagauucugagcuggggucaaugaaaccgcuacauacauuuugugcaaugaaggcagaugaugguccaugcaaagcaaugauaaggaguuauuuuuucaauauguauacucaucaaugugaagaauuuauauacgggggaugugaagggaacgagaaccgauuugauacccuggaagaguguaagaaaacaugcauaccagguagguuuccgggaagccuguggcacaagaguuggugugguugaggucucagugcagauucaauaauuuuagaagaacaaugugauuucccaggaaagccugcuguuuacauuucuagguuucuggcccacuguuguuucuugauuucauccuaccaguuaucauaaaauuaugaagcuucauuuauuaucuauacugcaaagggaagaaacccauaguccauggaagacuuucauagguacaaugacauuaaugcagcgagcguaccuaccugggagcugggcagucaggaaacaguuguuuuuccuauagacuuggcugcaccuuuauaagcagcaugcuccuccaacgcuuuucucugaagauagugagucagagaacugacccuuaggcucuaaggauaaauguauuaucacauauaaacuucuauuauuugaguaagcuuagaguuucuaaaacugaccuagaaaugagucauuuauaugaaaaauuuguaauacuacaaaaaaacaucaaaauuguaucccucccauguaaacuuuaccuggucuagcuuuggcauugaauauauggcugaaagacuauaaagcauauaaugugugauuaaacuucauuggcauucuuacucucagucacaucauaauuuuauaacguuuugauaaugauugccaaucuuaccauuuguaaucccaccugguguuaaugcauaguaggggagcgacaugcaaugcaauauuaugcaucccaaagcugcauggaaaaguuuuaaaaaguuucaacaaaaaaaucugauauauauuugaggggguagauguaucucgccucacuuaaacaucacuuaguauacagugaauugaaauaugacauaacaccccauugcuauguauaauucuacauuucuaucuaucaguuaaaacaaguuuagaaaacggcagugggaucuggggauucaguucagugguagacuuuuuuggcauagcauuuauaagaccuugcauuugauaugcacuaacauaauagguaaaaacaauaauaaaacaaggaaacaaaaaugacuggcuaaaauaaccucucucuauaaaacuugguucauuagggcauguaugagaaugcuaauuggauuauguaacuguccuaguugaagaucaagucauaauaguacauugucgaugacggccacugauucacauccuuccuuuggcagguuaugagaagacagcugugaaggcagcaucuggagcagguaaaugcucacuuacgugucaaucaguagcagugaucuaagauaguucuuauacaccccuggugggguucucuuuacauccacaugacgucagagauaauguuuucuuaacugaaaacuuagacacuacagacacuguucauugggaaggcuccaugggccaugagcuuugcaucuagagcaaagcaucuagggcucucaguccgugggucgugaccccuucagaggggucaaaugacccuuucacaagagcugcauaucagauaucauucauaccagauacuuauauuacaauucauaacaguagcaaagcuacaguuaugaaguagcagugaaauaauuuuaugguaugggaacuguauuaaagggucagagcuuuaggaagaugaagaccacugcccaagagccacaaggcuuuuuuuuuuucacaaggcuuuuuaaauaccaugcagauaaugguuaaacccuugauugucucauucuucaguuacuaagccauuguuaaucucagcacugugugacuuuaguagaugucauugaaaagauguaugcucuugagcuguuaucagcucuguaugcugaagugagcauggauaaguuaacaauaauugccgccaucauuauuuacugugcacauacucuuuugaaugaagauuuuuuuuuacuagaucuaacucuuucaaaagauuuauuauaauaauaguaugauuguguuaagaaaaccaagcuccguuuuuuuuuuuuucugucuguuuucaguuuuguguuuauaauagagucuugcacuauuggcuucuuuggcauaguccagggauaugccaaucaccaaguucaacuuacuuugauagaggccuagaaauagauuuaauccaguuaccguuuauuauauuugaacugaauagaaaaauauccaaagaccaagcuguuuaauucaaaauccuggaaauccugaaaagauuaaguuauguaaaggaagcgaagaugaagaaucuaggguacacuuacauuguucacguuuuaacccaucccuuuggaaucaguugaauauauccuucacuaauuggaaaucuucagaccuaacuuaguagaauucaacuuaaaaaugcauaaaauauccagguggugguggugguggcauacaccuuuaaucccagcacucgggagacagagguggaucucugaguucgaggccagucuguuuuuuuuuuuuuuuuaaacaaaaucucaaucgauuuuuaccaaugaaggauugggagccagaugcuggugugagagccugcuagcucagagagguagagaaagcacccagcugagcuuccuccucagccgauguuccagaacgaauguucuuuucucacauggaaaaaaaaaaucccccacaaacuaaauguccuuucuccauucuaucuacuuccagugcgacucucuauccauccucccgacuuccauuuacucucuaugguuuuucuuaauuauccugucuucacuuccugucagcugguugcuugcucugccucuaaaugcauggcugacuuucuuuaguucuguuuacaauauucaaccauggcggcggaaagaagggagugcgcacccaggcuguccccacuccugguccuggcugcuccagcaagaugguggcaugggugccugcacugguucagggcuccuaacggggauuucaggcuggucggauagaagugggccaaaccacuuggccaauguacucuuuuucuugggaccuuuucuguugaugaucucguuuguuuccucagacauuucucuugucuaguggucuccagcuuccuuaguuggaugcuuuuauucuccuggaaagauaaaaucaaaacccuacccaauccuaacucuggggauuucuuuuuuuggucaguuauauccuucccagggcaaaguguuuuuggcaacagaaaaaguauuaucuuucaauugaaguuaaaaaaaaaaaaacaacauucuuuugaaacuuugaaacuaaauguaucauaguauauguggagaaauauagcuauauucccccuuugcuuuauauauaaauucaagcuuuaaguaaauuuauuuuuauaccacaaaggacauucacuuuaaaccucagccugccuuuggaaagcagcuuuuagauuuaaaucacuguaauucuuaugugccugccuuugccucucaaguuuggggauuaaaggugugugccucccaaacucugggauuaaaguggugaaccaccaccgggcuaugggcuacggaucccuugugauagggacucucauaggguuguugugguuuaauugguucuccaguuccccuuuguuuuuaguguuagagguaaacuuucaaguuucucagauauauaaucuaccauucuugcugacugaguuugaauuuguucccuggcaaaauuuuaauauucuaguuuuaauuaaacacgaagacaaugcguccacuguuucauuauuuucagauguuuuaucugucuugcuuguaugggcugcauaaaguuuaaugucuuugcuaaguuuugcuagguuuugccauuuccauuuccauucaugccucccaggacccgauaucuuugucguuuaucugccaguuagugguuuuccauuuugaugaccauauagcuguaccauugcacacaccacgaauuggagaagauagaaauuucccuuuugcuuuccuaguuguuugucucagccaaugguacuacacugacugugcguuccauuccccagucuauaggcugccacuuuccauuagcuuugggcccaucaguguuugauguaccaucaguaaacuguguguuagucaaauguugugaccauucugucaguacccacaguucaguaggugccucuuugggggaggggugagccauguagacaacugagcuauuuccucagugugggaaggcccagaccccuuugcuaccauauccuggucaugaaggaauucauauaccagucccaguauaagaccuuuccuuccauggccaagccugugaaggacucugccuuugaacagauccaaucuacaggccguccaaucauuguaagggguucccuuaugaccauaggguuguugggaaugacugaguauaacguucuccaugccucacaaaauguccagauuuguucucaaugagaggauauuuauccucuguauauggacaguauucacauuauaagucaccaggcaaauguugguggagagucaugaagaggcuccaguugccaauucagccagaaguaugauauccaugauuaggguauccucuggugcaguuuuuguccggguugcaugcauggagaugagcugacuggcagccacaaaaguugcucuuuguuccuguccccaugggaaaguggaugccuuucuaguaauccuguagaggguuuuuauaauaaucuauaaauaugauuucuuuagugugcaaacauacuaauuaggagcugcaucugaguuccccuugggugaugggauuaaaggcuugugccaccaccaccaccucguucacuguaacuccauaguuuaggaaacaacuaauuuauagagauccacuaggaaaauacauuuuaucuuagcuccaaaucacuccaacccuuccuuagagauucagaaaagaaguuggaacaguaguaacacuuugaauuuacuucaaacauuuuaaaucucuuaacuguguuuuauuaaaagcacaaacagcaaaaauauccuuuuuauuuaagaagaaaacucaaaagcuaaaacguccaagauggcgugggccauguggaaaucuacagucuaacaguccagcaugaaauuaagacacaugguuuaagaaaacccauuuuucacuuuucugccaguaaggcaaugugccuuugguaaauuauuauuuucugaugucacaggcuauuguuccauccacacagguuugucaguuaacuauuuuaaagguaaagcacuugguaucgucgagagaccaacagcugguggguccugcuuauguauagccugaagagucugcaacuguucuugauaguaauuuuuaauauuuuucucagaagcacucuuuauuuuauggcuuguuucugagauuggaggaguguuaaucuguguuuuccauuguuggaacagauuacauccccauaaauuuaugccuguauuagccacauauggcuuuaauuuuccuucuggcccuauauacugggccgagauaaauguucaaucccuauaagcugaauauuuaccuccugaagaggccgaucuggauggcaagauuuuggugaaauuauuguuacaucugcuuccaugucuacuaaaucuucauuaccaaugccauucauagcuuugguuucucaucauuuauagcaguuugcaggaauacuuguuuacugaucucucgaauuuuuuguuuuaucuacugaagcuucucuuucuuuauuauauucagaacaguguuguuuuaaaaauaggcauuaagucuuuucauggcucugucaauuuugauauuagggucuacaggaggacccauagggcauuuccugauagcgaagaguuauguugccugucucuuguugaucugcauucguuaauccaauacuggccuuugccacaccuucugcauauuccugaaccugggccaucuuuuuggguuauuuuuuagaaaaaacauuguuucuaagaagaccuggccuacaaucccuuuucaaaugaccuuaccauaauuaaaacaucugacauuuugauuuuuaaaaaucuuucagaaauuacuucuccuaucagaguaccaucauaaauguaagauccaauaucagcagcauuucuaauccaucuaucuauucaugcugaucuugucuuuaaagaccuaaucacucuuuugcauucugaauuagcaguuucaaaagccaaagauucaauuaauguuugucugacuucugaauccgaugcuauuccauuuacagcugaagucagucuuugcaaaaggcuucaguucucuugggucuuguauaauuuuagugaaugauccugaccuuccucuugaaccaauaccccacaagguaugccccucucuucugcagucucaaaaaauguccuucaaacuaaaugucccuauucucucuccauccuccugacuuccuuuuacucuccaugguuuuucuuaauaauccugucuucacuuccugccacugguggcuuacuccaucucuugaccuaugguugacucuauuuaauccuguuuacaauauucaagcagaaagcucuuggauucaagguguguguuaagguugagccacaccacaacuaaaaacaguuuuuuuuucaauaaauaacauaaccucaggguucacaguaugaucaaauauccugcaacaccagucuggucuacagagcgaguuccaggacaucaagagauuuacagagaaauccuguaguguuauggcuucuuagcauagaaauaggacaaauccauucccagguuuaaugauagugacauuaucacaagauaucaaaaaggaaucaaaagagaaugaagagucaagacaauaccucaggaaaaaaaagauuagucuuaagcaauuuccugaugugugggcaugcacagaaauuaacauuauaacuucuguggcaucaacuuuuauugauuuuucugguguuucaagacagaguuucccuguaacagccuugacugucuuguacucucuuuguggaccaggcuggccuugaacucacagagaucugccuguuucugccuccccagugcuggauuaaaggcgugugccaccacaccauugcaucaacauucuuugucaauuauaacugaguaccauuuaucacuaguguguacaccaauccaaaagaaugaaacuguaacgaacauggagaauuagcuuauguauaauccuguuuuauuuuuuauuuuaauaauauuuuaaauaguagaacuaagaaauauagaauaccugugcauucucagcuuucuuguaagauaaauucucacaauuugaugguaucucagguaaaauuaacuuccauacagaauuuauuaaucaugaucauuagcauaaauuauuauaauuuugcuuuuaauaugcaauauacuucauuaacuuuuuacucauacauuuuguauauuuuaaggguuauuuaaaauuucaagaaaaacuauauacuaaaacuaauucacaugacaaaggaguguuuucauuuuuuucccuaaaaauauaaaaguuuacaaaacuuuuuuucucuaauaucccauaacaucugugaaauuucccaaguguuacauaucauaaggacacucauguuaaaggacaagaauaugauagggaaugauuacacaauaguaguuaucaaagaaauauaaauuccaacucaaacuccuguacuaaugguuguuaacaagagagaagagcacugauaaauuauaaauuaucauuauaaauuaauaauuauaaauuauaaauuuacauagcagucagggaaagcaauaugaugcucuucaucagaguuuuaaauuaaaaauagagccuccauuuacaguagcaaucaaugccaucacucaguacaugcaaaaggaagggaaucugagcucuguaucugaagggcauggaauacaugcuuuuuuuuugauaauagaaugcugugagcauugacuuccugauauagaaaacaaggggcuuuaagacacgauaggguauuauaguucauuuuacuaccacagaaauacauuuacaggagaaaauggaggaauugcaacuuuguuuaaaauauucaagugugguaagauguugauugaaauacauuggaacauugacccaguucucuaaacagugcacaugcagacagagauuauuauguaggucauaauguuaaaaauuuugugacagcuauguuuagccuguuuuggagcaugaucaaagaaaggguuuuagacuuugcaaaagcccuucuaaucccugaacauguauuuccuuucugccucuacauuguugguucaguccaaugcuuggaagaagaagaaaagaaaggguggaaagggagggagaagccuaacaguggagcaugccauauugggcgcagauauuaauuccagcauaagaauucaggaacuuccaagaauagcuagggcagcuuccguaccucucagauccuuuccaaaguuuaaagucccuacagcauuccuaaugaaguaacacguacuccuucccaagcgauucccgacacuuuaguagacuguuucuuaauaaacaacagaaaucauuaaagcaaaacuuaccauaauacuuuguacuucuauagaaggucauugcauuaucaaaaaacccaguaucuuuauuuuauuggcuuaugaaaauguugauagaauucacuguacucuaauauaagaaacuuaaagcuaaaauaucaguuuuuaaaaaaauguaugauauacuuucaucaccaaaauggcuagauagauaaugauucaguuuuuaacaaagucauuuuacuuacuuuuaaugagauauaaaaauaccuucuaguuuagucuuuaagcuuuuaagacugauuuuucuaaguaaguuaauuaugaauuuuauuaaaauaacuaaaugauuuacaaaacaaaaauauuucuuucugauauacuuugcaauuucuagaaaggccagauuucugcuucuuggaagaggacccuggacucugccgagguuacaugaagagguaucuuuauaacaaccagacaaagcagugugaacgauucguguacgguggcugccugggcaaccgcaacaacuuugaaacuuuggaugagugcaagaagaucugugagaauccagguaccuucccuucucaucucauguaggugcauaugcagguaucgcuuaaaaugaggauccccugagaauggacucagauucuguuuaaguugggcaaacagaaguuagguuugaaagagauucaccauuguguuuaaacaaacaaacaaacaaacaaacaaacaaacaaacaaacaaacagaaauaaacagagaauuaacacaucucuacaguuacugugaaucucacaauguuuucagcuaaaguacuuaacuuuccucauaguacugcagaacauguucagcaaaaugguaggaaugcugaaaucucuuauucuuauaaaauauaaggguuaauacuuacucauaaaaaauaagaaaaaggaaaccuuauguauuaacuguugcaggauuucagucacuagcuacaaaauuacuaaugggaaucuuaccuugcacauguauuuaaaaguccuuguuuccuggcuuagagcaucaggggaacucaauugcaacaacuuugcuguuuuugacacaacaguuacauuugcuugucugucaagauaugaaauucuguuguguuuucagauaguaauugcuuauggcuucuauccucuacccaguccacuccccuuccccagugaaugagguacagaugagugacuacguaacugauggaaauacuguaacugaucgcaguacuguaaauaacaucgugguuccccagucucccaaagugcccaggcgucgggguaagaauauuauuauuguuauuauuauuauuauuuuauuacuauauuaugauauaucaauagaagguguguguguguuagaauuaucuuuuuuuaaaauaaugauuuuauuauuugaggggcauguuaaauuauagacauuugaucaauuuaaguaauuuaaucuuauaagaguaucauuuuucuuaaugucguuuagaaugugcuuugcgguagggcuucuguguauguagcauguagaaaaugugcacuuaugcauucuuugcuuuaauguagccuuauuucucaguuugaauuugucaguguuuucaguuagcuuuuuccuacuccagaguuuuaaaaacuaacuuuuaaauauaagacuuucuucccauuggaauuauucauaaucauguuauccauguucauuccauagaauauucuauguaucaccccccugaaacugauauucgcuggcccacucuuccuaucuaugguuucacuacugugcagagaccuccuuccucugccuuugcucuggcuacccaaccagucauugauauggcugucacuuggugugcuugcuuugcuuaugugacuaugcuacaagguuuugaguaugacaauuuauagccugccugugcuccagcauuuaucucagugucaagcguaugguagaugacuuauauuuuuuauuuauuaauuuugugaucugcaguuacaaaagaagaaacaaauggugguuggaagaaugcugacuauacuuaccaaggcuuucugaguuccgucuacauucacguacucuauuuugucuuuaggauuggauaguauauucuguuacuuguugccguugggcuuauuucauaauauuuacauagcacuugaugcuuuuauauuuauuauugauuaaguuuuaauauuaacauucauaguuaacauaaucuuuuacuaugucuaacugguaaacuuacaacuaggaaagaaagaccagucacauugguuccggguuuuuguggguagaccuaccugaucauucuuggagaaaaguuaauuauuuuccaaauucucacagcccaccuugcuucuauacaucaucucuuaacagcugccuugguacuguaucaccuuuaugauauuuugaaaaaacucaucuuugguuagacuucaacagccuacugcuaacucagucuccagcacuuggucuuugauugagaaaggagcgccuaagcacugagccagggccguccugcuucaugccagccuccagggccagggagaaugacuagauguaauaaagaagacccuguggccacuugaaacucuuuccugacucuaucuaacagcuaacccagggccaaacucuacacucacagaaaacggugagaaagaaguaaacaccuguaauuauacacauaaucauuggccuucuggaagaggagugauguuggcagaggaacuauucaauaaucaaaugucaucaccgauggguucauguuagagaucugcaauagaaugcuuucaccuauacguucucuuggaagauauugauuacaugcagaggaacuucgcaaucauuuaaguuuucugggaagaaaauauaccccaccaacuaaggaauugcacauuuaaaugcauaccccaagaagucacgagugcagugggcacucauuucaucaacaagcacauacaguuugaaacaaauaugguggccuucaaauguauucucacugagaagcauaggaucuaucucacaaucuacguauuccugcaucguaaaucugguagcuucugcugacauucuggcaaguuggguuuccauaaauagacagcuuuagcagagcucauaccaggccuucuacuuccugucaagaaugcuggcaagaaacaagaauguggcacuuccuuugccaaaaucacagacagcacccuaccuaccuaguaaaucucgucacagacuaucuugagucuagucaaagacaaucguugucccagacggcagagcccuccagagaaacacuccucagacaucaacagauccuuuuacaagagaugaaauggacaacuucacucugucagccaauucuuuuaaauaacauauguacugaauaaaauaauagaaauuuaaguuuuugacaauuauaaagcuacaaccaaaacuuauuugcauauuaauacaguacuaauuuauacuauuaguuuuuuuuuuaagauuucuguuucuuaagagagcaggaaaauccauauuggaauaugaauuuuguauugacaacaagaagacagacgagggauaagacucaguuuaggaaaaucuaugauacucuaagucauaauucccugagggucgcuuuucucuuugaagaucagaugagcucucagaacugaggugagaauuacucaguaaggagcccccaacucuaacccucucagcaccacagggcuguguucugacuuuccaacuguuugaaugccaggagugugcucacugcugugcaucugaucccagaaacaaagguccagguuugugauuucuagaaugaggccagguugaacgugccaaucaaaugaucuggcuuuagagguugggaagcuaucuggcucaccacuauugcccccacggcugguuuccagccuccuuauuagguugucuguuucauugaagucucuccucuuguucagacuugaugagcaucaguccuugugugugacagugcaugaggcacauucaggucguuuugauuggagauuaagagaagaagggauuuggagaugagaaauaaggaaguuucacaaacuugaucugaucagcucuuugcccagucagucuagcaggauuucuuauuuagcuuuggagagaugucucauacuggucaagaacaucagcuuuaugaauggaguuugagcuaauuccaguucuuugguuuccugacugguuuuguacccuugggaaaaaaaaagcaugcaguuuccuuuagcuucuaguucuuucuuugcuacacguggaauacacuaugucauaaaguauuuaaaacacuacaguagcauguaacauuacccucuggguugccauuaacaagauuauugauuuuaauauuuuugguggugaugaugguaacccuaacucacuuuagguuuauaggcauaaaagcuauugugacugaaagaucuuguuaaugcauauuugauuauagucuuaguacaacuaauguuguaaccuuagauugaggaagcuugauucauuauagcuaacaugcagugcuugcaaaauucaagcauaauuaacuaaauaaaauuucaucuuuugugucuuuugauuuuauuuaugauuauuuggaggccuaaaacacuuaucuauccgccuuuaggaccugagguauaaauuuauauucuaacuuuagggagauuuaucaaaaauugaugaucuggcugaagggauuguaauagaacccggaaauggaagaaugaaaauaggagauuuuuuuuugccagauaggugaaggauucagguaaguaacuggcuugagaccuuacagacaguauggcaggacagagucagagucaaauaaguuguaauuucaaaugugaguaccggugucccaggucacaggguuaagguacuugcugcuaagucuuccuggggaagaccacuccucccacugacagcuuuccucaauugcccauagguuuuguguguguauauuaaucuguuuucccagauuugcagucuacauccucuuuguuguguucuguucuuuaacuaguguagacuuucuaaaauacuuccccagauaaacuggaacuauuuuguauccacagccuguuguuucucugauuguuagaaucccauucuuugauuaaaacugacugacauauuagauaaacauuaaauuuucaucuugcuuaaaucuauuuuuuuccauuucacacauaaugaguugcuucaaauguauccagacccaaaacuaucuugaaaaaauuauaucgauaaucuaaaaagauuucugauuggucuggauacagaagagcaggaaagaucugcugcccagaagaugaaaggucuaugguacacaugucagcaaucacaagcgauagccuuuccuaggguucucaauggaaugguuuuuacaguuauuuauuuuguuguauguuguaugagaguuuugcaugcauguaugucugcacaucucuguaugcguugcaugaggcagcugacagcaguuccuggccuggaagugcagaugaauggccauguggguucccuguaagagcagcagcuauccuuaacugcugagccauuucuccagccccucugcauaauacauuaagaugaaaacgcuagcacucgugugaugguacugauuguaaguauauuuucaccaaacauauauuuucuaauaaggcacuuaaguggaaaaaaguaugcucacgaaaacuucuuaauugucauugucuaaagccauuuuuguuaagaaaaaaauucuugagcgcagcuaacuuagugagcucgggguaugguuuagucagcaucuugacauaagcaaacaaauagcuacuuagguucucucuuuccucauuaaucugugcaggcucuccuguccaggagagauuucuuacagucuguccuaugaccuuucaaucucagauucccuggcuguacaaucuccacacuucacccucugcuaagugacccaguacacacaaggagggagaaauaauccucagaguaacugcccagcagcccuugccccuuucccaugucgaauggagcaccgguuccugcuaguucagugacugcucuucuuuggucacacacucagugagaggauacguguucucuguaaagcaggccuuacugucuguuaccagccacagcacguuucagucugcucuggguuuuucuuuuaucacuuuaaggaacuggaauuauuaguaauuaauaaucuagucaauuauuuuuauuuuguaaaaagcauuagaauuuaggaacauuaagcauacagaaaaaagggaacagcaguaaaaauugaucauaaucagauauacaggaaaaaauccccagugaguugucaauauauuuuauuuuacuuaaaaaauuaucauauagcaaaugauuaaaagacuguaaguuucugcugaagguguccaaaaacauauaauauguucaauauaaacauuuaccaauauaaacauuuacucguagaccuuuagcuuagcaaacuucucagcguacaacccgauaaaacuuuauuuacagaaaucauuuauaacauagucucucaguacuuuuacaauuaauaacauauaucauuuucauuuuuguauacgugguuccauauguaugcacauaugguaucuugacauguaauacaaauuaauauauuuuucuaauuaaaaauuuuuuucaauuuuuuuauuagauauuuucuucguuuauauuucaaaugcuaucucgaaaguccccuauacccuccccuccugcccugcuccccaacauacccacucucacuuucuggaucuggcauuccccuguacuggggcauauaaucuucgcaagaucaaggcccucuccucccauugauggccgacuaggccacccucugcuacauuuuucagcauuuaauaugacuguaaccaugaugaaaccuaucacugauagcauacaauaauauagucaguuuuuccuuauuaggcaguauacaaaauaguucaucuuaaaaucaaaggcauuagauucuauguaagugauguuuaauagaacugaugaaauaugcauauauuuuaaaggauguauaacuguacaagauauaaauauacauucacaagcaauuaaggauaguaauaauauguagaguaguauauauaguuuguacuugcaaaagacauuuaccaaaucauugauaguaacuuaacuggagaaagggaaucaugcagaaguuuuguuucauauuuuuguuuuguauuauuuaaauuuucauaaaaguuguaauaaaauuauauuucuuguuaguacaacuuauagguuaaaaaaaggaaaaacuucuuaaucaauucucccacaaaaaaaaaagcucagaagaaaacaaguucacaggccaugcagugguucauaagcgcuauuuuguuuguugcaauaaaaauguacacaggaaaauauuguggggauaagguauugcaauaaagccuuagugcauuaaauauaaaguuuacuguaugaguuacaaaguaaaucuacauaaaacaauuuacuugaaaacuggacccugggccaccuccugguauuuuagcagucacccuagacaguaauguuuucuagcaaaaauauggaaaaggaggugguuuggugugaaauuucucaaaaaagccuucuagauggaauccauucaaccugguuuugauggcgggaucaagauagaauacauuuggcucuuaaagucccuuuggaucaugaacagaaaccagacagguuaguguccuuuuauucugucuuaaauuucugucacuaaucaugauguagaccagaaaaucacaguaugcaacuacuucaaaacauauuuucuuuuauuguagauuaucaauaucuggaauuuaaauaggugagugucuaccuaugucuagaauaaauuuguuaauuugaacauaggcaaacuuauauuuuucaugggguacaaaaauauuuccuuuucuuaccucuugaaauuuaauuggagucaaggacuccaaacgucccgcagaaacugucugcuuuuucuuuaaaccuaugauguaugcuaaaguaauuaaauaguggucagaacuaaaauaaucuuaaaaacaaugaauccauuucaauuuaaucuacaguuuauguucuagaaaaauaaauaccuuauugaaaggcucccaaaacaaaaaucauuuugugucuuuuaauacuuaacuuugcauaguauaaaaacuuacuuagugguaaauuucgaauugcagucuacucugaaaauagcauucuccccaacguuaggaacacgauuauggauggcguauguuguauugaaccuguguagacagggaguggugucaggacuaacagugagauaagcaaacagcagucaugggucauucuuggggagaugaagaggcauggggugugcauaagcacgcugaccucagcucucagaaccaugcuggacccuuuauacagagcucacggcguauagggagcagaaaugugaugucuuggaugguuaaguugguaaugaagcgucuccugaugcaccugugcucccaagugccugcuuucacauaaccccggacuuccgcuguccugcauugcauuaaaccggacuuccgcuguccugcacugcauuaaacccacuuccgcugguuucuucauauuucuggauuauuaugcaguuagagaaagagaagcuagagcccgugugccuacuauaccuguagcauacccuccauaauuuguauuccccuagaaaucuaggcuguuuugguucuaguuuucaccugggauguaagcuuuugguuucugguaacauucugucuucuuaccuccaguguaggggcaauagucaaaugagcuucuuuuccacuuugaaacaugcuugauuuugauuaugaagcuuaacuugcauccguuaaguggagaaggcguuguacucagggaaugaaaauuucuuucuguccugacauaagagaccuuagcaugggcacugcuauuaacacaucguaauuaacauuacaguuauagaucucgcucuguuaagauacacuuucugaaacuuaccacggacugacuuaucuuguauaggaaacacuaacucaaaauaauguguacauuacauaugauucuacacagaauuuguaaugaaauauaugugguguuuucuggggaaaaacauaaaacaaauaauauauuucucuguuuaucaguuuuauucacuugcuucuaguuggccaccuuugucucugaacaugggugguggcuuuggagauucaggacaccaaggugguacaggugcucacuacucaaauuuaaacuggggcguggugagcaaacacggggugcccacuggagcuauuuggacaauaggagaagccaacugcaacauuucucugguaccuuuaggauuacuuccucauaauaucuacuugaaaguggcagggauauggauuugaagaaguguagcugggaggagcuagaaggagaaaacuggggaggaacaugagguacuuuuauguaaauuaaaacauaauaaaaauauuuuaaagcaucuaaaaaaaaaaggauuacuuccucagacuauuugugaaagaaaaugcuagcaugugcugggaacuuuagaaccuauucccaucacauguucuuaaccuggguuucugauggagcacauucacguuugaaggugcaugguagcagaguauaagacgagcagacuagcacucuguggacauuguuuaaagagcucaaggguuccuuucagaagugcugucuauguauuuagccaacgaccuaaaugaaacuaaacauucuccaucugaugcuaacucuccuaugcaucauuccaucacccgcaguccucccuaaucuucuagguuuuuacucagaaugucaguugcuguagccagacauucuggcuucuacuuaucugucuagaaggcaggagaugauaaaacuucauuuaucagacuaagucuuuucuuacaugcuguuucauuuugcuucuucucuuuuacaguauuuuuccauuuaggguuuauguaccaaaagauugccgcuugccuucugcacagcugcuugccuuuguuggccguuggauucuucagucaugucuccugcucaugaacguuugucagucuuuccuugcaugugcuguaugacaucgcaccaucaccacggccacuaaaguuuuccuccauaguucaauaccauccaacaccuuacauucagcuuccauuuacaaccaucaagcauagcuggacagcugagaaguacuggcauguccuuccugagagaaaccaucaaagaaacuuaaaaagauguuaauaagcucccccgguuuucuccucagacuuaacaucacugcugcuguuguccuuauuacccgaguugcauggucucgguuuuugaauguuugcuggucccauugacagaccaugcuaucgauuccaaaccaguguccuacuauacuauggaaaaaugaaaauuuuauuucauauaaacuaauuuguauguauuuauaaauacauaguugaaguuucagaagauaaauuguuuuaauuguguauaacuaguuuguucacauaaauacuaaccacaggcuuuucuuuuuaucaaaagugcuauguuuuauuccuuggagaaaaaucaugguauuauggacguuuuaauuuguuuaaccauauucugggaauugaaacccuugggcuuugcaguguuuuaaucuuuguaggauucugcuuuauucagaagacgugccauaaagccaaucugcaaggaauacuaauaagaaggcucagauuuacuauucauagaacuuaacauguuuucuugauuuuuaaaauucuaucuaucuaucuaucuaucuaucuaucuaucuaucuaucuaucuaucuaucuauuagauuaucguggccgucccuggugucuucaaccagcagacaguggauuauguaaagccagugagagaagauucuacuacaauucagccacugggaaaugccaccgauuuaacuacacuggaugugggggaaauaauaauaauuuuacuaccagaaggagaugucugagaucauguaaaacagguacgaaagacaugcuucccauuaaaucacugauauuuggaaugauaauuaugcuaaaaucaugaaauacuuaugaaauaaauauuuccuuacuuauaggaaguaauauaaugacuuaaugacuauucucccaccaacuaaacuuagauaaugcugguagguaugcuagcuauaacuguucugcauuuuuuuuuuuuuuacaaauuauccauuuacaacagguucaaaauuuuuaauuuuuuuaaaagauuuuuuacuuuuuuauuuauguguaugugugugcaucuguauaugggugcucugugugugcagguguuugcugaguccaagucggguaucaggucccuggaccuggagugacagggcucuaugaggcuccuaagguaaacgcugggaagugaagucagcccugugccagggcagugcacacucguaauagcugagccagcucucugccucaagcuucuuucuuaaacauuuaagaccuaagaauuuauuuuuaagaaauuugaguuagaguuucucuuuguagcucuggcuguccuggaacucacucugaagaccagaccggccucaaacuuagagaucugcuugucucugccucccgagugcugggaucaaagcaggagccuccaugugugguugaaaguucucuuuuaauacacaaaaccuuaauguccuucugcuccccccaaguauaauaaugauauaauacaauaaaaagaacauagaaauuaaauaaaauauuacuugaauaaccaaauguuuauuccacaucuauccuuuuaugaaggcgaucaugcauuuuuaccugaauuguacuauacuuacccaggcuuggugacuauaauacaugcaaaaugacuuucuuagggugggacugagaagaaaggagggaggagggacugagauuuaaaugucaagugaauacauuaaauaaauauauguacauauacaaaauagguuauuuuacaaaaauauggagacaaauuaauuuagggaauuuuagacaaauuuuuauguauucucuucuuacuauuauuuuuuuuuaucguaggucucaucaaaaacaagucaaaaggaguaguuaagauucagagaagaaaggcgcccuucgugaaaguuguauaugaaagcauuaauuagugcuaagauauaagcacauuaaauuuuuacauuaguuucacuaaauauuccuauacggugcuucuacugugauuuuuauucuucuacaaaccagugucuuguuuccauuggugaccaucuauuagaagauauauuuucgccaguuaugaucacaaacauuacauacccuugacagucuaaaccuuuucgaaugauuuuaauuuuuaacaaugugagaaauaaaaucuuucauccugagcaaucaug

SEQ ID NO: 880 - RNA, 7579 nt, Mus musculus
guuucaguugcuugcaccuccagaucugggagcuucuuucuccugccuaagcaccuguaguuagguuccauuauucuagaccuggaggucaccugagaucaucaccuugagaccuccaagguuucuuucuuucuuuuuuuuuuuuucuuuucaaaaauuaagaaguuagcauuagucuggagaugagugaaaggcucugccugaaagguugcaggcagagagcaaccuccccuacuaccaccaccaccacaacacaaccaguuauuuccuuugagaagugucaaaugaugggacucccacaggcggucucacuuggcucugcaccaccaccccucaagaaaaaggugaucuuugcugggaaggaaaugaggacgagggacgagaggaaggccgugacgugagcugaguguggccagggacugggagaaagggugaggaggcgggccggcaugccuuugcugcuggccggagcucuuuucacauugugcuacugucuaacguguaccgagcagugcaauguuaaaagggcaucggccuuguaguacuacccagugccggcagccuccucagcaucacugcauuuucucccaccugagcaccagucagcuacucugcuggcaauuuggauauauggagcccucccuuagaugaggaagcuaaggcuguagagcuccuaaguuaacugcucuauccugagcccaacaggaaggcacccauuuuuguagaccuguccagagagauuugaacugagggggugaaugguuuugaugccaccugcugguuaugugaggauaucaucugaagucuucagcuuuuaagaauaaacuccgccgccacaccccccacaccccugccccgccaaggggcagcuccuuaaaugaaggucugaguuuucaggugaagcuugggaugggcagauggugaaguaugggagaaaauuugugaggcccacagaaggccucuggggauagggugcacugaaaaggaaaggggcuaacaagaaaggacagaugccuaggcaaaggggcuucggugucccuccuguccucuacggcucuuccuugcaucuuccauguaggaaggaggucuccucuucacucaguuuucagcaugacacucuccugaccacucacuugcuugugaugguucuugaaggccuggucacccaggauucggucagcacuaguuagaaucuuaaguggugcccagagucuucucgugcuccacaaccacaccauugacuuuucugucuuucacagggcucuccuugagcagauuuuaaagcuugcucugaugcagcaaguggggccaaaggauggaauuggguaccuacuagaauuuaaggaaagaagacacugugggucagacacuccuauggucccagcacucaggcuucuggcuuguuggcccuucugugucugcugguucuuuguccuuucuacagucucucgauucugaugcuaacagcacagguggcucuaggcuggagagauggcucagcgguuaaaagcacagcuaugcucuugcagagguccugaguucaauucccagcaaccacagggugguucacaacuaucuauaaagggaucggaugcccucuucuggugugucugaagacagugacaguguagucacacuacagauagcucuaaauccauuacuucagucuaaguaaucugagccucccuggguagaguggugcacaccuuuaaucccgguacugaagagggagguaaaacugaguucaagauucgcaugaucuuuauaggaaguuucaggcaagccagagcuaaguagugaaacuauggcaacccucccucccuugcacagcaugagaaaguacugagcuugaucccaaacacaagggauccacgggccagaugcggcagaacacgccuauaaucucagaaauaauaaguaauuagaaacuggagguaggauuagaaagucauaccgcaaguuagaaggccagccuaggcuacauaagacuauuucagaauaacaguaguuugcccaugcuuucccaguguccuugagaugcagucccaauccucugagguuuacagcucuuccccuuucucccauuuuaaucucaugucucauccucuugcacuucuguuccagccucaaaaaaaaaaaaaguuuccucaaaugagcccagcuugugccacaccacacaguucugucugaaauucucucucaucuuguccuuuuucugcccaucuuuccaacauggucucucuucugggaagccaucccugacaccucaggucuagggagcuagucuggacuagagcccauauuaucuucuguugggauuaauuagguucuuucuggccacuagauucagaguuccaaaaagucugcccauggcuggcuugcucuccacgcauccccagaguucagaacaacgccuggcaauuaauacacaccuacaauguaacaaauggcuuuuuaccauaaauauagucuugcucuauaggggcugggccucuccaauuucacaucagugcacuccagccauguuccucacaucacacuuuucuguugaugcuauacuuuagaucaacugccagcagcaucccgccccauagauuuucauuuuagccucaaggguauccaugaauuaagacaucuuaggacacccuccuccuccaaauaauugauacacaagaaaacacuaaacuguggaguaaguuuacccuaguugcacauccugaaucugauaaaaaguagccucacuggggagggcccaggggacugaagacacuuagauauuccuucccuuuggacaagcucacaaaacccacgccucuugguucaccuggaugcuuaccgcuugugaaacagguggaggaggaucuugccacaaacaaagcaacugcugccuccuacugguuuaaaagggguggggugacccuuccuugcuugugugcauacggaggacaguacaagguccgcaccuaaggaaggaaagccaggacaaccaccucacaguugcuuuuccccuuuuuauuaaaaauagacccaaaacacuuuauguaucauacaaaaguuucguucgcugguggcagucacaggaaagacuggucccucagcgcugaugauccgccuccuccagagggcggggaccucgggagcaguggcugagccuuggggaaugccuguaaagacugcucucucuggcaacagccggcuaggggugggggcuguucuuggagcagcuuuucccaccccacccaauggcaaagauuagauacuugaaagugccucuuuagugcuaagguaaacaguggagugaaauggaaaccccugucacugauucccagggucuaggguuugguuuuccuucuauuggccccauccgauccuuuauuuuuuuuaaaccaagaaugggggguggauaaacuacccucagacucuggggcccugauaucugagaccagaauuucacuccaucuuugcuuuucuguggucuagccccaccaccaauguuuguccuguuuauucaaaaaaaaaaaaaaaaaagcugaucaacauuugguaauucauaguccuaucugccugaguuugcgcccugccaucacuugguuucuggugccacaguucucuccuuccccuguucuguauuucccugacugcuacccacuccugagccuuagacaccccugggguaucccaggcuccuguuccaaagaaccugguacugcugugacgggggaagggaggaggaggucacuuggaaccagguuuccccaggggugggcaguacucaugcugguguggacugcucagcagggccaggagacuggugugaggaggguggggcaugcggaggagggucacaggcugcugagccccucaaucccagccguugucuuucaccaugugugacaucucaaugauguacuucccuucuuuguauuucuggcuggucucaaaagccuguuccugggguugggggaggggaguaaagaaaugaccaugggaaagagugucuccccucuaccgccaccuaggccaacccgaugccaagcucccucuguggacuaugugaaggccugccguguggacacaucuggagggccacagggacugucuagucuuccaauacuuacauauuuccagcccaguguggucuugcagcuuucgcagaaaaugucagcuaccgaguggaguccugugagcaggaggcgcuguucagcuggcccacaacccacguugacccugucucaggaaacaaggacccagcacacaguaggguuguucugucaguccagcccccaaccaacccaaaaggaucucuaccuggggaacaugccuucagcgguccaccccucuagaauuugugcuugggccaucuuucgccccacgaaacuaaacugcguuucuuaaccccuuuauagaggggauacuagaaccaggaguaccaggucccuuugaagacucacccccauuuugcaaagaggaaagcuguugaaacauaaguacacgcacaagcacacacacacacacacacaaagaaagagguggacucacacggaguuaaacagguaggcccggccauggcuuccuuggaaggacuguggaaacaggacagacagugacuacuggguaucccuuggccccacugccuggaguaaaagacugggggaguggcaggcccucacuucagcguuaccuuggaaauaagcucaucguguuuggccaagugugcucgacaguggacgcaacuguaagugcgguggcagcggggcagguaacugcggaaagucuugguggguaaacaugcgggggccgggccagggucacagcugggcaugacggguuggaggacgaugcccuggcgggcuggaggggcuggugcggugcagcccccacagagacggucgcagguaaagcaacggagcagauuggcuagagccguguuucaggacaguagcagugugggggggcugcccugccagggccccccccagacgagaaccagauagaaaugggaagucaccuggcaagagaagaagaugcaucagcggagguaggacuucacaaggagacgcuuuugauuggcuagagaagauggggcucaguucaucugcaccguccccaucaccaccagcccucagccucucguugcacuuucuguccccuagagucccauucuguucuggcagcgguuccaggcgucuugugccauggccagggauuugguaccuuucucucuccagagacaguagcagccucuagcauuuuccauugagagcugccuccuggcacagacacugccuugagugcaacaucaccugcagaggcccaccuuguguccaguucugugaggaacugcacccuaaugggaggagaucggaaccuuuuuaagagucaggucuuccuggaaguuggauuuguuuguuuagcuuguuuguuuuuucugucucaaggccuccauuugcaauacaauuugcccauauuuugggaaggaaggaaagagggacaggcagauggguacacacagucuguuucggcacucgccugcgguugaguccugcgcccuggaacuccauagaacuugguagcuucuucaguauugaagaccuuaacccuggguguuccucaauccugcauccugggaugauacagcucccagacuagagggagcacuugcugucuuccuagcaucugguccucuggucucauuacuuacuuaccguugccuuagcucugaguuaaagacaagcaccuagcccuaggaggagaauuaucuuucuuccagcaagucugacagcuaggcccguggaaaguaggcagcacaucagaagccaggcuucugggcugugugcuauagagugagagcaaccuuaauaggagacaacaggguaaggggacaccuuauuuuuaaaagcugggcuuuagggcacaaggcagaaaacauuucuccucccaggagcuagagcaaaugccagugccaggacagcaacagugagauaauugcggggauaagaauccugagacgcugggaucugcucacacuccagucccaaaguagcugagugcacugcaggcagaggauaaggagggaagugucuucuguuaacuccgauaagcaggugaugugccucugccucucuaguggagcauccugcagcuguaggugggguggccugugucuccuucagagaugcccgcuaagugcucucgugaugcuagaccaccaagcagaggaggcagcacagcuucaguuacccacauaaacagucuguucuccuguccuccaugguggccaugagcacccgauucuucuacugucucgaagggcugucaugcagucuccacaaaucccccugggugagaccaucuucaguuuuugguccucuacuguugucuugagucccaggaagacaccuugggcuuaguucagggugacauuguauucuggcccuucuugcuacaguucagcaucacuuccaugaucuuccuucaaguuugccuguaguucaccucaaggugccaccuugaaacaccuacuucaagggaccaggagaugccagguuugcccccucccgcuaucuucuucccuagcccuguccuucugucacugucacgccucccucccugucccuuucugcuucucuguccagcagaggagaagcugcaaaggacaaaaaaauaaaauuaaauuaaaaaaucauaaaaaggagaguuggggucacuucucccauuucugcccucucucgucauggggugaagcaaaucggggaaauuacugaggucagaaaacaaaacaaaggugagugcugggaagaggacgagucccugaagcugagaugaggcuggacugugggagguggggggagcagaagggcuugugccugggaagacuggcaacugagagccuaagugacaaggcagagacagguggaaccaggugcgaauccagugccucucagggaauaaaaaggggagggggacuugugcucacaacggauguauucaauugcuuugaguuuucgccucccccuggaccaggcauuuucaguaugguaugguccgaauaauuagcagagcagccagcucccagggcugacucugggggucugcaccgguagcaaaaacaauaaacagugaugucugaugccgcagccaaaguugccgggaaauaagugcgagagaaucgucagagcuuggggaaggauggaggagcugagagagaggagggagcggaggcagcagggagggggaagggaggacaaaggguggaugaauaaugcuuuugcaaaggagagaaagcaacacacagcaggaagagguaauuugcgaaggggaaaaauugauuuggagaagggcugccccccucaccuugaggucugcuccagagaucuccgucuaucucuuucaaucucucuguucacucuucucucuucucuguugguuccuucaauugggaaggggaugggauugggggaggguaguugaggggcugaggucugggacugcaggcuggacagcugcuggggggcagagguugccucuugcucuguaccucggucuguggguaaauguggcuguguguuguggaacugca

SEQ ID NO: 881 - RNA, 27723 nt, Mus musculus
acaucguuuccaaagucauuucccuuuauuaaauuguuuucacagaccagaaauacaaaauaaaaguagaaauaggccccuauuaggagcuacaggccugacuuggcaugaccccugcugcagcaacuugaacaggacaggaagcagcuuuuacuacagucagaaaguaggaaaguaggcugaggacuuggguccuucaaugcacugcgaguagaagacaacacacuccuaccgagucucucuccagauugcaaggagccuuccuugcaaagcagcagagguuaggugcuucccucaaagccucagggcaguggaagccaccaagagcaguuacucagauggcacagaauccaaggacuaugugagagacuggagcugugacgaggugggaauucccuccuuuauucaucagaucccgaggcagaguccucugagcuuggagggguacuggcuagcuccucuucagaguccugaaaagcaaaguucuuuuaggguaaaugugucccagccaggugggaagagggcugcuaaggccuagcucuuccuucaacuccugaaaucaccaaaaccucacaaguccacccgcccacuccaacucauuccucucagaccaaccaacgggaccugacccaccccagacacacacagcccucaaccccccacauuccugccgcaccucgcuccgccuccucuucuuuuugcucuuguucucgccugaagagcucucaucacuggacacaaacucuuugcucuugaagcugucacucaacugccuggaugaagacuuggaugacgagccccgggaaggaguggacuuuuuuuccaucuuugcuuuuacuuucuuuuucuucuuagacuugucccuagauuaggcacaugggaaagaaaccaggucauuaggcucucuauuacuacauaggcgauguaucuccuagcuuuaaugaggacuuuucccaguacuggccacacuauucucaccaugacaaauguagugucagccgucagcccaaagugcaccaacggauaaguaaguacccccagaaaaaccagggucacagucuaaagcaacucacaugcaaaacuuaccggacacuuuugucguauuuaaaagcucacguggacuuuucuuucugaacuauuauauuacuucaaauaaaacugaucuaggaaaauggccuauauuuaucccccaaccugaaagcaucacccauacuuggcaacggcauucagggauuuaagaagcacuacucaaacugcugucaaaaccgaauaauucucuauucugaccuggcaaacacaaucugcuuuaagcgguuauuagccguuuuguucccaacacucaccuuuuagaugaguccccucuuccuccuucauacucuuucauggcuuucucauacucccuccuagcauccucagccuugcggucccacuccugccacaagcacaaauacuccuucagacugaugcaagcaagugacacacccugcaccccuacaaagcccuuccugcucccccuccuucccaccgcuacucaccuccuucuucucuuuggacauucccuuccagaucuccccugccuucuuggaaagaucugugauacugaugccaggaugauccgacuugaucuucucgcggcuugcauuaagccacagcauguacgcagacauaggccucuuuggggcguuuggaucuuuacccuucuuugccuauauaagaaaccaaaugccaccagccauccacaucccacaacuaucccaagcuucccccaaagaaacuauuugggaaaggaagagaugcaggaagaacuaaaucgacuugggcuacacaggcaacuuuuuucuccuccaagagauccccuggggcagaggcagguaucuucuaauucagagacucacaucuggucaugugcugaggcuaagggacaaccgagggcucaguccuaaacagaacaucuguaucaccaaggccaaggcuagaagagggagcagguaguaggcaggagccagaaaaggggagaacugcuagaacacaaugcccagcauggcugcaugacugcaagcacucacagcuaaggguauuugccugcuggaacucuaccagagacaggaaaggcauccgugagggcuuacucccuccaaggagcuauguguaguuaaugguugcuaagagcacauggaucauuuccaucagugguguagccacugguaagcuacugaugcuccagcaacucacccucuucccaugcuuacccaucacacaagcgauucuuacuaaacucagaaaagaaagaaguaaaagagguaccaauuagggagcugagggaggggggagggaaaucauaguacacuaaauauauguauaaaauugucaaaaaauaauaaacuaguuaaaugaacaaaaaaauaaaaaagcaaagaaacaaacaacaacccaccccagauccucaagaaacaaaguauccuaggaccaaaaagaaaaacuuaagaaaauaccuacugggccgggcgugguggcacacgccuuuaaucccagucucaaaaaaaaaaagaaaaagaaaagacccacuaagucauagccagccuacaaaaagcagcacaaccaacagcaucuacugguagugaacaggaggaaggaaacagaaucacacacauucuuuuuucccaauaccucugaagacuuccugcggcucuuucgauccuuggccaucuuagcccuuuugagcuguucccguuucuucucuucacggucacugucacccucauugcuggaggagcuggcagaggcauugcugucaaaccugccagaacgaggcuuagacucaggaaaggaaggaaggaugcagcgauagaaggaaagggaaucuagacaucugcccagaaagagccaagggaguaagucccaaggacagcuuccaccaccauuugccaccccagccuccugcccuucacuaagauggcuucaacaucccuucucaaagcggccaccacgaaagguuauuuguugacucaaucaguggcaagccaauguuucacagggcucuucugcucuaaggcaggcuuuccucuacuuccgcccuccaggacuguacaacacugucuccugcuggccugcaggacagcaagucuacuucaccauuccagguggucaucuccuuaguuuauacuacaaucuuuucugauaacgagacagcccuaaaacggaggaaaaccagcuucagcugaagccagucccuauguccgacuguucuguccaacagagcgcgucuccucugagcagcugcugacacccacccgcugcugaaagauuuccaaagcacuucauaagcaucugugcauuaagcuuucugagcaaaaucagugggcuucggaaggauauucaccauuugguuuuaauucuacuacccaaucuuucuggaucaacaguuccaguuuucugcagggaaauaauucauuccaacugcagggucuagggugguucugguccaucagagcccugcacauaaguauuaucucaaguucaggaaggggcaggugaccagagaccacacuauccacgugcuguucaccaggaggugguucuggguguuacacuagccacauuaagccuaucuagcauucugaggggcauggaccauucuuucuaagaauaaaagcaggagcaaaaaaauaguuucucuacuauuucugagcgccuagauccaguagugccuaaagucaacuacacccguauucucuccaguuacauaaauuuaaaaaacaaaacaaaaagccacaacccuguagagccaggcugggccacuuucuuacaaggaccaccagaguguuaagcgacugucagaagcacaaggguacugcugccacuugccaggugagaugccuaagcacagccuauucccauucccuuccaauuucucuggcuucaaagcacgccgugcacuaauauauauuccugggcaccgucacaaaugcaucuguguagcgcccgccucacggcagguuacuuuuccuuccaucuuggaccgcuggcuaacuaacacugggacaugagaacuagucagaaacucucaaguuuauaggccauaaucucaucccugugugguccagucaaaacucacuccucugccacaucuucuucuucuucaccaggauugaaggacucaucugaaaaagaacaaaaaaggcaucaacuuccacuccaguggaagccccaccccuuagccagacacccagcccaggccacagguagagccggacugcccaggccgcagcagagaggcuagcccaccagucucuucuccugagucgucgcugcugucauuggcauucuccucccggaucuugcccuccuccuucauccucuccaaauaggcaucaugcuggucuucaucagagucagcauaaucgucauagccuggguuaaugcccuagcgagggaagacaugagugucagccaccguguucaaaccagcacuucugcacacucaaagcacuuccccacgccugugaaaucaggagaccgugagcgagcgggaaugucuacacagccaacaugcagggccuacuacacggaguuaauccaagccccucccuuuccuggccccacgggggcuccuaagaggcugcauagacugaucuaaggccaugcagagagaaccugcucaggaaggggaaggagccacacgcaccucuuuuuucuauaaggguaagaagagaagaaagagugaaaaagaagccaccaagucucugcuccuuucuccucuacagaaagagcaggagagaggcgcauccuucccacagauaccucuuucaguccucuguucuugauguugagcuuuuucgcauugacaaaaucgaaaagcuuuccauacuccucccugugggggggcgggggggggguaacaaacagcauuaacaaacggucaggaccagcucgggaccagcucgggagggcucaaccauguucugauacugucgggcuggguggggcuagaacucaugacuauacuacgcaggacaucaguaggugagauacagcucugaagaguucugggacagaaaaggccagcagacguauagcuagucaccagucaggcacagagcagggcauuguacgaagagaguuucaucuuuuuacuggucugcauuucacccuucacaggacuguuaugaagguuaaacaaggagauuccauaaaauguuuagcccucagcugaguacucaauaaacauuaguugcuauguuccugggcacagagcucauuccaagaaagagauaauauucccaccauagaggaaauggagaggaacgggcuagaagcauaaacagcuuucauaauauaaaaaaacuaaagccggacagugguggugcaugcguuuaaucccagcacucaggaggcagaggcaggcagaucucugaguucaagaccagucuggucuacagagugaauuccagaguccuuaccuuucaaugcugcugaagguauacugagugccuugcuuggucucaaucucaaagucgaaggaacgaguggucguggugccacgggcaaaguugacaaaagagaucucaucaaagcggaugugcacagggggcuuaugcacguagaugaagccccgcuccaguggguacaggaguccugagcuggccuuauaggagcagguaauacacugggccccugagugccugguggaggaugcaggaagccuugucagcaccaacaggagcagagcccaagggcagauuccacuagggggcuuugacccaaguguugccuaucacaagggcacucaggcuucuaccagagcacacccaucacaggagagacuucuuuacuaaggcaacacuucccgccucauccccauccucggcccauauucuuacccuuggaaguugccugggacugugauuuuacgguugacaagugcuuucaugacccgacugaccauuucauagagggauccugacauguucuuggugagucgccccucaaagcgcuuuucuacuucuucccuacaaacaaagcaagaugaaguccaacggcgggccugccuccuacguaaauagcagcaagaaggaaguccagugagacacucacucauucauguugagagucaaggagauguccucauccuuggagaagaggaggaucaggaagugguaacgaguuuggcccugcuugaugggaggauccaagcugaucugaaaaggacaagcgggcacggcugcguugaagcccaggcgacugaacaacacggaccucuaggcagcaugaccuuuaucuacuaaaaacuuaggcaaaaccaggcaccccaugagggguuugcucaccacaaagaacaucugucucugauccuugugugguagcaggaagagacggagaacuguaguauaggggaucuuguagucaaaggucuugccaugcagguguagaaagguaggguagauccggauaucguaucgaccgcgaggagucaaacacugcagcucccggaagaugcagauggcgucuccgguggccuggaucacaucugccuuugacagaacauucugggcaaaggccugugaacacagguggguauucaaacagcuggccucugcucccaggccagccagccaaagucuauucagcaaccuccaccagcccaacgugaagaaaccucaccuccacaggguccacaccaucuuccugcgugggaggaacauagaagcgcaccuccaugagagauacuucagcaucgucauucugguggaauuccagggucaccucauucuugccugugguacacugggacacauugcuuagggguaucucaaagacugguugaucaccaaugucaaaagaaagcagcuguccuguaaggaaagagccugucacaucgcagacuccuccccgagaggcuucggaagcauccccaccaguccugaggcccgugagcgaggucagaggacuggaggaacuuuguucacaccguaccaaaaccaggcacagugccugauggaccguacaugcuggagaaacccaugcuaaacacacaaacugaaauuagcaaucagaaccaaggaaagaguacagaaagguaccaucugaggcccuccuucaccccaccuucuccccaaaccucaagcuugcccacucaccuccaaacuucacugucccccaguuccagcccuucacacacagauccuucuccauuagcucaaggcgauagugaguuuugaagaagucagagaguuucucaaacuccuguaaaucaaacggagaaaaugcagauccaguuaaaccucugggucucaacacaacuaacagguccugagagucucuagcucaggucaccaauguaucuuccucaggaacuucagcuaacugaguauaccaacuccaaaacuguuucaaaacaauuucccuuuguuaguggagacuguuucuagaacccagaugccuucugcccuacucuucaaggauguccuucuuccaagccucuuuccuucccuuaaccuuugugcuuaaaaccuuuuaagugcuagagaccugauggcccagcaguuaagaguacuuguucuugccagaagaccuuggaguccuucucagcgccccacagugguucacaccugucuguaacucuaguuccagcugauccaaugcccuccucugagcuuugugggcaccgggcaugcacauggugcacaagcuagcaaagccucauacagauaaaauaaauacuuuuuaacgaaugaaaauuauuuuuuaagacuuauuuaugccagacagugguggcacacaccuuuaaucccagcacuuggaaggcagaggcagguggauuucugaguuugaggccagccuggucuacagagugaguuccaggacagccagagcuacacagagaaacccugucaaaaauaaauaaauaaauaaauaaauaaaauuauuuauuuuauauaugaguacgcugaagcugucuucagacacaccagaagagggcaucagaucccauuacagaugguugugaaccaccaugugguugcugggaauugaacucaugaucucuggaagagcagucagugcucuuaaccacugagccaucucuccagacccugaaaauauuuuuuaacaauaaccacaaaaacuuuuuuucugggccucuggcuaagaguaguaaagaaacuuaaauucccagauacaugcaucaccugaguuucuaaacuuuguguaggugaucuuuugaugaaagugaauauuaaaaccaaguaacucaaaagcagcucaaaauggaaaagcaaaauccuagagcaccaagcuaagaugcugagccaggacagagggagcaaguggaaaccaugguauaaguuaagaugguagaaaaccuccuggaguccagguacacgacacguguacugaauacacaacacuguuuuuuuuguuuguuuguuuuguucaauagucuccaacagccuugcuucgaggaacccaaaugagcaguaacaugauuaucagagaaacgccaacugucucuagaagauuaaaaauaaaaaaagacaaggcaguuacaaagaaagugggucacagaacaagaucgcucaccgauucgcggaagccaucguacuuguagacaugcccauucuuugugagcaguuuaagcccauggccuaaugcuacccgacgccagaugccuucugucaacuccccagccuggauguuguccacuuugcccgucuugcuguucuuaaagaugauacccugacggcucaaucgaagccucccaucauucugcccaaaauacagacccaaaaucagaacaggguaguguguaguggauccuuucuaccccuuacccaugggaugcaggauggccagaguaucaauugaaaagcggucguggugaaaucaaguuaaaagacacaacagacauuaagucuagacugcaagcuuggcucuggcaucagaaacccuguaagggccccaguuuccugguuuucuaauacaacucaacaaacucaacaucuugcaacucuuugagacuuugcucacguuuucgcuugggggacacacugauacacuguuuccaaaaaaguagucagaguuaagcuuuucguucauagauucgaacucuuucccccucucugccuuucuuuugcccaagccauucucaccauggacccuuucaccuccuggaagaugucguugaacuccaaugucucugccauguucaccugcccgugguggccugagcacacagcccuaggcugcaccagagaaaacgaacccuucucuggaugcugugccccaauuccugguuaguuguguagauguccagcagggugggaaucugaauucgggaaggagacugauaagcaagaaacaacgccaccuuacuccgcucagccauguaccugguaugucucaaguucuuugcugccuggggaucuuacugacccguucugcagggcuccugaggccaaggcccaggacccuaggugcagaaccaggccuauaguggcgcuuacaccccaacccgacacccucucgguacguuccacggacaggcacggcaacaaucggcggaaccugagacccgcucagagagcgcaccucaacuccgcucagaggguaguguccugaucgcagagaccccaccaccccggggccccgcgugaaucuacguuucucccccuucuuuuaaaauggauucgcccauugcccgcgaauuugaacgcggaucgauccauuccgaucgucccgcgggggagcggggcccaugcacaccaggggcccagggaucgcgaccacccaccucuaagagcugcagccucgcgacggcacagugagggcggugggcgcagggggacgcaggggaggggguagggaugcgggggaagggaugccggggaagcuuuucccgcgugcgcagccccgcgucccgccaccggaagucgcgcacggaccauagagaggaagacuuggcuagaacggcaucauccgggccgaccaacggguacauucgccuagagcgucggcacucccccuggucggcuaaagcgagaggcuugcuauggaaucccacgcggcugaauucuugacuagaaaacgggaacacucuuuagaaaguuacaagcugcucuucaaagacuagauuccgaagggaaauuaugcgguuuuauuagguguucagguuuguauguuuguuggaaucaugcacgccccucccuccugugaaauaaucugggaaggagucuguugaacaagaaaaauacagagguguagccccacuagcugcaaaggagaugcgggugucggcgauugugcuugcuuuccagcuguacccuggcaaguagaucagauccuuucugcagugaguucaccuacccccaacacuauccuguccauaucccuaauuuguggguucucaggaagagccuagcagauggcugcauuaaauucaagugguggugucggauuuaccuuugagcuagaacuuacuugaaaucacaucagccuacguuggcagaagcccggauggccucacauagcaccggagugcaucuugcaaaaucugaagccaggucugacagagaugcuugaguuuaucucauuuuacagaugagaaaaaugagaccacaaaagauuugcgacugggugucaguccauuaccaucaaaacuggaaccuagaacacagacucuuuaacaucagccuuuuauaaucaugaggguucaggguuuagagugauugcuagcauauguccuacacaaagacaggauaagcccacaguuucccugaaauaucacugcacugacuugcuaacucaguccugggauaugauauagauaaaaauguguuuugucauucggugcuuguggcuuuaaccacuaucauugcuagcacuauuuagcuaagucaaacugggcuuaagacauaaugaaaaccuauuaaugcagcacguuucuaggaucugacaaaacuguugaagaucguuaaaauagcccagccucuuaggagcacauacccuaacaaaagauuuuaauaacuucgggguuuaaaaagagagggaguucaguaauuucugugcaacuugaagaguugcaaccaacuagaguuagaaauaagcgacuuuccgcuuuguaguauuacaaaucuguaaucacaacacucaaagacuggggcaggaggauugugaauuugaaacauggcaacauaacaaguuagacaacauaaugagaugcuggagggcagagaggaggagaugguaagaaaugcgugucuuccucccaggagacacagaacugucaagaacccuuucucccuauuugugcuauuagauagaaaucgacagacacucaagaguggaguucuuggcucaggcagaugagcuaacucaagagugggcaguuacaaggggcuuuggagaauacaaagcagcuggugagcugggauagagaugccgcguaagagaacagaauagaaacaguagacagagugcagaugaaacauaagucccagagggcccuagccagcugcaucucaggcaaucuggagcccgggauuggagaccccaccccugcugugacaucacaggggaguggagugaagaugaauaaaaaggugguccaccgcccuggcccuggacuguuggcuucuagagugucaagaggagagacgaggcacuggacuacaguugccuggcuuauaggaacuggcucuuuuccucaagccccauuaagcagcccacuccaguucuugaucucugucucccaguccugaggucuuuucucuccuugggcugcauccacagccuuucuggguggcugugagcacuuucucaguaugaacuguauaucagacuucuucaccuacgagacuaccaagucggugguugugaaaagcuggaccauugggaucaucaaccgagccguucagcugcugauuaucuccuacuuuguggggugaguccaugguccuucggauggugggacagaagggcuaccugauguccuucccucccucucccaaggcugcucugcagcuccuagacccucuucucugggaaacacuuugauuugugggagccauguccucaggauuggccucugccacucccaucuagacccgucucaggugcauuauuuuacccagaaucucuuccaggauucuagacacauacgccaagaauaugaguccauucccugguuaagaaaggacccauaugguccaucuucccagaccaaaacaaaaacaaaaaccaagucagaccccuccccacauuuccccauuccccuccauugagucuuuagagucccagaaagauaaaggaacgcaggaaggaggaaugaaaaccagggagaugggcugauguguggaagaagaaccagcuagagaggaaaggggagagcuggcuuuaauguagacuuaggaauuucuucuugucauagggcuagauggugagagguuaaaaagcaagagacaucuguucuuggagagcaggagaacugccccccaagcuagacagaggcacagacacacucaagggaagaccugcccaagagaaagguaccuuuucugacuuaguguggggcuuuuccccaggaaugcagaaaugauaccuauuguuaaacagcauaaauucucgccucacucugugucauaagacacaugcuagggguugcucaaggaccagccagaucccaacaccgcccuccugcacacauacaaagggacuuuggcaaacaauggcugggaggaaagcacgggucuguccuucuugcggucauuucuacacacugguuggcaccaggaaaugcaggcagaaaccucaaggguuuucuuuccuggcuugugggucuguggucgcuugccguuccuugaaacgaugagucuguuugugaaagacagccacugacuagaucaugaguuaauucaggcaaaucaaagaguauguccugugugcuugcagcuggagcugaaaggugggaguagauagauagaugggcagaugugguuuuucauaguucuguuccuuggguuugaugagagucuguaggcuuuaguauagcauuguggggacaucagaaggaauucaagcuauggagucggauuaaauggccuugaagcuacuuuccuauguugaaguuuugugagaaauguuuagauguuccaugucccuuucuccaaauuuggcucaaaacugguuuuuuguuuuuuuuuuuuuuugguuggcuaguugguuagcuuuuguuuuggagacaaagucucaucuauccaagguuauggacuuacuacacaggugaaggugaccuugaauucuuaauccuccuagugcugaauugcaggugugggccaccacauccauuuuuauggcuggcugaacccaggacuuugugcauauuaggucagcacucugucaacugagcuacauccucagcugguucuuaagccuucugugugcacauauauauucagugccuugauuguugauagccacaggaugguauauugguccaaaugaaagaaaaagcuuuucagcacauuccuaaccuggccuggcucuccuggcuccaggcaggacguugauggaagacagagacagccaucuccuagauggcuaagcccccuuagcucugcacugcucuuggcugcccucucaucagaaucagauugaauccuccaaugcugggguuuugaguccagucugcucaagggagcaugagagaggcucuuuggcaucuugauauacaaccccauccaucuccuauccugacagcucccugugcaacagugccucacaguuucaucagcacacucaacagcccagcccccuggcccaagcccaucucuguuuauaggagcacaaacaccaugugacuucaugaaugcauugugauuaauuuagcaaaagugcaucaagcgucucuucaugucaggcauuauuguacagugaggguagagcaaugggcagaagcagacagggucuuuauccugugagcaucauaccgugaauagagcaagaaguugauacuaacccagugauccucacaaacaaauggaaaguuucaauggcuucuaaaacgugcacaacaccugaaaagcugccgcuguggagucacuuuggcuucaucugaaaacugaggugaguuuucuggaaaugcaguguccagguucugaaggauggguagaagcaaccagggagaaguccacguaaggcaaagaacccacaucuguggaggggaagagccuggucugugggaagaagaaaaggaguguagagcaguagaggcuagaguguagaaaaaggucccugggaacucagaggucaggccuggcauccugugagaaccaagagcuuuuguuuccacagaaacguaaagaacgagaaggaaguuacugacacuguucaaccauuuggggggggggggcugagacugaggaagagcacuauaaucagaucugagcagucugaugugcccaaggauuaagaguaggaucggauguaggaaagcuuaccggagaagcuaacacuaccucaauagaauucuaaaguuuuguucuuuuuuuuuuuuuucauuuuauuuuguuccuuuaggggcguggagcauggguauguguagagguaagagaacuguggggugggaguguagggggugaaaucaguucucuccuuccaucaugugaguuccaaagauggaacucagguccuuaagcuuggcagcaaguaccuuuccccacugagccaccuggccugucugccccuugaagggauauuugauguggugguguuggcacuuaacuaauaccugagucuuuccccuguuauuuucugccagggagagaggacacaacaccucaccuaggaaguguaugagaugagccgaguauuccucuugcacacucacagcagcauaccaccuaaucaucugggcucuagccuuagcuacccgguguggcugacacuucacucagcuuugguguacaagacccuggggauacauaccauccuuuugacaccagguagcaaccaagguuccaugucagcacgcuaggugacaugcuaggaggaucaguuggaaucccucauccucuagguacaaauggggaacgacacccacuguugccuguuuucucccuagaccacagucucuggauaaggggacuacaugguaugacuacagcuuugacacagaccuguugucuuagggauucuauuccugcacaaacaucaugaccaagaagcacuuggggaggaaaggguuuauuuagcuuacacuuccauacugcuguucaucaccaaaggaagucaggacuggaacucaagcaggucaggaagcaggaacugaugcagaggccauggaaggauguaccuuacuggcuugcuucuccuggcuugcucagccugcucucuuauagaaccaagacuaccaguccagggaugguaccauccacaaggagaccuccccccuugaucacuaauggagaaaaugccuuacagcuggaucucauggagguauuuccucaacugaagcuccuuucucugugauaacuccagccugugucaaguugacacauaaaacuagccaguacaccugugaaucucaauucccaugaucuaggaaauggguauaaggguaccuccuaucagcauguucuuagaugacauaugucaagugccuuucccuagauggugacucaguaguauuaaguuauauaugguaacuauuacuguuccuagacucccuguggugccuuccucuuucccuuuacccaucucacaccuuccuaagagaccccucuccucugacacccacaaggcacacguuucacacccacucccuggccuccuccuugacucccuggggauagacgggaggguguggaggugcugcuugggccucuuuccugcacaucccaccugccaaggagcugccaccgccuuccgcucuauaaauaauaaaccagaaaugcgaggaaaaaaaagagaagucagagcagcagcauaaaugccaagaaucagaggcucaguccugcugcaucuaaguccuggccucuagagacagccucagccccucuguucuggaaaugaagcaaccccucaccucccauugcuagcuacccugaugacguucucagccccauggggccacugaaauucuuccauuuguuaacucagaauucuaauguggcuucuccucccuacugggcauacaaggagucuuaaaggaagaggaggaagaagaggcugguuaauuguuucuccaucccaagccccuuccuccugagaccuuccugaguuaggggaugcauuucuaucagugaagcaggggcuugaacugagauggagcuagugaccuuacaguggggugauuggaagugauccagaacagauugcccuguuuggaaccugcuucccagcuaugugacucugggcaaguucacacacccuucugugucucuuuccccaccugugguauaauggucacaauauagcuaucucguuaaggcuuuauggaagggggucaacuuagugucauagaguugcuuguaugauagggcaucuacaaaugugcccugacuucagagacaggggacugggcucaaagaaccauuucuuuagcucaacagcaagaaacauauccaucugcaucaagacacacuggacaaggcacacuggaguuccagaagucuguguuuggaccguggcuuacucucugaugaguguucagcagcagucaccaucuuagcugaaucagagacucaggccccccaaaccucauuccccaucauuccagagggcaugaggccaugagcuaauggugcucuuucagauaacuuccucagauucuguaacaagaugcugccuucuucucuguuagaauauaacaugcugaaugggacuuaaugaaauuccuccccuucaaaaaaaaaaaaaaaaagaaaggaaacuauugcaagagugagcgguaagcaaacggcacugcagacuucugaaaggcguggugcucagaagagcauuuuacaagcauguggaauguggauaaggcuuaauggcacauuaaucaacuugccgguugcuacaaggcagccacaauaaagcagguaacaggucugaaaccauuuggcggaucugugacuccacccucuuucucugguacaagaaagcauucagaauccaagugaacguugcuacaaaaagaagcagauaaauaggagauguuaugcuaauuaguuuaauagacucauccuauaauguauacuugcauuaaaacauucacauugugcuccauagauacagacaaugauugcaugcuaauuacaaguuaaagcuggggagauagcugaauggcuaaagugcucgccuugcagacccaaggacuugaguucaauccccagaacuugugugagaaggcccuggcauuguggcucauucuucuaaucccaguguuggagaaauaucucugggauuugcugacuaguuggucuagcuuagaugcugaguuccaguucaaagugagagacucugucucagauagauaaauagguagauagacagacagacagauguugcaugaguaggacacauguugcaugggucaagggugcagggaugguuagggcaauaagagagccuauauguaaaucuacuuucuaccaugccugacugaacuaaauucagucaccaagacccucagaacagaaguagagaacuggcucccacaaguuguccuaccuccacauacacaucucuacucaaaaaaacaaaacaaaacaaaaaaacuaacuaauuaaaaaguaggcaguuucugggggugucacuuuuauuuccucagaugaagagcuaagacaggagccauacccaagcugcauacacaccucgagccuuaccuucucuguuagggauuaaaggugugugcuaagggcgugucuggauuccagccagaucauaucuuuggaugugaucccuugccaguucagccauauugcuggauuaaaauuucucuacaccuuuagguguaaaggaaccaagaguuucaguaagagaagcccuguucugaggaugguacugaacaaagaggaaugugcaaacccagaggaaaugcuaagcccagagcauuuccuucucuguucuaacuaaaccaaggccuaggcccaaaagcuucuagccuccuuacaaucuaaucuucuaaccugacugacuuaauucagcuucuuugggcuucuaacugaauugcuuugccuggccucauacuaacuugggcaauauguucuaaucuucugcucauugacuucaccugucucgcuuguucccucuguaaccugucucuguaacacugucccaguaaaacugccaugcacaaacaccaccaccaccaccuuuuuucucucccugcacugcucuuaaauagucucucuuccucugauguucuccugugaggugggcguauccuaucucugauucgucacuuugccccucaauuagacaucacuuuccagcauggcugcuuccuuuuacaaacuaaccuuaccuucacuguuagagauuaaaggugugugcugauggcaugucuguauuccagccagaucauacuacaaucuagggagugucuggauuccagccgcaucauaucuuuggaugugaucccuugccagaucagccauauugcuggauuaaaauuucucuacaccuuuaaguguaaaagaaucaagaguuucaguaagagaagcccuguucugaggaugguacugaacaaagaggaaugugcaaagcucagccucuauuugcagcaagucugucuuuccuacaaguggcucuaguuccaucaguguccuuagaacaguauccucuaacaguauaaggaccucaaaggccauacaauucaaccuccacccaagaaaaaugucuccucuuaacauacaaacaacauaggauagcauguuaguguccagcccuuucagcuaugcaguacccaccacuuguaccaccuucuuaagcugcaguugaugccaacucaaugacgaggauuccugggcuggacaccauuucugccuccuuuuaaaugccucaugccagcccagcccugauauugucucugcagcuacccugccagggacccccacagcaagggaucuugugagcaaaacugccucagauucccucugucaucuccucaugugguuucccaaccuuugguagaggcagaaaaugcuaacccagccguuccaagguaugcuguucaaugcugccaauugucagaaauucucucuccccagcuggauucucugaucaggagggcuuaggaguauagcuuggugauagagggcuucccuagcacuugugaggcccuagguuccauacucaacauugcaauaaaauagcuguaguaguaauaauaaugauugugauaaugauaaaacuaaaauuuuuuaucauauuacuaguuuguuauauagaucauucauuuuuccccaaacuuauuugauauguuuuucucaccuauagaauaaagacagacaguaacuguuuuugccuucccgugugucaccaggaccaaaggccuccaugugucgagcuggaacaguuacagagacugaguaucuugaacucugagggcuaugguggccgcacaaagaggaaguccuucacaguuaugcagagucgguaguaggaggcccucccugcugcugggcaagucugggaggaucuaaaguaggagagaacggaagagagggagacuugccucauccacuugauaccauaauggcucaagggagucugugagggugacucuaccagagacuccuagcagugggggauauggagccugaauggccuucucuuguagacaggcaggacucccaauagaggaauaaagacagcagcccacccacaaaaccuuugacccaaaauugguccugccuacaagaaguacagggacaaacauggaacagagacaaagauggagcagagacugagaauggccaaccaauggcuggccaaacuugagacccaaguuugagacccaugggcaagaaccaaucccugacacuauuaaugauucucuguuuugcuugcagacaggagccuagcauaacuguucucugggaggcuucacccagcagcugauggagagacccacagccacacguuagacagagcucagagaggcuuguggaacacuuggggaaaggacugggggaucugggggcagggugaggggauagggacuccauaagaaguccaacagagucaacuagccuggagucuugggaccucccagagauccaccaaccaaagagcauccaugggcugagugucaccagaaccugggcuccccgaacacguagcacaggugcagcuuagucuucaugcaggucucccaacagcuggaguuggggcuaugccugacucuguugccugccuguggaucccauuccccuaacuggaccaccuugucuguccucaguuagagaggaugugcauaguccugcagugacuugaugcgccagggugaguugguacaggggguggagggccccccuuuucagaggagaaggggagggggaggagcuucuagaagggggacuggguagagagggaaagccugcaauugagaugaguaaguaaauaaauuuaaaaaaacaaaaacuacaggagauagguaaugggcacuagguggaagcacaaugcaaggaauaagaucagugucccgccuucccaacaguacccacauccuggcagaggcacacacugccccucacccucucccuccaaauuucucaacugauccuugguuggguaaagacugccuagugcucugcucccaaggccucucaccaguuccuuucuuaaacagucacugugucuccgguacacggggcacaagcauggauagagcucaggaugcagccugagacuuuccaucucuccccccccccccuuggugccugccccccccccuuggugccugcuagagaggggaccucauuaguuaucaacaauaguugcuuuuagacaugaauguggccacaaauggauagaaauuccuucuuaggaaaaaaaacaacuagguuuuuuuuuuuuuuuuuuuuuuuuuuuacuuuuugagacgggguuucucuguauagcucuggcugcccuggaacucacucuguagaccaggcuggccucgaaccuacucccugggauuaaaggugugugcaccacugcccagcuccuguuuuuuugguugguuuuuuuuuuuuuuagauuuauuuauuuaauguaugugaguauccuauagcugucuucagacacaccagaagaaggcaucggaucccauuacagaugguugagagccaccuugugguugcugggaauugaacucaggaccuuuggaagagcagucaguguuccuaacuacugagccaucucuccagccucccagcuccuuuguguguguguguguguguguguguguguguguuuaaaucacaaauagguggagacuguagccuaauauuaauagagcacuuuccuagcauucuggcaucacuagugccaccuuuuauuaaaaauaaaauuaacaccuggcaugacagaauauacuguaaccuaguucuaggaagguauaaauaguagauagagggcucacuggccagccagucuaaccaaccacugaagaccagguucagggagaccuuguuucaaaaauaagguggacagacagugauagaggugauguuggagugucuaucucacuaucagcuucugauaccuggccuggugccucuaguacuuggaaggcacagacagauagauccgugugaguuugaggccagccuagucuacaaaauguguuuuuguccagucagagcuguuuuucuguuucaaagagaaaaaaaaaaggcaaauaucaacuucuggccuuuuccacauggcacaugcugggauauuaagaguuuucacagggaagcaauuagaaaaagaagcccaagggugcuccuuagugguggguuugaagauccucugaacuaagcaggaacucaucccaacacauccuccugccaagcacccccaugugacucuaauguuggcgggaaggagaguuaucccaugcccugucucgugagccugugaacuuucucugcgccccuacucuucccuugcagguggguuuucuugcacgagaaggccuaccaagugcgggacacggccauugaguccucaguaguaacaaagguaaaaggcuucggacgcuaugccaacagagucauggaugugucggauuaugugaccccaccccagguauagugcccuaccccggggaccugugcaugcccauauccggggaggauggggacaaagggcgagugucccaaaccagcaguacuguuugagaaacaagaaccagccuccaaaaugcaacacuggauaucaagaagcuagacucccccaccccacccccgacccuguccugccuguguuuuaauggugaccaauacaggaaaaaaaaaagcaagaggggccaucaggugguuagaaagaguuggauuggaugccagcugccaaguuccuuuggaugccccuuguuagcccugccaccuuggccaaaucauucuaccuaggacuuccuguucuguggaguauaaacagcuuccugccuccacagauugggacugggcuuuuccucucccuucuccucccaagggcacuucugucuuugucaucaucaccaaaaugaucguuacugaaaaucaaaugcaaggauucuguccagaggugaguggaacaggucaacgaagcagacuggcaggaguagggcaaguggugugaacagagccucauagucuggccucggagcugugacuccaccugccacccacuagaggccacagcuaugggaacucgugggaggcaaugggaauuaaugggcugaccagggccaacagaggggccuucauacaccugugacccuguccccccacagaaugaggagaaguaccgcugugugucugacagccagugugggccugagcgcuucccgggugggggugagugcaguccuuuccccccucccucuccaaccccaagccuucaugggacucuaaagggcagaggauuuggugugaggauagcccuuuucaggaaauggguccaaccuacucuguagacuuaagccaaugucacagagguuugcugggugcccagacccagcuagggauguggagguggcaugguuacggccccaggaguuuagucuggguacuacagagugguacacagcaaguaguacuaaggaaacagaggacuaugggaggagacccaggggagggagcaagguuguuucagagaaguggcuucaaagcccuccuagaaguggucugaagauggcaagauggagcuucacgaaaagcacuccaggcagaagggauagcucaggcucagaggcaaggaagaaggguucugggcuauuuaggacacaugcagcagguuagcuugccuggcucaucugccaggaucccuggugaggaggggcaugggggugguaaggggcaggaugccaacugucagcucugcccuccagggauccucaccggccgcugcgugaacuacagcucuguccgucggaccugugagauccagggcuggugccccaccgagguggacaccguggagauguaaggcucuaagcaucccgaagcuaauggaggguuauguggguccccaacuaguguucuuucuugggguaagaaugugaucucagugugccaucucccuugcucugccucugccucucacccucgcugccucaagcccgugaucuuucuauaagaugccuucuuucaagaggcaccuauaaagaaagauuccugagaaaagcccccugucuccccucuaauggagagcugaagccccauuucccccacaggccuaucaugauggaagccgagaacuucaccauuuucaucaagaacagcauccguuucccucucuucaacuuugagaagugaguccuugauucuucccuuauucacccugccauagaggucacucauguucucuccaucuccccaucuccacggagccccugucccuccacagaccucgaucccagauauccgauagccaauuucucugccaguuuuccugccguggagcucugagcccaaaugggaguucugcuuggagcaggggaaagacaacuuaaacuggcuguggacaccgaggccuccugcaguuggagucugaaguguuugucacuuguauuucuucccaucucaaacccucaaguggagaguuuuuugucuuacuuugcucccacugccucucgacuccugcauucaacaacugucugguagucguguauccauccugucaggcacugaagagaugcaccaaguaauuaggagagacucuggucacuaagaggcccagccugguaguuuggagaauuagccacauucauagcccuacuaugagauggaacaugauggggguuucaaaaucaugaggggaaaguggggugauauaugggaagugacugagagauggugcagguagaugccuccccuggauguggagggccugaagcauccagaagaugagagcauuuaggcauuuccaucuuuauuuuaauucugggccuaacuacucuccucuuuccaucccaggggaaaccuccuuccuaaccucaccgacaaggacauaaagaagugccgcuuccauccugaaaaggccccauuuugccccaucuugaggguaggggacgugguuaaguuugcugggcaggauuuugccaagcuggcccgcacggugagaacuugucccuucccugugacccccuaccuuccuaucuaccuggaaagcucagccuuagacuucagggaaagccacugggaugcugggcaggaacuucagcaagacaaugccaccugguggaagcacucuagaccugcagaucccuggaucccaaauccuauccauccauccccagugaucuugccucuaccuccccuauccucaguugcccauucucucauuccauuucaccucagaagaggccuuuggucucggaaaaguaccacaccacaggacagugagcugcaguaguguucugaauccuguguuguaucguggggacuuuaaagauccaaguucuuccccuaaagggcaccagucaugcucuucccuccccacugccaccuccuauccagagaagggaaagaauuuacucauuggaaacccucagcccugacuuggcacaagggagaccucauauuuggcccuuuuuucaggguggaguucugggcauuaagaucggcugggugugugaucuggacaaggccugggaccagugcauucccaaauauuccuucacucggcuagauggaguuucugagaaaagcaguguuuccccuggcuacaacuucagguaaaccccacuccuaagcagaaguagaggacacaggcagccccaaaaaaauucgucucaggcaaaagugcacaaucggaaggaaacuccucguguccuucugcugccugucaggcuucaguuccagcuugcgaaggacuucuugacagccguuccugguggguggguugugcuaugagguuuggauucaugucuuuaaaaaugauccaacuaagaaaucugcugagguaggucauuagaucagauggccaaaggucaucuggaguaauugauucuguaauucuuuaccuguuuuuagcuacaaugugccucuuuuguauccagacagccccacucccugugcugcaccugaaauuuuaaggcucuuacucccaaaaaguaaucacaguaucuggccuuguuucuuuuuccaaaaugguaacuuggcauuucuuuccaaaaccaggaaaucccacgauucacagacagcaacuaucgaucacuaguucuuuagggauuuucgggcagggagaagcuuuuacauaucaucuaauugauauuccauauggcucugugcccuaaaggauuuuuacuuugggggcuuuuuccauuaggaaaaagggaaaccgggggguggggggaggaacucugggugaacuguuuggaauagcugagcccuugaacaaguccuugaccucuuccuuguccauguccccaucugugaaaugcuaguucaccugugaauccuacuggucagugcaugaauugcuuuggauuucaguuuuguucucucucucucucucucucucucucucucucucucucucucucucucugugugugugugugugugugugugugugugugugugugccaacacucaugauguggcauauguacagaagucaaagggcaaacuuugcuuguucuuugaggcaggaucccucuuggucauuagugcaugucaggauagcuggccuacacacuccaagugauucuccugccucugcuccccagcaccuaguaggaucacacugggaugacagaugccagugccacugcaucuggcucuugcacaugaugugaacucaggucaccaggcuuauacacugcacacuuuugucaugugaguuaucuccucaguccaucccuuaguuugugaaaaucccaaaacuucuuaaagauccugauuuaguauacaauguuaugagguaaaaaagcuaagaagacuaaauagguagugguggggcaaauauauaggagacucuagccuguggguugaugcaaccacauuccugcuuagguauucccaccuaaaucaacacucccucacacauggcuagaaguuugucuccuaggucaaucuaaguccuaccacauugauaauaaagauuaacaaucacaagucuucauuuugucaacuugacacccaagcauauuguuuuuaaucauaguauuucacuccugaucucuaaaaucucauguucauuuuauaauacaaaauacauuuaguucaucucuauaagucuucaauauuucaacagucccaaaaguucaguagcauaaauggaguuguuggaguuugucaaaaggcccucacucacaaagaccacagagaucaccaucgcugcaaaacacaugaggauuuuuaugauucuaacauguuggggacuccccucucagcaugaaggccagaagagagacacugaacaaagaaagaacacacuuuuuauaccuuuguaaggggcagauuugagcaacaggguuuucauugguguagcaaguaacccuuucaggcauuaguugguuugcauagugacuaaguaaccuuuggccuagugacucacuuugcuugcccccaugguggguuauuaugauuugcagcaaagcaauaguacauuuugaacuuaugggucagcuauuaaugucacagcuauuaaugucacagggaauccuagcaaggucagggugguuuguggucuuccucagaauucaguauggggcaggaggggggggcaggagaagucuucuaagaacuguuauuuuuguuaugguuauuucucuaagaacagcuaauauuauuuuggcagcuguaggcuuaaucauuuugacugcgaaaacuauguuuuuacauauguuuagucagccaacuuucuuaucuggcucugcacuuggccugugucuuaguuaggguuuuacugcugugaacagacaccaggaccaaggcaagucuuauuaaaaaaaaaaaaaaaaacauuuaauuggagcuggcuuacagguuccgagguucaguccauuaucaucaaggugggagcaugacaauauccaggcaggcauggcgcaggaggagcugagag

SEQ ID NO: 882 - RNA, 1081 nt, Mus musculus
gucauaacagguugauccacaggaaugaugcacagaaaucaaacuguugugacugaguucuucuucacuggauuaaccuccuccuuccaucuccaaauuguccucuuccugacauuucucuguguuuaucucgcaacucuucuggggaaccugggaaugaucauucuuauucaccuggacacucgacuccacauccccauguacuuuuuucucagccacuuguccuuuguggaugccugcuccucuucugucauaaguccuaagauguugucugacauguuuguggauaaaaaggugaucuccuucuuagguugugcuauccagcuuuguuuauuuagccaguuuguagugacagaauguuuccuccuggccuccauggcuuaugaucgguauguugccaucuguaagccuuugcuguauacucucaucaugucccagcgagucuguguacaguuagugauuggcccuuacagcauaggcuuuguaagcacuaugguccauauuauuucugcauuuguccuuccauacugugguccaaaucucaucaaucacuuuuucugugaccuucuuccuguccucucacuggcaugugcaaauacucagaugaaaaaacguuugcuuuucaucguggcugggauccuagguguauucagugguauaaucauauugguguccuauguuuacauugccaucaccauccuaaagaucaguucugcugaugggaggcgcaaagccuucuccaccugcucuucacaccugacagcagucucuauucuuuacgggacucucuucuuuaucuauguacguccaagcuccagcuucucucuggauaucaauaagguugugucacuauuuuauaccacuguuaucccuauguugaacccauucauuuauagccugagaaauaaggaagucaaagaugcauuaaucaggacauuugaaaagcaguuuugcuacagcuuucaagauaaaauacuauaaauauaaacauuauuagauaccaggguaucuaauucaauuuuugucauucaauaugaaaguguuuagaacuuuuaacugagauguuuggguuuuagggugu

SEQ ID NO: 883 - RNA, 1149 nt, Mus musculus
aaaacacaagcccaaggaugugauaguggacauaguucuugaaaggcauugauugauuuauacagugugagacucagaaaugucgauacauucaccagguuacacuguacgaagaauuccagugaacaaugugacagacaccaccauguuuauacuaacaggcuucacugaugacgcugaccugcaagucuuguuauuucuucuguuuuuugugauuuaucuuuuuacucucauaggcaacuuaggacuuguuuugcuugucauuggagauucccggcuucacaauccaauguauuauuuuuuaaguguuuuaucauuccuagaugccuguuauuccaccguugucacuccgaagauguuggucaauuuuauuucaaaugauaaaucuauuucauacccugguuguguaacagagauguuucucuuuguuacguuuggaaccacagaaugcuuccuguuggcagcaauggcuuaugaucgcuuuguagcuaucuacaauccacuucuguaugcagugaaaaugucaccuagagucuacauaccucucauuauagcuuguuauucaggagggauuaugcaugcuacuauacauacaguggcuaccuuuagccuuucuuucugugcauccaaugagauuaggcaugucuucugugauauuccuccauugcuugcuauuucuuguucaaacacaaauauaaaucagcuucugcucuucuauuguguaggcuccauugagaucaucaccauccugauuguccuggucucuuacaguuucauacucuuugcaauucuuaagaugaauucugcagaagggaggagaaaaauauucucuacaugugguucucaccuuacaggaguguccauuuaucaugggacaauucuuuucauguaugugagaccuaguuccaacuaugccuuggaacaugacaugauuguguccacauuuuauaccauugugauuccaaugcugaauccuaucaucuacagucugagaaacaaagauguaaaagaggcaaugaaaaagauuuuugagagaaauuucuucaugaacaaagugcauuuuaaauuauaauaacacuaaaaauaauguccguuguaaaucuguauuuuacaaagaaaagcauuccagaguuuuguuaaugguggcca

SEQ ID NO: 884 - RNA, 1111 nt, Mus musculus
augaugacucucagauccuggaagaaauauuuuuagguauuuauuuuuuauuuacaucucaugauaacaaggagcuguagacuauugaaaauaugagaguuuggaaucauacaggggucaaggaauucaugcuccuuggcuuaacagaaaacccuaauugucagguuccucucuuuuugcuuuucaguauaguguaucucaucauacuuguggguaauugggggaugauuaucuugaucuggcugaaugcccaccuucauacaccaauguacuucuuccuuaguaaccucucuuucugugacaucugcuacucuacugucauugcuccuaaaaugcucaucgauuuucucucagaacacaagucuagcacauucuuuggcuguguucuucagaguuucuuuuuugcaguauacauaacuacagaagguauucuucugucuaugauggcuuaugaccguuauguggcaaucgcaaaccccuuaauguauacaguuauuaugacccacagaaucugcagucagaugguucuugcauguuacuuggguggccucauuaauucccugacucacacaauagguuuacucagacuggacuuuuguggucccaacauagugaaucacuucuucugugacaucccuccucuuuugaagcuugcgugcucugaugcacacaacaaugagaugcugcuuuuggucuucucuggagugauugcuauuuucacuuucaucauugucaugguguccuauauccauauuaucauugccauccugagaauccgcucagcugagggaaggcgcaaagccuucuccacuugugcuucacaccugacagcugugauauuauuuuaugguucugugacauuuaguuauauccagcccagcucucaguacuccauggaacaggaaaaagucucugcuguguuuuacaccuuagucauucccaugcuaaauccucuaauuuacagucugaggaacaaagaugugaaagaagcagccaagaaguucauugguagggagaggagaaccucuugaauaugucacuucucugacuuagaaagcuuggugugaaucuucaaaguaguauuuuuaaaauuuauuuaucuuuuauaaaa

SEQ ID NO: 885 - RNA, 942 nt, Mus musculus
auucaucugaagauccccagucuaucaaacaauuuuuuuaaugcauuuuucacauccuuauuucugaagcuguaaauuauuggauucaacauaggaaauacaacaguguaaaacaaagcaacuaccuuaucagugucuggggaauagcuaguggugggacgcaaguacauaaacagcaguguuccauagaacaaggugacugcuaugagaugagaagcacaaguggaaaauguuuugcuccugccuccuguggacuugaugcucaaaacaguaaugaggaugcaagaguaagaaauaaggaugaccaugaaagugcuggucuggauuguaccacauaaagcaaagagcagaagcucauuaauaugaguaucugcacaugauaaagcaaggagaggugggauaucacaaaaaaagugguugacaauauuggaccuacaguauggaagcauaaaugcaagggauacaugcaccagugaggucacgcuuccgcuaaaauaagccaacacaacaaagcugaagcagacccuucgagacaccaauguagaguaaagcaguggguugcaaauggcugcauagcggucguaugccauugcagccaggauaaggcacucagcaucugcaaagcaugcaaagaaaaacaucuguauagcacauccacagaaugagaugcucuucuuggaggcuaagaagucuaccagcauuuuaggugcaauggcuguagaauagcugauaucuaagaaagacagauugcuaagaaagugauacaugggaguuugaaggcuuaagucaauauuaacuaggauuauuaagccaauauuucccaccaaaguuaagguguaaacuaugaaaaacaccaaaaauagcaugagucuuaauggcugguaaucuguaaauccgauaaauauaaacucuguuggcuugguauaguuuguauacugcauc

SEQ ID NO: 886 - RNA, 959 nt, Mus musculus
auuauauuuucacaaauuguuugcauaagaauuuucucagugcuauugugacauccuuguuucuuagacuguauaccaugggauuaaacauaggagucacaacgguauagaaaagagaaagaacuuuaucugucucaccugaaugacuacuauuggaucuaaaauauguaaucauaccugauccaaagaauaauaucacuacugcaagaugagaagaacaaguagagaaggcuuuggcucgacuuuugguugaugauagcuuuaagacuguaaaaaugauuuugcuauaggaaaauacuauuaacaggaauggaaacaagacaaauaagaaagcaccuaggaaaaccaucaucucauugauaaagaugucuccacaggccaggugaaguauugggggaaugucacagaagaagugguugaucugguuggaaccacaaaaugacagagaaaagauaugugaugucugcccuaucugaauugggauuccacuuauccaggagccaaucaccaguugugaacacaccuuuugguucauaacuagaggauaaugcaggggguuacagauagcaacauaacggucauaggccaucacagccagcaagaagcauucuguggcucccaggauaagaaugcagcacauuuguguagcacaggcaaugaaagagaugguccuucuuuguguuccaagguugaagaccauucuuggaagaguaauugauacauaacauaucucuaaaaaggaaaaguuaccaagaaaaaaguacauaggggucugaagagcagagucuacguuugugauuaguacaauggugccauugccuaauaggaugaaacaauacauagcaaucaauaguccaaauagaacccacuggagaucaggaacaucugaaaauccaagaagaacaaauuccuucagauugguuagauuuccuucuugugguuuuuguugaugguucauc

SEQ ID NO: 887 - RNA, 8016 nt, Mus musculus
caaagugagucccaggacagccaaggcuacacagagaaacccugucucgaaaaaccaaaaaaaaaaaaaaaaaaaaaaaaaaagaaagaaagaaaaacaaaacaaaacaaaaaaaccauccaaucagauggcagcauuuaucagugguggugcugauaaaaggcaagaagaaaaagaucuguaaaggugucauuggagccagagaagacacucagaucccgggacucugucaccuguauccuagucagguaaguccuuugccuaugcccggauacucuaauggguuuggagacauuuuagguauaagucuguauccggcacccuggaaucuauuucuucacauggacauugggauccauucaaaauccaggucugcuuucaccuccgguggccucggugcuucucugguugaauuucaaguguugagacagccucaaagugcuuuacagguuuaccuuagaccuggccagguagcuagcuucacuggguugggaaucaagguccucuugucugagccccauaagugcugggaugaccugaauauacaugcccccccuggccaaagguuuauuuauuuguuuauuuuauguaugugaguacacuguagcuguacaaaugguuuugagccuucaugugguugcugggaauugaauuuauaggaccucagcucauucuguuugggcccacuugcucuggcucaaagauuuuauugguuuuuugagacaggguuucucuguagcccuagcuguccugaaacuaacucuguagaucaggcugaccuucaacucaaaucugccugccucugccuccccagugcugggauuaaaggugugugccaccacugccuggcuuuuauuguacuuaaagauuuauuuuauguauaugaguacacuguagcuguacagaugguugcaagccuucaugugguugcugggcauugaauuuaugggaccucugcucacucuggccccaagauuuauuauuacauguaaguacaacaucgcugucuucagacacaccagaagagagcauuagaucuuguuauggaugguugugagccaccaugugguuguugggauuugaacucagaaucuuuggaaaagcaguguucuuaacuguugagucagucccugcauguucuuucauguugugauucaugcaaaugguggccuuguuuuugguugguuuuugaggcacagccucacucuauagaucaugaaccuuugaacuucgggcagaucuucugcuucagccucccaaccccuggaauuccuguugagauagucaagugucuugaacuacaauuugcuuggugcgcauuaaaaucuuguuuuuugcuuuuuaaaauauggucugguucuacaauacacauuagccucaaguguauaggaauauacugccuucaucuucaugaguguaaaaauuaaauuccuacauguaucuuauaacuccuuuuggaggcaggguaacaauauagaaugcagugucuagaaagcaugugugacacaggaugucuuuucucccuaccuccucuuccugauuauuaugaucauggaauaaaauguguucauuuuaaaauuuucagaauuuauacuugugauggaauaucauaugaucaaacucucuaucauaggcugacuuugacuguuaaucuuccucuuuguaccucagagcuaauggacuguaggacaugggccuguuucuucauaucuagcucuuaaauuuuuauuuuauagcccgugcugcccuucaagucagaaucugacccagguuuacaugaauauaugauauucucaauuacaacuacucaguguuggauucuagguauuuuccagauuaauauagcaauggagaugaagaccugaggcucuuaacauuccaggcaagugcucuaaguaacucaguuauauuaagacccaggcuuuagccagguggugguggcggcucacgccuuuaaucccagcacuugggaggcagagacaggcagauuucugaguucgaggccagccucgucuacagagugaguuccaggacagccagggcuacacagagaaacccugacucgaaaaagcaaaacagccgggcgugguggugcacgccuuuaaucccagcacucgggaggcagaggcagguggaucucugaguucgaggccagccuggucuacaaagugaguuccaggacagccagggcuauacagagaaacccugucucgaaaaaucaaaaaaaaaaaaaaaaaaaaaaaaaaaaaaaaaaagaaaaagcaaaacaaaacaaaaagaaaaacaaaacaagacccagacauuaauacucucuccaaggacuggagagauggcccagcagauaaaacaccacacuggcugcucucccaggugaccugguuuccuuugcaaguaaguacccaugucagagaucacaaacaucuaaaaugcuucuaacacccuuugcugaccuccugcacacugcaugcaaauaguguucauauauacaugcaauacugauacccauauacauauaauacauagcauuuuuaaaguuugaaugaauuuucuucaaagcucaaguuggaauuuuuuuguugguuuuuguuuaguuagguuuuaaggagaaauuacugguagucuaaguuuuaguuuguucaguaguuugagggguuuuugacacuggauuucauagaacccaggcuggucuuauaauucuggccuucuagcuuugucuccacuucuuugcuauguugggauuucaguuauggucucauuauaauauagauuuuuuguaaucucacaaauuauacuuaauggguugaaguuuuaugguuuaauuaaaaugauuuuguucuuugagacaguuuuucugcagcacuaguuguccuggaacucacucuguagagugggcuggcuucaaacucauaucuaccuaccccuccaugccaggggcugggauuaaaggugugugccaccacuacccaacuacuugaaauuauuauuuuuuuaaauuuuuauuuauuuauguauuuguguauguauguauguauguauguauguauguauguauguauuuauuuauuauauguaaguacacuguagcuguccucagauacuccagaaaaaggcaucagauuucguuaaggaugguuguuagccaccaugugguugcugggauuugaacucaggaccuucggaagagcaguuggcacucuuaaccacugagccaucuugccagcccuugaaaauuuuuuuaacgguaucuuuuuuuuuuuuucugagacagggugucuuagucaggguuucuauucccgcacaaacaucaugaucaagaagcaaguuguggaggaaaggguuuauucagcuuauacuuccacauugcuguucaucaccaagcaugucaggacuggaacucaagcaggucagaaaucaggagcugauacagaugccauggaggaauguucuuuacugguuugcuuccccuggcuugcucagccugcucuuuuuuuuuuuuuuuuuuuuuuuuuuuuuaaaacaggguuucucuguguagcucuggcuauccuagaacucacuuuguagacuaggcuggccucgaacucagaaaucugccugccucugccucccaaguucugggauuaaaauugugcaccaccacugccuggccuuuuuaacgguaucuuaaaaacaggcccguggacaguuuuuucuguuaggaggguccacaaggcacagugaggaaaguguaacuguaggaauguaguugcuggguuccuaguaucccuagggcauccaaucuccauccaggauggccugggucacaugaagugaccuuuauauagaaaaagaaaggaaaggguugaguugaaauguaauucugagguugagggauugccaugcaugagccaggaucaaaacccaacaucagccaaaaacaaaggggcucaucaaucuauuuuuauucuugcuuauuucuuagguaggaucccccauacuuggcucuaaaauuuaaaaauaagaacuaagcuggauguggcaguuccagcacaaaaggaggcugaggcaguuaggucucuugaguucaagggcagccuggucuacaaagugcauuccaggacagcacgggcuguuacccagagauagucuugacaaaugaagcaaaugagagagagagggagagagagagagagagagagagagagagagagagagagagagagaaggaaaauaaguaaauaaaaaguaaugccccauuucauagauucuucucugucuuugccaggcaggaucaauuuguugaaagcagaauaugcguuagcuugguauauagcuuuuucauugucucugaaaggcggauaauacuguuuuugcuuuauaaggaaugggcucugauuacuuccuccuggauucucccuuccaaaggaauuugggauucagaauagcaaaaguuggaacuggaugggacaaugguaaacaggaaugguugagagaggcuacacaugcugcauguauggggaguuugauuuugagacgagcaaauagugagugaaauagggaacaauucaagucuccaacauggcuaccauggugacagaugccuacuaugagggguuaauagccucauaagagagacccugaaaauacauugucuccuaauuuuucccccaggaucaucucccuaaagaucugucagaauggucagugccccacccacacuccaggaucaggcuuucaggagccuggugaggaaugaaguauugaccgucucugaugcggagugccuaauaagggaauucuucccaccucuguucaaggaggccagcacucaaaaaaaaccaaagacaauuaugauccugguggagcacuggcccuacccuugccuucauguuggguuguugauugauaaacccaacuuucagaucuuccaggcuauacuggauggaguagacacauggcugaaacggaaguaucgccccagguaagcugaauaccagguaaauggcuggugguggcacacgccuuuaguucuagcacuugacaggcuaggcaggugaauuucugaguuugaggcuagccuggucuacagagugaguuccagggcugccagggcuauacagagaaacccugacucaaaaaacaaacaaacaaacaaacaaaaaaucugugauaagaauaugguaaaagauggaucagagguuuuggcuggugucuuagagagcuauuggugccuggaaagcuugugagucuuuguauaguaaauuaugagauacagguuggugcagcuuuagccacagaagaaugacccugucccugcgucuccaccaguuaacagaaauaggaucugauaugcagguuagucacccuuaaucccaacacaugggaggcagaggcaggugaaucucugaauuggaagccagcuagagagccagggauacacagagaaaucaugaucugaaaaauacaaacaaaaagaaauaggagcugacagaacucccaagacaacugaauggagggaaauaggacaggucuucagaugcagcucaggcaaggugccccuuggcaacuagaggcuguguuggagacccaguacuggaaaccaugaguauacagaagacagcagaacaaggaacaaauaacaccagagauuaugaaaaaaaaguguugggucucaauuucccuucuaacacgucucuuguuuuauccacaggaugggaaggcuuaaaaagguugacuucagggaugcacagcaucaugcuuccuuagauaugcaggaugagagagaggguagagacuacuuaguaggaacuuugccuaagaagcaaauaguggaggaccacucaagaacaaggaaagagcguuugaagcuguuccaugaccuuuccuuuaugucuucucugcaugaggauaaacaccaaacacuguuauuggagugggcaaaggaaaggacgaguuuccugcaucugugcugugagaaguuggagauaggagcaguagaagugucuaaggucaggaauguauuaaaauuucuacagccagagcucaucaaggaguugaaacugaauacaguggggaaucuguccaaacuggcaaaauucguaccuuucauuagaaagaugagaaaccuucagaaacucaugcuaguacgcaccuuuggaacaaggacuuucacucaagaggagaagcagaacaucagcaagaucauuucucuguucugcaaacucagcugucuccggcaucucacuauugaugaugucuauuuucucacagaucagaugaaagaguugcucagguaagaaaggaugaagagcugucacuguuaccagagcaaaccucucacauuagagagcaguggguacuacuacucucugcaggccaaugcacauuuaacagugaacauguaagcaugaucguguuucaucuuaaaugaucacucagaaagcugagcaaugaagugaaguagauuauauggagagagcugcugugguagaagcccaguauccaguaagguuuccugcauagcaauucuaucugaucuaaugugaaggaaugggaaagagaagaggccacucacuacauagggagggcucagaucugcaguuucccaggugagcucugugauucaauuagauggaagauuagauugggagaacaggcccuccccuuccccuaauuccuaaauuguauaaggcucuuuggagaccaggacugggcuaagugggucagggaaugcaagggcugaaguugagugagggucaauuuaagagugaggauguaaagauuuauuucagggagucaaugauuuuucagaagccaucuuaauacacugucauggauuccaacuuucccuuccuguggucccuauuagccuaaagacuaaauaguaacucuugguccuugcuuucagagacuaggagaguuagcuguagaauuagccagacccaccacgacggugauaacuucagcaaaccaacaggccaaacggcauaccaucccauggucacucugaccccagccaugugaucucucccuaggugucuggaggccccauuggugucccucaagaucacccugugccagcucucucagucagacuuggagucauuugcccagcgcuggaacuacagucagcuuaaacaucuaugcuugagaggugucacuuuaacuaaccuagaugucacgccucuaagagauuucuuaaagcguguugcagcuaaccugcagacucuggacuuagaagacuguaggauggaugauucucacuucaggacccuucuuccugcccugaucaaaugcacccagcucacuagcaucaauuuguaugacaaugacaucuccgaggauguccuggagaacuuuuugcaccgcacuaccaaucugagccagcugaccacagaaauguauccugcuccaucagaggucuauaaugaguccaacuauguuauaguagagauauuuauucagauuuguucugaacuuaugaacaaacucauggaagucaggcaggccaauucagugugcuuugguuccucuuccuguuaugacugugauaaucguuauuuauaugaagaugauggggaugucacacuuuguuugugccaggaguaacaacaggaauauuccuuugggguacuaagaaauuccuagggacuggucucucauccagagaacccacauggcuuuggacauuuuucaaugugaugaaacaaugguccaaaucaggacugacucuucacuggcuuucugcuaucuaugaaauuauggucagauccuaaaaaccugcuauucucucugugcuuccagucauuaguugguccucaagauuguagucagaacaguucuuuguacacaguaauggagggauaggauguuuaaccuuguuucacauaaccucucaaugugcaauggggauauucugauauuucccccuucugcaucugccuggugggugggucauguguaaaagucuucaaaguagcaauguaugccaagccaaauccuuuuuuuaaauaaagauuuauuuauuuauuuauuuau

SEQ ID NO: 888 - RNA, 926 nt, Mus musculus
aaugaauauaggaaacuguuccuugaaugaauucauuuuugugggaguuaccaauaacccagagaugaaagggacgcuguuuaccauauuucuccucaucuaucucaucaaucuucugggaaauauuggaaugaucauuuugaucagaauggauccccagcuccacacacccauguacuuuuuccugagccacuugucuuucugugaucuuugcuauuccacagcaauuggucccaagaugcugguagauauguuuggcaagaacaagucaauuccuuucuggggcugugcugugcaguucuucauuuccuguaccuuugcagauucugagugugugcugcuggcagucauggccuuugauagauaccaggccauuagcaaccccuugcucuacacagcaaacauguccagcaggaaguguuucauguucauggcuggcguuuaccuggugggaacaucagaugcuuugauacauacaacuuuggcauuccguuuguguuucugcgggucuaaugagaucaaccacuucuucugugaucuaccuccaauuuaccuucucuccugcucagauacucaaguaaauuaccuggcacuauucacuauuuauggcuuccuugaacugagcaccaucucaggaguccuuguuucuuacuguuacaucaucucaucagucuuaaaaauccguucaacugaagggagguucaaagcuuucuccaccugcaccucucacuugacugcaguugcuauuuuucaaggaacucuacucuucacguauuuucgaccaaguucuucuuauucccuugaucaagacaaaaugacaucucuauuuuauacccuugugauuccuaugcugaacccacugauuuauaguuuaaggaacaaggaugugaaagaggccuuggggaaaaugaaaaggaaaagauaga

SEQ ID NO: 889 - RNA, 852 nt, Mus musculus
accgaugcaugggcagcaacacgggucacgaugacagauuauggcaaggaacaacgcaaugaguuggagguucuggagaccaucuaccccaacuccugcacaguauuaucagaaagcccaccaagcuucaccauuacugugacauuggaggcuggagaaaaugaugaaacuguccagacuacucucaaguuuacauacagugaaaaguacccugaugagacuccacuuuaugaaauauucuccaaggaaaaucuagaagauaauggugucucagacauuuuaaaauuacuggcauugcaggcugaggagaaucucggcauggugaugauauucacccucgugacagcuguucaagaaaaguuaaaugaaauaguugaucagauaggaacaagaagagaggaagaaaagaaacgaaagaaaaggaagcagaagaagcagagaagaaacuguuccuuagcaccccuguuaugauugagaauuucuugcguuggaaggccaaauuugauacagaacuccuggaaauuaaaaagaaaggaaugaaagaagaggaacaagcaggggaaaauaaacuaagugggaaacagguauuugaaacagaucauaaucuugacacauccaauauccaguuccuggaggaugcugggaacaauguggagguggaugagucauuguuccaagaaauggacgauuuggagcuagaagauggugaggaugauccuaacuacaauccuguugccccagggagugaguccucagacugauggacugucccagucuccagagaggcgugaccgccacagcaucugugccuaugcugaggggguuuggaucuuccuuuucuuuuuguuuuug

SEQ ID NO: 890 - RNA, 929 nt, Mus musculus
aucaccauuuauucuuuaauuuuaccacagccucuuucacaucuuuguuccucaggcuguaaaucagaggguucaacauuggaaucaccaggguguagaagagugaggucauuuugucuugaucuagagaguaggcagaacuuggccggaaauacaugaagagcauaguccccuggaauacugcaacagcagucaggugggaagcacagguagagaaagcuuuaaaccgccccucagcagaaccgaucuucaagacugaugauaugauguagcaauaagaaacaaggacuccagaaaugguacucagcucaaugaacccgaaaauugugaauauagcuaacucauugaccucuguaucugagcaagauauuaauagaagaggaggcacaucacaaaaaaagugguugaucucauuggauccacagaaacacaagcggaaggucaggguuguauguaucaaagcaucugcuguucccaccagguaaacuccagccaucaggagggagcacagccggcuggacauguucacuguguagagcaauggguuacugauggccugguaucugucauaggccaucacugccagcaguagacacucagaaucugcaaagaugcagaacguaaaaaacugcaaagcacaaccaacaaugggaaucgauuucuccucaacuaaaagauccaccaacaucuuggguccaauugcuguggaauagcagaggucacagaaagagagguggcugaggaaaaaguacaugggugugugcagcugaguguucacucuaauuaagaugaucaucccaagguuggccagaagauuaaugagauaaacaaguaggaguguggugaagaaggucacucucaugucaggguucuugguaauucccaagaagaugaauucaucuacugaggagcaauuuuucuuuuccauu

SEQ ID NO: 891 - RNA, 914 nt, Mus musculus
gaugcauaacuauaguguuacugaguuuauucuuuuuggauugacacaggauccagaaaaacagaaggcaauauuuggagucuucuugauucuuuaccuuaugacuuuaauagggaacuuccucaucgugaugaccauuaagaugagucagacacuugggagucccauguacuuuuuccucuucuauuugucuuucgcugaugcuugcuucucuacaacuacagcaccuagauugaucauagacgcccucucgcagaaaaaaauuauuacuuauaaugaauguaugacucaggucuuugcagcucacuucuuugggugcauggagaucuucgugcuuauccucauggccauugaccgcuauguagcaauuuguaagccucucagauauacaacuauaaugagccaacguauuuguggcauauuagugauucuugccuggguagggucuuguauucacucuucagcacagauuuucuuagccuuaagauuaccauucuguggcccaaaugugauugaucauuauuucugcgauuugcagcccuuauugaaacuugccugcauggauaccuaugugauaaacuugcuaguugugucuaauaguggugccauauguaugguaaguuucacacuacugcuuaucuccuauauuuucaucuuauacucucugagaaaucacaguguagaaggaagacgaaaggccuugucuacaugcacuucucauuucauugugguggucauauuuuuuggccccuguauauuuauauacacacgcccaccaaccaccuucccaauagacaagauggugucuguguuuuauacaauuggaacaccuuugcucaacccucuuaucuauacucugaggaaugcagaaguaaaaauugccaugaaaaaauuguggugugguaaaguaugac

SEQ ID NO: 892 - RNA, 1092 nt, Mus musculus
uggacauugaucucaauaugccauuucuuucuuuguagguuaaacauuuguaagcuacuucuuaccuacugcagacauugacaucauguauaaccauacgaugacugaauucauucuguuuggguugacacaggauccagaacaacagaaggcaauauuuggagucuucuugauucuuuaccuuaugacuuuaauggggaacuuucucauaauggugaccauuaagaugagucagacacuugggagucccauguacuuuuuccucuucuauuuaucuuucgcugaugcuugcuucucuacaacuacagcaccuagauugauugcagaugcccuauugcagaaaaaaaucauuaccuauaaugaauguaugacucaggucuuugcaguucacuucuuugggugcauggagaucuuugugcuuauccucauggccuuugaccgcuauguagcaaucuguaagccucuaagauauacagcuauaaugagccaacauaucugugguguauuagugauucuugccuggauagggucguguauucacucuucagcacagauuuucuuagccuuaagacuaccauucuguggcccaaaugugauugaucacuauuucugugauuugcagcccuuacugaaacuugccugcauggauacuuaugugauaaaucugcuaguuguaucuaauaguggugcaauauguacgguaaguuucauaguacugcuuaucuccuauauuguaaucuuauacucucugagaagccacagugcagaaggaagacgaaaggccuugucuacaugcacuucucauaucauuguggugaucuuauuuuuugguccuuguauauuuauauacacauggccaccaaccacuuuuccaauagacaaaaugguaucuuuguuuuauacaauuggaacaccugugcucaacccucuuaucuauacucugaggaaugcagaaguaaaacaugccaugaaaaaguuaugggguaauaaagugugacuauacuugauaaagaauauaugaagcuucuaguuauagcuacuaaggaguuaauuuugauacaugaauuaaaaaaauaaagcguuucugagaau

SEQ ID NO: 893 - RNA, 1092 nt, Mus musculus
auucucagaaacgcuuuauuuuuuuaauucauguaucaaaauuaacuccuuaguagcuauaacuagaagcuucauauauucuuuaucaaguauagucacacuuuauuaccccauaacuuuuucauggcauguuuuacuucugcauuccucagaguauagauaagaggguugagcacagguguuccaauuguauaaaacaaagauaccauuuugucuauuggaaaagugguugguggccauguguauauaaauauacaaggaccaaaaaauaagaucaccacaaugauaugagaagugcauguagacaaggccuuucgucuuccuucugcacuguggcuucucagagaguauaagauuacaauauaggagauaagcaguacuaugaaacuuaccguacauauugcaccacuauuagauacaacuagcagauuuaucacauaaguauccaugcaggcaaguuucaguaagggcugcaaaucacagaaauagugaucaaucacauuugggccacagaaugguagucuuaaggcuaagaaaaucugugcugaagagugaauacacgacccuauccaggcaagaaucacuaauacaccacagauauguuggcucauuauagcuguauaucuuagaggcuuacagauugcuacauagcggucaaaggccaugaggauaagcacaaagaucuccaugcacccaaagaagugaacugcaaagaccugagucauacauucauuauagguaaugauuuuuuucugcaauagggcaucugcaaucaaucuaggugcuguaguuguagagaagcaagcaucagcgaaagauaaauagaagaggaaaaaguacaugggacucccaagugucugacucaucuuaauggucaccauuaugagaaaguuccccauuaaagucauaagguaaagaaucaagaagacuccaaauauugccuucuguuguucuggauccugugucaacccaaacagaaugaauucagucaucguaugguuauacaugaugucaaugucugcaguagguaagaaguagcuuacaaauguuuaaccuacaaagaaagaaauggcauauugagaucaaugucca

SEQ ID NO: 894 - RNA, 926 nt, Mus musculus
aaugcagcacaacagcacugucacgaaguuuauacuacuaggauugacacaggauccccugaagcagaaaaugguguuuauaaucuucuuaguuuucuauuuggggacuguaguggggaauacacucauuauuaugacaaucaaguucagucgaacacuugggagucccauguacuucuuccuguuuuauuuguccuuugcugauuccugcuuuucaacauccacagccccaagacucauuguggaugcccucucuaaaaagaacaucauuuccuacaaugaaugcaugacacaagucuuugcucuccauuuauuuggcugcauggagaucuuuguccucauucucauggcuguugaccguuauguggccaucuguaaacccuuacgauacccagucaucaugagccggcaggucugugucaucuugauuauucuugccuggauagggucuuuuauacauuccacugcucagauuguuuuggcauugagacugcccuucugugggcccaauuugauugaccauuauugcugugacuuacagccauuauugaaacuugccugcauggauacauacaugauaaaucugcuauuagugucuaacaguggugccauuugcucaagcaguuuuguaauuuugauuaucucauauuuugucaucuuacacucucugcgaaaccacagugcugaagggagaaaaaaggcacucucuaccugcacaucucacauaauaguuguuaucuuauucuuuggacccugcauauucauauaugcacggccaccaacuacuuuuuccauggacaagaugguagcaguauuuuauacuauuggaacacccuuucucaacccgaucaucuauacauuaaggaaugcagaaguuaaaaaugccaugaaaaaauuauggcauguuaaaauuaugaccgaauaag

SEQ ID NO: 895 - RNA, 929 nt, Mus musculus
aaugggauauggaaaccuuacagaauuuaucuuacugggacuuuuccauaaugaggaugucaaggcaauaugugcuguguuguucuugcuuugcuaucuugcaauucucuguggaaaccugguuguucuucuuacuaucaagggcagucaacuuagugagcagccaauguauuuuuuucucagcuaucuguccuucauggauguuugcuucacuuccacaguagccccaaaauuuauuauaggccuauugguacaauguaacacaaucuccuacaauggcugcauagcccagauguuuuaugcacacuucuuuggugccacugagauauucaucuuggugguaauggccuaugaucgguauguagcuauuugcagaccccuuuacuacaugaucaccaugagcagacagguauguuacauccuugugauaggcucaguuuuuggugcuuuuauacacucacuugugcauguacugguuauuaucagacuucccuuuuguggcagcaaugaaauagaccacuacuucugugacauauucccccugcugaagcuggccuguacugacacaagacuccugguuauuguaaucauuacuaccacaggggugauguccauucugaccuuuguugcauuggucauuucuuacaucaucauuuuguccaucuugaggaccaggucaucagagagccgccgcaaagcucuuucuaccuguggcucacacaucaccguuguauucauguucuucuugccacucaucuuuaccuaugucccaaugggugauucuguuggggacgacaagguguuugcucuguuuuacaccaugauugccccauuguucaacccucucaucuacacacugaggaauacagacaugaagaaugccaugaggaagguguggugccaagacaaacucuuugaaggaaagugaa

SEQ ID NO: 896 - RNA, 938 nt, Mus musculus
gaugcaaaaccagaguuuuguaacagaauucauauuccuuggacuuucacagaacccuaaaguccagaaaauaguuuuuauuguauuuuuauuugucuacauugcaacuguugggggcaacaugauaauuguggugaccauugucuguagcccagcauugauagacugccccauguacuucuuuuuggcauucuugucccuauuggaugcaugcuucucuucugucaucacaccaaagaugguuguggacucccuguaugagaagaaaacuaucuccuuugaaggauguaugaugcaguuauuugcugagcacuuccuugcagcaguagaagugauugucuugacagccauggccuaugaccgcuauguagcaauuugcaagcccuugcacuacucuuccaucaugaacuggaggcucuguggcacacuuauggggauagcauggacagggggcuucuugcauucuaucauacaaauuaucuucacguugcaauugcccuucuguggaccaaaugucaucgaucauuucaugugugacuuguucccauuacuggaacuugccugcacugauacucauaucuuuggccuuuuagugguugccaacagugggucuaucugcaucauaaucuucucuauuuugcuggucuccuauggugucauccuguucucucugaaagcucacaguucugaagggcgauggaaagcucucuccacauguggaucccacauugcaguugugguuuuguucuuugucccguguauauuuauuuaugcacguccuccaucugcuuucuccuuugauaaaaugguggcgauauuuuauacuauccuaacucccuugcucaauccugugauuuauacuuuucggaauaaggacaugaaaaaugcuaugaagaaaguguggaagagguuggcagugguuucugauggaaagugag

SEQ ID NO: 897 - RNA, 1029 nt, Mus musculus
auggagugcucuuagccaacagucuauuuacacagcuagcacaauaugggauaauuuuuaguguuuaucagaaacugcaaucaguuucuuccacauuuuccugauggcauucuucauuuccuuauuccugaaaguauaaacuacagaauugagcaauggggucaacacugugguaaauacaacagcauuuuucucaaaggaaaaugcagauauaggucgugcauauguuaauaugcaugggacaaaaaacaaaaccacaacaauaauaugggauccacagguugagagggcuuuaaauuucccuucagagcugugggcucucagagaguacaagaugacaccauaggagacaagcaaaauagagaagauuaugaugcagauagacccacuguuggcaaacaccaaaaugacaaauauauaggugucagugcaggcaagcuucaguaaugggaacaagucacacauguaaugaucaaugacauuggguccacagaagggcagcugcaacaugaauauaauuuguaugauagaaugcaaaaagccuccugcccaggacaccaucacaagauugccacagagccuccgguucaugauggaagaguagugaagaggcuugcaaauggccacauagcggucauaagccauggcugacaguacuaucaccuccaucccagugaagaagugcacagcaaacaguugugucaugcaacauucaaaggagauggucuuccuaucauagaagaagucuacaaucaucuugggggugacaguggaagaagugcaagcauccaguaaggacaggaauaucaagaagaaguacauuggggagcccagcagugcagggcuguagaugauggucaccacaauaaucauguugcccccaauaguugcaagauagaucaacaaaaauauaaaaaacaguauuuucucaacuuuugaguucugugaaagucccaggaauaugaacucagugacacagcucugguuguucaugauucauaauaugauggugaaaguaagauguguuca

SEQ ID NO: 898 - RNA, 942 nt, Mus musculus
gaugaauaauaucaccgaauucauccuugugggcuugacucagaacauggagcuucagauauuuucauuugucguauuuuucauugucuaucugcucaccuuggcuggcaaccugcuuaucauggucaccaucagcagcagcaaggcccugggauccccgauguauuucuuccucucuuuccugucgcugauagauggcugcugcuccucguccaugacuccuaagaugcuggcugacucucucucugugcggaaaaccauuucuuucaguggcugcaugacucaagucuuugccgagcauuuuuucggggcugcugagauuauucuucucacagugauggccuacgaccgcuauguggccaucuguaaaccgcugcgcuacacgaucauuaugaacagauuuguguguggccucuugguggggguggccugggcuggggguuuuauucaugcgaccauucagauccucuucacagucuggcugccuuucuguggucccaaugucauagaccacuuuaugugugaccugaccccuuugcugaaacuuguuuguauggacacacacaaccugggucucuuuguugcugccaacaguggcuuuaucugccuguuaaacuuucuacuucugaugaucucuuauauagucauccucgaugcucuaaaaucucacagcaaggagggaaggugcaaagcccucuccaccugugucucucacauuacuguggucaucuuauucuuugugccuugcauauuuguguaucuucgcccaguaauuaccuucucuauugauaaagcgguggcuguauuuuauaccaugauuacuccuauguuaaaccccuuaaucuacacucucagaaauacugagguuaaaaaugcuaugaagaaacucuguaucaaaguugauuaaauugagaaagaaugaaucacauaacauaaauuaac

SEQ ID NO: 899 - RNA, 1020 nt, Mus musculus
uuuuuccccucagugcccauuaguuuggacucagcagcauuccaaucccaauagccaauauccagacucuauuucucaucuacuuucauuguccugaaccauagacucuucauggcuuucuucacuucugcauuucucagggaguagaugagaggauugagcaggggaguuaucacuguguagaacacagcuaucaucuugucuacagguaggguaucagaaggccucaaauagaugaagacacauggaccaaagaacaauauaaccacagugacaugggauccacagguggacagugcuuugcgccgucccucagcacucugaguucucagauggaacaagaugacuccauaggaugcuaagaggaccacaaagcugaucaccgacaguguucccccauugacaacaaucagcaaaccaaugaggaaggugucugagcaggcaaguuuaagcacaggaagcaaaucacagaaauaauggucaaugauauuggggccacagaagggcaaaggaaagaugagaaguauuugagcaaaggaaugcacaaagccuccuauccaugcuguucccaugaggacugcacacacacuuugguucaugaugcuaguauagugcaggggcuugcagauggccacauaacggucauaggccaucauugugagcaggaaaaucucagugccaccaaagaagugcaugaagaaaagcugugucaugcagccccauacagauauggauuuuuuuucagcuaggagauccaagaugaguuugggagcuguuguggaggaguagcagaucuccacaaaggagagguagccaagaaagaaguacaugggggauccaagacuucugcuggcuaccacagugaccaccaugagaagauucccaagcacaauggccauguacaagagcagaaauaucacaaagcaaacuuucugcaccucuugauuggaagagagccccagaaaaaugaacucagucacauuguguaugucagccaugagggagcaaggugggugguac

SEQ ID NO: 900 - RNA, 150891 nt, Mus musculus
gggaggggaagagagggggccgagcgcucggcgcggcucccugcagccggagccgcaugacgcgcggaggaggcagagggagcagccggggccgcgggagccgggagcugggagccacgcgcggagggugggcgccgcucgcuccgccccgcgaagccccugcgagucuaaggccgcggccgcuccgcgccaggcgcgcuaggcuccgccguguggccgccgccgccgccgcugccauguccccggggaagcccggggcgggcggagcggggacuaggcggaccggcuggcggagaaggaggcggaggcgucggcuggagacggagacgagggcgcccggcuucgggcacacggcggggcgcgucccgggcacguuccagggcgcgcagggcaugaagcccgcggcgcgggagacgcggacacccccgcgcucgcccgggcuccgcugggcgcugcugccgcugcugcuguugcuacgccagggccagguaagcucucgagugggccugggcgugugguaggaagacgcgggccgaauuggcaucgccugcaccugcccgggugucacccguuccaggaacacccggcgagggucugagagaucgugguccugggagccuuccuccuggaggaggcuggcagggaucuuggccagccuccugcucccgccacucagccccuucccuggcucccgggugccaggggaagggcaggauuccgggguccccagggugucccccgccgugcccguugacucuuccauagaagcucccgcaugggcugcaggcggcgguggcccggccuuucccggagcuggucacgucuggccagcgcgggcccugcuugcgcgcccgaagcggccggagggggcguguuugcggagggcuguggaugcggagcagggacggccuggcugagccgaggccgaccuacgacccggccuggaggggcacgagggcuuggacagaagggcaguggcgguggccgggugcuuggggacaggcccuggcgcugggcggugggcgaagcgccggacucagaaccgagggcgcuuuuugugggggaaaguucccagccuugccaagguggccgcucaaaggcgucccuugaggcugcuggcucuguucucaucaucgcuccugagauagugcuggcuuuucugggugugcauucgugcuuugugggcgcuagcuauaccccuccccuccagacuuuucuuuucuuucuuuuuuuuuuuuccuugcuucacuuuuuuuuuuccgauaauggugggacucgaauuuuggaucuuuucucucagugguauuuucauggcaggggaugugaugcaaggcagcuggggggacauucccauuuugcagauagggaacugagggagagaagugaaagaguggaaucacccagcuggugcugcgggagcugagcaagcgaguucugccucacagccuucugggaacuggcuguggucuugaacucugcagcugaaaguggccuggaggaugcucuugucuugcuuuuugcuaaugaaagucucacuugcuuuauagguaccagcucuaaacagacagugagacacaaaugaagcauaggcuggggauggaaacugacuuugagagaaagcuuugcacacacacagacacgggagggagggagggagggagggagagagagagggagagagggagagagagagagagagagagagagagagagagagagagagagagagagagagaaugagaauaugaauuguucuagaggaaacauaggcacuggggcagcagagcaggcgggcagaagaagggagccugagucugggccugaacuaauugucagcaaggguaacuuauaguuucuaaagcaggauuugcacaggacucgugguguuguccccagcaaauaauucuuuacuggacuggguaagagcugagucugaagaagaaccagaguugauuuugccccuuuuccccaauuccaucuuuagcaaaaagcaucugcaggaaugggggaggggacacaccauuucauaguagaauuguuugaauggcuuccauugaagagugaaagaauuuuguaaauauauauuauauauguacaccacuuuucauauaaagccuuuucagaugggauuggggauuuauuggggaacauuguggaugggcugucuucauccuuucccuguaggaaauucaugcacagcagucuuugacguuaaagaaaaagaacugcuucuuauuugaaguuccccuucuccaagaauucgcuaugcagacuaggguggcuucaagcucauugagaucuguuugcuuuuguguuccauguacaggaugguguggucuugaaauucucuugaacuaaaauuuauauuauagaaacauuugagcuacauuucucuuuaguuuaauuugauuauacauauguauauguauguaucugacuuuuguuucaacaauaguagaaguugcaagcugugcuuugaaucagcaaaaaguaucuuggguaaauuuaucucuugcccaauccuuccuuguguuucuuuagcacauugcuacccuccgccugccuuggguuugcuuauuuccuuccucuaguuuguucuguagaaacucgagaguccugucuucauauucuuguuuuuguauuuguuacaaaauaggaaauauaaaagguuucaugaagaaauaucuccaaaaacaauccuuuucagcaguuucauuuugauauggacucuugcaggggaucggcaccuucucucucucucucucucucccucucucuggugcuggggauggaacccaggguaggggaugcgcucuaccaccaaguuacauucucaguuuuagagaagcccugcgcuuuugaagugacucagagacugugucaggggcagauaggaugggucauugaguaagaguucuugcuacacaaacaugaggaucugaguucaaaucccuagggccaguguaagauguggagugugguugugugugccuggaacgggcauacucugggguguggagacucacuggggcuuguuggcugcccaggaagagacccugucugaaaggaauacgauucuguguccucugcccagugcaagcacaggcauguguauccauacacauguacauauuauacugaaaacacauagacccuuauccucagccuccccccccuuuaaaaauaagcuccccuccuuuuuuuuuuuuuuuggacaggguuuuuuuuuuuuuuuuuuuuuuauguugccagcccuggcugguagaacucauuauauaaaccaggcugcccuugaacucacagagaucugccugccucugccucucaaguuuugggauugaauuugagcaccagcaugcuuggugcuagcucuggugguugaagacagcuccagcccuucaaaccucuuagaugaggacauuggacuugagagaagagguuauuuggcaagauaggauuauaaaaaagccaagaguagagcuugaguuaccagucugggccuaggcuuuuuggcuguguuuucucuucgagcacagugcuguguuacuguaugccccaaacugcuuacaaauugaguuuaagagucaauuagagcaggcuuacaauuaucuccagcuccaggggcucugaccuucucuuuugaucuccacaggcaccaauacaaaugugacagacagucacauaguuagacacacauacacaucaauaaaagaaaaauaauaaaucuuuuaaaagucaauuagauuugaaauauuuuugauuuguguguguguguguguguagaaaguaagagggaacuucuuugauggcuucccuaauguugauuuuucuuuucagaagaggcuuucuuauuuauuauaguacaagcaacagaaauggggagggaaagaaaggaaagggaaaaaaaggucacagaaaagacccagcucuguuuggacaccgaugaggacagggcguggaagcuggaaacugagaugccggaagcaucaguacuuaguaggcccggaaaagccauuuuugaaacuagcaucucacucccuuucuccaagacaggacgggcagucagagaugacccuagugcaaggacuuucaugggugugcuaucuuaacugguccauuucugagugcauucguacucucuaguuuugguuuauguauguauuaggcaguguggcaaagugaucucuccuuccucucuugagacauauaguccuguuagguuccuuaaucagcuugacagcagucuguauuaaaauagaugcugaugauagcgacaaaacaaaaacaacugguagccacuuggucucacaguguuccuuuuugcuuugucuugugucauuuggugggugauaacuuuguauuuuuaugucuuguggcuaaucuauaagccugauuauuuuccugcuucaaccagaguacacacacuaaauauuuuggcuccucuuauaacugcuuuuuaaguucucacaggagugacuuuauuuuuguuuugcuucagaacaacaaaggaaaacccaaccauucuguuuuguuugcagacaguuuaagaaaacagagcaaauugguuuaugguuagucugugacuuugggcuaacuucaaguucagccccaggacaaagaugaccaggaauacccaagcuuuccugagcagagagaauccuggcuccagagugagcaauuuuggucagcaaagagguuauuuagcuccuaaaaguaaugcuugaggcuggggccgaguuucuggaugacuguaggccuggcuuuagccagugcaucacgaguaauuacuucuuaguucauucacuucuuggccaggggaauuauuuugaguggcggauaagaugcaauuuucuguguauuucccuuuuagcaucaugccaccgauaauauuauaauuaauagguagcauuaggugugucgggcacuguguuagggcuuuuaaugaacugucucauuuggccauuucagaaguucuggugguagcugcugcgcauguucucaguuuaugauucccaaguagagccagguugcucuguugcuccaguuuccuguucugugcuguagaaguccuggugaugucgagguuuucaguguguaacugagcaucgaugccaggcuuuuguggcaagagauaggcuugagggucccgaaccuugauaggccugagaauuauuuuggauucuuugugucccaaauuaugucacaccuucaggccccucauggcuacuucuguuucuuugaagccugaguauguauacaaaggcacaccugccuuguguggguaaacugaaguggaagagccugggugugggcuugcucugccauucaguaguuacaagaacaagccagucacucucugugacucuucauuuccuuaucugggagcuggaacuaauacuuccugcuuagcugggugguggggggaucaaauaagauagaaggaccgcugucaaguaaaaccugaagccugaugcauuuguucgaagugguugcugcuguuaugugggggcauuucaggguaguaagggaagaaaugggacuuugagucauuaguucccagaacaaauauuuguuaaauguuucuccaagguguuuuaucuuuuugauguuagguauuauuuuacuuagcaaaacaguauuuguaaacuauaucaagcccaugauuuuauagucagacuaggcugcauaugggcucauaauaaggaaauuuguuuaaauauaauagugaaucccgaggaagcagucugaguaaaugaucuuuaggugugaggugguuuugggaaacuacacaggugauaaaugcuuaguuuggggccagucccaaagccaaggcgauucugggaaagaagagauugcuuucuuaugggccgugaggguggggaugauuuagaugaccagauacauagucacaguggcgauguuggcagugcgucaucccugaggucccuuuagagagagagcuggcgcuggacuugccagagaaggaaugguugguggguggguggguggggguggggggggggugggcaaagagucccuggguggagaccuguggaagugucagaaaucucugacuagagaagucuaccgcgggcuuaucaccaucugguagggcuggcuuuccagugccuuuucuggugaccccucagaggacaggagauguaggaaacuuguuauuacuuccuuauuagugacagcuguagccguccuauugucucagaauuuccauggcauggaaaugccuggguugggggguagcggcgaugagauggccgaagcgagcgcgcggcucccacagaaccucuaauuuuagacaugcaaauaauuuucaguuccacuuuuccuucuuccuguuagagggaagccguacccugcugcugccauuucugaagcuugugcagacaaugcugguauuaugucacaaacuagcugcuucuccggggcaggaguguguguguguguguguguguguguguguguguguguauguaugugugugugguuauuuuccuggguagaugugccaggggccagcccaguguaauuucaugccuucugaauaacugagcgauauuaaaacauggcaccggcaugaacuuuauagcgaugcugucuuucuuuuugacagguaaugagacuuugaguagaaggaaagaauuguuucccuaaaggagugaaaacgugggauuuugugucguuugaguuguuuccuuuaguagcccuuuuuuauuuauuucugacccaggauaucacugugucucccaggaugcucuugaacuggcguuccccuuguaucugcuuccuuagugagcggagguuuacaggugcacaccaccaagcccagacuucucuuucuuccuucccaacccccacccccucucucuuucuucuuuacacagagucucacaguauagccuuuuguuagucucaaauucacuauauagacuagucuggccuugaacucauaaagaucucccuaucucugccucccuagugcugggaggaagggguguaccaccuugcccuggcauacucagcuauuaauaaacucuuuagagugguuuuuuuuuuuuuuucuuuuucguggugcugagauuggaacccagggccucucauguacagagcaagcacucucuacaucuuuagccccuggacuaguaaaaaucccuuggaagcccagauuaacccccccccccccgccccagugugaacccguguacauuagacccuccauuucuguguucuugcuucuaggguccagucagacgugcucagcugaggcuaggauuacuaaguagaauauuuugagagagcaaccacagucacaucauuuuuguuagaguguauuguuauaacauuccauuuuuauuaguuuauuauugcuaauaucuuacuguaucuaauuuauaaaucaaauuuuaucauagauaugucuuguuacaaagauuauuauauauaauguauguggaggucagccauggcuuuaggcucugagagucuuggagugucuccuccaugggaaaugcaaggcuacuguacuguaggcucagaaagcuaucaguccuauuuaaagauagaguauuuauuuauuuauuuauuugaggcaaaccuugaauucccagauaugccccugccucagcgucugggaguauacuacaugccuugccaaaacagacuuccaggaaaauuucuucuugugaugaacaggugcugagagguagaauggucagagguucuucauucucagcuacacaguaaguuuaggacuggcugcauuacacgccaugucucaugccccaguccugaaaaugguucugugggcuggccauguagcauuugccuaacaccagguuugauacccagcauuucccuauaaacacuacauuuuuauuugugugcaugcgguguguacaccaugaagcaugaguggcagucagaggaaacaggagaguugguccucuccuucuaccuuguuaguccugggguucaaacucaggucaucagguuugguggcaagugccuuuaccuacugauccauccugguggcccauacaagcuacuuauagagcauauuauauacauguuaugcuugguacguagccuccuaauuuauccaguuauuuuggagauuaugccaguuuuuaaccuguguaaaccuauucuuuuaacuaacuuccugaaagccagccauaugggccuuccuucccagugggcccucggcuguuuccgugugaccccucccccucccucaaguccuucuccuggaaugccuuugguguuuauuuuuuguaacugucacaguaaaacacaacgaguuaagaauuauggaagccuggggugguugcugugaaaauugcagagguaguaaauagcugagaggcucuccacugguguaguucugucugguccuaggauugcagaaauaggagcggcggcacugcuuaaagcucagagcucuugaaugguuuuuggaacuguugccccauugcaccuacaaauguggguguaaagagaccugcuucuccauacccucaccuggguugaggauuguuaaacuucuaugugugugcaaaucugagagguuaaaaaaguuuaucaugaaaauuguuuguaucuuuaauuuugaguuaguugaauaucuucuucagugucuggggugggguguuuacuuguuauugacucuugaaaaaaagaaaaaaagaaaaagagaaaaagagaaaaagaaaaaaagagaaaaagagaaaaagagaaaaagagaaaaagagaaaaaaagaaaaaagaaaaaaaggaaaaaaggaaaaaaaagaaaaagagaaaaagaaaaaaagagaaaaagagaaaaaaagaaaaaaagaaaaaaaaaagaaaaaaauucuuuuugggccggggagaugguucacuugauaaaguacuuggcgugcuaaaauaaagaccaaggaguuuggauccuggcgucuguguaaaagccuugaauagaggucugugcucgggaaagaggcaggguggaagcaggaggaucccuggaacuugcuggcuugccaguguagccagugagugagcucuggguuugguuaaaaaucugccucaagggcuggagagauggcucagcgguuaagagcaccgacugcucuuccagagguccugaguucaauucccagcaaccacaugguggcucacaaccaucuguaaugggaucugaugcccucuucugguaugucugacagcuauaguguacucauauaaauaaaauaaauaaaucuuaaaaaaaaaaagaaaaaucugccucaaaaagauaaauguagacagagauauagcagaagacaucaccugaaacucugcccucacgugcacgaguaccugcauacacaccacacacaucagaacuuuuguuuacugauuuguucauguacuuugcaaauuaaggaaaugaguucuuauacucucaucucuguugcaaaucagcuguccuuaauuguuuuugguauaacccuuauuccuuaggaucucagaugacagagcuuggagucagccugccuaguuggagaccugacucuaucaccuaacuaacuguaugcgcuuggguagcuacucugaucuuucugcgcccuguuguuccuaucucuacaacacugguaauagugcuacuucuugcccaagucauuggguaaguuaagugagauaacauucugccuuguaaauggauguagaauuauaaaaacauuuuagaaaacauugaagauagaagauagaaucuaaaguugaaggaaacauaaugacgcuacagauggucugaaguuggacguaagagauuaggucuaccacggauuguggacauucugugcacauuccucuuccuucccgugaauguaucaaaaggcagaguaguggagaguugauaguccaguuuaaguuauauuucucuugauaaguguguguauuugaauuaauaugagguaaaugaccaugggagaugaucaaggaguggccaaugugaucuuagcgccaaaagaagcacaaggacacuauguccauuacagaaaaaccugucuugcuuugagcauuucucuucgccuuguggcugggccagcuccggccgugcccaccuccugucacuggcuacauuuucuguagaguuauuuuaagcuaccaauggaaagugugaagaccuaguucuuggcuuugacugcugggagguguguggcugcgacagugggcucugacgaggccaccuguuuccacgcaggcagucaguacugugcauuuccuguagcugaggagccaucacugagcccugggcucuucuccuccugagcagacugcuggcaguucugugugcagagucuuuggauacugacggaguugcugcccagaacuugguucauggacuucggagucgcuuuccuccuagcugugugacguugggcuaucucgucuaaagcucagcaucucaucuaugcucagaucuuggcuguuguugaaucauuuuauucugcugagauguuagcaucacuuacuauuuaaaauaaaaaaguacuuauaguuuauaggugguuuuacacacaccugaacucauuuaaacccaccagcaucccuuugaguuugccacugugacucaggcucuguauguguguaugugucucccuuagacccuaucucaacaaaacauaaugaaacaaaagggaaacaugauguacuucagugcuagaacuugcgcaacaugugcuaggcccuagguucaagucccggcauuggaggaaaaaaaauuacaucauuuguuaaguauagcagcucacaccuguaauccuagcaccuggagacugaaccaggacuauugccaagaguuuagugucagccugggccacagagugagacaaaguccccuaaaaagggagaaaggaaaccaaaggcaauauauuuaaaacugaauauaaaauugaauaaaaugagucuuaaccagcacuuaaaaaugauagaacaggaaaucuuugaguuuacuggugagcacugugcugugaagcugcuucugcauugagcgguugugugugccuguuugugugugugugugugugugugugugugugugcacguauugcauguaaaguggcuuguaguagccagaaaaaaauuccaaaccuccaaccucaccuguaugucucugugugucugagcugugggaggugcccccugagggaaggagccaggccguguguguccaggcucugauuuacucaugucguuguguccuguguggcuggaagccaucaugugggugcaggaaugacuaaguucuccagagagacuuaggcagacacagggcugugagucccaauagggccuguguuucuugcugccagaggaucuugguggaagaaaccaugggucagugcuugacauuuuggcaagcgugcuugguagagagcuccaggcaccaccugguccauugguuuaaauuccauucuccuuuuggcuaccaaggaucacaucuaaggcuucgugaaugccuggcaaggacuugaccugcucagcuucuuaggcuuggguacuuuagaugagaacuuguggccagcacaggguggcugagacccuuggaagccaccaccauccacgagguagggggagugggggugcacaguguggagcccugacaguccuggcauuacccucggcccggaacugauuugcaugggguugagccaaccucaucuaggcgucuguuagugcuaacccagcacccauguucauuccauucccaugcuaguuuauuuauuuuuauauuuuaaacuuuuacuaucauuacuuuaagaacuuuuaauuuuuaucuuauguguguggauauuuugcuugcauguaugccugugcauuacacacaugccugcagaggccaucaggggauguuggguccuguagagcugcaguuaugaaugguuguaagccaccacgugggugaugggaaccaaccacagguccucugcaagagcagcugguacucuugacugcugagccauuucuccagugcuuauguguuuauuaaaaaaaaaagaauauaauaggacuauuaugauauauuugagcaaaguuuguuuuugagguugccuacuuacccaguuuauuuuuuuacauuuauuuauuucuuuacuuauuuauuuauuuauuuguuuauuucaggacacccaggacugugaauacagugaaauccugucuuuaaagaccaaaaccaaaccaaaccaaaccaaaaaaccaauaaauaaaagaaagcgaagucaucggcagucucugccgacucuguuaacuccaucacggcuuugcggggggaguuuggguuuccagugugaauccuauuuuacccagaugguguaaccuccuacacacaugugcugugacuuagguuuuucacuaaaaaaaaaaaaaaagcaauugggacagauggucucuuuaaggauaccccaggaagccagaagacagacacaaggcuucuucuugaagggucgcugcuaggcaguggaaaguaucugggaagucuguugaaaacaaacguggacaugucauaggguagauacuaagugugugaguguguguggggggguuauaagagacagaagagagaugccuacucugcugacccugagggacaaguucauuccuccguucuuuggggggccuugugccagcuugugaacuguggacacuacuugccagggaguagucucuuguggguaaccuagggauugcaccucauuucauugucuaguuaguggcugugauacagucuucaguuuuugaguauuucuuuugccaugcugaacuugacucagauaaacucaccucugaugcuccucuuaggagaaucuaaaaucacugaacucauaauaaucauauauauuucaugugaagaacugcuaacacuuuguauacauugacucuaauccuauuaugugggcacagagugggaaacugaggcucacaccuccauuguaagcguccuaugggguaccagggugagccgggcagggcaucucuacaggcaggucugggucucccgggaggacagcugggccuaaugguuguucucacagguggaugaacacaugcucagggcuguaagcacaugacaggagacccaggcuucccccaaccacacaagacaagacuaucuuuacuguggguuuuagaucuuggagcccuaaggugguaaaggcugugucugacuuuuuucgggucuuaguacugaucaaaggaaugacauagcagccuuguguauggccuccagccuuguugugaaugaacuuggaucuuacagagcuagaguguccacacagaucacaugacuucaggaugucccagaggcacaugggaagagcuucuguguugauggcagcguggauccguagcuaugugaccuugccauuugcacaagcauuguaacccccagaauguguaacuucauccgucccauuaggaagugccaggccacagagcuauugggcccaaugacaggaggucuccucagaucuuggugcuuggggagguucuuucauacucacccuuccuuaccccucuguuagcacagcaccuggggcugccgagugacacaggagaccugcuaaguguuguccugcacccaaggugugcucagcagcuucugccagccuuagcacuugcugucuugggcgauugccagauccugcuguguggggagugcaugcuggaaauugcagacaguagcgaguggggaucaauggaagaucuuacuugaaaugacguguuggggugggagagacucagacccuuagucuccaucugaccacaagguaugucacagccuuugacugucuuugggaagaggcacaugggauguuuaggguuuuuuuuuuuuuuguuuucuuuagagccuggcagguaggcuuuguccuugcucggcagcgugguuagggugagugacaaugacuucuuuuccuuuagcucagaggucuuucacuucaguaucauaaccauuuugggguggaccgcuuguuucagaaggcuuacccaugcagguagaauguaggauguagcauuucuagcuuccaccuucugaauguugguagugucccuuccuuaguugugacagacaacagugaauguuuuuuagagauuggcaaugucugcugagcagugagggaccagucugguggaggacuguguucucuauaauuauucugaagacuguuccauuuucucuuguguucccagccucaguuuccucuccugccaagugaggacgccagauaguuucgcuaccuugcuuggggugggacaggaagccugugguaaugugauaggauaguucugagcucugcugugggcaugugggggugaaagggagaccaauaguuacacggaguaguaaggccaggcgugccaaguuccacaccggagauaggcccuguuagagggagaucccauuacaaagagguucacugccaaguucucccucagcagcucccuguucagcuucguuuggaggccccagggcauacauacaacaggagagaaugcuuuuagagcuugugacacgggaggauggcaggaauguggcaggaggagaaacccacuuaaaaaggagcugccagccagggaaacuggauugguuuucuaaaaacucaguguucacgugcuacaucaggauccagggaccuccuagcuuagcuagcguugggcagaccugaucaggacacuacccagauuccagaaaaguuauucugucauaucuaccuaacugccaggggcugugcuggccucuuguuucucuuuuacaguuauugcguccauuuuagagaugagaugcccagaagcaaaggaaugagcuggcccagugcccgcggugugguguggcucuuguguaauuucacuucuauuacuuacucauaaacagcaacuuagcuuucaaaaccugaguuuuuccucacaggccaaauggggcuaauaaacaccucagaggacugugauccagauuccaugagaacaugugcgauagcucuagcacauaggaagcucuccauaaaugucaacggcguccauuguuauugucuaaaauaccagcgauagcagaggcaccugcuuggaugaggguuuccaggaacacaggaaggcuuugcccuccuaauccuaugcucuaucucaggccuggccaguaaauguuggaggugaagcugccaagggggugggauggggguggagaggacaaagagcucuagauucaggaaaucaggcaaagccugcccucugggauagaacaugugaucucauggucugaucagccucauacagguugagcucauugccaggcaaguggguaguuaaugauugcuagucaaagaaugucugcauuggaaacaaccuugggaacuugaagcuagggaaaccagaugguucuuaguuuguguccaucuugaaaugguugagagugacagcuuggcccccaaauagaagggauucuuagagucuuugggcuuuccugguucaguauaaagagaguacugggauugauuagucaugccuguuauggccacagggaaggcaaagggugguauaccuauuugcugaauuuggauauaguugauggcuaagacuugcucucgagaugcucacccaccaaaucauaaaacuguaauauauuauuuuuuuuaaaggaauuacacaagaauguuuaguucauguugggccugguggcuugugacuguaauuucagaacuuggaaagucgaggcaggagaauuuuugaguuugaggcuagucugagcaaguaauaaagaugaggaaaugaagcaggguaaguagauggagugaugauaaggagcuaugagaucuaaggaagaacacuccagcaagagacgggcccugaggggaauggaggggccaagucagccacaacugagcaggugacaaaaagucaccucaaaggggcaggguugaauugaggcugguggggaggugugacugguggucaggaucagacguucugggucuuggcucuguucagauccauauuaagagcaaguagaauagcaugacuccgcccgcccgcccgcccguaugaggcauugagaaggguaggugggagcagagggugggagggagggggggagggaaggaggggcuaagaccuaguaucugauagugugugauguuugagucccaagucucucaagucuuccuucuuuguccauaaugcuauguaguucuggguagccaugcuccugucuaagccuuguuuccugaagagauuuggccccuuugacucucaauccuggcuacauauuaaaaccacacaaggaguuugggaaacucagguauccagauucacuugaucuuauagagugccucaaaauggaaccuuccagaggcccccaacauggagucauaggugagaagggcccaucaaaagggggcucugaagucuugucuacucaaagugugauucuaaugcacgugugugugcaugcguguacacacacacacacacacacacacacacacacacacacaguguggagcagggaauacagcuuaguggcacagugcuugcaucccaugaaugagguucugcguuuaaucuccagaaccucaaauaaauggauggauggauggauggauaaacaaaugcaugcauuaccuuucgacacagugaguuccuccacacugaagacugugaaagaaaggggacuuucucaaggcugaaauucaaaaagcaaauguguguguguguguguaugugugugugugugugugcgugcgugcgcgcuauagugcccauguggaagucggaugauaacuuguuggagaauguucuuuccuucuaccauggguccuggggaucaaacucaggugucaggcguggcugcaguagucacauuauuggcucacacaaggcucuaaagaauauagguucugggaauugagcucaggucuuccugcuugcauaacacacuguguccccagggccugacuguaguuuuuaacagcugugguauacugcagaguaggugugcuguggucuacuuaauuuucuccuauugacuguuaagcaccagccagauuuucaccuuuuuaacaguaguucagagacguauagcuuuaggccucuugccuuuucugugaaguagagauuacucagaauuaacuuuuagacagcuuccugauauuugacuguaccugccagacacauccccaagagagaugcuuuguuuacacgacuaucugaauggauaagacugccuguuucaggacgccuacacuggcacuggguguuacuguuuuuuuuuucuuuuuaauauuuuuaaauuuaauauucacauuuucagacaugccagcugugugguggcugcugcauauuacuuucugaccacgugugacucauacagaaccaguuuugucuguuuugugugauccuuuuuuugagugggggaggguuaaucuaugauucuguuuuaaugcaugaguaucugucugagugccugauuaggggcauuucuuccuuucuuucucucucucucucuuucuuucucucuuucucucucucucucuuuccuuucuucuucuucuucuucuucuucuucuucuucuucuuccucuuccucuuccucuuccucuuccuccuccuccuccuccuccuccuccuccuccuccuuuuuuuuuuugacaggaucuucuacuaaacucggaacuugcaaucuggcuagauuagcugggcaguaaaugccucgaaucaaaccccugucucuaccuuacagcaccaggauugcaguuagguucugggauuugaacuuagguuuuuaugcauggucacccaguuuuguuuuccccucaaggaaaaugucuacuuuaaagcaaaucaaagaaugugaucugcacuugucuugagggaccuagaaaaauugcugauggaaccagagccagcugggccaccugucacaugaacuggcuucagggcucgucaggugcgcccaucucauuuucagaguucaugggaaggggucuugguguccaguggcuagcuuucaaaugaugagauugguggaugucucugcagaauggaagauggcuggauaucugcuagcuagcagauuggccucccuggcugagucuccagagggcagccuccacacccagaguggaagagaauacugaggucaaauuccagcuuugcccuugcugccugaccuugaccaagucccucccaccuucugcaucuucuaguaccaguagccuuaacguuucccacccaugaggacaucguguuaucagggauuuagcacaggaaguccugggcaugcuguugcucuugagcuaaccuaacuguggccugaggguuggggauaaaagaagaggaaagggccaguuuguguuucuuuucuguagccaguuccaguuuaguuggagacgugagcugagcuugccggagacggcuucaccucagcuucauguggguuucaaaggcacugcggcuaggggaguaacccaguagcuaugguuucugcccgugcuguugcuuugugugaauguuaggagccuagaccugcagugcaggaggcucauuugggguaccguggagggucacauuuggcaaauucagucuuauggcaagagaggcuugugcuggacuuggacuuggguaucugaugucugugugauuuagauugucucacagaagcaucaugggagaguuuucuuauguuguauguaguagucauuuauuuuuaguggcaauuacaaaacuaguuucauccggaucuaauucacauacaauaaaagccagccccuuaaaguguauagucacauuuuaaaaauuauauuuagggcuguaaaaccauuaucauugccaaauucuagaguuuuucucauuacucccaaaggaaauccuguauccuuuggaagucacuccugauucccuacuccccccagcuacucauuguguguguguguguuugcccaaucuguguuuguguaaacagaauaaggcagcaugugcccuugguccuuuuuaugacccucucucaugggcaugugcugguuuugauugucuuucacgaguugguggacacuuguuuuuugcuacuuggcuauuacaaaugaaacugcugugaauacuuuugcacguuuuuauagagaugcaggcuuucuuuuuaaaaaucuucuguauagguguguauucuguguaagcgguguguacgcgcacacucgugaggagucaggacaacuugugaugucagcccugucuuugcaccuuguuugagacaugucuuucaaggcuagcuggucugagagcuuccagccauucucuggucccaucuuggggugggaauacugggguuauaaaaccccacuacuguuccuggcuucaugugggcuuuagggaucugcacucaacccuuacuguguacacagcaagugcuuguacuugagcccuagcuuuucgguauagggagauuuaggcuuggagagagucagugacgggagcuggggccuuuaggaaguguuggauaagaaaaaccuguguggauuugcccugccuacuuuuaugugacccucugaggcagggucuguuccuaccccuuugcugaugggcuacacaguuagaaaguggcugggacugucuggcuguuaggcuuucugaagcugcccugcuccagucaguaugcuaggguuccagaggaaaaagccuucagcaaauggaucaugguggcaugcacauguuuguuaggauugguagggagagaugcugagggcuggggagggggaagccugcagcaugaccuucuguguaguugugacaggaaaaguauccuuuagaaucaugauagaggguaacauuuacagccuuugaugaucuuguguccuuugaacaucaccuuccuuaucuggaaccccaggcuuuuauccuggcuuccggccucccuugaggcugaguaugaaugaaggagugggagagggagggaagcagacagaugggagagagagggauaggggaagacaggugggagagggggcugggcgagggaggugggaucguuaccuacaggaaccugcagagcucagugaugguccagggggcacgggggcagcuagggaggaaauguagcaggugugggcagguagccugcuggucuaggaggauaucccaugcccacuuggggguucuggaacuugccaaagcuccuccuaaugagcuggcucucacccagccacuauugauuuuuccugguauuugaaugugagccuuugucucugggaagagugcuggcagccucccccauccuagaacacccucaucccuacuggacaucaccuacacugcugugaggcuucccagggcucugccagucuccugguggccugaccuauccggguuggccucucuguucaaguggcugacggugguucuuaucucugacucacagcuugccuggaguuugugaaaagccuugucagaaaauagagacagaagccucuccuuggagggguugucaugucgugaugauggucuuguuccgacgaugccacuauuuugcagguuguuuugaaucagucacuuuuuuuaaaaaaaaaagugugaugaacacauuugucuuaauaugaaaagccagacuuaugugaugcaaauuagaugcuuuuuaaaacccaaagccagaauucuccacccccacccccacaccugaauuagacugcaauugcucuuuuguguuuuccuuccuugugcucagugucuccacaguuggacauaggugggcccccuuccuguucugcgcuugaugucuuugcucugggcagcagcugcuugguugggcgcugcacuuaagaauuugagccgggcgugguggcgcacgccuuuaauccaguacuugggaggcggaggcaggcggauuucugaguucgaggccagccuggucuacaaagugaguuccaggacagccagagcuauauagagaaacaaaaacaaaacaaacaaacaaaaaaaacaaaaacaaaaacaaaaaaaaaagaaaaaagaguuugaguuaugaauauggucccuguacauuaaaaaaaaugaucagacccaaggguccaauccugagcaggaaggggccuugaugaaguguuuuauagauguugcuaucaggaccuagagaggggaagugacuugcccauggccacacagcuucucugugcucuuaaggcuuccgacuucagccacuuauuccuuuuggccugcccucucagauccuaaaguuccuauaguacacauauggcauguucagggaacauacuugccucugauaacguuuuugacagaugcugcauuaagcucugagguugaauucuugguaugugccauuccuuuggggagaagacuggaggagucuguuggauucuagagacacuaaccauuuccuuuccaucuggcagaggggaagcuggccaugccugacccauuucacagucacaccauaucugcuuucaguauaaaaaccaacccaauucuggaugaacuuagguuggcaaauuggggaagcugacuuugggagguagguuagggaagaaaaauaguuccuucuauauuaaaauuugcugacauaauacugaaagucauuguccuauucaugcuuggcugagauaggucacaccaugggugguaucagaggugcacuguuucccccaugaggauaaauugggaugaacuaggguggguuugcaaguuagaaaaagaagcugagcugggagugaaacucagggguacagagcuugucuagcaggcgcaaauccauggcuuucauuccuagcacuucaaaaacggggucaagacauacaaacaaacaaacaaaugcucccuggaacccagggguuggaaagagacucuauaaagcagcggggaucguggaacugaggacugagaugcaguccucacgccuacuuugaaagacuguugaaagacguaagaauaugcuuucuuuuaaagaugugugcaauaagacauaaaauauaaacccaagacaaaaagggacagugggcucaaccgagcaccuagaacgcccgcguggcuacugcucuggugcgcaugcgugucucugcucuccaaugugcuguuuggagcaaguaaggcaggccuggcugagccugagcucugcccuguaaguaccuuguuuccaggguggagacccccuuggggucgaaugacucuuucacaggggucgccuaagaccaucagaaaacacagauauuuacauugggauucauaacaguagcaaaacaacauuuaugaaguagcaacgaaaauaauuuuaugcuugggggucaccucagcaugucuuaaagagucacagcaggaaggcugagagucacuggucuagaccuuccuaagccaggcuucucauuuauaaagugagcauggugccuucuaccucugacacaucuagccuuucagaggaggguuuuuuguggcuguacucuuggaucucugugaguuagucagugcucuguggcucugaucagaccacaccagucuccaucugcugcacgaagcugaggaaagcucccuucuggcuggcauacauggcuccuacauacauaucaugaggcacacuacaccacguuucuuguacauauguguggucauauucuguguguguucacacacacacacacacacacacacacacguucaugugccugcacauguguuuuuaaaacacuaauuuaaucuucaccacagccugauauaaauaaaauccacacuuuacaguuuuccuuugugaacugagggaucugauaugcucagcaacuugccaaaagccagagagugguaggacuggauucuaacccuuguggccuuguggacccaggguaggcaauaucagagcuguguucuaacucacaggguggccagugagucuuccucuucauuuucuuuuucuuuuuuucaaguguucuaaaaaagcugaaaauauagauuaaaaauguuaagucuuaauuuuuuuccagugcuggagauuaaacauagggccauguguguacacaugcuccacuacugagcugugucucuaguccuuccuuuuaaaauuaagacuaaagagacauuucaucaauuaauagcacucgcugcucuuauagaagaccugaguucuguucccaggacccacaugguagcucacaaccaucuguaacacuagcuccauccgaucuuaauaaccccuuuugaucucuguggguaccaugcaugugcaugauaaacacacaugcauacaggaaaaacacucauacuuaaaacauuaaaaauuaagacuuuauuaaaaagguuugacuuuaaaauuugaaacaauuucucaaacaaaaauuguaaaaauagcaguucccaaauguuuuuuguucaaguuccccaaauuacauaauaugcaaaaaaaucgaaacuaggaaacuaacaguuuuggugcaauauaauacacccaucuauagacauuauucaguuuuccaguagucuuaccaauagccuuguccagguguaggagcuuacguuauguugaguggucguguccuucagucuucuguuuguacuggauauaacacuugagggaggagcaucagccaugggccaauggccugguguggggaugggguucagucuuaacacuacugacucaacccagcaaaaacauuuguagauggguagauggcuuaguuuuuaaguacuugcaauguaaguuuacuggcugguuuugugugucaacuugacacaagcuggaguuaucacagagaaaggaaccucccuggaggaaaugccuccaugagauccagcuguaaggcauuuucucaauuagugaucaagggugggagggcccauuguggguggugccaucccugggcugcugguccuggguucuauaagaaaacaagcugaguaagccaaggaaggcaagccaguauugaacaucccuccauggccucugcaucagcuccugcuuccugaccugcuugacuuccaguccugacuuccuuggugaugaacagcaguauggaaguguaagcugaauaaacccuuuccuccucaacuugcuucuuggucauguuguuuugugcaggaauagaaacccugauuaagacagcaaagugugaggacuggagaauccauauaaauggaggccugccuguaauuccagcuucagaaggcagagacaggggauuccccaggauaagcugagcauaucagugagcucuggguuugauugagagagccuguuucaguaaauaaguuggaagagcaauugaggaggauuucugacuucaaccucaguccucuacgugcauauaaagacaugugcacccauaaauggguacacccguaaccacauggcgugugcaaacacaugggauaauggaaaaagaaacaaaaacaaaacaacacaacaacaacaucaaaaacaaaaauaaacacaaacaaacaaacaaaccaaagcaaacuugaagaccauacccagcuuuccuuggcgaaaagugucuccuggccccaacaauuuugcugggucaucuggagucaggcuuuuguuuuguuuuucaagacaggguuucucuguguagcuguccuggacuucacucuguagaccaggcuggccucaaacuccuagagauuugccucugcuuucuuagugcugggacuaaaugugugugccaccacugucccgcugagucagcacuuauuuuugccuuuggucgggcccagcucugagguuagcagggaagaggcucggcuggaugccugcuacuguucggcuggugccaggcaugauguuaaugcuucuuucauauugucuguggaaguaugguggcaauccaguggcucuguucuguuguuacagauguggaaaccaagacucagaaaucgcacuaggagggagggccugcuguuugaacuugggucugagacagugccaagccccugauauuacuuaucuuacaugggauggugauaacugacucauuuuaguuuguuucuuaaauugauuacauuuguuguuauuaguucuguguguguuuguguggaguuuucuuuuuuccaccuuuguguggguucuggggauugauugaauucaggucaucaggcucgaguuguuaggcaauaagugcuuuuaucugcugagcuaucuugcugggacccuugauuuuaguuuuuaaaaaauacgugcuucaagaaagcacugaagccagguuugguagcguguggcuaugaccccaacacuugggagucugaggccaacacuugggagucugaggccagcaccugagaggugcugugcuucaaaaagaaaaagcaaaaacaaaacccagagagaaaguagucaggaagguuuuaggacggucugcugaagugacagagaacauuuguccccuugcacccaugauuuggguggcucuguguguguauauguguguguucucugugacuucauaugaggggggaaucuuugaaguguagacuucugggaugucugagaugguaacugcuacucuucuuuuuacacccucuucucuuuucugaauacuucugagacguacccuuguaaaucagcauguuuggauccacacccucucgcuaaguggcgcuaauugaauuacuccacagcuccaaggucaugguucaaagcugccaucugggcagcugugucaaaagguguuguguuguguuccaucugcccagaugcuaaccaccaugccuguugauucuacaggauuuccaugaguacccgcccuguguuagcuuccuccaguaccagcagagugaagguguaggauauuguccuccauagucagcacccauuauccagagggguugaauguaaaggcacaggugcgggucaccuauucaucugucucacggcagggguagacuuugagaaagaaugcuucaggcugcaaagacaacauagguacacaguagagagagaccagaguuaccuguggagggguccuuggaaggggagacuuccaggcugagccuggcaccuucccuggggucuguacacaggagcugcuuagagccuuucaaguuggcacugaagaugccagucuccacaguggaagucgaugucaagguccaugaggguucaugacauccaucuacaggcugcuuucauuucucucaaauacauaaauugaacaccuagaacuauggcaccauggaucagguggcucuguaggguuccccuuagacaugacugcaagccuaagcccuguagcauccaugggucagagaucaaagcugaauucuaccagaacuuggguaccugcaggagcaagggcaguuacauugguuacucacccaaugggugagugggucugagaacuugcagggcagcuagggagaugaggcuguugucccuccucucacccacuguuucgcagguacuugucaaucuuuuccuuccuggugagggcccaggagcucuguacuuacggugugguguaugcguguuacaggugccuaugcucaucauuuguguggccugaccuccugguucucugggagccugggugguggcuguggcuuguggagauaggcagcagugaguguuggcagcuguguggguaaauaaacuguaacacagggagggaaccaguugccaggcaccucugggcuuaguaagcuaaacagaacaugugacacauuccaugggcaaggacuccccggacauguacccagaucccuccugcccuacccacuucaaagaaaguaccuucuuugcaggggcugaucagaccccaagucucugagaucauggcucuugauuugggguguuucuuugcauucagguggccugggucaugggccugggaguucauuuugcugaaguuaggcugagccagcaggcuuuagaauguucacggguagccuauuguccagaugaagcauucuacaugggaagaacucgcuagguuugugucucagagugaaucaguggugguagagggguugguucgcagaggggaucccuuugucuggugcuguucugugacagcuguuucuccgggugcaggucccuuuuccuccuuaggaucaucuagagcccccugggguugaagaaaacuguuugggucugucucauuuuuugagggaaaaugaguguuguggucaggcaagauuggagaauguaggccaaagaaagucagaaauguuuuucuugugggaccuguaagauucauuaugcuagugacuccgagaaggaguuauaaaacauuucucugugcuuuuauuuuauugugucuuucauguuuucaggaaccugaaauauuuacuccuuaaauauuuauuuagcguccacuccgugcuggugauuguuuuagagccuuggucuacaucagcgagcagaucagaccaauguccuuugccuuggaggaacuuacauuuguucuaggaggagggaugagcuggucuuuauugaauaccuacucuguauuccgccaugagauuccacagcuaucuugcuugggacucauaaccugauaaaauauauucacuguuuuuuucaauuuaauucuuuuuaaucguauguguuaggguauguucccgugaaucuaggugucaauggaugucagauagaugagggcaucagauccccuagagcuggaguuacagcugguugugagccuccuaggaugggugcugggaacugaaauuagaacccugcaacagcauacacucaacugccaagacaucucucuagccuccagggcaccaucuuaacgcuuggguaaccaaggccgcaaggaguucaggauauguuuauuuucucugaauuguucucuuuuuggcuuaugucucugaauugugagaguugguggugagacaagcaacacuuuggggucugguguagggaugcugcacaccuugaugauauuaaaccgcgcaucccgguuaugagguuuaauggggaaguugcaccagaucugaaucaagcaggaaaagccauguuuccccagaacugcccaguuguuuucguguucuaggaagccagcaucuugugacugaucauguuucucaccggcuuuguuuacuaagaaccucagaacugaauuugucgcccaucuugacacuucugcaggaagagagcauauggcucucguuccuaggugcuaauccacuuccuggcuuuauuauuuuucucuaccuucaucuucuccuggcuugaucucuuugacuguccauuugaugugugugugugugugugcaguuugauuauuuuagucacuguaaaugacuuucuaaaacagagcugaauuuaucuaaaauuuaaauguaguaguaaguugauuagugccuagggaccucgguuuccauacagcugucuuggcuugggcuccaggcccuuucccuuucccagucagaagcuccaggcuccuuuguagugggagcuagucuguuuggccuuugcagucuuuuuuuguggguuccagaggaagcugcucuggcuguaguggaggucuuuagugguuugaauugaucugaaugucacauacagggcuggaaggaggcuuugugauguagcuugcuucucaguaagggcugcucagccucaggcaggaaagacauccugaugguuagugcugaguaaguucacaaucuaagguggucuuggaagagggaaccauagcacugucccacaggccaccccgugggaccuuucucuugacuauagauugauguaugagggcccagcuuauugugggcagugccacuccugggcaaguguccuggguuauauacaaaaugcaagcugagcuagcaaugaggaguaagccuccaucucugcuucaguuccugcuuccagguuccugccuugaguuccuguccugauuucugucccugcuggacuacaagcuguuagaugaagucagcccuuuacucuccaagucgcuuuuagucauggcuugucacagcaauaggaagcgaacagggacagacagaguggcuucuucuaacuauugcuugcagggaggacgucagccucugcuaagggagcggcacuccauugccgcuucagcucugucccauucacagcccucagcagugcuggacgagugguaggaaagaggguguugauaaagcagcaggccugaagaaguccagcuuccccugccagguaauagcugaggcugcauggcaguguacagccgcagccuccaggcacuugcuaagccagggaaccccaguggaaacucaguggagcaucugagagagaggcagcaugggaaguauggaagagguuaggauuugggaguuggauguuguggagcccaagugcuggccacgacuauguaugugugaguaaaauaauauuucucuuuaaaauaagaagaauccuguuuacacacacuaaagaaggugaagcaguuaguucaaggucacagagacaucagguagcugacccuauugugauguuauaugauuauauaggaaacaacuugguaccguuugggugauaauguguguguguguuaguuugguaggggcucagacaccauugggguugggaagguugugaaacccugagauuugguugggugagagcccuggggugcugaguauaucagugugcuuugucacuguaagauacacugcaguacaaaacagugcgccuccuggggguuggggggagauggaguugaggacacaggguuacuugggugguaucaccgaaaugcugugaagcgugaguuacagccugaaggcccccaaggcacucaucguagcugcugcguugguuggaauggccagaucaucuccagugugcagcaucagccuaucugcuggggacagacaccugaguuucuagcuccacuuagcaagccucaggggccccagaaaccuugucugugagaggaaugcagacugcugcucuuagcugguugcaccuaucugcagcugugugcauuacauauaaagagcaccuuagggcccgccaccugccaacaggcuguccugugaggcauggacaagggacagcucaguguauuacaguuguuuagagcucugggaugugacacuaggcugucaguaagccaaaaaagacagaaccauugucaacucugggagccuuggcuauugauuugagauugaggcucauucuguagccuaggcagguccuucugccuccgccuccugagugcugugauuacagaucacagccaccacaucuacugaagcuuuauaauuuuaaaaguacuuuauaaacacuaaagugcuuuagagacgcauuucccccccuaaacugacaggagcaaacucaauaugcauaaagauggagcgaacugccaggcuggagcagagaggagacuguagcacacaagugugaaugugauuuauuucugauuauaaaaauacuuuauaugacuuuauguggguuuugccaaauagagggaagcauaaaacugaggcaaauagaggaauacaugaaagcaccuauuauucuaagcagcuguaucaauuaauauaugggggggggaaccccuccagcuuuuuuucccugucuagcuuuuaaaaaaaauauuuaacaacaauaauagcaacaaccaaaccaaaccaaaccaaaccaaaccaaaccaaaccaaaccaaacuccaagcaaagcaaagcaaagcaaaacaaaacaaaaaccagaggcuugcuguauagcccaggcuggucucaaaauuguaaucuuucugcuucagcuuccagguucuaggauuaccugccauguuggcuccacucaguguuguuaggcaaauaguuuauaacccauuucaugauggaagcuacucuacacuuuuuuuuccuucaguuuguugagaguuuauuuuguaagaugcugacauagugcuggucacaaguucuacgucuggguugcugcuguguggagcugacagugugccuagucuacugagcccaggcgugaggugaccaugagaggcaggaagcccugcugagguucuugugagacacuggcuaaggcuggugagauggcucaguggcuguuggugcucgcugccuagguucuugugagacccuggguaaggcuggugagauggcucaguggcuguugcugccuagguagugaccgcaguucagucuucuagacccagaggagagaacugacucuggccaguuguccuccacauaugcacgguuguguagcuggguaacaacagcuaagugauguauaaccaugaugccuuugggccagagaaacagauucagugagagcagggcccuaaauaagugccagccaguggagggcugguuaccacuagcagaucugagugcuggcucccuuugcucuugaugagauuuggauuugagugucagccccuuuuauuagcggguuuguucauuuccugguaugaacugaccaguuauucacacaaguggcaugugcuccuggagaguuagauaccgaugaggguggggcaagggcuuucuuuccucugucccucuccaauggggagucaccucaccuaggaugugcuuuuuccgcuucauugugaauauaagugagaggaugagauggggugggggggagggagggcuaugggccuggggcagugaaagaagguugugggguccuauucuaccccugccuugggacacacuguugugggaaggaacacaggaguggcaaggggggccuuggcuuggugauggcuuuggagagacuguucucucucuuacuggguauaugcucauggccauucccgcugcuagagacuugcaacuuaacuggucucgaaccuccugcuaccguauaacccuacuuccuucucugaauugaguagagcgacaagccccagaaagggcagcccugccagauugguuuaguacacucuugcccauguugaaaauaaagugacccagguuaaaaugaaacaaggcugugcugggcauggugccaggguggcaauagugugcuucggugauccauuccagagggacauuuacucacccacccuguuguacuagaugcuaucagauucaaccuccucccccauuucucuuuuuugagaaggguuccaguuauguagcccugguugaccuuaaacuagcucuguagauuaggcuggccuugaacucacagagagaccuaccugucucugccuagagaaugcugggaguaaaggugugcacuaccacaucuggcuuuugcucuuuuguuucuuaacaauuugaggaaaaguugaguugcuuuuagaaaucaucaucuaaucugggcauaguuuuguaugccuuuaaucccuugguaggcaucggcugguggauuucugugaguucaagccuggucuacauaaccaguuucaggacagccaggguuccacauagagagaccuugucucaaaaagcaaaacaaaaauaaacaacaauaaaaaacaaacaaucaaggcaggaggauugaaaauuugaagcuggcuugggcaauauauugagacauuauguaaaaaaaaaaaaaaaagaaaagaaaaaggaaaagaaaaagaaaaaaguaaaaaaaaaaaaggaaaagaaaaaaauaaaguaugcggcagugggagaguaacauggcugugcagaauuagcaguguauaugugugcacagcagcaguccuggguggcagguuaugugugcagccagggacagaagaggaaccauaaauuuugcaggcaugguuuguuuugggucucuauuacauuugcuuugccuuacauauuguuuaaaagauggauuuuuuuuuuaaaggaaaaggaacuguguauuugagauaaggaguaaaauaaagugaaauaaauacuugggauuguagcuaucaaaggcacauuauuucugagaucacuguguuucugcacuguuccaauauuuauacagaaaucagagaauacaaagugcggacauguccugagauucugguugaauuuucauuuguaauaguguucguuuuccuuuguuucacugagcugaguuuagcgauauuucaggaggguucagccaguggcucuccaaagacaauaaauauugcuuuguggguagguccccacccugugccuuccuugguaccauuaugugguagccaaaagucagcacccaguaugcaaauguugggguggacagauaugagucaguuccuuaguuuucagcaugcuaugccauagauuugguggcagugauagagaguauugaccuggccaaugggaaugcuuuuugucucuuauucuuacggggaugucacucaccuguugccauggccuguuuccauaguaagucauuuagaguuccuugagcuuagggcuaugccugcuucugugacgcucacaucuggauguuuuuuuuaaaaaccugaacuuggugcuguuggcugcagagcaagggcccacguugcggcuggucaugguucauugcuggaggugggagcagccgagcagacacugguuucaaaaucaucugaaaaccacacugcagguauuucccacauugcuagcuucuagccuggugcuucuagaaacaacacugggcuauaucuuagcaccagacucuuuuucugccucucauuggugcggagguguuugagcucagcagcacggggacaagugaaucaaacaaugacaagccaggggauuuggcuaacucaccuuagaugaucugaccaggguugggugcagaaugauucccaauggagcaggcuggcuuuuuuuuuuuuuugaaugaaugaaugaaugaacacacuauuguucugugaugggaggggaugcuggccacagcacagaacuguuaauaaaugguuaggcuuugugccuagucccuuucuagaagcuuucaugggggcaucacauguagggaugaagcuaaaaaugggucugucugaaggacagcuguaucaagaauaaaucauaaaaugaagaccacuguuuaaaugaaugugcacagcacacugcaggcagccaccacuugcagaagauguguacacuggagcuuuccuguaagccuggcacuccuggucuuccauagcaguuucuaguguuaucauuugguuuugucuucauuuuuauaagacuuugguuuuucaggugaaaucuuuacauauguugcauuuaucaacagucuaggacucuaguccacaagugcuucugugagaugacuugagaacccuggccacaagagccaggcugccugaguucacauacccgaucuucuggcccuguugacaguggaugagugacuaaccuuucugugucuuagugccuacaguguaaacuggggaggauagaaugucugccaucagguuguugugagaauuaaacaugucagaggaguucggggcacaugguaagcuuucuauguguugguuacauaagaugauuaagaugcagugugggucagugagaauaucauuggucuguugaaucuggaaucuggcuuugccugcugucuaagcugcgugucuggccaggcccuuuccucucuuagguuuugauuucacaccuguaaaacuaagaaauucgacuuaagcaguacuuccuuagacuccgcaguaaagggaaagaggggaggcagcaucaggagcacaugauagaaacuucuagacucugugccugcucuaauuacaagguuuauuucauguaauggauuuuggcuggagagaaaaaaugauccugugugugagugugaguguguguguguguguguguguguguguguguauguuaugagugcggaaguagcugagugaaacgacccaaggauccuuugugcagaagguacaggucugcgggugagucggggggagacuggcagggauggguuggguaggcauuuuuugggagaggaaucugaagacucaagauuacauaguauggcuuacagcuaaauagaguaugcaagaaugugguggcugcuuuuagcaauuuguccaaaagguuaggaagugauuuucuuauuagggagaugcaaauaucucauauuacaggagauauuuggauaaggaaaccagaguuuggggggagagagcaagcggugaaucacagaaagaaaaccgaauguggaaacacggucuacaggcauucuccucauuugaucugagcagugcuugccugagccagaacuuaggaggccuugccaacagcuccucuugcuuccuccuugccuuuucuuuccuuuccauucugaugaucacuaggaauuuccccgaucugauugcccauucacucacuggcauuaucacacagcgaugaggaacugacuugccaaguggaaaaccauucacaggcuaaauguguggcuuugagucagacuguucccuggguuuuagaacuuugcucuuauuaaaguggaguuuggcugaguuggcuuagugggugaaggcucuugccaccaagccugacaacuugaguuugaucccuaggaccuacgugguggaaggggagaucugaucccucaaaguuggccucugacugccaccugcuuugguauuuguaccuuugcuguccauaacauaaauaagagcaauaaagugaaauuugauguuucuuaaaauuaaaaaaaaauuguuaugaugcuauacauuuuuugguuauaacaagaauuuugauuauuuguacucuucugggucacuucaugugccccaaagaggucccccacccccaucccucauguguguucacguauguaagugcagggacaugcauacuguggugccuuugugcagaaccucagguguuuauccuugccuucucucuugcuuaacacagcuaacugucuugagaguuugggggauaugucugcuucucugucuuuccgaaaggagugcaaggguuucagacgugugugcuguguaccccccgccccccuuuuaaaugugggaucuggacucagguuugugugucaagcucuuuacauccuacaucaccucccugcuaacccuaaagcccucuuucaaaacccagguccagcaguuccuccagcaggccucccaucccacccugcccuuguucacauuccucccacaccuucaauuacucugugucuaggguuugauguuucuuucuccagugagauugcuugcucgcugaagaugaagcacaguuauauuucuuuucuaccuuguucaacucuuucuuuaaauaaccaucagagccguggagucaauucucgaaucaucacaaauggcugaugcuaauaaggguaagcaugcggcccuuuuaccugguucugggacacugugccugcugccuggauugcuagcuggagacggcugaacauuugguuguauaguguguguggauugcaagcuuuacgcgugaacugugcugucauuuccuauauccauguggcaucgaaaccagggauaccugcaguuuucccagggcuggcagaacugucucauucaguuguuuuuugagcccugcuaggaaggucugacacacaguagguaacaggaggaguccaaguguaaagaguccuguggcacuagaagguauuagguuucuccuaggcuugcugcccaguccccuggaggugccuucugauuucccuuaguggugccaucuggcugggccugaagguauaguggaagaagugaggugcugggcugucacugcuugaucuuauagauaggguguaggguuugagugaggggcaaacaccaagaucuggaaggaucaacucuacuaagcuacauaugacaggaguuugcaaaucuuuuggggugugguagauacccuuugaaagaugccaagugacuaguggacauugguucucagucuugaagggaauggacauggguugugaacucugcuuaaagggaacauuugccaguuagcuucuuuguugucuuguaaaaguguagccgcagaagauccauguuuccaaugugaugucuguuguuucaaaaacagauggucaauucaacaaugcgucugcuggccccugaacaggggcugggggcuuguaagggcuacaagucaccuaggaaugaaccaaugaguaaacacacacacacacacacacacacacacacacacacacacacacacacacacacccucccucccucccuccuucccucacagggccaaauuagauggauguuauuccaucauccagauggucagaugccagcgucacuguggagauggacaugaugugcagagcaggcagaguuggcacugcagggaggggcaaggaugaugaggaccaaguucuuugccuacaagaaagccuucuaaguuucacaucccuccuccaggucucuaaugcugcccccucauuccuguuacaaguuugaauuucccugccucacauucuugggacuucagugcugcguaggagggacagaauauaagcaauacuuuggguucacuguguggccuuuaccuccuacucugguguuuucuuucucaauccuuccagauaccccaggcaggcuacaggcugccguagaccaguggguguuccgagucaugcccgugggcucucccuuccccgauuuuacucaugcugucccaucuuccuggaauacaccccccuccagauuauggaaauccuccccgcccaacucugccuucaaaaggcucaacacauagacacacuuucccagaacugggcugcccuccucauucuguaaaucuguaaucagucaugacucucucucagccuccaugacacuugccugugucucuagcguagcacuugcaucauacaucauggcucuucagaggccugaggucuucuagaugaugaggucauuguggaagguucacaucugacucauuaccauggccccucagggcuugguaacugucaaugaaguuuuuuuuuuuuuaguuagaugcuugauguuggguaauagagaacugacucaagaggaagcuguggaaggucugccgagaauugagggcuagggugguggcuggagcagaagugugagcagguagguagagcagaucuaacuuugcuucagacuauggcaacacugucugucuccuccuacugcauggcucacaguguggcuucgugucucguaagggauugaaagcuaagauauugguucuauacuugacccuguaaggagccgaaugaagggacagaaccaaggaaaccucuaagacucagcuaggauggcuuucuacaugcuugccuuuugcuauggcauacucaccaugaugguguccguauguccuuuaagguuguaagcaugcagggauggccuaggcuuguacacccccaaagacagugagaagaagcagugugucaucauaagaagugugguuuaggagccuagagaauuggauuucagcacuagcuccaccucuuucagccaggugacuuuuaaugagacucucagcuuaggauuuauuuccucaauuggcuuaagcgguugcuuggauccuuuggggcuaugacaauauaugacuaagggcuaggcugucauuacuguaggcuuguaaacucaugugacuccauuccguagcauacaaaguaugcacccacccagcacaggaguuagcauggggugguuuaagggcuccuuuggaucaagauuucaggacaaugguuagaugugggugaacuucagaauccccuugaaauacagucagaaggaguugagauauggugacauuccagggcaagacuguucccaugaaaggaaaggcuaccaagcaacaugugugcauuugguucugaugccgauuuggcuggccagaaugucuguauuguugauaauguggacuugaaucccacaaaauagaacaagcuugcuugcuugcuugcuugcacuaugguguagaggccagaggacaacuuacaggagcaagcuuucauaccacaugggguuggggacuccaacucaggcugucaggcugggcagcaagcaccucuauuuccugagcaucucagcaggccuguggcuuuguuccuguugaucaaggaagacuguucaguagaugcuaauggucaucuggccccuaagagcagugaaaagaauaaggcaaagaaagguaugguuuccugguugaccaguagacucaaugagagucaguauggcugugaggggacucagauagagagucaggaguaaccgcagagaaggcuagagcuaagaggagggagguaccucagacuuccauggaaaggaaaagaacaccuuguagauccagcacucuccaaagccagcgucauguugccugcuucugucuuauugacaaugaccuuggacaagccagcuuccaaccuuuguuucuucaucucugaccgaugccuuaagauucugugaaugaaguaggauuacauauugaaagcaccuggcauguuuguaaccuuuuccuuacaaaacuuuuuuggagacagggucucacuauguauccuuggcuggccuugaccguacagagaauaacauuuuuuauuuuacuuacuuaguuuguaaagacuguagcugucuguagugaauggauauggagggggcccugaagguagaagagaagggaauccaguguuaacgguuuuucauucacagcugccuggacuuguagaucagacacaaaggaaaccuuccuuuccugaguucuauguugccccaccuugauugaaacacaaaguccuaugguuuauccuuccauuuugugcuuuugauaguggugugaacccugagaugugucugucucucuuucagugaggaacagaacugacgugugguucuguuucugacuucacgucuacuuaccucacuguccucucccagugcccagccugagcccguggaccuagugagcccauuaucuaauucaugaaaaguuagaaaucuggacuuuuuuuuuuuuuuuuuuuuuuuuuuuuuugagaccaggacagcccaggcauuacagcuuaggugaguuuugaauuuguuauguugcugaggcugaccuagaacuucugauacuucugccuucaccuuucaggugcuggcauuacagacugugcuggggguggacccuaaagcuucauggaugcuaggcaagcacucuaccaguuggauuucugaguucgaggucagccuggucuacagagugaguuccagcauagucagggccauacagagaaacccugucucgaaaaaccaaaaccaaacaaaaacaaaacaaaaacccaacaacaacaccacuaugaaauaagacagaugggaaaaggaguggagagaagcugagaagccuaaccuaacuaaccuaagucugaguccuggggccugagcuggagaccgugguuagaccuaaucauuucagaagagagacccucgucucagaagauggaagggagagccaaugcccaaaagugcuccucugaccaucacacaugcucguaaugcagacaugcaugcacaucaucaaauggcuauaaaugugaggcucuccauuuuacgccauuguccauuuaacuguuagugcuaaacugccuugauuacaauagcuuauaguaaaucauaaaaucagggaaaagaguaccuaguccuuucuguuaagauccuccauuguuucuuugauccucuugcugucuauccuggccucaaaaauuaaccaauuaacggauucacucagcauauacaauuuaucucacacugacuguguacuaugcacuacagugugcuugggauacugaaaaacucagacaaauucccaucucuuugguggggaagauagauaaauauguuaacaaauaaaaagcagaauguuggaugggcuuuacaucugugaagaaaagugaaguuggauaaggggauacagcacggagaggauggaguagguucauguuauauguggugccaaggaaggcuuuucaccaucaucaccaucaccaacaucaccaccaucaucaucaggugacaaggcccaagucauggccaguugacuugugaauggaaaaguggacagcaggcuggugggaguuagaggaagacacuuggaacuucugaguucuagaugcuuauugguuaucugagugggauuuuuguauggccaguuggagcaggagccuggaguucaggaaggacauugaggcuggaauuauauuuuugguugugagccuagccuuuaacggcugagccaucucuccagaccaaggcuggaauuauaaacucaagagccauuaguuguguggaaucagcucugaugugauuaccacaucagagagguaguacuggccacgugguguccagacugccaauauuccuggguuauagccacuuaucuauaucacugaccuugcagcugaaucugggcagagugaccagugauuagauuaguaauuaaauccuuuuagcauggcuaugguuggaaauccuugguguggaaauccuuuggaaugaugggauugggagccgcagcaugggagggaaucacagaugaaucugugcuggggaccuggcuccauuguguguguguggugcuggacguugucaaccuuucaaaggacuugacaguuuugaaggagaaagaggaaggauggucuggaucagcaguagggaacagggaugggacccauccuacaucucuguagucuagacgacaguguuugacuguaguagcagcuuagcauugcgaagaugcuugcuagcuggcuucucuucaaagcacacuggggauuguggagcagagacuugugaagacuucaacuuugaacucuagggcacugaugcagaguagagaccuccucggacgcagaauaaccugugaacuuggccugaauugauugaaaccccccuuuucaugccugccccauucugggguggaugcuaaccuagggugucccucaaggaagaaaugcagucuaugcagaagaacucagcagcagaggugggagcagaaaaagaacaaaggaugacacauucugugcuccccguuaacugagcuguuuccccuuuggucucagggaagucucuaagugugugggugcugcucaggcuuccacagaauuuaggccuggacuucacaucaccuugguucugcuuuucuuaaauuuuaacuuaaacgaugaacugacagaauggcucugagagcuaauuaauguauuaguggccauugcuacaauugcacuaaaggacacgaccuucccccaguucucuugucaguuuaucuuacuuuuauuuauauaacaaguauuagagcaguaccuggcaugugauuauacacacuccugugcaaccucgcgcacacacacacacacacacacacuccauacaugcuuugugcauauaaacuuauuuaaucuccauagugacucuaggugguagaaacuacuauuuuucucaguuuacagaaaagaaaacagggaggagauuaaauauaauccacucaaucagcaagaggcagaaugaggguuugaacugggaggccugguuccggguuuacuuucuccaguuugcucuaaggccugcuagcuucuuuccaaaaaaaauaaugacaggggccuggggauggagcaguugguagaguguuuaccuggcaugcaugaaacccuuggguucaauuccuaguacugcuuaaagguaccacaggccuuggugguacacaccuguaauccuagcacuugguagguagaggcaggaggaucagaaguucaggguuacccuggcuauguagaaagauaaaaagccugaagccaauugagucuaaaaagaaugaugacaggggcuaucacaauaguuguuguucuguauauacugugcauugugcucuauaguuuagauguaugaguaauagcugaaugccugcaagguuuuagaaaccuuauuuauuacacagaggguaauaaaggcucagagucauuaaguacuuuguucugaguccaaagcuaagcagguggagaugggauucaaaccugaccugugugucuucugaccccugaagagcuguuacacuuuccuucuuugguaacuugucacuagauacuuccuuuuuagacucaucuuauggcccuuagcuccuaguagagccauagaggaaugguggccacauuucucaggccugauacaagucacccaggcagcccucaaaaccagaggcuuggcuugaaagcucuuaauccccuagagcuccuccauagccuucauucugguuugugccugagguuucccagcaucacgucggauguucuuuuucugcacaggggucaggcagauggacacaccaagugccaggguccaguuucugguuggcaucagggcaggcggguuuccucugaagugccaggguggcgugagcccucagcaaggguguggaccaucugugcacuccuauaaaggaaauuguggguuuuuuucuuuucucuuuuucucuuucuucuuccuuuuuuuuuagauaugggaaagggagccuugugucucaauugagucuuugugguguuguguuacagagagucacagaaaauguucuauguaaaugacuaugugcccugauuagagccucaauaggcaccauugugccauauugcuauuauuggcgauugcaggauacuaaaugauauucucaucaggcugaaaaacuucaguguuagcagugaaacucggguuaauuauacugcucugaauuagagcauagaauuaaguuugagagagaagccuauuucucuugccccucuguuucuucaggguugucacuggggaguuugaucagaauauuuuuuaacccaucuucuaaauuuguacuguuggcauuuugcucccugaguuaccaccccuuuuagugcugggaaacacagaaccaauuuauaggacaguuggagacucggucuauuuaauagugcauucuuuucagucaguagcggcguaaaaaauagcacggagauugaagucuuaggggaguacuuaguucucuagaggggccucuuuaauuuagcucuugucuuuccugccuuugaauuauuggcuccucugaucccgacucaccucuuugaagaagugacacacugaccuacaucguggcuggaacagauagaagagcaaucucugcucugccuggcucagcauucccggcacgaccuuccagggagcagucuagggcccaggcugguccucucgaguuucacccacugacuuccuugcuuuguuuuaauuguggaguuuugcuauuugaggcaauccuggugguaaaugugguauauauaccccauucucuccuaucauuuguuuauuaauuucaucuuacuaguguuaggucugugcgcgcucucucucucucuauauauauauguaaaauauuaucaucaugaaauccucuaugaaacgucuuuuuuuuucccccuuuuuuucgagacagggucucucuguguagccuuggcuguccuggaacucacuuuguagaccaggcuggccucaaacucagaaauccgccugccucugccucccaaguguugggauuaaaggcauacaccaccacgccccggcuugaaacuuuucuuuaauggaggcuuuguaguuaauuugugugucacuacuaacuguuucacuuuauguggauauuuaagucaaauccugugggauuccccccauuguguuacaaguugcaaccuauuggcaauuguaguguuccgaagacagccugagccuuuccuucuaccuuguuugcuuguggugucucuuguucaccacagugugccaguggagguggccuggagcgucuggagauuuucuugccucuaccacccuuguugcugaggagugcuggggucacagacacagggacuguggcaccuuugugaggguucugagaaucugaacuuagcuccucauguuuguauagcgaauucuuuacccauucacagagcccucucaccagccuacaauucaagauuuaaccccaaaucugccugccuuuaaauccagugccaucucugaugguauuaugucuccuguguccuuaccuguuggaguuccagagucuuccagcaaaaacaggucuguauugcucuucaugaguaagcauaucuuacuugcgaucuccagaaguccguuuacuuuguauuuccauggcugacuguuguuaagggcuuugcuagaugagaguguuccucaucucacaugaggacggguugucuuauguaguguacacugugugucucauauuaaaggacuaucacaugguuuggaaaauaucacauguaagagcaauauuugauuuaggaaggcugucucaagucagauguuuacaacauaaccugcacaguuuagaacucauauagggggucucagcauuacugcuggggagcaucagucaccagcuauggucagucaaaugacauuucucccauguguagagauguaaaauagaccuuccuuuugacuucccacccuuccucuuuuccagggauggaacucagggccucaaaugugcuaggcaagcucuagcucaugaacuuguguugcacaguucucaugaccacagucuuuuucuaaacucucuucucucagcaucaggagaagguacagaggagguuugggacacuuuggucagaugaacuagaaagaguuguuaagacagagagauacugcauguuggagggcugaguuuguggaagccagugggugauacagaacacaggcagauagccaccaugugguagguggcagagcagagaauggaaguccucacgcauggcucggauggccccggcccugcuguucacaaggcucacuucagaucacucuucuuugcuucuuaagcaugaccccuucacacgguuugucuucucagcccccggugccuuugcagcugcugugucugucauguggaacccuucucuuuauggcaugucacgucacuuugacuucucugcaguugaggcugcugugcugccuugcccauaggaagcuuguagugaauucuguucuucaugcccaagauugauugcuuccagugguggggguggggauggggaggcuugacaguguugacaguggagaugucaguuuuuacacaggcaacuuucccccuauuuaguucccuagggaggacauuuauuaagugacugguaauaucuugaguuuugagcacuuacaauaugcugauugcucuuugcaaauucuuuaaucuuuacaacucccagggaauuagguuuuguuauucaggcuuggugacccuuuggcccagcaaagcaaguguucaucccugacccccccccccccccaacauggccugugugaggcuaaagggcucaauugugacaguaaugguuaagggugcccuccaauuugccaaguggcaagucucagauuuguuucuucagaagacaagcuacgauuccguguuacucauuugaauuuuuccaugacagaaaucugccugucucugccucccaagugcugggauuaaaggcgugcgccaccacugccuggcgguucguguguuuucacuuguuugcagccuccacaaaugugcuuuccgcucuguuacuaccaagcaaugagggagaaagagaugcuucuaaaacauggguaugauggucucacccucccugguccccugguggccacucuuuucuccugcguuugccccaaucauggagagcucuagguuauuccaugcagguaugcacuucucuuuucugggccuuuugggcuauagauagauguuacuucuuuccagauuucacuuucucuccaccgccuuccccacacucaacccacuugggaguuuaggcaggucaggucuguccugggucugccucucugcugagcugugccgcugacugugcuguguuuggcgucugcuagccugcuuaccucuugaaccaggcaucuuggcucugucacuucugucucuacucagugccuugcacacgguaagaacucagggaaggauuagagagaaaacaaagaguguuucucuuagguuuguguaguaaguaccacuuguugaaugacuccugagugcauuauguagcuuaucauuaaccauaauggcauaucuagguacauggagauauugcuaguuacaucauggagaugaaaagcuugaggacucuauuucuuagguuaagaaauguuucacacacaugcacacacacacacacacacacacucacacacgcacucacucuggagagggguaguuugaauuuaugugaggaccaacuaggaaauguuuauugacucaguaaagguccuauuguuuugauugggucugucaggauuuauuaaaugcugucaggaguugacauccuuauuagacaagccuuuugugagagacacaggguugauggaugggggcauugugauggugggaauuauguuauaagagaucucuuuaguaucuucuuggucauaugaguuuuauuugcccacuaggacgugacagagacucugaguagucagagaaaacauccccuauguuuuucucaugaauaggacacucuguguucuggauuguggcucacuggagccagcacguggugucuuuuuuucuaacauugaaccaguaggcuuucucauuuugggguugucaaggggaagaucugugugucauggaaaacaccaccuccucucucaagcuugagaaaguuuguuuugaauuacaagaguaauuugucuuuuuaagugaaguccuggcugaauuugaacucauuauguagaccagguuggccuggaacucagaggucugccugccccugcaggauuaaagguguguguuacugugcucagauaagagugcucuuaaccaacuuaguagaaauuaauguguaaagccaguggcaugucuuggagauauaugauguauuccaugcuggggaagagggcagcaguugagagcacuggaggacuauagacauuuguaaaaauagaucuguagccccagugugugugugugugugugcccaauguaaagaagaaaaagggaggaauguaaaaagaggaguaaaagaagagagagaaguggggagagagaaagggagaggauguuguuucagagaacagagcuucccuaaauguaagacuuauacagauaucaugaacaauauccauuuugagccauggaaucaggcucaccuuugaccuguuaugaaagauuucuaagaguauauaaaugcaguugaugugcuuucuuagagaaagagcacaccccuacagcguggguuuugaccugccaggccuggaaccugguccaugcacagacaguggucuuuauagccuuugauuaucuuucuuuuaggcaggacuuucuauuuuggccccguauuuagcaaugaggucacauuuagucagaucuuguucuuuuccaagagaacaggaccacaccccucaggccggaaggacgcaggcagaggccuguggagaccagggcuucuuggcuugaggguggagggacuagagaguuaacuaauacagucaagagccucaguuuuuguccuuagggagaaaaaaaaauucauuguucaacuaaguagaacaagugccaccuguaugagauggugggcguuccaagcagaauagggaaggaaaugguugagguucuauuuuauccuuucuugaguuauucagcccucgcugcaccucaauagggaugguucaagacuggcaaggucugaugagaugggucaagggauccuuguggacaagugugggaguucccggagaggcgcagcuauaguggcaucauaccugauccugggccauucuacaggggggggggggagggggaggauaaggacacggggccugggggaggguguaagcgacucugucaauaccuuucuguuuuacgaguaguucugaaguccaugcugacuggcuggaugguggcaguaaaucuuugaugucuugaaaaaggaccacuguucuuugaagagaguugcaagccuuugccaguguuuugagacugggaaguucuaguccuaggugguuaauuugcuccaaggguuuuuguagcacuugguguguuucuucuuccuugaggacugggcuugagggaaggccuacacaguuuguagagcucaggcccucagaguuuuccccgagaugguguguuauauuuuggcuuuuccacuuguguuuauuucaagguugcucuccaacccuguccccaguggguucaaacuaguuacuugcucagcuggcuguaggguugacugccucaguggaugcccccaggaaggugggagguguguccuccagugaggacuacuguacagcugggaagauucacagcugcucuaaggucaguccucuuggguggugaaggcccaaggggcaccacaguguuugggucuaagccucagucugaguaguuaaggguggugaccuaucuucaaugcuuauuggguuguuagugauggugaacagaagauuaacuguuuaucaccuagguuugggauuucauaagaagccagucagguugguaggcugacagcuuggcugcuuuucuuucccauuccccacgugaggaaagggagaugguauaagaucaggagcugguguuucuucugcagcucccccaaaaccaggguaaggauagcaggccaagucaucaggaccucagagaccagcguaugagggaguaggagugguaacggggcgcagcaguggguaguggugggauagaggucuucacgguugaugaagcuuuguguguggucccagacagcuucuggucacaauagguuaucagaauuuuuuuuuggggggggagggagggguugaucucacaugcuugcugggacuuugccuguaucacugccucccagggucacaucugcuauccaaguacccccccccccccaccuuggcaugucuaucauguucuuucccugcacaaauggugggacuugggauuuuugucuuagggaacauuuuugugucuuggaggguuagcuuggauuuugaccuuguacguguuacaggugggcugguuuuggucugggagucugcagagucuguuuugucagccaguggaaagagaccccagagaagcuuugggagcugggcuccuggcagagugggccuugaacugcuucuucacuagagugccuucagugcccauaugaaccacacuaugaacuggacugcaccgugagcagugcaucaucuucugagauguacgucuuuguaguucuugcugcauggagccugguggcaagcuucucuuuacugucuccucaccucguccaaguaaaaaccuggggcugccugcucaaaauggcugcagcucucagggaucuuucuuaugagaauugaguuuguucccuuuuccuuggcuccccuccucuccauccucuggucugauggggacagaggagacuugcugggguaccugaguuaaguagaacccacuuuuuagacucuugcuguggccuugucuuucuuaucagcuccucucucugcaggccacagcccugcucugcugccuucugcaggggugagggaguaccugacaggaguaggaguuuacguuuguucuccuggguggaggagaucaggaugcagaugccaugcaugucaaguacaaccucuuuguuuucuuccuggucucucuggagcucugcccgggcaguacuguauggaggccuagggcuagcauuggcgcauccccuggcucguucaauccucaugcuaagagagccuuguaaugucucugucuuagauuggaggaaauggacgacagaacuccuuguuccaagggucacuuucauucauuuguucauuccaugggcaauuauggagucuacugugugcugugcucuggcuucauauuggcuuugguagauaggagugacaggcucucuggucucagaaaucugaggguuucucuaugagcucacaagcaaacuuugaaaaaaguuuaaaguuguaccuggccugguggugaagccuguaaccccagcugcucagugugcugaggaagaaauguagaagacagagcagguucaagauuggcgugagugauuuaucaagacuccgucucaaaguaggaagcaaaaaaggggcucaguggcucugagacaguuguucaguucaccaauugugcuugcuuugaaauguaaagaucugagucuggcuccucagcaccuaccuaagaagccaucuauggugugucucuaacccgguguugagacggaggagacaggcggacuccuggagcuugauggcugacuaguuuagcuuauuagugagguccagguucagugagagacccugucucagacauuaagugggggauaggcugaagagauggcuuagcgaucuuacagagagcucagagcaguucccagcauacacgggcagcuggcaaccaccugucacuccaguccuagagguucugacacccucuucuggccuccauaggcacugugugcauauggugcucauauauaccgguagucaaagcauacacaacaagaaaaaaacauuuaaaaauguagggagugacugaagaagauacccaaugcagcagaacucugggacacaacacacaaagccacgaaggacauuaacacacacacacacacacacacacacacucacacacacacacacaaagugaauaaauaaguagauagagacugugguaggugguaguccuccguaguagaguguuugccuggcaugugugaugcaccuaauucccagcaccacaaacacaacuguuugacuucguuaacaagccaagggaagcccaugacugagcuuguaaacgagacucagaagagucuugaggucugaggcagcagaggaugcugucugaugaaaugcauuugacugucuucaugcacauuucaguugggguuugggcaaaaguuuauuaaacuugcugaaagaacaaacagaaugaauaagcaaacccaacaacaucaacaacaaaaaaaccaaaccugaaacaaccccccccaaacaaagccauaaguaaaaaauaaacaaaggucaggugagauggaaccuaguagccugcuguauggccauccugucaaaagcaucaaacagcuaccaucccugaaacaacaaaacaaaacaaaaccucaccaaaacacuugaaaaaguuucuaaacuggacccgguggcgccugacaacaacccuggcauucaggguucugagacacgaggcucuugaguugaaggcuagcuugggcugcguagugagaucguaggugcugguggauagcucagagguagaguacuuggcuuuggguuugaucuuaagcacugcaccugcccuccaacacaaacacauauaaggaaacaagaugauuuaaaauauaaacuucucacauccuugacuugcauuacuuuugacuccugaucacauuuguagaaaaauggaaguguggaaauuccuccacugcacgugaacaugagggcgaccugggagggugacucagccuggugggugcucugguaguucuucggaaacagauuuuccacugugcaugcaguaugcacuucucauggggcuuuugugggguuccgagcuuucugggcuggcuguugccaguuugaugggguucuagucauuaguggcugucuugggggaugcuguggacgucacuguccauguaacccaacagauguguugaagggguuuagggucucaucugcuucuguuuccuugggcacgugccuuuaccagcugagccaucggcucugaggaacuguuuuuuuuuuuggugggaguacuauguguuguguguuugugugguguguguguguggggggauucaugugagugugcagaccagcuuugaacuccugauccuccuucuccauucaauguuucuucaacuauaaaagaaaacuacuaaaaaauaugugccuuggggcaagagacauggcucaguuaguaacagaacuugcucuccaaacaugacgaccugagcuuggauucccaggacacauaugaaaagcuggacauagcuguacguacuugaaaccccagcauugcggcagagacagguggauugcgagagcucacuggcaauccagcccagcugaaauucaagcuucccacucaguuaagagaccccgucucaagguaggagggcagugggugacagggugccugauggcgugggcuuugcaugcacacaugugaguacacauauuggcauacuuauaugacaauugguuguccccccccccccccagcccuccucucaaaccaaaucaaccagacaaaaaaaccacaacacaacaauacagaacauucaaaaaucucaguaaagucaaccguugccuggguagucggggagucuccacuuucucccaaagaacauucguugcuuagaguaaauuuucacugauguucagagucaaacauuuuauuucugagccuuccauuuuggcagggcucaagccugcacugguaauguuuggugcuggguaaugcuuuguuuuggaggcuguuuuaugcacggcaggaugccagcagcaucagaagcaccccuuuucuacccagcccaguuguaguaaccggaguguuugcaggcauagccagauaugcccaguggguuaaaaucucacucaguggagcacauugaguuauagcaacaaugucaaacuccacacugggguacucagugaauggagacaggccgaguacguuugacacggagacuggcuuaagaaaccuggaagacccuguuguuuuaacuauagggcucuguggggaauggcagcuugacacggaccuuaugugaggauggccuuuuagaaugaaaauuaaauugcagcagagccugccuuuggaggccucaucugugaagcucccuuuuuaggaauuugcagagagagagggagaaaaaaaaaacccuccuagcuuuagaguuacuggagcuuugugaauaaaagugcuuuuuguugaagagccaaccgaaagcuggaaggucuuucuuugaguccucugacacucaggaaauguacagcgagcugaaaacauuccugugcuguguggagcgagcacccuggcgagccugcuuuucugguucuauagccucugcagucagauggcuugugaaugcgugguuuuguggcaugucacagaaguaugcugguuuuuguacacagagcugauaaagccugcuguguuuuaucaacuaugguugcguucuugauuaaguuuauuuguauuguauuguuuauuggucuauguguauaugugugugggggcaggcaggucgauguuacgugucuucuuguauuacuuuccacauuauuuccuuagaccguguuucucaaugagcucagaauuuacuagucugcuggauuggcuggcuagcaagccccggguccuccugucucugccuuuuuaauguugcauuaccaugguucugugagaacucaggcuucacacacuuuauagacaaccaucuucccagcccuuacuuuuauuuuugaaccaagauuucauguagcccagaguggcuucaaacucucucuguagcugaccuaauuuggcccuucugccuccauuuaccaaguguugacauuccaggugugugccagugugccgagcuaaguuuauuucuaagagcaguuuuaggcuuacggcugcguuaaguagaagaaauuucagaaauuucauauccccucgucaaaccuacaaauucagcaaccacacuuggcaccauccauucaggauggcagaugcagcgacucuuccgcagugccguuaucucgcagacgcccugguucacuucagggcucacuugcggcagugugcguucuguggcuuuggauaggcacguaguggcauaggauggugauuccuuuuuccugaguuccuuuaggacccacguuggcccacacauccauuugucagaaugccucagugccugcuauguaccaggcuguuuuugagccuuugagcaauuauuuggaaaguuaauuaaacgucagucagaggcuuuggucauggcuugugcuaagaaaauguaauuucuuagcuucgcacacagcaguaaaagcagaggacuuacuuauuuauuuuugaugauaagcucauuuucucaguuuggugaaguagagcugucugguucggucugaaccagggauuggugugcucucuucuguagcaagcagccuuuuuuagaggcuaccucccuguucuuaucuuugguauaacugguggguguagcucuccuaugaaucuugguacaucuaacaggguaccugguggacauuucugucuucucauccguguaccacagcugccgcggggaaauggccaauuaacugaugacgucuuugauucugggguaccuguuuuuguuauucccagggccuaauaggaauagcuuccauccagggcucuugcuacuguugggcuauuaaguggggaaaguuaaguaccuggcacaagguuaucuuaggugaaacuggacugagguucagccuucagcuacccacgagccuuuucuugccucuucggugguuguuaaagaucaagaacuuagaaaaugaaggaggauguuaauggagagaugacauuuacagauaaacacuguccacauccacauucuugcuguauuucuuaggguuuuauccccagagcacauuauagacaugauuguaugguauuccugaagugaucauaugacagaaaugauucuuuugguguucuauuaugaaugguuucucuuauugguaacuuuuuuuuuuaauaccccguuguuaguaguuagcagucuagaacauauuuuuuuuugguaagaauuuuaaguuuaccagucuuauuacucugcauuucaugauuuugggcaugucauuuucauaaaagguuagguaugaagugcuaccgugagugugugcgugcgugugugugugugggcguguacgcacugaagcaugcacuguguuugagugucaaggcucugggguggugguggugguggugguggugggauccaagcuaaagccggaggacucuuacauuuggucuccaggucaagcuacuugagaucuuuuugacuuagaggaaguuauuugauuauauuauuuccacucccauacauaaggaaguauggaagauguuuuuucuccugaugacuuuguuaaccugcaaaaguggaaaaauaugcuccuuuuuuuccuagugacuuucaggguucugugaggugggacucagcugauggccuaugucuuuaugguucuauuucugcgaggcagccccugagcucugggcuuggcguaauuacucucggcuuuucacagcauccccgugagggccaugaaggaguuagcucaugggccauauaauaggacugggauuuaaggcccagcuccugugcguggggcucgggaagacucuguauguucugcucugucgucggguucccguguaguuccuaauuggugauuuucacaccccauugggcauuuaaugccaggaggccuucugagggugcuauuggccuuggguggauugaggccagugauguggcuuagaacuauuuccucagccgcagcuccugcauucccagugugugaaguucagggauggagacacccuaugggaagcaauaaccgugaagaaacugugcuuuuaggaggcagccaggaggaagugggagcaggugugccuggcagugugaucucuucccaauuucaucaucuggaaccaagcagcuaaacuuuuucagguuagagguuaggagauguuucuucucuggcaucgugagcauacauucuggaguuagacuccuuagguaugcauccuuccauccccgcaggcuuugaggaagacacucucaucugagcaucauuuccuugucuucuaaauauagucacauggccaagaccaugaugagcccugggacauugagagcacugggaaaugagcacccauaaaugaaauggaugaggaugauggagggugguacuuuagcgaacagucagguagcaggcuugcuccaugaacuucaguugcauuuugagaauugaccugucugcaaaucacaugccacauacucugucuguauugccugauuuuaaauggacucuucucucaggugaagacuaagacuuacagauguuggaagaccugcccagugucuaagugguuuaucaccaucuucugacuuugguaucauuuugaacccuaaaugucugccgccccuguggucuugcugaauacacugggucucccgauguuucccuugcugaugccuuuucaugggaaacguugagugggagcucugacucagacuggugcugauucuguauuaccauggagucuguuuuacaccagaacaaguuaauaagccugacugugaauuucaucacugguaaagucagaucaccucuggugucucccaagguguuugggaggaugaaaugaagggaauaaauguaucuccuaucuauccauacuccacuaugaugcuggugcauguagggacucaacauacaccaagguguguuuaugaaguaauauggagcauguuuuugccugggugauugccugugagcauggaaccguaauuuuucaugucuucaaagccccaaaucucugcaggucuccuagguaauccuauccuauccuauccuauccuauccuuuugcuugcuuuuuuuuuuuuuuuuuuuguccucuguucuuuucccuuccacccgugcuagucugauuguccugauaaguucuggucugggaaggcuuaagggcaggucuugugacggacaugugaaguagagcaccaugacauguucaaagcacucagaagagcccacggcacucuauuucaaggaaacuagcuugccaggcaggcugguacacaagggccugucugccguuccacaugcagauggguuugggaaaguuggggaugguggugucugagagugccauuccacagguaggccucccggucaggucuaggaaauaccacugugacucucuuaucuuuggccccggcauugaccuggggauuuuucaggacucugcuuggcucggcccugcuaaugcugggucuaaccagcaguguugaagaugugccaggguacucugaucccuuuccaggcuuugcgagucuguuuuuccagcucgguuacuugcuggcacacauaggucaauauacaagguguucuuggagacgccagggccuaauguugacuuuugcuuccugggauguguucuguggaggaaguggguuuucaggugguggugggaaugggauguggucuggagugauugguacugcacacagagaauaagguuagcuaggaggggggagcuucccccugcuuugugcucuugggcugaagugccucaaagggagcuuugugaguuggggaggugcccugaauucuguguguaauuuuaacauuugaaauagcaggcagaagcacacguguucgcuuuauugcauauacuuaauuuauuucugccaaaaauguauaagaagcaaguucaaauccugacuuugacauuuauuugcuaguugugugagcucuugccauuauauuuagccuugcucucugagcuucguguuccuggguucaaaaaaaaaaaaagcagaacaaaacucauaguuacaagguuuucuugcauaauugucuguaaaguacucaguguacaguucuugcuacaaagcaauuugguaaugguagcuuuuauccuaauuauuagagaggcaguuggguaugguagugauggugacaguccuggcagugacaguuacugagugcuuucagugugucagcuguucuuccaaguacuguguaucaguuagcacauuuaauccucaugauaacccaaggaaguagaugaugucauaaccucuuuauugauaauacaugcaggcacagagagguuaacuaacuuguccaccauugacuggcuaacgaacagaagcagaguggggccuuuagaaucagaaugucuggcuggcccaguugcauaccuucugguggggugaccaaccaugaaguauuuaaccaucaaauaaacgcaugauacagaaccuccaccacccucagacauugcugucuaguggcguuuaauaguagugcuuaggccucauuugcugauuaacuaacuagagaggugagucugagguuccaaagaguugugaaagucaagguagauguuauugucaauguuuuugacgugcuuaauguuggaguuuaaacaacacccccauaucaacgaccugagaggcacaguguaaaaaacaaagggagagaccaaacacuaucuuuauuacccauagcagcucagguggaggcuaugucuuagaugugaaccugagguucaguagugcacccaccagucguggguagagcgcuaggaucgguagugguauggauagucacaaguagauauucacagaggagauagcacacucuugcucccugggaagauggagcacguacaagguggaauuuuugugggaaguuccucauaucuggaaaccaaaagaugccaguuguguaaaggaaggccucgguccucucccuugagaacagggacacaguuuguaccauugggcccagcuuguuucuccccucaguuccuggccauucgguucuuccaguuguuccuaggaaaagcuuuggaguccuccuugaagccuguccuaugaaaccuguauccggccuaccuaccugucugugggcuugaccuacagagcaaaugcaggaucugaacguuucucauaccuccuggcuacugcuuggguccaagucauugucacuuuuggucuugauggccacuuaucuguucucucuacaugugccacaaacccucuugugucugcuucuacaaggcaacuagaaugccuuuuuuaaaaauugaaauuggauuacuuauuuuuccuugagcuaacccuccaugguccuuauuuucccucagggagaaagauccuuacaaagccugauacaaucugucacugucacccuuacuuccucccuucuuaccugcucugaauggcgccaguggcccugcuaccuccuagaccaugucagucucuugaaugccuuuggguuacucagaacuuccccuaaaguauagcuaguccuuaacuugcaacaguuuaacuuagauuuucuuuuuuuggugagaggagaggcuugagacaggguuucauguagcccaggcuggccucaaacuugcugcacacuggagggagggauguucuugaacuuccgauccuccugcuucuacacugaacaugcugggauuacacgaaugugcuaccauaucugguugcaguagaaauaagaaaguuauuaugugccugugcauuuucaugagccaugaugcacguguggaaagguauagccuguggauagucaguucuuuccuucuaccauguggguccugagcauggaucucaggucacaaggcuugguuaugagugccuuaacccacugagccaucucaccagcucccaacucagcguguuuuaugauaguguaaaagugcuacacauucaggggaaacucuggauugugauuugugaucuuucccuugcuuagugauauagaguugaagacuuuuugcauugcugcauugagcagugguccauagcucccagccagccagaugagauggccaauacuuuaucaucaguuaagcccacuguaggugaagguagguguccacagcagguucgagguaagcuuggguauuugguggugcagguguuuuaguguuauucagcuuuagauuguaaaggguuuguuugggcauagcccacguccugcagcucccucgaauuccugaucgaucuuuaacccuaaucuauuuuuacccaaagcauugauuugucucuguuauacaaguguugcuccuuucuaagcgaggagucagguugcuugaggaagcuugccugcuuuguuaccuauugucucucuagccucuguggcagcaccuggguacgcaggagggucaagaauaaaacccuauggucaauuuuggggguugugcucuguguauuugggcuggagcaagacaagcuggccuauaaggagguguccacuggcauccucuuccugaucaauggguagcuccuguuguuaagucccuuuuagggaucaggcagagaaaggacaauucauuaguguaagguuguguuuccccaagguugugugccugcugugccuggucuuacagucuguguuccuaugaacucuuaaccccaauuccuucugucccauuggcucaagcccuauucuuaaaagaauaagaauguaguuugacugggguuuucaaggagcuuugagcauaguuuuuuuuuaaaaaacaaacaaacaaacaaacaaacaaaaaacaaaacaaaacaaaaaaaaccccaaaaaccuaugagcauuuaaaaaaacccaaaaaaccaaaaggucucauguaucucagguuggccucauuauuuagcccaggaugaccuugaacuucugacucuccugucuguaccuaaauguuggaaauauaggcauucaccacuguucucaguuuauaugacgcuggggauuggacccagggcuucaugcauucgagggaaguacucuaccaaccuaguuauauccccagcaucccaucuugcuuuuugaguuauugcuacaguguaacuaagccuucaaaaaugaagauugucaggucugcaaaguagaugaaaauauuuauuuuuuauuuauguguauguaucuccgaauuuauguaccuguggaggccagaggaggcaauaaauuucuggcaaccguaguugcaugcaguugugggcucccugaugugggggcugggaacugaaccugggucucuauggaaagugguuacuguguuuaacugacaagccaucucucucgccccuaugaaguagcguuuuaaaagcgacuuauuuauuuuuauuuuauguguaugaguauuuaccugcaugaaugugucuggugccuguggagaccaguccuggaagugggcucugugguuacugagacuucaacuaaugaaucauuugaaugcagcuguauuuuuggauucauuguggagaagccccuuucaaagccugaaagcgagccgcaccagaaccuucuuucucgucuagugaaccagcauucugcagagacacagguacugccucuucacacugcacaggaucagaaacaauuuuuuuuuuaaaguuaaaauaauccaagcuuguguugccacacaaacaacaaaguaggccaggacauucgaagagccaguguuugcucuacccacccacagacuuggaaagaugcagaacgggagaagucggaagccagugagguaaugccagcuucuuuuaguggcucccuuuaauuuuaguaaguccggaagacgauuggaggcugauggguguuuuaguaggacuaacaccucaacaauuucuuuuaggaaaaaaaaauucauuaaaaaaaaaaagaggaagaguaccauaauccauuaauaaaaaaagauugcucccagccucucuuucacauuccagcuuucaggauaaugaauggugggcagguuuuugaggcuugggugcuuauggcuucuuuagggagccucaguugccugggccgcucacugcccaggcuggcaccaggggcccuugacuugccucaccucugucuccaugguggacauuacuggaaccccacugucccugcacucuaucucccucuccuaccugacucaaaccucuuuccuagguuucauucauaccaggaguggcaugugacccuguucuggcacaugaauacagguuaucagacuagcuacaggguauaagcaggagugauagacugguugacccucugccagcuuuguuucugagacacuuucugacacauuuacccacuucacgcccucccugcccaaugccaguaggaaugccugaccuggagccugggacacaggcuuguuuucugcagcuggcuguuuacaggaccaccggaauuggccuguauucccagcauccagaucugcagaaguaggaaccaggcaggaacauccuuaugggaacaaaugaggaucugcaguaaagagaacuuguuaaaaaguccaacucagauguaguuagccccacacagaguguagggacgauccugacuguccuaggcaccacccugaaacagugacuggcgcacacuagguguucagcacacauuuguugaauaaagggaacuuagcauccuuuccucacuuuccacugaacauucuguuuucccauauccaguggcaguguccuagaggguggcuuuugcuagucaccucccuccugguucugauggaaggauacuguguguuuuuagcugcuuuugauaugacagauacauuuggcuucccaacagaaagccagaggagaaaugaagauuuuuuagcaucauucaaaaugcuugccauucuucucgauuugcgaaaucacgagccgguuauuuugaguucacauagaggucagagcuugaucugcaggaaggagguuccccugguuuaugugcugggaacucucccccucuguuuauuuuacccagaggcuucuguuuuccuaugaagcgaggaucugguauuuguuggggaaacgucucagcuucugugcauguauuaaagaagagcucacuccuuggcuccaguuuugaucauuaguugauagauagauagacagacagacagacagacagacacacacacacaucuggguuuugcucugaaaaaggcuagcuccuaaguagguguuugguacucuguuuccgcuucgaaggugucuuaaaaaccaucuucucggacuggagaguugucccaaaguacucaguuuuuuacagaggacccaggucugauucccagcgcucacaucguggcuuacaacuaucuguaacuccugccucagggaucggaugcccucuuuugaccugagugcaucaggcugcauguggugcacuuauauauaugcacacaaaacacuuacacaauaagucuaaaauacuagucaacaaaccaaaccaaaccaaacuaaaccaagcaacugucuucucaagucuuuccucaaagcuacuuccagcuguaugcccuguuuucuguucagauguuggauuaggacccugaaaguccgugguucuucucuucucucucacaccgggauuguuguacaccacugugaggugcaaguguccgguuucucuuguauguaacuuccuggaggcuaaaggagacaguacaagccaagacucccagccuggucccggcccuccccuauuuuuucuuuuuuuccuuuuaguguuggauuagcuuagaaaguggcaguagugcuuggguucccaauguggacggcaaacauggaagaaacuuucccgaguccuagcaggccuuagaccucuucccuucucucccaagcuacauugugauuuaguucuccauaagccugcccaaggacucucauguucuacccugucuucuugucucugccggauaucugggguccuaccuagcaggucccuccugaugcagauuuguaucaggaggcauccgaaaguuuuuccuuuucuuuucuuuccuucuuuuuguaacgcucuaucucuuauuagacuuuaaaaccuuuuacauguguuucugaguugcugugaucuacguguagggcccauuaugaugcaugcucucugucuccccagugcuaggauugcuugcaugugcagcugugccuggcuuuucgcacgggugcugggcagugugaacuccaguccucaagcuugugcacugguugcuuucacacugaguugucuuuucagcucuccagugacacuuuugaaccauucuuuuuccaaacaggauuuaccugggcaguuuaccuucaggauccugguauucuguacuguacugaucugaucauuccuacacacacacacacacacacacacacacacacacacacgcgcgcacacacacacucaccccaauaugcuuugcaggaaaagcagaaugugagaaugccugcuuucucugaggugggccccacugcuaacaagaaagguuccugccuucucuuaaaucuugugcacaaauucacauugccuuggaggugguggggcagggccucaggcacuaagacugggaagaaaauaggugcaagggaugggucugggucugaacucaagauuuuucuguuuccuaagcuagacggagggcuggauucaugggaauucuucaguccuguuguugacagaugguauucugaguuguuguggguacuuugcagggccacaaugaaauggcuaaauacaucacaauuaaauggcuuuugugggccagggccacagugaaaaggggaauugauuuuaugcaaagacagaagacuguagaucuugguuuaacuuuggaccaucuaaaaccgguggggauauagaaaagagggaagcggagggacucucagagaccuuagauuaccggguuaggaggccuguuggagaggagacccuuccauugaugacacucuccucaucucuagagcaauuacagagccuccagccuggaagcuuccucccuggccugcaggagauacuauuuugcaaacaauggggggaaggaaagaaaagcggagcauuugccaaugguggcacuaaugacuuccuuagugcaagccugcagcuugugcuuuggaaaccccagcuuucagggucacuguagacugucagacccacucucacucucuauagccagggaagagaguuucagauuauagccaaguggcucuaaagugcgugaauuuacguggagauggaaagagaagggccuuuucuuuagaggaggguccuuuuaguucuagguuugacuggcuacacaccgacaguuguccaagccagagcacagggaaaucacaaggaaaagaaacccaaagaagcagcaggaacagacccaucccccuccuaccccaaagcauguguuguuguuguucuaagggaagagucuuuuuauucacuuuuaaaggaucaguccaaaaagcacaguucuuuuaguuucccaucuagguaagcaggaaaguaggaggaauaggagcggccugcacagugagaacauguagcuaggguguagauagggcaggaagaacugaaagcccuagaagccucucugagccaggggccucugcacguacugagugucuacgagucacaaggucugaaauucuacuggccugggacaccuuauuccagcuagugaacagucugccaauaaacugacugggcauccugaagaucaggccaauagcauucaacccagaauacccaguguaaaaagaugagacagcacaauacacacagauguucaucccuuacuccuuauuuggagagguggcacagccaacguacccaugacuguggcuacuuugguuaguucacucuuagaugaacaaaugggcuucuuuagccaucaugagccuuuuauuuccucuuaaauuucuguuuguguguguguagugcaggcuaaccacugcucaguaaccacugcucagguccugagaucaugugagacgcaggugagagguuggaugaauggcucauugguuaagauuaacgauggaguuugguuccuagcaagcauguuggauggcucgcaaccgccuauagcuccagcucugggggaucugacaacuucuuuuguacucuuuggauacuuacacacacacacacacacacacacacacacacacacacacacacacaaguuuuaaggauauuaaaaaaauaaaaagacaugaauagaccuuguucagcuggagcuuggacuucagaagugaugagauccuguuuagccugcauuccuauuagaguuucccaggcagaggaucucagagcuuugcguugaauacagcauuagugugucucuucucaagaaaugcuggcucacaaaaaagggaccuagcaugacugccgucugaaagacccaacaagcagcugaaagaaucagaugcagauauuugcacccaaccaauggucagaagcagcuggccccuguuguugaauuagggaaaaucugaaaggagcugaggagaagggcaauccuguaggaggaccagcaaucucaauuaaucuggacccccaaguucucucaaacacuggacaaccaagcagacagcauacaccagcugauaggaggcccccaacacacauacaguagaggacuucuaggucuguguucauucagagaugaugcaccuaagccuaaagagacuggaggccccagggaguuuagaggucaugugaggugggggugggguggggacauccacguggagacagguggguggggaggaggugugggauauggaacaguuggaggguaggugggaaggauaaaauauggaguguaaaaauuaauuaauaauaagaaagaaacaaacauugaaaaaaaaaggaagaaagaaacguugguugagccccuauucccccuaauccucauuuggcucuugugugaaaugaagaacaagaaagcuccacucuuuugugucuuuccugaaaauuagacaaaacauggacucugccuugccaaaucuuguguuuuucuacaucugcuguucuauuguaggcuccuuuacaguccagaucugccccauggagagagacucuuaggucagcucuggagagagagugagcuuugaacucaguucccggaucaaucuagcuggugcaaaggagguggcuguugugacuaagaugcgaaucugcuuucaccucuugacaauuguacuugguugugauaacagggugcugauaggugauucaugugucaugugggugaaaugcuuauugccugaugaugauggacacgugcaacuagaugcuaaaguacuuacuuugaccguggagcaagguguguugaugaugccaaguuuuuauucaaagaugcagaugguggaauuguaucugauguagaugauugcaucucuguauuuauaggcucucaaaugaaaaggaaguggcagaaugagggucugauaaaaucacaagugaagaaauaauuuguugaaucugucucagaauauacaaacaggauuugucuaccacacuggggagcacacaccucuuagcuagcuccucuuccccuaagucauuccuuuaggggguggaaaagugccauauauuugauugggcauaugauaaauaugauaaauauggaaacuccauauugucauagcauuggauucccauaguaugguaaggagugguaccaggggaccgcagcucacugauggagcagcggaucugagcaucaaauccgucaggcccucuucagaguccggguggaacaguuccugugcuuuccuuugcuuucaguuuucuucccuuggcaggcggacuuuaauucacuucaguaauacauuuguaugauggacuccccaccaggguuguuugauuuugcuauggcugaugauacgauuuuuaagcaagaaaauuccauugcuaaagaguuuuuguuccaugcauuauucuguguggaaaaugccuuaaaugggauuauugaaauauauguuuuauuauuuauccucuggcaguuuaucaguagcagcaaguaucauauauuauuauuguugggaaaguuagaacuuccuuacauuguuugguuaaauguggcuuggauguuuucaaaaguagagggcagucugguaauuuaauguuacaagauagggccuuuagcuggucugaaugucacauggcugcuguaauugcuguagaaguauauuguuaccuguuuucugagagguagagggauuugauuucccugggauugcauaauuauugguucacuagaaccacacuguacuguauugcaugcaggauaaaagaagggauagacagccuuucucaucugcccuguguugcagggaacuguccacagaguccagaacagacuucauuaguggcacacaauagccaugacuguugauugguugguuuguuguaaggaacaucgaacaucuggauccauggcauauuacuuaguauuuaguguuucuuucagucauccugucguccauccugugucacacauuuauauucucuggagccauacccugaguagcuguccaagugcuucugauaagguguuuugacacaggaacaagucacugacauagaaggcagaacucagagauuuguuggagacaaaauagagucaggaguuuaaauacagaauuguuucauucaaaagccacuguuuuaaaagaaauuauucccugcuuucuuauguguaguauaugugcauauauuagugugcauguguguguguguguguguugggcacauguagagggcagagacugagagugaaugucuuccucaauugauucucuacaucaccaccaucagcaucauuauuauuuugagacaggagcucaccaauuuggcuagacuggcggcagccagcugcaguggccuuugcucucagccuccucagugcuaggauuacagaguguaucauugugcuguggguauuucggaucugaaaucagguucucagggaugccuggcaaguacuuuacccacugagcaaaguguugguuaugucacugcugagacucaagaugacuugaggcaugaaguugacaaguaucuauuuuaauauauacuuggguuggagauuuguuucaugguuuuccaaaucccaucaaacugagaaccaagaucaagccaccacacucccaacucuaccagcuuagucuccaugugucuugaucagggcccuaaucccugcacccuggaggcugaggaaacagcccuagcuucauguggggaucccacuuuaggucaugcuccuccuggcguccuuggaaauggugcuucuauggcaguuaccuucuuuagcaagucuuacaggacagcccacccacucacccacccacccauccauuuuccuaaccuuguauuuuucucaugagccacauuucuugguuuucuuaucuguaagauggagaugauaguauguaacuugcagaaaguaaaggguuugcuguuuaccuuaguguggcuggguuguguucuuuggucauggagguaauggagguagcugcuauugccucuucccccuccuccucuugcagagucucacugugcagccuugguggccuggaauuuucgauguggacuaggcuguccuuaaacuuacagagaucuagcugccucugccucccaggugcuaccauuaaagcuguuuaucaccauaccugguaaccaugguuuuuaauuaugagugaagcacuguaaccugaaaauguccagacuuuuggccuuacaguagaagauccuuuuccaauucuccuuuuauaugaaaaucuccuuccaaauuagaaaaaagagauguucaauuucaacauccuguuauuuuucaguuuauuuucucuuguuuuuuccucccuugcaugaaggauaauaucauuuuuagaaauaaauuauuauauccagggacuggcggggugucugucuguguguguuuguauguguguguaaucucagcacuuggagguggggacaggauaauccuugggacuggauggccauccaguuuagcucuagauucagugagaaacucuguccuaaaaaaacaguguggaaaguaaacgaggaaaacacagauguugaucccugguauccacaugcacacuuguugauauacacaccuacacauaggaauacgcugguuucgaacucaugaucuaccuguucacaccucucuggugcugggauugcaggcaugugcuacaccucuggguagaauauuuaagcuagcuuacaggagguuuuuuaaaaauauauauuuuauguggcaaaauuauacuuaagacauuaaauuaugucuuaaaaauuuagauaaaaaauuucuaaaaauuaaaaaaaagcuuuauaaaaguguuuaaggucuuuuauaacauugaauauuuccauuguucuguguucuaaguuuuuuccucuuccagaaauaaugauuucagcuauuagcacauuggaacauuggacuaauuuguucauggguauauuuagaucccuuuacuuaguaagaauaagaaauuucacgcccaaauuucuaauuacccaugugaccuaaaguaauaugcacuuuagauuccaggccauauauaauguaaacuggcaucauuuugguggcaucaaaugucucuguacccauucuuugauccuggcaauguaggcaaacuuugugcaucuuaguguaaaacuaguuaaacuuucuuuuccuuguaagcaggaggggagcuggggaagcugagucagucacugcaccaugugacuugggugaagucauggggcgcagugccagugggacugucauggggacugacgcuuugcccggaggccauucccuccugucucaugccuguugacucucauguuugaugcucucuaacauguaguacaucuuuguuuguaagguaguuuuggggguuauuucagcacuugcuggaguaauugaagagaauaaggaauuccaucgaaugaggacgaagggucaguguugcacgcuagggaaggugcagugagggagaagugguggcugacagccccauggucaagaucaaguuucugcuccgaagagaagaccagugagaacuuuccccaugggguauuagcuucagaggaugcagcgaauagcugagaaccuacauuucuagcauuuuguuggucaguguuguauaacaagcagcgauauauuuuuuuuaagauuuauuuauuuuauguauaugaguacaguguagauguauagaugguugugagccaucauaugguuccugggaauugaauucaggaccucugcucgcucccacccaaagauuuauuauuauauccaaguacacuguagcugucuucaggcacagcagaagagggcgucagaucucauuacuauauagccauguguaccuuuuucccuucauuaauccuccagcauaugccuccucauccuacccccuaaaugggaguuucucuguguagcccuggguguugugaagcucacuuuguagaucaggcuggccucaaacucacugagauccacuugucccugcuuccugugugcugggauuaaaggugugccccucuguacccaguucauacugaagcuucuuaauguuucucaccaguuauuaagacgauuuuuuuuuuuuuugaugugggauuauguccuuuaccugcucugaagcccuuggugggugcuguuuugugucauguucaaccuugguauccuguguccugugccuucaccccuuuuucugccuucacacccuaaacacagccaaguugagcuagcuggcucagaguuuucuccgugagaccagacguuugugcuuucacauggaaagcucuccuuucccugcuguaacuacgaaaaaucuggccauccagucugcauuuugaaggcccucuuguccaugaaaccucucaagguuuguucccugccccaacccagguauacucuucucuuccugacucugcucuguggaugugauucaaauucugucacccacuuaugcaaggaaugauaugggugugugggccauguucccagagccccaugaugugagauaggagaucucuaacuugcacaagaugauagaaacaguauugauggugaccuauccagcacuugacugcagcagguucuugcucagcaucugaccuccucugucucccucauggggaggucacuuuugcuguugcauuacaguccuguuacaguuugcccuuucuuuucuuuucuuuuuuuccuuuaaagauguauuaauuuauuuaguauauguaaguacacugaugcugucuucagacacaccacaagaggacgucagaucucauuacggaugguugugagccaccaugugguugcuaggacuugaacucaggaccuuuggaagagcagucagugcucuuaagcacugagccaucucuccagccccaguuugcccuuucucuauuucuccagaaggcccuaguauagugcuuugaacauuaaaguuuugcugauagugaauaagguugaccuggacacagucauggugaaggguaaguggguuuucucuaccccccccccccccacuuucaugcuugugcuucugucuucuuccucuguuuuuuaacuuccauuuuaaccucuuuuagcauugacaaagcagcaggcucacuucaaagaacugacuucaaagcccucuuggcgcagaaauccuggccacugaagccuauaggcgcuggcccuguggccgcugcauuuaagagguuuuuugaguucuauuuuuaaaguucuucuaaaggaaggaggggaggguuacagaaacaucugccucuuuauaaaagucaaauauaacuguguaauuccaggaaaaaaauuaaaaaaauauuuuaaagaaagcaauuuuaugauuugaagaaaagaacauuuuuuuuuucuuuaaaaagaucgcuuguucuuccaugucauaguuacagcauuugggauagaauuacagccuuaguuugaaugcagcauuuucaagauaguuaagcaggauaacacagcagaauacugggcuagaguugcaggcuuuuauuauuucuuuucuuaaaagaauugcauugagagagagaauggggggaugugucugucugucugucugucugucugucugucugucuguguguuucucuguguguacaugcuauaguaaguguuuggaaguccaaggacaguuuguagggaucaggucucuucuaccauguggguccuggguauugaauucaagugguuagguuugguggugagcaucuuuaucuccuguuaguggcucuuucuacauuuuucugugaagcccucaacugagaguaguuuuugcaucuuuaaaugauugaagcaaaauccaaagaauguauauugugacauauuauaugaaauucaaacaucaauguucauaaaguuuuuuuggaacacagccauaguuacuuauuugauuugucuguggccugcaaagcuagguuauagacuauaugguucucuacagaaauaguuguugacuccugggauugacauucagggugaaugaaaguaugaaugggcagggagaggcaggcagaaccaaagaacauuucagaggaaaugcacaaugggaguuuucuuuucugaugggacuccuugucuugauguugguguuccagugggggcauugcuagagugugauguaugaguuuaaucucagaguaaaccccauucauuacccggcugguucaggcuccagugcuaaucucauggcaugaugcagggccauuugcuggugcagcacaguauaaauaggcuuauggugaaguucagaggcccacuucuggcugggugaggcugaggggaguaggcagcuguguucuauagaaaaggcuggaagaaagaaauagcuggagaggcucugaggaggcucuuuuccacccagcugcgccuucucaaggguguguuuguuaugaccuaagaaguuggagcucucuguuucuggcugguguugauucuucacugccuuuagggggauugacugagagcccugaguaaggagaaggcugggaggucagcuucccuccugucucaugccugccucuggggauccguauccagagauucugauucuuuggggaaagacacaaagaugaagcaagguauauugugaggucuaaucaggacaaggcauggccgucacugaguguggguguccugaucaagcauccccaaugccauggucagaggaaagcaucucaucagccccagacuguacuucuuacagcccguagaaaagcagagccucacuguagaagagauuuuaaagaggcagccucucgugcaggagaggaacuagaggcguaagauggacacacuuaccugcuaguuccuauguggaaucaguuucaggcuuuaauuauacacacacacacacacacacacacacacacacacacacacacagagagagagagagagagagagagagagagagagagagagagagagagagagaguguuaguuaguuucugggaaucuaauccaggauuuaccugugcauucuaccauugaaccccaaauucuuguuuucuaugcacccaucaaacauguaugcgcaccugugagaaauuaggaggucaguagguuagaugaggaccaagccaaaggcagugcuaaagucagccaagggaaggagcgauuguucuuggucucagcucugagcuccucucugugguaaagcuauccuagcucuagaggcaacuuagucucuccuauuguugaguccuggugauuucuagcucuuuacacuguguugucuucucuaggccugaaggugaugagcaagugacauuuauuuuuguaugucugcuucauuauguggaagacuugcaguaaacguuggaugaauggauguggugaauaaauauagacccagauucucaaacuguucuggggaaaaaaaaauugccuaaggagcucguuacaaauucacucuuuugacucuuugggaccccagcaucugaauguucaugcccagguguguuucugggugcgggugguccguacaccauacuuacagcaacucuggcacaggugccaagccuucuggaguagaggcaggaacagaacauuaaaaauagcucuccauucaucugcucaugcucaguggccaagcgcccccuccugcuggcgucagguccggaugugggccaguucucagcccaggggaaaugaacagugucuucuccgaggugcccagaacacucugagucaguggacugcacuggccagucaggcagaagggagcuuccacuucuuuguaaaccuuggugggaaccgaguuggcacagcgaauggggaggagaggaagugccauguggggcuugggguuggccaagguuucaggacuggaugugcuuuggguggcugcucaggcuguugcuauauaugcaguuuccucucuaaauaguaacuuucccuacuggcuuguguguugguuggugaccacaaaugcauggcugcuguucaggaggcuccugggaugagaggauggggcuggguggcugucagggcuucagaggaaagacaagauugcuggugucuccugucacugacucaugaggagaucugggagguguggcuuuucugugccccaggcuuacuuuuccaucugucaaaugggugauuuaaagggacagagugauaguguugaucuucaggaagggauguuugcaggccgguguucugacuaaguccagggcuguguguuagccagagacugcagauggacuuuuagaguuaacccuuucugggcacacauggcucgucaugguaugggugcuggugagaacagcagcacaagaagcugagaacuuggucauuuuuucccccuuacuccuuagaucuguuccagccacaguaggguuuccauaaauaauuauagagcuuagagcuccaaagagcagugauugccaagugccagccccauuucuuucuuugcucuuugaugggcuuggcaugaugcauaggguguaugaggagcaggggcuuucaacaucgcauccauuucccccuuuuccuucuugaucucuuccugcuguacuuccuccuccucuuuguagugcugaggauugaaccuaagccagacauacuuagcaagagcucugccacugagcuguagaccccagccccuuuuauuggccuuuuuuuuucuugccuuuucuucucuuuacauggagaaauacuaaaggccaagacaaggauaaaagucugugugcuagaguaaaccguguguuucuuucucuucucuucucuucucuucucuucucuucucuucucuucucuucucuucucuucucuucucuucucuucuuucuuucuuucuuucuuucuuucuuucuuucuuuuauugaacuuuacccuguagcugaggcgauccuugaacucaugauccucagccucccagugacugggaauuuuaaguuuguugaaguuuaguuuccucaucugugaaguagguaagcaguagccuucuuguggcgugucugccagccagugcguaugagccuucucugcagugcauggguugcagaggugagagggggaggauggagggggagugcuuggcccuggggguugacagccucugagugaggagaccucugaggcuuacaucucuuacagcacuggauggggaugcagccucaguagugagcacuggcagcucucuuaggggcaguucacccugcucuacccccaacuccacagcauuuugguaauaaaaauaaaaaaaaauccauauuucauggugaaaguuuugaaauagcaaggcucagguuggcugauuuggguucccaggaaaccacaccuccugugugcaaaugcccgauaacaguguuugguuuuuuuccacucagcaccugauguggaagaguacaucuacuuauuuguuugugugcaguugguuucuguuugagagcccucuuugcuuuagucacugcugaacuccuggcauccaaccuagaguggcaucuuggugggaugaacaaaugggcauuuacauucaacaggcauaagugguucuguaagggugguucugggaaacuugcagguuccugagacccuuuugggagccugcaagauccuaaguauuuucagaaugauaguaauuuguuguuuguuucuucuuaaucucuccaacaugaaucuuggugaacugguauuuuccaagcaaccaaugcuugaugacaaagucuuguaggguaaagagcuguuucagaguggagcagauacacuauaaauauaagcaguuguaaauuuaucaguuaccaaacucaaggugcaagagauacagagaaggauggauuuucauaugaaaagcucauagauacagucuuggcuuucacaacacagcuaauggucuacuuguugaauuacaguguggcaccaagaaaaaugccuauauuuaucaaaaagcccauagaggcccucauuuuaccagagccaaugauugccucauaguuuaccuacccaccaaacugcuugaaacagugaaugaagaggcagauaugagagccaggcgauuccuugaguauaaacaaacuaugaaagagaauuucgaaaaucuuauauugucauuaugcuaauuuuuuuuguauuggaaaauauaaauuuucauaagaugauuuaugcuaaugugauaaguuuauuauaaacaaaagcuuuuugaaggccuaaccauuucucuaaucaccaugggguucccaggcuaaaguguuuaagaagcagugguggggacaagucagaggauuauggaagggacugcaguggugauguagauggugcaggauucuuuucuaugugggugaugagucuuuguaucccuauguuggaagagggcugaucucucugccuuucuagccuuguagguuugggcagaugcugucuccaugugugcugagagucaguccagcagccuggguuggaacagugucuugguuuccaccaucucuaacaucuucacacuggcuuuuuggaacuuucuccaucuguuagcucuacuugccccuuugggagagaucugggaggaccaagacaaaacagguuucaggggaaggugagguggaagugaggguugcuugagauggcagcuuguuggggaccuucauguuugucucauggguuagugagguucugucuuugagaccuaaggcaguaacuggugaacguucauauguucauucuggaccaagacauuuccagccuguacccuagugcucuguuuucuucugcuguagccugggguggcagugaugaccuuacccaggcucuuuuccugggguuuaugcaacaucuuagguccuuggcuuggggcugccugccucuccugacugacugguuggucugcaagaugacacuguguguuuauuuuaguugcuccuuuauaacuuccugcugcgcuuugcagagcaguggaguuuuaaaaaggcugucugugugucuccaacugagccagggcauacacucaaaucuguuuuauuucuaaccucgagacauuucaggguuacuguguuccugguauuuuugcaaaucuuugauagaaaauggggaggaguuggguugggagaauuaaauaagccaauuccugcagugcauugauuauuuuuauuauaauuaucauuauuauucugaugaaugcuauuucucuaaaacagcccugagagaugauucggacaacucauguaagcucauucugcaagugcucuuccuguauaccaggcacaguugcacauuguauuugugagcauugcaaugugucggaguguagccacuguucuguagcugggaagagacaucgugaucaaggcaacucuuaugaaagaaagcauuuaagagacuuacaguuucagagacuuagucuauuaucaucaugguagggagcauggccguaugccuggcacuggggcacugagagcuacauccuggugccugaaggcaggcagacagacugacagacagagacacacagagacagaaagacacagagacagagacagacagacagagacagacacacaaagagaaagacagagacagaccagauagacagacagacagagacagacauugagcaugguaugggcuuuggaaacaucaaggucuacccccagugauauacuuccugcaacaaggccaaaccuacaccagcaaggccaugccuccuaauccuuuuuauucuuucaaauaaugccacucccuggugacuaagaucucaacuauaugaguguaugggggcuguuuuuacucaaacugccacaucaugauuaggaaugccugugacagaaguucccaaacacugguuugaaauggaugaaaagacuagguuugagcuuaugaaaagucccaguacucaugagguagaggcagguguguucaaggccagccagggcuaccuagugagaucuugugguggagagggacacggacagacagccacagacaaacugacuguaguucucaggaagguaaauguuacaguuuaaaggaccaucacgucagaguguguccuuccuccagcagaugaccaccuuccaguggguggcccuauaccccgaguaucugggcagcauauuggacucugggggauuauuaaaaccccuagaggacauaaaguugggaagggguggaucugaaagaaauuaugagaagugggaaaucaaaauacacuguauaaaaacugucaaagaauuaauaaagcauauuaaaauguggccuuuauuuguggggagcaaguauuuacuuuuauuauuuuauauaagacaauagguaguuuuucuuugugauuccugugucagccuuuauuauuuugguauguguaaugucugaaacaaccuuugucuaggaaguucugaacccuaauacaaaaccauaaaacgucagagcuacaugggcccuuaggaauuaggcauauuaugugcauucuuuaguuaaagaaccugagccuuacaggagguuugcagcuuguccaagauuacccuguacagucaaggugagugagggcucacauuucagauggaauggcuaugagcacuggcuugagucagccacaccugugcuuacguucuucuucgguuucuaucagaugaagcugcuguacuucaucuauuagaugacgauuugagaggcucauccugugguuuaaugagaugauuuggaucagaaggacaaaggaggcucucuuuccccuccuccucccuuucauuaauacacaguccuuuugauaagucagugaggggcuucacccagaagaguauauuuuuagcaaaguuucucuuagcugaugguuuugcuccuucacuguccagcgguuccagagaucugagauccuucucccuccuuuuccaaucucuguuccuaggcacaggucuuagaaggguaggauaaggacuggagagagagcucggugguuaagggcacuuaccacuguaauagaggacccgaguucauuucacagcaucuacauccucauaaccaucuguacaucuagcaccaggggauccaacacccucuucuggccucugugcauaccugcccacaugucugcuugucugccuguuugucugucugccuguauuucuugucuggucuggucuggucugucugucugucugucugccugccugccugccugcuugccugccuguuugcauaccugcuugccugccugguaccccaguccccaauaaaaauaaacguuaacagcaaaggccuugcccacagucagacucugcccuuucuugagauggccugcuuuucuuuccauauccaagaugauugacaaugauaauaacaguuauaccauuuucuaccucauuugggaguugaaccuuuuaauagaguuuagacuguggugcagucauuaccaggacauauugugagguuuugggacuaaggaacaucccaucucucucuugaagcuuuguguaaccaccauaagugauuuugugggauauacuguaguccugaccuacauugugcaguaccaagcucuccuggagacuccaucuguucacagaggaugcauggggacuuggcacauggccccaaaucaucuggcucgaugccauagauuuaucuugagauccaggcauggugauguguggugaugcccaucuuugucuuugugacccagugggucaugacuacuagaaugcccagcuguacucaggucucagggucccuucucuauaugcuuuugccauuaaaguguaucuaguguuucucaggauagcugcauuagguccucagcagggccuguguuuaugccggcauguuucuuuccuuugcuuggggcgaaggggagaaauagcauguggguucuuuucucaggccucuugugcuuggcuucuggggauguuagaaagcacaguuacauccuaaggaaaaucgauguuguguugucuucagccuagucagcugacaggcuugcucuagucauuugugaugaauuuaucaucuuucauuuacucagguaacacccuccucucucuuaaccuuaguguuacccuauccuuggucagcagguuguggcagggagggcugucuacuaucuuuuauuuuugagauaggaucucucuauguagcccuggcuucucucuaauucucugugcaagcccaguuggccucaaacucacagagauccacuuuccucugccuucugagugcggggaucaaagguaugcgucauuaagccuucuaugucuguuaucuugaggaacacuugaacauuuuauuuaggccauuuauuuauauccaaaaugugaguuacuuggaguuaaauaaaauuucauuuuuuaaaaaaaaauuguaaaugaagcuacaccuugggccagcaaccccuguaaccaccugcagauuccauuuguaaucuaucaacauuuuuuuuuucagguuuuauuuuuuggggaguuucucuuauagcccaggcucaccucaaucaagaucaugauacucuuauaugcuucagcgucccaaauucuggaaguacaggucucaucacugugguagaauguccucugaacguaacuguuaccgucuucaucagcugugacugcucaugugcauuccucuagauugggccugucggccggccuucccucauaggaggcagggaugcagaaggcccagcagccccuugcuugauaucccagccacacccuccugcaccuuccugccagcugcauggcauucuguucuaguuguucauggccguguggucuuaggggcuagaccagugguuuucaaccuuccuaauucugugacucuuuaauauaguuccucauggugugugaccccccccucccgcauaaaauguuguugcugcuucauaacuguaaucuugcuacuucugugaaguguaauguaaauauccaauaugcgaucccugugaaagguugagagcugcugagccagacugaguggguguaugggauguggaaaguuaccugaagucuggccaagagccgucuaugcaggcaugaggaaguccuaauccucucugggugagaccuuuggcaguaucccaguuuuaggcuuaauccaaggccaggaaacuuauggguucuccaaguuggacuuugguggaauaguacuuuggucucucauugcaaucuuaucuagaguaggaauccccucuggaaagguuuuauuuauuuauuuauuuauuuauuuauuuauuuauuuauuuuauuccuguaugagggaggacacauggacgugugcaugcuacuaguaacgugguuguuugaggacagaggacacuuguacuuggggaucgaacucaguucuucugggugggcagcagauaccuuuaccaacuggcuugcuugcuggccccaacucaguuaaaauguguuaaaaauguaguuagggucauguuauccauauaggaacuuuuaaauggagaugaugcaucuguuguaagggucaugugauauggagcguguugcuucgugcucccccacauugcuguuuacaaggccugagggggauuuuuauggcaaaugugagugugugaacucaaaggcagacugcucuguccuggggucuucagacagccagugagugcagagccucuccccagcuacacucuggauggugguagccuccuucagaaacacugugggguuaaugacggcccaccugaggcucuuuuagaacagcgcugcuuugacacaaguugaccguuaccacuuaagagaaaugagggaaaacauauuuuucaacaaagcagccaucucauucugacucuguaccccauuaagggcacaguuuuguuuccauugagcucugugguuucucauuggcuuggaagcaagccccgccccuuccagauacagcauuugucugcuucgggcccuuucuucucuuccugguguguucauuuaccccucucagcacugaagacagauguaguaagaggugguuucuucagggagaaguuaggcugcucucuucuuucccagacucuugguucacacuggccuuuccuaaagcucccgcacauagcagguucuggcuaguggcuuuucauuucggucuugucuuuucgcagagcugaguccagugguccucuucagagguggggcugugcaccaggcuagccugcauguccacugugcucuaagaccagaagugagagcacuggaacauucuuaccuuuucucagagccugugggcuucgugugaugcugugguaaggaguaccacuucccuugucuugggguuuccuccuggagcugugugucaccuggcccugcuugccuaggcauguggccagugaucuacauuuuugagucauucaggccgaguccuuauccugcucuuguggcuuccagaaauuuaggaaaccugcaggauuugucccagcaaacaucugguagugguagggcuuccccaaccugugauucugucauauugaguucuaagagaguucaagugagggcacugacuuaucugucuggagaugaggugugagugugugggguguuucuuuauucugcagugagcaaaguccuccuggcuuuggguggaggcuuuaggggagggucaugccucaaggaggaagacuguaugaggaauguuuagagcugcaggcugucauggccugggucaauucuuuccauguuuguaccuuguagucccuauuuguggaagggagccagaagcauccccugucucauagaaaggccacugugauuucucaugagauugaugaaaguuuccugccauauagaacuuucuauauuucuauuuucccagaaugucacuaucauuaagauauaaauuugcauauuuugcuaggucccuugaagaguuaacuguauaaauguaugcauacaauaaaacuauguacaucagggcaggauaggucauuagggugguguuggggaaagucuuuucaccauggcccucuucuuaaagacaggucuggaccagcccccucuaggagaaaaccagacuuguuuaugucacaacucucucuuggccccagcugugaccuuuuguuucuucaggugacugaaaaauuccccaagaucacuuacuuucucaggaucggagucagacagggagagcuaggugaaccuuuggaagggaggucuucugugcucaaagcuuauuugcugggacccaacaugggcaucauugaugagcacugcucugaagcugcuuuauucugugggcaacauuaagccuuucugaugaagccugcaaguuagagucucugagaacauacauuguauuucugggucgcccaggaugcuguucagaaaugcaggugcuucuugccgauauuaugggucagcagguuaauugucaaacauuauagcauauaugcuguugaaccaagcauguuauuuguuagacuggcaguuccaaacaacugucauauguguacuucugcagaguacauugucauauucgaagacuguuugaggugcagcagagcaguuagguguguaaacaguugugugaaagucauaggcaggaaggacaaaagaacaguggcccaaaccaggccauguagauccaggacuagaauguggauuuucaggcauucaaaggaucuuugaaggccuuuagaucugcuguggaagguagguaggcuaugaucccagccaccuagugagcuaugccacuccagcccuccaaccucaugacuuagccaucagccagccaaccaccucuacccagcuucucugauacucuuugccucuuucuaucucugugucucuccacaguccuuuaguguccagguucuugggcacguuccagcucccacuaugugcauaagcccgugagccgcuuauaaauauucccuuuacccuccuagugaagaagggauucuaugguccaagugcugaccauuugaagagaaccuuggauuugcuuggcuuugacaagcccaaucauuuaugaguuuauuaguagcagaugacgggacgugguucucaugacugauggcagcucacuuuucuguuacuacaucagcugaaaaccauuuuuuuuaaaaccuaagauuaguauguaucuggagaaagcgacugagucuaggcuguguggaugugccugggccagcugauuacgaucuguauuaaaugacagaauguguuacuuugcccuuccuuucugcaucuggcccuagcccaugguauuuauugggcacuguaugacuuuucuuauugcugugacaaaauacuucucauaggcaauggaaugaaggaaauaaaggagggguccuuggucucacgguuuaaggguuuacagucccucacaagcaugguggcagacacgccugggcacauuguauccucaggcagaaagaggagauggaagaugcuacccaagcccaaggaacgguacagcccccaucagagugggucucaguuaaguaacccaaucuagagagucccucacagccaugcccagagguuugucuccuggguuguucuggauccugucaaguuggcagucaguaacauccaucucagguacacuguaugccaggcacucucaaggcaacagaggcucaauaagguacagccuugaacucacaguguaccuggggaaaugaggucaacacuaaacaaauaccuauaggcugguuuaagugagguauugagcgcuauggagagagcacugaggaagagggaggaguguuaugucucgccccuugccgccuuccugucagugcuacacugggaaagucaucuggcuucccuagguaucuuucuguggaagugggucgugcuugguaacugcucuucuccugaugaauguuagcuucugucaaacauuagcuccggaugaugacaagaguggauugugucagugccuuacagauguaugucgcguguuauuagaaaaaguguuaauagugcaguaacaaaguagaagccccagugauuucagauccucacugugccaguguuuaucccgucugcacauuaaguauuuuuuuaagcauaucugcauaucucuaggcagcauguugguuagcucuguuuauuaaagugagucucacguaguuuucugugguauacuuucaacauccaguaucagccuuuugauaucuaguuuguguuguagcagcuuauuugucuccauuggugcgaaccauuaauugguaagagaauuuugaacuuuagcaaaguuucugaauaaugugugguuuuuuccccuucauuuuuauggccuauuggauaaaauagagauauauacauauuacucuacaagucugguauacacagaagccauugugugugcauuuguguguagggauagaggacaagggcaucagaaaccucaguaaauuuucaaacaaugcuauuaacugcaaauccaaugcuguaaugaauuuaccuuagcacugugaauucauucauucugccuaacuacacacuugaacguguuagccuacauguccccacgccccacacuacccuuucacccuguggauuugauuuguuuucauuauauuuuguguguucccugaguauguguguggugugcauguguguguguauacaugcucauugguauguggcauauauagguguguguggauagagggcagaaguugaguuucuaucuucguugaucuucugguauacugaggcacgguuucucacuugacccaagggaugccccugaggcaucuccucagccuuugacuuguuuuuagauucuaugugcagccagacagucacugugcagugauggaaugcugucuagcugugguccuguaagaugaaguugacuggaaagcaguacagguagucuuauacuggcuaugugaccuccugugaaucuuguguuuacccuguuucuuguauugagaggccacauugugaccuacaucaucuacauuugugugaaggacacuuuauggugucuuuacaacagugaaaagccuaacagccuuguucuuagaauguacucuuaccuuuuaaguaucaggugaccaggagugggauuguaaaaucuuucucuuccugccagucucuguuucucuaaguaacaggcuuuccuuuuuaaaggcugaaccuucaucucuuucucuuuccaucuccucuuuauucauuuauccacuuggguugguuccugugucguggcuguuguggacacugcugcaguaugagcggauugccauuauuaaggagguuccuucccagcuuaggacucuccucccaggaaugugcugaguguggacagacaccuuugggauauuguccacaugaucuucaggcuucuuucaguuacuugaugcugugauuaguggcauguaucuuguuuuuaaaccaauguauuccugagguaaauugccuugguugugagacugcugcuuuugggcaucacagauuucuccuuacuaacauuauucugaaagguucgcaucugugauagugacguaacugauaggucuguaacuuuccuuuuuuccuuuguacuucuuuugguauugauauuauauagcccaaaggaugaggaaaaaauucacccuuaaagucugcacguaggacguguaagauuagagugugcacaaauaaagaacuuuuccaaggagacauuuuaugguguguuucaggaacgcuauuaaaucuuuaauuugauucuuuauauauucuucauuauguaaaacuuguaauguuggcagccuuccauguguuccuuuacucugccaguuucccuuaucuuuaugacaucuccaggaauauaaccucugcuauuuaauagagaugaaucguuaaaugguugucguuuacagcggcacaucccugcgaagcagaauuuuacugaucucaugcaaccaaaugcaaugcagaaacaggugaaauguauuguuaguucauugucaguguuuuauagacagaggauagucuguaacaaaauacuacaggcuuggagcuuuucaguuagaaaaggguuugcuuugcaagccugaguuaggaugcuuaacacucaccuaagaagccagugugguggcauacacuuguaaucccagugccagggaggcugaguucaguaaauucuugggccucaaugaguagcuagguuagccuaugcuuuuuaaucucaggagagauuuugggaggcagaggggcagaggggcagaggcagaggagcagaggggcagaggggcagaggcagaggggcagaggggcagaagcagaggcagaggggcagagaggcagagaggcagagaggcagaggggcagagaggcagaggggcagaggggcagagaggcagagaggcagaggggcagaggggcagagaggcagaggggcagaggggcagaggaagaggggcagaggcagagaggcagaggcagauggaucucugugaguuugaugccagccuguucucuguaguaauuucuaugccgaccaggaaggacuacauagugaaaugcuaccucaauccaaaaccaaaaccaaagcaaagccaacugaccaaauaaaccaaaaaucccaaaaccccaagguggcugcugccugaggaauacccaaggguuauucagcacaacacaaaaucaaugugaagcucaaaaaugaagcuuucccaaucuugcuacccguucccucugaucuuguuuuuuuuuuuuuuuuuuuuuuucuuuuucuuuuucuaauauauacuccauggagaguaccuugccauucuaaaguggagcugggcagccacugguugcugauggcucccgcagcccuggcacucugugguggagcccucuuucauuacgcgucaaggugaguggggcaagccuuugacggacugugguuagagaaagcccagcauucaccagcgucaccgcugacccugucaucucugcugagccgagcagguguggcgugagcucagcuuccuuucagcccuuccuucucccuggugggccguuggcuccugaguaagauagauacaugcaguagaagagcuguuaauagcauuuacucugucuuaauccuuuuuaaucccauucauauuucagagucugaaacuuggcaggaugucagaagccacacugugagcagggaaauuuuuucuuugaacagcaggaaccuaguuuaaaaaauucucuaauauuuaguuuguuaaaacauagaagagaaggaaauuucuccuuagauaucugagugucauuaagaagucuugcuagggcuucauauuuuuuucuaacgaaugacaacaaucaguagcaggcuuagucauagugagauaucuguggcauuggcuuccugaguggaaaaauuaccagagucaguggcucucuguccgaugucacacccauggggacuuuggaccucauucuauuccugaugagacauucgcuuucguuuggacuugucagccuuuuugauuaauggcuauuucuuugcagauuuaaugcaaaaacauuguggaauucugguaaaaucuaggaagacuuagacuauguugagauuugucagaucugggacuggguaggcauuuucuuuccuacauuuacugcagugcauauguguaucggaaagccagauguggccuguaaggagcuugguugcuguguggaaguccuucgucauccagccgcuccugaaugcuagguuuuggauuggacuuugggucagcuucaggguagugaggauggaugcccaagaacauguugucuucaacuuccuggccuuccucuuccaaguucuggccuuuauugggcagagacgggucuugucuggagggcagcccugucugccauuugaaucccagcccagcccuggggugugagggcuggcagggagggguaggcaggccauuguaggagagaagacugggagcuccuggaggaacaguuaggguuggaaucaguugugucuuuuaaaaauuuuacccauuuuggacuugucuguggaagcaauuagggagaucacaggaccguuucugauucuugauucugugcagugucuauucagaaagauagaaaacagucaacuggaacaggggauuauuugagcacacacagaguccuguugucucagcagcaugcccucagacaauuugccuuuuagugaaguuuaaacccaugaaaggaaauaaaaaguguuuuauuagauggcgaagaaagauggacugggcuuaggagacuuugggaauuuuaguuuuuuuucuuuguuaaugccaacuuuggaagagggcaacucuuucuguaaugcaauuuauuuguacaaugugguaauuauugcuaauaguuaauaauuaucuucaguuggacaaaaugucagagagagagagagagagagagaauaugaauaugagggaaacauugcugcuucugaagaaagguguaccuuacgcauggggccugcuaacguuuaugaagugucugcuuugguggaucuagcuggguagucaggccagagcauuucuccaugaauaugcacagacugaaccugugggagcacugaggacucacugaaccugcgggagcacugaggacucacuggaccugcgggagcacugagggaggacucacacacuuuuacuaagcuguuaaagaggcagggcagagacaccaacccaaugggaacuugcauaacuguuccuuuuuuuuuuucuucuuuuuuuaaaauuucauuucccuuuuccuuuuuuacugugaaauacugacucauucaguuuggcacaguucagugaaguuuaugaacuagguauauguccaucaugccuuguuaaaagugugguuuuuuuuguuuguuuguuuuguuuuauguuuuguuuuuguuuguuucuugagagcacauaaagcaagccaggagaugcacacgugcuucguggauggauagauggugccagucacaggcagggagagggcuuacuaugugcugaguagcagagaucugggcuuuuugaccuugauaugaaaaauguuucaaguucuuagucagggaggaaaaaucacucuugguuucaauucccgugcaggucuauggggcuauaucuuaaaauaugcugcuuuacuggaucuuucgaagggagaacuggacaggugcucagcagcauacuggauaguuaaggggaccaugcccuuuggccuuccccaucaagacaggcccgacuagggcaggagagauggcuccacaguucagcccacuugcugcuuuugaggaggacuuggauucaauucccagcagacacaugguggcucauaacuuugccuguaacuccaguucuagggaucugaugccuagaacuuucggugcuagucauacacacggcgcacuuaaauacauguaggcaaacacacagacacauacaauaaaaauagaucaucuuaaaaacgaaagcaaaacccaggcuagccugauugaaggacagcuggaacccacugggcaaaccuagccuauguuccagagaagcaggcccucccuuuguuuuaaaaccauuaaauuuucuucaguuuauuuugaguuuuccugucacagcagccuccaguucagcccguucguuggguucguuggguuuguuggguucguuggguucguuggguuggguucguuggguugaagcugucucagguccugggcucuuucccugauacaccacucuuucucaccugugcugcugcaagccagcugcucucccacuuugcaggguaggugaguguccgagagaccugaucaaguacaagguucaggcugggugaagguggguaggucugucccuuuguuuuuguuuuuuuucuuuaaaaccaugugccacagaugguuuuguuacuuauuagagucugacugggcuggaccgacuguccagugagaccaggucuuccugucugucugcuccuuggcgcuggaagagcugaggcuguagaggcugccgcagagaccagcuuuucauggguucugaggauccgaacucaggccuucucauacuuucaugguguuaagaaaaagagauaguuucagugucucacacaaaggaacaugcaagcaagcaagcaaaaaaaaaaaaaaaaagguagcuuggcacugcaguuucucuuugugaaaagguuacaccaccacccaaaccacaacccaaaccagucuagagcucauacuggggaggucuguauucuaaugcagugggacaacugugucuuuuccccauuggcuggggccuaaccucaaugucuuccuugauuggcuagcuuuaaaagaauucugagaagaaaugaagaagguaauuguugguuggccaucucgugugugugugugugugugugugugugugugugugugugagagagagagagagagagagagacagacagacagacagacagacagagucagagacacagagacagacagacugacugacugagggguauuuuguguaagccaaaauuuuauuacuagguagguuaguuuaaaagauuuacauaaaaguuuuacaagguuggggaagauuuauagaguauugacccuugguagcugccuuugauaggcaggaaaaaauaaacauuucacacaauggcaaguacuauugggucacccucuccccagccuccccuucccacuuccuguucuuuauugccaccuccauccaguauguauguauguauguauguauguaugcauguaucccucuauccaauaucaauccaacuauguauguauguaucuauucaacuaucuaucuguguaucuaccaucuauucauauacuuaucaccuaucuaucuuaucuaucaacuaucuaucacuuaccuaucucauucuuuuuuuggcucaguugcucucuucgguucuuuacugcugcccagauccauccaauuuuagugccugggcccuuuuuccauuuucaucuuuuaaacccaccuuccuccuuauuaccuguucacccaccugacagccagugcauguucugugguaggugugaacuucaggugaaucuucaccaagaaguguccagccagacgggcagugagaaucccuagugguaagaguuaagcaccaggugcuggcauaucugggaaggaaacccuagcucuaguggggagagggguucuguaagggucaacgaaggcugucucauagaucagccagccaggauugagaaagaggggcaggaagcucucacuuucuagguaguagggcuggcuggagccagaguugggacuggcagcuggacuauugaggaauuugagguaugugaauagcggaagggggcaugugacaugugaacucuucaguuuaugucuucuuugcuuuaaagagauguugguuacaucuguuguuaggggaaaaaguauuucugcugagagguucagaggacaaaguagacagugguagacuguaaaacacuggauuuugccuaaggcaagggaagagaaaccacagugauuaugcauuccuuugucucucucacugacccuuaagcaguuugggacuagggaaggaaacuauguccuuucugugaagaggggcugguggaaaugugcuuuggacucagguuuguuaggccugcgugagccucucuuuccucuacccucaacagaggcaggcugagauagaugaucucuaaggcuugauuccaguaugacuggucauacaugucuccguugguugccuuugaagcccugaaguugaacaugccugguuuaucuuuacaccaaaaaaggccagaccagcuuugccccaggcccuaaggagcuggcgcuguaucucagcagaggaagugagugagguucugggagaggugaacuguguaauaguuuguucacaagcuuggagcauauauacugccuuaugcuaagggcuaacagagaggcucaggcuguguguuguucagaaucguggggcugcugugagccagcagcuccgugcacaccugaccgcccccauccugauuaucaggauuacucucugcugacacuaggcucacaguucaagucauuuuaucucccagauacccagcauucauuaagaaaggugcuguuucuaauaucucaucagacaauuggaaacccagaccagccuugagagauccagaguacuuuuuaaaauugagcugaauuagacaguuauccuuucucgaacaugccuugugcccgauagcauuucauugacuucucuugaguguuugaggaggcuaaguagggacauaaacccuguuugcaggugagaagcuugagacuggguuccguguagguaacugucagcucgaaccuacccacagggaugcagccagacucuggcugcaagucuguuuuugugguucuauccagggcaaacgugugauuuagggcaggacuaagccgacuauagccacugcuuguuuuugcaugacccaugggcuaagaauagcuuuuacauuuuuaaggaguugagagaaaaagcaaggaaaacuaauuucuuucuuucuuucuuucuuucuuuuuuuuuuuuuaaagauuuauuuauuuauuauauguaaguacacuguagcuaucuucagacacuccagaagagggagucagaucucguuacggaugguugugagccaccaugugguuucugggauuugaacuccggaccuuuggaagagcagucgggugcucuuacccacugagccaucucaccagcccaaaaacuaauuucauaauguaaaaauuguaugaaacucauguacuuauggaugaauaaagcuuuauuaaaacacagccauggguguuaguguccugguggcagacuucgcucucuacugacagacuuguguauccugcagaaccuaagauguaaugccuggccuuuuguagaaguugaccgagcgucggaucagggcauucauuaggcuuaaugggauguuaaaaguaaccagucaucuccuguguacugcaccagcuccccagucagcugccacuugaagaucccgggucuccuucuguuguuugauguccuaaguguccugugugccaugcauggcagugcccacaugaugugacuugcugagcugccaucuucucaagagcuaagucucucggagcagaugccugguuuucugcugagaccuuguauuggaugaugguuguccucaggcaguucacugcuaacaucucacuggagggcagguggaauucccuguguugucuaaaugugugggugaugcaggcuuucacugaaguggaaggaaguggaagguuguagagacaggaaaaccaagaaguaaccuucaccaucacuugcauuucugagacuauuuugacacaugguuaagaagggacucaagauccuaggcucuuagucaaaccugaugccauuguugcuaauugcuaacuugagaguguguccucuuaauuccugaacagugccuggguggcaccgucuuacauggcguuugcugucacucauagaggccugcuauguugcugugaggagcuuagcauuugucagaccugcugaauaacuguaggggguuggucuggugcugcuuauauucagaugcuaaauucuguaccucaagaucuguuugcuccaagaugauccuuauggauuccagccuugguuguguaaaccuugcuccccaauuuaaaacuauucauuaaauaaaacuggaggcagccaguuacaggggaaauagggagagauggaguuugaguuaucgugcuggagaucgcagguagugggcacgaggacaaggagagagggagaaggagaugaagaaggugaaggaggagaagacggagcgagcaagaggucuuugugacucauaucggaccagcagcacaugucagagucagaugucuccccaggacaccagacugcuggaggagaaacaacccagagaauuucaaagagcaaguguuuguuuggggaggacaauugggguaguagccagaguagugugucagagauuuagauuagggguaaucccccaguaauugugcagagccugauaaauaaauaacuaucauugcuugggcugcauuuauuagaagcuagaugacgauacauuuaauuaaaauauucuacaaguaaugagucuuuucuuuuuuuuucuucuuccccugacuuaguagcucaaaccaaacugcuuugaaggcccagcacacccaagccacagauuagaugagaaaacucaauaagcugugucguuggcugugggcuucagcccauugauuuccuacccuuccucaguucugaaguuuagggggauccacggggagggugugguuugugggaaugucugggauccugcgcacacgugcagugacguaacagaaguucuuuaaaagcaaaugagcuuguugaccccggcacccaugccaccauggcuucugggaucagaucagcccuggagguuguuggguagagagaggacugggagaggcuuagaggacagucagaggaagaguugguuggaacuggguccuggauuuucuucgcucaucugggagaaagggggagggauguuagagagggacucagacugcagcagggcagucucugagcacugggcccuagugaauggugugucuugucuucuuuuauccagaccuugagcagaugggcagugcacgagggagcugguugggcucagggacuggauucaguauuccaguuugagggucuggagucaagucaucaacugaagaccaacaaaaugucggucaggauuuuguuccuagugguggggguguuugucccacagguggauaacagauuaggaaauaaggaggugguuagugguagagagaauggugccauuuauauucucaguguggacguuguugacaagugacauuggccagaaggcucuuccucagagaagaacuuagaaagucaacaguucauuggugaucauaacuuuugauuuggguagcaaagaacaggucuaucaaaggccacacacucagaugucuucaggcaguuggaaacauaaauaaaugaucuaaaccuugaaaagucguacugucucucaaccugucauacgcucauauuugauagaggaaaccagcugugugggcaccuuguugcuuggcaacugugcugcuugcccucagcauuggggugauaguacugccagugcuguuugugcuuagcacuuaccccacagagagggucaccuagauccaauuaauggcuugaauguggccagauaagaacuuuuuuuuuuuaaaagaagacguugaacaucaaaauaauaguaauaaaaaagccaauucucccuauucuuaagauuuuaagaaacuuauaauuuuaagaaacacuguaggaaguugggcaugcuagaacaugcuggaacaugcuuauaacuccagcacuucagagcuaagggaggggugugacaaguucggggucauccuggacuacaaacugugcgugacuugucuuaaaaaacaaacgaacaaagcacuaucagucaaaugaaagcuacugcuagaaucaacaaugaagccucacuucagcacccccagguuuaccugugacgaggagaaagggcugggcagaggcaacgcccaagcccuuccagaucucuggggaucugugcucagucccaugcugugugaucugguggaggugcuaaagugugugagauccacuaucagccuucauaaaguccacagcuaggcaaaccaccacuuuccaucuuguauucucuguaguccauuggaagauuccauucaugguugaguuuaaaaggcuccuuagcccgcccuuucugaaaucuagaguguuugggauuguaugaaaacauuugcuuaaguaucugccgcacuaaaucugaagauuaaagcucuccugucucagaagacgagcagaacacuccccucggcugucuuggaacuugccauccuccugcauccgccuccugggcacuggcaugugaaccaugaauacaguguagagcaucaggagagucaccugguugcacucagauuucuugaaaaauuuaaaggucacuugaaguuucguugcugucgucuggaaugcacagacacauccaugauuauacugaucugaaauguggaauuguguucuuauacguuauucauaaggcucuuuuggggguguguggggguuggcaguaacagcucugguaaaaauacugacagaagcuucuggcccaagauuuucuaaagccuccuucaguucugcaucucagaguucgcaaggccucuuucagguacggccucugaccacguguuccucugcaccuuguggaagagcucauugugccuccaccugccucuagugcagcauagaggcagcugggcuuuuuuuugguggugguacccauuccguccacugaagcuucacccucagucuuugggcuguagagcuaugggugaugcugacucuuaagauggcaggaucaaauucugaguccuuuauuugcaugcgagguagaguguaugcaugccuguucucaucuugccacgcugucugcuuuccugcucaggcccugccuuugggcuccauggcggaauuuaaugccagguacugagaccaguucaccaggugaugccugacucuggggccuuucagcugugguacuugcugugugcguuuggugggacgccccaccugugugcuguucuuagaaggcaaggauuugccuuucugcggacuguauuucggggagcgguuggauaauacucacagagagauaagcuagagcaaugaagaaagguggccuuucaccaucggacucaguucgcaucagacccuauaaaauacucuuugauuuuaaacauugcuugaagccguucacauucugguuaauuacgucagugaguaaauauagcuguugucaucuggugugugggcuuggcuuuagaaggauaaagagucuauuguuaccccuuguaccucaguccguuucacucacccucgagcacccagcauguagaauagaaaaccuguggccuccucacuugcuagaaucacaggcugcuccgugauuucaguuucuuuugcaaaagcugcuucauucauucagucccaaugagcugacacaaggugucccucaggccauuugucaccuuggcuuuccugguaccuguugagaccugcuugcggaugaggcugcagagugcuuccuggaguuaaggccgaggguuccagggucaggcggaaggggugcaaaucuuuacuguaagcugaaccgugucaggacagggacaugaucucccagcugugcugucaaccucuguaagauagggaugaccauggcgucugcucccuguggucucaggaggcuuaagugagaugaugaauguaacacccaaugcagugacaggcuaggaggagagucgaugaacguuacagcaaguguagaccucccagggggucuguguagggcugucugucggccacaguuuuacauguucugucaauccccuguccuuuuccuuagucauauuuccuagagucuuuaggcaaggucuaaagacugcucaucuaggccccucuacccugaccauuugcucugccauuuucuuugaaguguuuccaggcuuaagguuaagguuaggguuaaaagguuaagguuaagguggucuggaucaccuuaagugcccccucugccuucgguagccugcaccaaucaaggauugaggcggggguugaguggcauggacugaaagcuucgaggucaucgggugaagugaaaggguagcuuugggguuuggugaggaagaaggguguuaggacaggaugagagaacacauaugggauauagauuguagaugaccuuucguuauuuuguaauugaugaaaugaauggcuuugggagacucugaagccccagaacacaaaggucaaggaaaguggaaccugcccuuuauuguucuuguucucauuucuucuuuuauuuuuaaagauacagaucucacuuuguagcucaggcuguccuggaacucauucaguagaucaggcuggcuuugaacucauagagaucuaccucccucggccuuccaagugcugggauugaaggcaugugcuuaauccugaacuucuugacccugcuuggcucucacccagcagaucaacuggcucucugaagauaagccuggguuaucuucucugugccccaacugaccccugcccacccaugugcaccccaagaggaggcuuaccucuguguucugugccaggggugcccuugauuucugccuuccuguuuggacaaugggagaugggagagacagucacuucagcuugucuccccuuucucguugugggccuccaggauucuugcacauugcuguugcuuucucauccacagccccacccacuuccccacuuauccuggcugagugugacaccuguaucugucaggcuccugacugacaccgcacacucuuaagaagagucaucugacagaucuguuuauuuucccauugaggaagguccuaacacacagggggagagagagagagagagagagagauagauaugucaucccggugaauggaugaggagacaggaucuggccucauucaccuucaguguucauggaaggcccugcuuuaggcguuguucugcuuuguauuccaaauuccaaauacaggguucuguauagaaucuuagccauaaucugacagaacagaaacgaacguccgcagauaacuaccuguucuggcucuuguuaguucuauguguauggauaaugucuugggagguuuugaaaugccacaagccuugcuggcccagggugcagcugccucugcuguucagaccucagauuauaaggacagaacacagcacggaaguggggggaucagaaccaugggagauccaggacgaaggguguguguauaggggugcauuuagggguuccaaagcuuauagccugagggagucugggauaauggggaacucacaccagagaggggaagaggaggacuuaaagggucucuuuuggugugugguguugucauguggacuggggagacuucgaaagguuuagguccguguucccagugaggucucugcggccugguuguagagcaggaagaacucaggguuccuucucuuauucuccuuccucauuucuuuuccuccucagaagauuccuuucccuccuugagcaggauggggaggggcugggcaaagaccagauuuaauugucagaggaaccauuuggaagugugucucagcggcauuuagugcauccacccugcgccucugucagcucuucucgcuuagaaucccaugaagaaacccaguuuacguagacuucauuuguaaccaggccuugucucuccccagccccuguggcccccggccuauguuucacuucuguggagucucuguucuggauauuuuauauacaugaacagucacguguccggccucuuucccggagugccaucuuuuugagauucuuucacguaucaggagucagugccccguuccucuuuuugaucuagugauuuuccucuuguagagcuauuggguauguauagcuauuggguacauuuuucccuuuuggcuaugugaaucgcacuucugcaacgccuucaacagcucccuggugcaaaggccgagaugucugguuccccucgagcccuaagccccaggucaaacucccuaguccucuguaucacagcucugcuagguuacaagggaaaggcuggggguggggggacucagagaagggucagaccucaagcuugucucugcauaccucauuaugcccagagggaaguggggaguggaaagcgcugguccugucucgggucugcagcaucucucucugggcuuucuccucuggacacagcuagucucugaucuugggcuguguaacccgagcagcacagaccuuaucuguggauggagaugcucauuuuuguugccaccacagccaucugggcaugggcacgcugaggacuccuggacucccggaaggaauccugaggaaugcuuacuguuuucccugugccacggagacugauuccagggggagggaagucucagcuccuccuccgggagcagcaggagcugugcuccucaccauguccagcugucagcagggaaguuguccccagacucccuuuccugccgguaaccuugggguacucuucuugggccugggaaccugucuccugucaucccgcaucaggcuuaccgcauccuucuguuuggaaggguggacuuucuguugaugucauuuuuaaaaguaugugugaagugcccuucuagccagguaucuugcaggugcuguuuacagccaucuuuuuaucugguuugugaaagacgcugagguccuggcugugccuucuguucaccugggcugaucccaggagaggaguccuuggccuuucaggauugcugcugugcagauucagguuaagagaaagucaccccucguuguccugugaacuagcauaaguuguuaucguuaacaggugcaaaagcagauagcugcguggucagcaggguugcucucuccuggcaaggagucuggagguauugguugacuuagcucaagguucaaguucugcucauccucuuccuggugcucuucaacauguugugaagcugcaggcaucacgggcagaccccaugaaauccaccauagcagcaugguaucccccccccccccccccccccccccccguguaccucauuguacuaucuuuugcagacucuugauaccauuuugcuaggccaagucuuaguucccguggcuuccaaggaaagggcugacauuauuuggaagucagguccaaggacucaaggacgagagcgcagagguggagagggaaguuggcaaggaggugauagauaaccaugugcuuugaaguggccauugcuucaccaugagcuccaaagagacccagccugccuugucuauccagucugccucagagcacggggaacccuuaccauguuuuuaaaaaucaucaucaucauuaaugggaaaggaacaugcugauauauuuuuuauaauuaacuuuuaagucuucacuaaucacuaguaauuuucuccacuuagaagguggcagagcugguaguuauacacagggacucugcagucugaguaccacgguucaaauccaggccugccauucaccucuuuauuaaugagucguuugaaagacugaguuugugucugggagcauuuuaaacagagccugguagucagugcucugaaugaauugacgucaacaugcugagcacagggacuccgagcugugauuccuuuuuaacuccaacagaugauacucugcuuuugcaggcaguacuguuuaccugacucugagggcguggcugcugcuguccucuuucuugggaugacgaaagaggcugcuagcugcggcauuggcgcuuuagacgcgugcuuggccuuugcgggugcguccuacugggauauuuaugauagugcucucugacuggaguuacuuuuagacuugucucuuuuccucauuuuuggcaaacagcuagagggcaggaugguuucaggugguccuuagaugaauggauuccaggaggggcaacgcuguauugauaccaaggcggguacuaugggcaggugccagaagccaccauccuaaagagugaugguuuuguaguugaacugggcaaaauacacuugcuuccuugugcuggcauggccucuuguguucucccccuccccuuggguccauccuagacuguguuguugacauauugccuggcucagaugagcuaagaaagguuaagcuugagagaggagaugguagaaaguuuugggggaccuuggggauuccguuccaucucagcuaauugguucuuuucugugacacuuauugagcaccuacuguaugcacaguguuucugcuccuguggaggaaacaguggugaaggagugagggugguuuaguuuuccuggcugguuauagaagagacuucugaagggguggccuuuuugggcaggcccuagaaaauaaguuuuggggcacugauuuugcaagagggaauauauguuuaaauguccuaaggggaaaucagcuucaagaauacgagugucaccaagacuagaggagccugcuggguacuuaaggguggauuuuuaaucugagggcaguagggaauuguggggcauuuucccuucuuuugguuauuuucuuuuucucagucaccauacuuuggaaauuccaauuaccaaaagcauguauuuaagagacaaugggauuugcgaccuugaauuacauuaggcuuuggggaaauaauguaugguauggaugauagugagaaccgccgaagggacucccuggcucccaaacgaaagacuaacauugccaacuaaaucuguaaggccucacauucugcuccuucccaaagcuauauaccagauaauuagaaacugauugcccucuacugauagacuaaagaagguuacuauuguauagugagagauuacaaaccuauugacugcacuucagccauggcuuuaacaguaggcuggcccuggacauggcuaaagggaagagcuuguggccugcauuuccuuuuguauucucuguaaggcaguucaccucccaggggcaggagggagcacuggcuugcggagcugugaaaaacacuggguuuauguagucagcagccccauggccucagugaacccaguuaaucuuuuguauaguugacuugcucuuucccuguauuuacagccccaggacgcccucuccauggccgucugccucccgugcacucgauacccacccccaacugcucugcuucugauuugcauuuucacgguugaauggaucugcugacuucccuuuucuuuuccguuacagguccugugcgcaggugcgggugaguaccuugcuccuuuccauucuuguguuguuugcuacugcccccuaguggacacaguugcauuaauggcuaacauggggggaaaaaaucacaggaaaaaaagauaacaagaauccacuuaugggguuggagagauggcucagugguuaagagcacuagccucucuuccaggggaccugaguucgauucccagcgguggcucacaacugucuguaacucaaguuccagagggucuggcauccuugcacagacaugcaggcagaacaucaaugcauauagaaacauaacaacccccccaaaauacaaugaagauagaaacuguaagugaaaggagcauucaguuaguuguuuaaccacaacuauaaaaauucuuuguuuucucaacugaaugacggugauauagcacuguauucccaguuccucgggagucuacgucagcagauucuuuugagcuagggaguuugggggcuuccugggggacauaguuaaaccaccagcucauaaaaucauuggauuucuugugauuuucuuucaccagcccacacccaugugugagauaaauauacugaaacuguaauacugaauauuucuauuuuaugugauauguauuauuuugcaagcacuuucuuauguugcuguuuuacuacacuuacaauaugguguugugggauuauagaaauucuuggaaagcagagauagccuccuauauuuuuugauuuugcgugucagccugggagugagucuauagcucaugguugcguacuugcccgauacauaugaaguucuggcauccuuugaaagguaaguuauacaaaguuccuuuccucuuggcccuccagugcuguguggaggccugagucccaguuggagcuggguacuuuuccuggucuguaggaagacaagauaaauacagaugccugccuaauauuauggugacgaugguuuauauagcuaaauacauccagcugaaagcacuguucugggaucaagaccuuacuguuucuguaggaggauaauaguaguuacuacuuuaaaaaaagguauauuuuugggaaaaaaaugguagcauuuuuugccccuaaaauucaggacuuuuuuuuucuuuuccagcaaagccaaaccgaaccaaaccaaccaaccaaaaaacaacccaaagccuaggacucauugagauaaaaugauuggcuuggucuccccaaggagggcagagcuugcugaaccccucuaauaaggcaaaucuuuguuaauagcaguaauuaugcagaacuuucacagacaguggggugcccacacaggcaggcacugucucucccgugagccagccugguagauaaguuggagaauagcuggagcucugcagaauuucacugcucuagugcagucuagcucagaggguggaguguuauugaaugcucauggcagggaacaaaacuccagagcuacccuagaaggcuuucccugggaacuaaggacuccagagccacgggaggggcucugcguuagucugcugggugacccucaggaucacgccacauucugucuccccacacuucaggagguucuuucucucagcccugagagcugugucaucauggugcugccuccagccccugccuacauacuaaucugcucuucuuauaugaauggcagcuuuauggggagagaccccccacucucaugaccucauuuggacuuaaccccuugacacccuaucuugcaagugugcacacauuuggaaguacugguauauggaguacuuuaauguauggguuugggggaugacaucauuuagucuauaacuuacagggagugggauuuaggugcagacuccagaaucgaugucuggauuaaagcuauagaguuacccccgugacaggcaguagggugggaaauugagaagguguuuacuuuacauucagaaggguguguccugaauugugaaccccagauucagcuacccacagugcugacugaguuccaguuccauucuguaccaaagagaccuaugagacacauccacguauuuuccccaggagcuggaaaugcacauucuucuccacuggagauggagcacugucuggaauagaccuauuuuaggauacacaggacaucucacgaguuuaagaauucagggagccacugcaagcaucucucacagucaaguaaaaccuagaaaucagcuauugcgaacucuggaaacuacacacauuuggaaacuagcaacaugcucuuauauaacaggcucacagaucaauaaugcaagaaaaaaagaaaaggaaauuaaaacauuugagaaaaaacauauuucaaaacauacagaacguggcaaaaagcuguuccaagagggagguuuauguuaauaaacgacuuuguuaguuccuccuugaaaggucggggacccgauucaacagcaccccgaagacucuucggugggucaagugagacucaccccagggauuuaaacaugggucagcacacgcacccgaguguaugugguaugcugcguugauagaaagauggacagaauccuugguacugugacugucgaaaucuagcagucuguuuccccaugcugcucagauccccucuaugaauaaaauccaagcagcucuucuugcuauugggaugccauggccguccuccugcaggcgaggcacgugcacacuuagcaccuguaccacagcugggacauugcccuccagggugcugcucgucugacugccuccucggauguagcucuuaccacuuucuccucaccaccguuguggcugauuguaaaugguggcacccagugcugugugagccuguugacuuauagaagaagcucacgccugaggaggcucacagaucauaaaguguccaauuucuccuugcuuuccccuuccuccccuuccuaugaacuggaugaacucgcaccuccuucaagccaggugaggcacaccauccaguucgugcugagaagacugucagcagugguuucucucgcacuucgagaauaagggcucaccuuguauuuuacuguuccuggggcauugcucuucaaucuugaacuuaaccaaguuccacucucuugcugguauuacagugaauaaccacauggcuuccauugguuuggagucuugcauucuuggccuuguacagggauauucagagaguugaaacaauuuugaaugaaauuuuaugaccagggcgauuaggauugaggugucuuuaugaacugaucuugucuauauugucaugauggcuuaaugauaacccuuugaaguugguaugguacauuagaguuaagauuggguuuuaaggggcucaaaccaagucacucacccaguggguagaauagauuuucaugggcuguuuugcaagacucauuuugccuuguaucagcucuuguaucagcugaugucaagguuuaaacucacagccacccucuuuuuguuuugucuucaguuucaagaacgcacauucaugcacaggugcauauauguuuggauguauuuuguuucagggaagucaaagagacaaaugaagagaaauaaaauuaagucccaacaagguagacuuuauucuuacauuauuaccuuguuacauauaauuaaucucucucucucucuccauucucuucauugaaauagcaccgaauccuauauuugacauugaagcugucgucagcccaacuaguguguuauuaacauggaagcacaaugacucaggcgcuucagaauguagaauagagaauaagauggagagcaaucugacguuuccuguuaaaaaccagacaucauguaacauuacaggcuuaagcccaggcacuucguauacauucuccaucaucucuguaacaaccaaugagaccuugaacaaaacuaucacaacagguaagggacaggguaaacagggcugguggcuacagcagcagaggcaugggguggugaggagggagguuuggagcccucagggcaggacucauggaaaagaucauaucagacacuguguaugaaagauauuaucuugucuccauaaagcccgagggcugaaggugaaaaccgugggaaaguuaaguuuuuucuaagaucccauaguccuggauaucaagugacaggacuagaauuuggagagccugagucuagucgcuagagauugugauacccauacagccaccaagauccaucacauuguguaguuuauugguguuaaauucuuuagugauaaagaaaaugagagcggggauguagcucagugguauaguguuugaguaguauguguaagacccuacuucaacucuuaguguugucagcauccucauccccacccccacccccaacccccagggcuggagaggugguucagucuaugaagugcuugcugugcaagugugagaaccagacuuuggguccucagcaccaacauaguaaguacugggugggcauggaggccucccuguaaucccagguuagcuacaaaaccaacccacccacagugaccugauuuagaaucuuuguaucugaaauaucugaugugagaagucaaaccaacgaccagucauaugagagcuggaggcugccuuagagucauuuauccagcuucuuggcugucagcccucugcaggccgcaggcagggcucuucucugugugcagcaccgccccuggucuccucacagcacacagcggcaggcuguguucuugagcuggucuuccugcuuccccuggucucccuguucuuaucgcacagaggaaagggagagaugcuaggcacuggugggaagauugcugcaugucugagcccagccuggggccacauagugaaacuaacuaaacaagcaauaaaaacgcugcaaaaaaacaaaaaacaaaaaacaaaaaauggaaggaaguguauguucuuucagcugaaauguuuaaauugucaagcaaauaaggcgauggaagggccugggcaugucuuuuaaaaucuucuuuaaagaagaauuuccaauuccuuuugggaucaaucuugaacaauaacacagaauguaagcaguuuggguuuuaaggguucuuccuucucgagucuuuggaugguguuuguccgcugccuuugugaugucauggggauguuuggacucugauauaaauggcgcauauuuagugggucacuuaggcaguggcugaaggaaagauggcugcagaugcuuuucucacuaauacccaugguguguuuuugaaacagagcccuggccagugucugaucuccaugucaccucugugggugugacacaggcucgucucaccuggagcaaugcaaauggcacugccuccuaccggaugcugauugaagaguugaccacacauuccucagucaauauuucaggucugaagccggggaccaauaauagcuucgcuuucccagaaucaaaugagacacaggcugacuuugcaguugcagaggaggucccgggugaguuacaaaauuguguaucagguuuugauuuuuaucauuuacugcuuuuaaacaguacuaugcacuguauuugcauaauacauaugcauaauacauauaaauaugcaauguauuuguguaggguuuuagaauugcuggcagguuuuccugcugagguguugucugaucucauaccuuaaugaggaagagugcuucuauucuacaagugaacacagggcucagugugguaguugggcuucaaacuuuuagauuuggaguucaggaagauagauaugccauuucacuuuucaucucaggugagcaguaacaggugauaaccaauggucagccaaaucagucacccccauugaggagagggauccuuggugggcgagcucagcagaugucuucuauguuuucuguaggagucauuuguagacuuuguagacuuugcaguggauuccugguaacugugaaaugagaaagaagagaggcuaaaucccuauuuuacaccaaggaaacaaagauacgaauuggguauuagaaucagaaaccagauguugagugcuaauagugaaagauaauuuaugguccaugauagauagugaagccuucaagaaauagaccacucucuacucuuucuccugcuuugguccgugagucagguugcuuuucagagacccccaaacccaguaguucaaugagaaauggucacccccugcccuuuuugccacgguuuggaguguuguccuggaaaaacacuggaauggacuuacguuagcaaaaguaggguuauggagcaaucugagggagaccauggugggauggcagaagauaacuucccaaagaaaggagaaugguccagcauaucagaguucaaagaaaacuacaaauuaucugugguguuuauagaguaauaguacaaagugaaguaucugguucuguucagggaaccggauauuucucaggaggugguagagaacagauauuuauggaguacccuguuggaugugccauccuaugggauggugguggaaggugggggauguguucugugguuaauuucuuugccuccugucuuugaagcagaugccaaugguaccaagagaaucccagugaccaaccuaucccaacuacacaagaauucucuugucucuguggacccacccucuggccaggaucccucccucacagagaucuugcuuacugaccuaaagccugauacucaguacaaugccaccaucuauucucaagcagcaaauggcacugaaggacagcccaggaacaaaguguuuaaaacaaguagguuggauuuugugaaauggauucagccugaguuuuauaaaguuuuaucuuuugcaauccuauaucugaauuauuuauugcuuagcagauaguucuggcuucacaucuguccuugcuaucugcagauuagccaucauguuuguggguuuggccugcccuugagggccacacugaacuuucuguugagacccuugcuaacuuucacuuugcugucauuagcugugauucacgggcacccucugugaguucaguauuugguagcuuuugugauuagugcugccgauggaauaagauguacgguuucugcuuuuagauggaggauugggauaaacauaugcagaaaugucugcaccuggguccuuugcguucagauauguagcuucgcaguucucagggacuugguguguguuugcuuagugugucuuagcagaaaauaauuugaaauaccauccuaggucaacagacuugagggagugaggaucaaagguagaggaacaaggacagaaaacaagcuggcauccaggaagugccaggccacccuauaucuauugaaguccccauguagaugcuguguaucugcuugaugaauggcugggcuggguaauugagcuggugugccuugacucucaaacaggcgacuagcaguuccuaccaccgagaguguuggguacugcuuggaaagggggcagggcagcuucacaggcaggcuucauggcuacugucugcugcuuacucuauggacauugcgaggugucuuagucagggucucuauuccugcacaaaacaugaccaugaagcaaguuggagaggaaaggguuuauucagcuuacacuuacuuccacauugcuguccaucaccaaaggaagucaggacuggagcucagucaggcuaggaacuuagaggcaggagcugaugcagaggccauggagggugcugcuuacuggcuugcuuccccugccucccucagcuugcuuucuuauagaacccaagacuaccagcccagggauggcaccacccacaauggucugggcccucccacccuugaucacuagcuggauuucauggagacauuuccucaaaggaggcuccuuucucugugauuacuccagcuugugucaaguugacacacaaaaccagccaguacaugaggugaagccugauuuuaacuaacauucagucccaaggagggucucuuacagggaggaucugaagucucucuggaggaggaugugucuuggauuaacggagauggggugcaaggggagucagggaggcccugaucagaaauacagaugacagaccuagggugugaaagcagagggcaagaggauagggggaggguuuuugaaagauuuaugacucuguauaaaaagcucuuuuauccaaauauuuauaaaagauagcaucccgagggugacuggguaagaauguguucagaagaauggcgugugagcgacagcagauggcuugaaguaucaagaagccucagccaggauccagccaggagggcuacagaaggaagcccagguguuggaaaacgaggacuagaaccucggauaaguggaugcagggaaaggaggggacuuagggaacagcuuggagauccugguaaguucuggaagguuuagugugauaucuagagagugugggagucuacaugugucucuugagaguagcggauggggaggggaggaagaagaggcauugccauugguuauaagccuguaaggaaugacugacagcucgcccuggcauccaugcugaaggagaagcgacucgugccuuucuucuuuccucuucuggaaaugguaacgugccagugagaagggcagagguuacccuggaguggcugcuugaccucaggguccucagugaccuuguaacaauggcuaggacucaggacuaggaagacuggcugaagagacuggguuccuguaggugcuguaauuggcgguagggaguccuacaggagaagcguguaugagaggguggauaggguccaaaucuagaccuuguaucucuuaccaugccugcugagcuggaucuguccagaggagggggcauuugccugauuugcuaagaggagucauaugguugggcucuagacaacugccuuucaaaauccauugagaaaaacuaaaguuauggugguuguauuuguagacucuugguuugggucauacacauccuggguuauauugaacugucccaggauuugguaaauacagaagcugcuguguguucauuaugugguguuguguuuuguacuauguguuuguuaguuuuggcugacgugauaaauuaucgcagauuggacagcuuguacaaaaaacauuuacaaacaaguguuuuucacauuucuagggguuaggagugugaauccaggugcuggagauggucagugucuggccgugggucuccuuccguauaucacaguacagaugagucgcuuuugggccucuucauaaugacacggauccuacucaugauguuccacucaccucaugauuaaucaccuccauaaagcccuuugaagaccaucagcacagcaguuaggauuuauguaucacugauauguguguguaucucauauaucuuauauuucacuccugcagcauauucauacacacacacacacacacacacacacacucacuuaaaauacacacaaagaaacacacgcaauccccaucugguauuuuucaagugacugauugggugggccaggguuaagggaacuauuagaguauauuucaaacccaaauaaguggcugguggaaagccaccuccagagcugaaguaaggguggagauaguuuuucuggagcccagugaaagaagacgcaggaugucagaucgacgaguccugcuaggcagcccucaccauccuuuccacgccacucauuggugcagagugcucacaggccauggggaaggcccccagugaugucacagguagagcgcagccuccugggacacaggaugggcagaagaaagacaggaugggcugauagaguugauaacugaaggaugucuaguguucucacauguuuuucuguaagguuaggguggauaacccugucuuauaagaaaguggcuuagugacuuuccuaaggucuaccugacugguaaagcccagccagguuagaauccagugugcucucuguucaggugugagaucuuuaauucaugauuugaugcguguguuuguucuugaguggaucuguacuugaaggcuuuucuggcuuacccccaagcccccagggcagcacaugugaaagucugugcgauugccugcucuggaauccaaggucugcucacaaacugaacacagaacaucugugaggugcaguggccaggcugucuucacagaugucugacuuuggugagacccacgcacauuucuggucauggugagcugauggugagggcgacugacugaugaacccuccucucuccucucuucccguuuggacuugacugcucugauugucuuucacucccucuugugccuuuaaagauuccacccagguuucugacguccgagcuaugaacaucagugccucaagcaugacccugaccuggaaaagcaauuacgaugggucccguacuucaauugucuacaaaauacacguggcuggggggacccacuccgucaaccaaacugucaauaagacugaggccaucauccucggacucagcuccagcaccuuguacaacaucacaguucauccuuuccugggucagacggagggcacaccaggcuuccuccaaguguacacuuguaaguucgcuccuugcuauuuggucggcuuugcuuuucugcugucgugguaaacuuugugaucaaaggaaauugguggacgaaacacuuuaugccagccuacacuucagguggcaagcagucuuaucacuuaggguaguaaggguaggggcugaagcagaagccggggaggaacauggccuauuggcuagcuuccuggcuccugcucagcuagucuucuuaaacaacccaggcccaaaugccuagauguaauaagccuacaguggucuguaugcccauuucaaucaucauucaagaccuuuuuucucacagacauggccauaggccaguccaaccuggcaguuauagagcugugguuuccuuuucucuuuagguuguuaucaagguuacaacaaaaucuaaccagcacacaguggcucaccuuucuuguggucugcuaugugccaagaauagauaccaggcaagagagcucuguucuguccugaaggagugccuggcauugcacaugguuccacaggggccccucagggugugugaguaacgagagccgucauugguugacccuaaucacaugcucagugacuugugaugggcugcuuuugcacugugucauugagugcuaggacauccuugugauguaguuggcauucgccuuacauuauggacguggagaccaugcgugaggugaugugugauggagaugagauuaggccuuuaggaggcugaguaacauguucaggauaaagccaucagccauggccagcacucugucccagagccuggggauccuuacugcugucacugccuguggguaauuggccuggugucuauacuuugguggucaagggcucuuucuuagccagccuuugaaggggcuuauauugcaguugauucucuggagaauguguguccaugauuaugacgguuggccauccugcucccuggagacagacuuuacauacuauuguuuuugagaugagcuuucucugugcaucucaggcuggucuccaacucgggaugcccuugucugagcuguucaaguguugguguugugggcagggccgcugcugcacccugccugggaaugcagauucuucaccuaaccuuacucacugucuuccacagcccccgaucaggucucugacuuccgagugacaaaugucagcacaagggcaauugguuuggcuuggaggagcaaugacuccaaguccuucgagauuuucaucaagcaggacggaggugagaagcaucgaaaugcuucgacgggaaaccagagcuauaugguugaagauuuaaagccuggaaccaguuaccauuuugagauaauuccacgaggaccagacgggacagaagggcuguccaguacagugaaugggagcacugguaagcgucuggacauggagguuucuuacagggagccagcguaacucauagauuucuuauuuuaugaguauuauuuuucuuuuuaugagaaagaaucuuaaaaacauuucauggcuguggugcauaucaacaauacaaaaauaaagucaagcaaaaaaaaaagucacauguaaaguuaguaauuauuacaaacgcuauagguacggaggucaaagggcuuuggggacugguucuuuccuuccacccugggcucugggaauugaacuuaaguccucaugcuugugcggcaggcagcugcucuuacuuaauggagccaccuugacgggucccacccagguuugugagagggucucaugucacucucuaacuuacuaugcaacugagguuggcuuugaacucugccucucaggugcuaagauuagagucacaugcuaccauagccagcucccugauacuguuuuaugaugcagauggacaucuauauuuacaaaccuggcugucuugguuccugugugguuuuauaaucugcuuucuucucaccuguuuauucugaguaucuuacccugucaaguaugagucauuuuauuuuuaucuauuuauuuucuuauuugcuuuugaaacaaggcuucacuguauagcucuggcugcccuuuguagacccagcuggcuuuucacagaaaucagccugcuuuugcuucccaaaguguuagaucaaaggcaugugcuaacaugucuggcacuguuuauuuuaugggauaauuuaaagucagccuuguauuugugugcaguuuccuaugaguaguuuccuaggaauggguagcaagaaggguuggaguaaggccccggaaacguacaguuacuguccacuaacaaacagcugucgucaccgcuugggacacgguuggacagcauuaaaggcaggcuugauaaagggaaacaaaugccuuccgaucauaccuuggcuaucugucagaaagaauugaaagcagggucucagguagcucuuuguauaccaguguucauucacagcagcccaaagguagaaaccauucaguauccauugucacacacaugaacaaaauauggcuuuaucuacagccuacacaauagaguuuuauucugccauguggagugaaaucuucaaguauguuauaauguaaauguaucuuguaaaucugugaagugaaauaagucacacacaguauuuuacaaaguggaauaagucacacauacagaaagaacauuuaauuuauuuuauuauuauuuuuaaugacaaggccucacuauguagcccuggcuggccuggacggcauuauauagaacagcuggucucagauuuacagagauccuccugcuucugccuuccacaugcuggguuaaaggugugugucaccacgcucccaaagacaaguacuuacgcuuccauuuaugcaaagugccuagaauaggccacuccacagaggcagagcggggcucguggggagggaauaggagguagugucacauagguacagauuuuauguugaaaaaugaugaaaacauuuugaaugugauaaugguaauguuuaugcaaugcuauggguauauuuaguacuggcaaaaugcacauugacagaugguuaaugauaaauaguauguuguguguauuuaccaugcuaaagggaaagggaacauauguucuuagcuguucucaucugguuggauuccuuuccugccuguguccacagcuacaccucuuguuuacaucauuguuaaaauuacaugacuaauuuuauuuuauucuugaagguuuugcucuguguauguaaugcccuugcccauaguuagcauggccuuccugcuaacuaugcuaggugugcauuaaacucaacuucaaauacauucuuuguugagauacagugcagggauaaaaaguggauccuuucucaguacauagcuucauggauuguuguaggucaaaugcaucaggaucccaguucaggguaagaaauagaguguagggcuggcaacauggauagcaguuaagagcgcugaaugaucucacggaggaggaccuggguuugauuuccuccgucuuuccugcucaaaaucauccaggacgcuguuuggccuuugugaacucacuggagaguuguuguuuuuuuuuuuuuuuuuuuuuuuuguuuuguuuuuuuguuuuuuuuugaggcagguuuacuuuguagcccagacuggcccugaucccuagugcauggucucuggccucauuggaaaucuggauaaugaagaguugguucuuuugacaaagacuuugaagugaagcuggaaucaugauuaaauacuuuccuuucuuuucucugacuagaccccagugcugugacugacauccggguggucaacauuagcaccacugaaaugcaguuggaguggcagaauacggacgaugccucuggauacacuuaccauuuaguucuagagucuaaaaguggcuccaucaucaggaccaacaguucucagaaguggaucacaguagggagccucaccccaggcaccuuauacaaugucacaaucuuuccagaaguggaccagauccagggaaucuccaacuccauuacccaguacacacgugagucuugugggagaugaggcaggcagaggggcugcuuccugccucucccauggaggaaguacaguaacugauggggagaggcugggcuaugccucuggguuacagagugggaaguuuacuagaaacaucaaccucaguaaaggcucuucuguaugguaggacugugcgcaggagcuaugugaacacagcugcucuuuguaagcagaaaguagcaucauaggagaguggagaguguuguagagccugcuguucacucuucagaaaaauaaagagaguugcuguccuugcugccgcuggagauccccucagaugaggaucucuucugugacagugacugagauguuuccccaggcuucagauggacggacaguggaaguguuagccuauccugugcuugacccucuuuaauagucagauuccaaaaggagguuggacauuauaguacacuauuucucuguaugagauaauguaugggaagguauaugauaacauuuuaaaagaagcacucucucuguaugaggcaauauauuagaauauauaugauaaaauuaaacauuaaaagaagccuagacauuuuaaauucuuuucagacuuaauuuucugaaugucuuuucaggaaaucaucuuuugaagugguacauauuaauuguauuaauucuuuauugaaaaaaaaucaggcagcuuuuggauauaguaaauaaaagaggccuauaauucaaagugguucauucuuguucauuuuuuacuuuuaaaccaagggcccagcagugugucccacauugaaguaaacaccaccaccaccacggcagccauccgauggaagaacgaggacgcagccucugcuuccuaugccuacuccguccuuaucuugaagacuggagauggcagcaauguaaccagcaacuucacaaaagacccuucuauucuaaucccugaguuaaucccuggugucucuuacacagugaagauccuuacacaaguuggggaugguacaacaucacugguaccugguuggaaucuguucuguacgggugaguaguccuguguucuucccuuugcggcacucacaugcaggaaccuucccagccuguagguuacuguaccugcagggcaaccguggacauggagaacuccagcccagccuggcggcucauuaauguugacgcuguugcccuugauucaccaagaauguguuuauugagcacgugcuucuuaaagaggccccugcgcuucuagaacuuuuagccugcugaacaaaacggauaagagauaaaaguaggcaaguagauagguggugauuauggcuaagaggacggaagagagaaagaaagagccaaggaagggagaaaugguauucuugucuagggcgugaugugaagaugcaccacggaaaggauacauauaaaggugacugagcauagaucugagggcgugaagagccaacuucaugagcaucacaggguuuugaccuaacacugcuuuggagaauuuauuggaggccagggacgggaguggaucugccugagcuugauagcgaggggcaggaggcauuagagcucgaugcuuggccucuucugaucuuucccaugauguaguuaaugauguguggcuuucaguacuguugcucagucagacugcauccugguggucugcuugcuugcuuuguugcuucagugggguugcugggaccacuguucuacaagagaaaaaccuacaugagccuguacggcuagcuggggcaggagcugggagcuaaacuugacuucucuagaagagcagccagugcucuaccugcuaagucucuagccccuuuucccagaaucuugcuuggugacugacacccauguggcauuuaacccucagacaguccugcacugagccccugggcaauaaggugacugaugcaaggucguguggucugauauugcuuuauuuagugaagccgagcaucuuccuuccuccacacccaugcuuucuccucacguguugagccagguugucugcuucccuugagccucaucuugcccuguucuuugcuuugcagaaccugaaccagugaccuccuuccacugugaaguggucccuaaggagccagcauugguucucaagugggccugccccuuuggcauguacacaggcuucgagcugggggucaggagugauuccugggacaauaugacacgccuagagaacugcacuucggaugaugacacagagugcaggacggaagucgccuauuugaauuuuucuaccucguacaacaucagcaucgccaccuugucaugugggaagauggcgcuucccgcccagaacaucugcaccacuggcaucacaggugggccuguggccaggagccggcuaccccucgagcagcuggcucagcagugugcaagcuuuuagggugcuuacuuuccuuuaaaguauuuuuaucagcagcuuaccucauuccgcagcaauccagcuuaaaacugcagaguaugagagauguguuuccacauccugagcaguucugagaaacacuugcuuccuccucuucuccucuccucuccucuccucuccucuccucuccucucccucucccucucccucucccucucccucucccucucccucucccucucccucucccucucccucucccucucccccccuccccuccccucccuuccucuauuuucccuauuucucucuauuuucuuuuccccuucucucccuuacaguagggaguuccauuauugcaucuagaaaggcauuuuguagaaauguucagcuauauccgcagucuagacaguaggugagccauguccgugggacacuugucagcucucggcugcuccacuccucagcacauuuccauccccucuguccuccuugauaaugggaggaagacucugaaacacgacuugaccauuucuacuuauaaauauuccacauggauuacuucaagauaaggacucucuuuuucuuccaaaaauagccauauaauaugaccacggaauuuagggaaggaaacuuaaaugcaacaacauuauuguauauguagggacucacuucccuggaaucuauugacaagagccugaguugcuuuaguggaagaaaagaccacacacuauacagagauccccuuccccacucuuuaauuuccugucaauccuucauauuccuucauuuucuaucucuccucuucccccaccccccuguuugggaagaauugguuuuaauuugucuguccagugcuccccugucuuugccaaacuuguguuuuagaucaggccaugggguggugguguuauauccaccuuuguguuuuuugacuuuuagcuauucuuucuuucuuucuuucuuucuuucuuucuuucuuucuuucuuucuuucuuucuuccuuucuuuuccuuucuuuuccuuucuuuuccuuucuuuccuuucuuuccuuucuuuccuuucuuuccuuccuuccuuuccuuccuuccuuuccuucccccuuccccuuccccuuccccuuccccuuccccuuccccuuccccuuccccuuccccucccucucccucucccucucccucucccucucccucucccucucccucucucucucucucucucuuucuuucuuucuuucuuucuuucuuucuuucuuucuuucuuucugguuuuucaagacaggguuucucuguguagcccuggcuguccuagaacccacucuguagaucaggcuggccucgaacucagaaauccaccugccucugccucccagcacuuagauaaauauucuuaagggucuaaaaauauugcugacagucucuaaagcaucagugguuauccuaagagagucuuuuacugcagggaccugacuuggaaagugguugagguauguuauagacagaggcucagaauagauaagguggacccagguuugaguucuguuucucccauguaccagucacguaauuaaccuugcuaagagccucagcugugaaaggagaagcaguacucgccuuccaggacugcugugcugcguauucugcauugaagaccauacauauggcugcucagguuguguacuguaaagucuuaaggaaagcagucuguauggggcucuuuaaauugugucguacacagugguacccuauccuguggcacaccacuuugguuguguagaacauagcaggaacagugacuauguccugucccgcuuuguagcuccucuuuccauggugucaucucuguguauaagcugcagaagagcagagaccuuggcuaagucugugcuuccauggcugaggauagcacuuggcauagagcacaggagcuuaucagaacuagauaucucuagguugggacuguagcucaauuggcaagcacuugcugccucgcaugcaugaacguuugaguucagucuccagcacuguauaaacugcaugugguagcacauaccuguaaucccaacacaugggagguagaggcaggaagaucagaaguucaaggucaccuuggcuauuauuagcacauaccuguaaucccaacacaugggagguagaggcaggaagaucagaaguucaaggucaccuuggcuauuguagggaguucaggguagccugggcuacaugaaaacaaacaaagauagauggugguggagggugggaauaagccgaccagacccagccauacacaaacaccauuuuacucagugauucuuacuuuuuaaucgggagcuuccguaugcagaggauggguauacguuuagcacauguuaaauucaaacuugcauuuuuuuugugucaagaaguauuggaggaaggagaguuggggaaggucuucaccaggguuuauugcuugcuucguaugugcugaggauuaagggaugugaaggggccugugauuagcauucaagaggagcaguggguaaggucccauaguuugcugcugccaggcuuagggugggaagugugaggucccuccugacuaguuaaagcuggagagcugaugguaaauguuggggguaucuguggugucacugucacccggccucugcaugguccuuauucccguccugccucucacuuugggauguguuuuagaugagcucuguauaaagcuuccuacacaggagcaggucuucuugagcguggguagaucuucccaggcagaggcacauucuguagagggcacuggagcauguucuuugccugguaguuuuucuucuucuuugguuuuaaauguugagugguuguuuuguuucauauugcuuuagacccaccuacuccggauggauccccuaauauuacaucggucagucacaauucaguaaagguuaaguucagcggguuugaagccagccacggaccuaucaaagccuaugcugucauccucaccaccggggaagguaagaaggguccagcaugggcuaacccgugugauggcacugucuuggcuacuuucuuacugcagagauaaaacaccaugaccaaagcaacucguaaaacaaaguguuuagcagguuuacgguuucaaaggguuagcagccaugauggcggagcaaaggcucaguggcaggaacauuugagagcucacaucuugagccacagcuaggaaucagaggggcuggggcacacacuggcacucacacucgaaacaucgaugucuaccccucagugacacacguccuccaacaaagccacauuuccuaaucauuccugaaaagcuccaccgacuggggaccaagcauucaaauccaugacccucugggaccauucucauucaaaccaccacuguguaugagguacaucaguggcaccaacagggagggcagcuguuuaccuggugcuuucaaggaucagguaggaaguaccuuaagcugcccuggccuugaagucucugucacaacuauucagcaccuuuguggugguauggaaacauuacagaagaugcaggagagacaagagggcccaucccacaguugauuuacccaacucugaggcuggauuuggacccuaggccauaaccagucaauuuaggaggaugugcccuugaaagcaagcacaaaaagauuacuuggggcauucugagggcaucuucuggguggaagaagaggggaauuggauggcaacucuguggcaguaagaagggaaugcucugaggacagcucagauagcagcaugguaucugguuucacacaaaccaggucuagggaguuagcaugguugguaaaguacuugccuugcacuggcccugaauguaaucccugggaccuauauuaaaugaaaaacugugcauugugauaugaccuuguaaccucggggccagggaggcagagucaggaggaugucugggugucagcaaagcuggcuuggugaaguuccaggcuagagagagaaagagacccugacucaaaagaagaaaaaaaggagaaggugccugaggaaugacaccugaguuuauccuuuggcuuccacgcacauagaggacauagacacguaugcaugcaaaguagcucacacacaugcaccugcaucccuaugaacacaaaucaacaaaacacggcauuucccccgacuuuuaaaacuguugagccuguuucuaagcucuuucaacaaauugcaaacucagacccaugcugaaugaaaaagacccuguuaugcggugaccagaccagucagcagcagcuggacucaagaucuugggcuaggaggucaggaacuccagcuucacagugugggcagccugcuuugggcaggucucugcuagcuuucuguacuuuguuauucuugcuugagaauaggggccgcaagcuuuugugagugacuccugacagagagaugaggugguacaagccaaguccuaagcgcucuccugcuccuagaacuccuugagagacaguggcugcugccuacuguugcucagcaccugugucaucaggcagccauguugugacacaugccuuucugcugucacucaucuuuuaccuucuguguuccucucuuagcugcccaaccuucugcagauguuuugaaguacacguaugaggauuucaaaaggggagccucggauacuuaugucacauaccucauaagaauagaagagaagggacagucucagggcuugucugaagucuugaacuaugaaauugauguggggaaccaauccacuacccucggcuacuacaacgggaggcuggagccucugggcuccuaccgguaauaucuggguccuugcaguugccuucugagccucgugaaugucagguuguguacuaugagguaaauacaccucagucaccuuauuuucuccuuugccuccccacagggcuuguguugcuggcuuuaccaauauuaccuacaaccuucagaaugacggccucaucaauggggaugagagcuaugugucuuucaguccauauucagaggccguguucuugccccaggacccagguagagugaaacaaaagcccugauguggauuuugugucuugugucugcagaaacuugcugaccaugccccucucucagguggcuuggaggguggaggauuuuggcucucugaaauugacaugucccuuggucuuuggggucagccuagcuccccacucuggggugcuugaaggaacagcuccccacuucuccucuaaacuggucacacuucuucagauuacuuaguccuuugcuuucuaggagucauuugugggcuugugugaguuaguuaagaguccuugaauuagaaggagccacaggaauugucuugucuaagcucugcuuagaaagaaggcuuuuaaggcuuagagagggggugugcccaguguuacacaguggcuuaaaugcaguucugaaauucuagccuuaaacuccuugugagguguucuuccuacucaagaucacagagcuagauauguggggaucucagguagcugacuggucuguuagccugcuuuucagagcuacugagucgaacagauuacccagaaucgaauuucagggcguuccugcuccuucucuuaaauagcucccaaaaagggugggcaugguguuguagguaguuuugcucauaggugacaagaaaaaccagugaucuagcuggcucagguccccacauuugcagcagaacagagaccuaggucagggcucugcuguuuccaggacuauccuucaaaugggugaagggagaagaaaucagcccugaaaguuguucuacuuuuucauccaaagauauuuacuuguucgcugugugcacacacucccucucucccugaauccugcaugggcaggcuggcuguguguguagcacauggcccuucgugaacacccauugaaaucccacuguuggggucuuccccaggugucaucugcggagcaguguuuggauguaucuuuggugcccuggccaucacagcugugggaggcuucaucuucuggagaaagaaaaggugauauugcuuauuaaucaucaggugcuauuguugaagggaacuuucuauuauauggaauggcaaccguauguauaaucagagggaagaguugaaagagccccuguguucuucacagugucaccaccuggccaguccucuuuccucucugaccuccucccaucugcgucaguccuacacugacuugcuggaugcgacuuucaagucaggauucuaugaauguguuaagaguuucauaggguuuuagaguugggcaaguuugaacucagguuccauccuugcucgugguuggaagcccugacacucuguggugugggaaugaguccccggcuuaaggagcugaggacacugacaaaugucucacuccaugacaacauuauucaucguucucuuuguaccaccacccugugguguaguuaacuagugagaacagugcuguguaccuggauuuguugucacccugagaugacacaugaauggcuguccugcuuuguucaugucaaaccugaugggggucuucacugcagcaucguuuugaguagcugccugguauuuaacaucguucacuuaaccauuucacuggauauuuuaauuauuauugacuacaguuacaugggugugcucaugauuauuuuccuaggauaaauuccaagcuggguagugacugggucagugggcaugcguucuuuccauuuugacaugcugccuaaacugcaguguguuuuggcuccagguagagcugagccaacagaacagugcagguccucacagcaucugugauggaucggaggccauuucaggacuugccucuaguucuuuguauuaauuuacaugauggcucccuaaaaaacagaacacagaauaagggaauguaaacacaugcacacacacacaccacacacacaccacacacacacacacacacacacacacacacacacacacagaaauuccaaaaaguugcuugauuagauuuugauucuucucaguaaguuugcagauaguuugcauguccugcuuggccuguuagauggcgggguacuagggagucggccauguucugggcugggugcuaugagcaggccguaguguccuaccugaaccccaggcugugaagagaggugucuguggcuaugagaaaggcggcagagcaggaugaaguucuuugucuaaugggccuguuuuuuuuuucuuucaaaauaggacagaugccaagaauaaugaaguguccuuuucucaaauuaaguaagucucugaguuacaaacuuauuuuaagauucucagucccccagucuguucagugacuaucuauagcauuuuuuuuuuuuuuugauagaaauagcugucauuuccccugauugacagauuggccacagucauauggaaguucuugcuguuuucugcaaggggucuuuguuuuauuaaguuuaccugaaacucccuuuauuuuugucccccaccccauguucuucaguuuuacuaauaaauagggcgugccuucucucucucucucucucucucucucucucucguguacaugugcacacacauaugcauccccaugugugcucggaggccagagaggauguugggaucuuacucuuuaucuaugauugcucuguucacuugagacaggguuccugcuaaauugagagcggugcuggcagccagcaagccucagucaugcuccugucucuaccccaccugagcacuggauuucaggugcauguggccacaccaguucuuacgugugggugcugaggauuggaacucaggcccuugagcuggaguaguaagugcucugaccuacugagccgucugcauagcacccuaccaccaauagauaauugucaguuuucaaaaaugaacaggucaucaagucacacgcauggucaguuauagaacaggucagcuucccugguucacauuucagugcuuuuaaaauaacauugcauuaaucuccagcccacaccccucacuauggcuggcuuuguucuuuugaguugaugcuuccuuccaaaacgaguacaucuuucuaauuguccuuuuuuuuuccuuuuuucuuuucuaugaugaagaccuaaaaagugaguaccuucauuuuuaaagcuucuguuuuuucuguuuugaaugagaaauaagcaagcaaacaaacaaacaaacaaaaaccccaacaauugcuuuuuguuuucccagauccaaguuaauccgaguggagaauuuugaggccuacuuuaagaagcagcaagcugacucuaacuguggguuugcagaggaauaugagguauguuuuuguuaacucuguggucugccagucugucguauggugaagcuuugggugagaggcagcccagagaggagagaagguugugucugacccucuggggcacacgacuguuggcuaggaagcucacagggaccuucacuucugguggaguuuguguuuagucuuguggauaccugaagauuauccagagagacagcuaugguuggcugaagcuaggggauuauuaacuaguuccuaauaagcuguaugagcagcauagaagccaggucugcuguuuagaggucuggggcugccacagcucuggucagagcugacuugggaggguuauuggaacccuguuugucagucucucgccuucuagacuccgcuaccucaaacuagggacucugcuaccaggaaacugugggagugcagaaggugcaugcgugcuuguccccugcacgaugugcccgcugcugucugcucuagcgcuccuacaauccugcccacggcuccaucauaauccauucucauucugacacauaauccauucuuccggauuccugagaucccaugggaggucucuggcuaugucguguuuguccuuacacugcucuugucucaagugcugcccuugcuaagugccaugaagugcguagcuggggacaacggacuuauugucucacuguucuagaagcaggaggcuccagaucacagugucagcgggaccugcuccccuuagccucuaggggagauccuugcaugaccccagcuuuuggaaagcccaguuguccuuugcuuugggggaagcauggcuuccgucugcaccaucaccaccaugaggcguccucuugugagucuggugucuuuuuuuuuuuuuuuuuuuuuuuuuuuagguauuuucuucauuuacauuucaaaugcuaucccaaaagucccccauacccucccccccacuccccuacccacccacucccacuucauggcccuggcauuccccuguacuguggcauauaaaguuugccuguccaaugggccucucuucccaaugauggcugacuaaaccaucuucugcuacauaugcagcuagaaacucgagcuccggggggugggggggguacugguuaguucauauuguuguucuaccuauaggauugcagaccccuuuagcuccuuggguacuuucucuagcuccuccauugggggcccuguguuccauccaauagaugacugugagcauccacuucuguguuugccaggcacuggcauagccucauaagagacagcuauaucuggguccuuucagcaaaaucuaacugguguaugcaauggugucagcauuuggaggcugauuaugggauggauccccaggugcggcaguuucuagaugguccauccuuucgucucagcuuuuguacccauauuauaacgacauuacccuauuccagugacuucaccuugauugccucuuccauggccauagccuaugagagccuacucuaagguacuggagguuagaugcuuggcaccucuuucuagguugcaguaguuaacaugaucugccucuguauuccuacuuaguucaaccgcaccccaugcuccgauuaaacauacaacucguuuuuuuuuuuuuuuuuuuuucaggaccugaagcugauugggauaaguuuaccuaaauacacagcugagauagccgagaacagagggaagaaccgcuacaacaauguucugcccugugagugguuuuauuccuuucgucuucccuuguuccuggccaucacacugugaauggcagagagaugggaaucagugauuccuacccggcaacuccaccaccauucagcaccagauauuucucucccucaucuccccccagaucuuuuccaccuccccacccauucaguuuugagaccuggaucuugcugagucaaguagauuagcuggccauugagcuccaagggcccuccuauuucuccuucuccaguacacggauuauaggggugcauuguggguacuaggguuuggacccggguccucauggcuuguauggcaagcacuucacugguggagcuaucuuuacaacuccaaauuuagaacuuuaucugucuaucuauguugcgguaaaucucuaacccaaauaugcccagcaaugaaaacaggacucaauuaauaugaauacuugcugugugccuagauugggcagauucuccacuacacuaccaucuuccacaucuaugagaccccuuagaacuugcgguuucuccagcccaugugcuucugcuccgcuuuucuuccuccuccucuauguccucucccucuuccauuuucuccuucuucccucucuccaccuucugcuccaccuucccuuuuuuucugcccaaucauuaccucugcuuuauuuuacaaauuaaggugggaagcagguuuacaggaaaucacccgagugcugacucauuccuuguucguagccacuuaccggagaacggaauuaacaucaaauauaauuagccucagggguauccacaacauucuaucuaucugucugucuguuugucugucugucugucuaucauccauccaucacugaucugucuaucugucuguguaucuaucuaccuaucuaucuaucuaucuaucuaucuaucuaucuaucuauucaucugucuuuaauuuauugauugucuauauguauggguguggcagugccacagcauaugaguugaggucagagaauaaucucucccuccaucauguggacguuggggucaaacuuaggccauuagguuugucagcaagcaccugaaauggccuagccaucucaccaucccaguaacaacuuuuuaaagcuguaggagaaaguuaacuuggaugccuucuuugccguaguagaauaggcucugaguucacauucugucugcuguuuccccaguuagaaggccuuggaaaugccacuuugucucugaaacuccugauuuccuuaucuugaaagcuugugggaugguuuuguugugugaauaugguugcuuggcaccugcucugcucagagcagaugcccaaggcugcaggagugagggcuucuuuagacugaaggggugagaauguaggccuggcugucaggcugccuagguuccaguccuaggucuccaaaggcuguugugcauuuucucugugucacugucauagccuauccacagggaucaaaugagaucaugaauguaauaugugaagcaacauggcagccaugggcugccaguuuguacuaaaaaaauuuuccugcuugcaacuuuccugaagcauggcguagaaugaggaccuuucuuucuuuuaaugccacagaugauauuucucgagucaaacuuucaguccagacccauucgacagaugacuacaucaaugccaacuauaugccuguaaguagguggcugcucucacggcccaggguucaucugaagaggagugugucugucugugccuuugauggugacugagcugucuguuucuagggcuaccauuccaagaaagauuucauugccacacaaggaccuuuacccaacacuuugaaagauuucuggcguaugguuugggagaaaaacguauaugccauuguuauguugaccaaaugcguggagcagggaaggguaagugucuuuuaaaaauucauaaauuaauuuuuauuaugguagaggguaucuugaaauccaucugucuuuuaaaaaaggcauuuaaaaaaugucuucccaaacaauacuuucauccuuagaaaauguucuguauuuuuagcuuucagauagaagauuuaaauauaucuugaagaauauuuuuauuauguuucauuguggggucauauugaugucugugauugacucugugcugcuggaguuaaugaguggauagaacugaguuagugcaguggacacugcaagccuugcagugggcaccagagguuagugcaguggacaucagagguuaauucaguagacaccaaagguuagugcaguggacacugcaugccuugcaguggacaccagagguuggugcaguggacagacacugcaugcuuugcaguggacaccagagguuagugcaguggacacugcaagccuugcagucgucugucgucagcucugugccuauaaagccucucugugcggucuccuaaaucucugauuuucagacuuaucuccaggugcaucucagcggcccccucucuuccuguguggccuggaacucuccugccauuucugucacagaaaggaggaucuguucugggaauaaaaaucucauauuucuuuaaauagagaugaguugaaaaaacacaugcuaaauuaaaaaacuguguaccugaagaaugacaauuaauauuacuuucuggagaguuauuaauuacuauuauuauucaguauuggggacuggaucuggggucuuggcugaguccacacuacaugucucagugugcuaugcuuugccacugagcaauaccccagcuauuagugguucuuguucuguuuuguuuguuaguuuuuugagagagggcuucacucuuauccuagguuggacuugaacuuagagcaauucuccugcuucagcuuucuaaguaaugagauuguuggcaugagauccuaugccuagaauaagguauauacucucucucccucuccucugcacccugcccccaaguguauauuccuuucucgaguccccgagucagugauucccacaccuccuuauccaccagagucgucugcaggauguuucugucuccuuguugauugagaaggguucugacagcucgaugguguggcugcugguggccagguguucuccaugagugcugcugucugcugucccagguggcaacuggaaccuguuggacaucauuccuuaaaaucuauuuuuauuauauuguguguaugauguguauacaugugugugagaggguauaugccacaggaaauacaugguuaaauacgugguccaugugauguuucuggaaaugggaugugaguccuggacucaggucuguaggcuuacacagcaagugaucuaccugcugaaugaccucacagaccugaaucauuucucugaaagacccacuuauguuauuuugaguuguuaguccaugaguguaucucuguguuugggucaaacagaccccgauaagggacugagcaguuaguuccccaugacaguuccaugguuuuccuugcgagguuuugaugaugguggaugugugaucccugaccuuguguucuagaccaaaugugaggaguacuggccuuccaagcaggcucaggacuacggggacauaacuguggcgaugacaucagaagucguucuuccagaauggaccaucagagauuuuguggugaaaaauguaagucaagauugaucggagaaaaucaauggguauuaauacugagaauaacuaauauuugaugcacgaggaaagcaucuuuugcugcccauaucugcaggcuuucugaggagccucagcuuuacuuucuugaggggacuuuggugucguuucugaguaaaugagucuuucgagcauggcaaugacacuuugcuucccggaggccuuugugucaucuggguggggaugugcacggggguugcuuacugcuaggaacaguuuguauugauuccaggauuuggauucuaggguacaugcacuguccucccuucccccacuaaguuacaaaaccaaauccacuuaaaucacaggcuuucuagaagcugagucuccuuuucuuugaaaguagagaaaauguucugagucaccguuaacaccaacugagugugcaaacggguuuaacauuuuccagcucauagcaagggccucagauggucauaucucuucaucuggugagcucaaguuggagucuuugacaugaagacaagauguggaguuccggaaugggcucacgagccacagagcucagucucagcauuguuuauucucacaagacuguuuauuuagaagcuccucuaagagaugaguaagcucuguguuuguuuccauuucucuuggguauauauauauauauauauaucuccagugucuucuacuuuauuauuauuacaaguucuuugauauuuucauacacgcucacaguacauuuaaaucauacugucaguaucauuuguggagguugaacaguuuugaagccacaugcauagcuagcuuuuggagacuggauaacuaaacugugacuacaugcaaacugugucaccaucgagcuuuuagcuuccauacguggagcugacauacagccagcuccuuuuacccccacugugucauucagcugugaauucaaccaacccagauggaacuuauucagaguaaaaauuguuuuuguauuuaacaugugcauuuaggcucaucauucccuaagccauacaauauuacaauuauuuaaaaauacauuagguaauauaaaugguuuagaaauggucuaaaguauaaucacauguuguugacugacagggauguguucugagaaaugugucugugugaacaucauggacuguacguacacaaaccuggauaguacagccuacuaugcacuugggcuguguaggguauaccaucauuaugucaauaugacugcacaggagcgugugugcagauuggaugcacacaugcuuguauuacguugggauccugagcauccacagauuuuccugggaucaauccauauggauccugaggaaauguggaaagguaguaucaacaguacauacuaggagacgacguuuugagagagugucuuacuagacagccuaggcuggccuugaacucaugacccucugccucagugcuggaauuacagauuuguguugacaugccuaguuuagcauuuauggaacugugcaugauagagaagccuacauauagacguugugguguuacauuuuaacagagacugauagauuggguucuaguuuguaagaugaagauauaggugagacauaguauaugagauauuaauucuuacuaguuacugggccucaaagacucuggucucagggauguuucagguccuccuuuggggauguuuaucacacacugacgugaucacuuaaguaaggucacagucagggaggaacauuugcaauaugucaggcuuauuucugcaggcuuugcccauuuaaacugacuggcauguuuacugucccuggcugccucugcuuggaguucaccuuuugugcauagaguuggcgaaauaaagacaaugcuacugcucucacucuaguucuaaauaguuguuugguguuugcuaguugcguaguauuaccacacacuaucuagagagcccaggacucaccagguggcucuugccccacagauguaaccuccugccauacuuagggaaacgauuuggggcuguaagggaggugccguuuccaggugggccauagaacagggcucaugaaguucccagggagcuugcauuaaugaaacuccauagauucuagagauuucaugauucccaccaaagccuuuucuuauuuuaggcuuauauauaggcuuccacguggcauuuucuaaaauagugcuuuauaguuaugugaaauccaugcaugcauuuccuuuuuauaaaaugagaacauuacagauagagcuccaugucuuuugacuaccauccuuagucucugcccccgcccccuguucuuaccucccugcccccuggcccugccccuugguccccuguuuccuugaccccugccccugcucccugcuccucugcucuuuggccccugcucucguccccgcccccgcucugcucucugccucccugcuuccugcacccugcucccuuguccugucuccuagcuuccuguccccugaccuccuguccccugccccugcucccuugcccucugcccugcuccuugcuccucugcagaacugcuucugaaaguucuauguuccacagucucuuugugucucuuccucucuuccccacuccucccagcugauuucuucucucaguaaacccuuaugauaauauucaugauguuaguuguccucagagaagcuccugaguauccucucuccuauuucucaaacuuuccauagugugaauuuauugcuuuauaaugaauaaaggucagaaauuagcuucagucauggagaugcccauugcccugcugaggggacauaugguaaggucagguacagacaaaugaauaucguugaaucaaggacaggaagggacaggacuagccccaggggacagaguuuugguaauuacaggcacaugcuuggucuaagguagaguuaaacacuguguaauugacuaguuuuguuguaacaguguccucugucuccugccggccagauguuaaaguagcagacugaguuuguauguguauaugugugcauugugguguguguguguguguguguguguguguguguguguguguguguauuucucuuucugugugugaauguguguuucuuuuuuagaucacuauaguucuaaauaguuguuugguguuugcuaguuguguaguauuaccauacacuaucuagagagcccaggacucaccagguggcucuugccccacagauguaaccuccugccauacuuagggaaacgauuuggggcuguaagggaggugccguuuccaggugggcuauagaacggggcucaugaaguucccagggagcaggcguguggguguagggcuguuacuggcugguagcugagaacagaagugaucuaaacucaaaauugaacugggugcguugucuccacauagggugaguaucgggggucauccccauuuccucugagccuccgcugcccaucuuuagaaggggagaugaugcccuuccuucuugggaacauuaugaggauuaauagggauaauagugauagggaucagcugcccguuuuccuuuaagugcugaaugguucucaggccugcuugauuucacucaccguugugauacugucagguaucuugacucuuggaucucuaacccguuccuuuagaugcagaauagcgagagccauccucugcggcaguuccauuucaccuccuggccugaccacgguguuccugacaccacugaccugcucaucaacuuucgguaccugguccgggauuacaugaagcagauaccccccgagucaccaauucuggugcauugcagguaugcacaguugggaguguaugcauuugugacaacuuaaaauguauacauuuaugaauacccccucuccccaccaccaaagcaaugcccaagagaaaaugcaauaggcaguuggaaauucaagagggcacuguggccuuagucccugagacuauagaaagggguuggugagcuauauagcccaugggccagacagggucugcuuguuuuuauauauaaaaccucacuggaacccagccacacccacuggcuuacucauuugcauugcuuuuauacugcagugguguaaugugcucagcugaggguauuggccaucuggucauuuacagaaaggguaugucugugccuacaauagaacagaaagaauuuagcauuaaaggcaaaagaauuaauuagagcagaggccucaaaaaagaugcaacuuuguguccuaggcugcaggaccauuugauuggcauggggugugagaagguuagcaauauguuuagucugcgacuuuuaacucgcuugaagcugcaguugaggagcaauguguucgccucagugauaaugaagauauggguaccaguggaggacugggagaucuguggagagacaacugauggugaugugcuaauuucucugucuucuagugcugggguuggaaggacgggcacuuucaucgccaucgaucgccugaucuaucagauagagaaugagaacaccguggacguguaugggauugucuaugaccuucggaugcacaggccucugauggugcagacagaggugagcccagaucuguguuuggcacguuaccauucccaucugucuguaaaagcucacauggaaucacaugcuggacucuucuagagcuuucuugcucuugacugugaauuucaguugucauuaaauuaccugaugcaguaguaccaauaggaugacacaugcagauaguggcaggacucuuugucuuaaagcaucugauuuuuuaagcagucuucuuuuuuuuuuuuuaauuuuuuuuauuacguauuuuccucaauuacauuuccaaugcuaucccaaaagucccucauacccacccacccccacuccccuacccacccauucccacuuuuuggcccuggcguuccccuguacuggggcauauaaaguuugcauguccaaugggccucuuuuccagugauggccgaguaggccaucuuuugauacauaugcagcuagagucaagagcuccggugaacugguuaguucauaauguuguugcaccugcaggguugcagaucucuuuauuuaagcagucuucuuuaaaauaaagagauuauuuauuuuuauuuugugcauauggguguuuugccugcaugcaugucuuuguauuacaggcauucgguacccacagaggccagaaaaagacauugaauccccuggaaauggaguuagagguaguugugagccaccauguagguagugggaaucacaccaagguucucuguaagaccucugcaguggucucaacugcugagcugucuccccggcccucagauuagucuuuuuaagacucuugguuugguuccuagauuuuaaauuuauaaaauuaguuuuuaaauuuaauaaauuuauuguuuauuaaaaacuuauaguuaguuuggucuucauuucugagaggaucugaccaucuuuaagcugacagagcacuucucaaaaauagcacauugccacugaagcagaaauguaauucaugcguacacacucuugaagauguuaaagaacaguggucaucagagcuauacaaaaaagacugagcagaaaaugugugcucgguaugcacugugguguauguaaagauguuggaguugccuuaucugaagugucccuuguaagcuuugaaucugaggcuuguucuuaucagagugugucaggaagugauuuccagggguggauauucccagaccaagaugagagcagaauauucaucguggcucaggcuguuacucuggaccaauuuagaaacuuaugaccaugugcuaugucugagucuagcaugguauguuagaggucuggguacauugugugcuuuugggugagacgcacgauugugggagaaagagugaaaauuugcuucuguguuagaguuucauuuuucugcuacaguuuuauagagugagaagaacagaaaucuuauuaucugccuguggauuccuuccucaucucucuguuggggggggagugagggagggagggagagaaugagagagagaaagagagagagagagagagagagagagagagagagagagagagauuuugauugcuuucucacuuuuugcagugaugcugguuaucacagucaaacacagcuugaaacuauggcuagucuauuuagcuggcuugaucugaggucacgcccucuucugaggccacacccacucagcauuuucuugguuuguugaucggcuguuuaguccugcugcucuguggcaaauacuuuaaccacugaucugccucuccagccuccugaucacuuuuucguauuucaaaaauaauauauuaaaaauuaacacuauagaacugcccagaauauauucuucccccuaacccuacuuccuagacgcuaggaccuaaaggaaggccuuaguuacuuuuagcuuguguaguacuuuggaucccacaccucccaggcugauguguuugaauauuuggucaccagacagggacguugcuuugaaaggucauggaaucuucagggagcagagccuugcuggaggaagucgaucacuaccuggugggccuuaagguuucauaccugguuccacuuccugucugcccucugcucucugcuuccucuaugaccagcugcccaaggcccugccaccaucccuuuucagccauggugggcuguaucuccucugcugugagucaaaagaaguuccuucuugucaggcuugguuacagcagccagagauggaacuggcacagcagguggcgcuauagaacguuuugaauaugcacaugcguacaucuguggucuccuuugaaaagacuggaugcucuuaugagguuugcuuuuacggcaccuagccuuuuuuuuuuuuuuuuuuuuuccugccacagcauauacuuccucuauuuaaacagcgaccuguagauucugauagauacacuuguauuaguguuacuuuuuuguuguuguuguuuuguuuuuuguuuuuuugagacaggguuucucuguauaguccuggcuguccuggaacucauuuuguagaucaggcuggccucgaacucagaaaucugcuugccucugccucccgagugcugggauuaaaggcgugcgccaccaccacccgacauuaguuauuuuuuugaaaacaauaauuguguguaaguuuauuuugccucaugguuugggguacaguuuuucaugguaagccacugugauauaacuguggcagcaguaggaugacccuggccacauucugccugcaguaaggcaggagagagaugacuguugguacgcaacccccuucauuucucacuugcugcagaccuccgccccacauucaggaugugucgucugucccucaucaggugacccucuccucuaaugaccuccuagucacacggaggagugucuucuaggugauucucaauuucauccagcugacaguuaagauuagucuucacgcuaccccgaggagggggcugcacucagguccagcugaugcccuuuaacccuucuccucuuuagagaguccuuccgguuuacucucacuccacgcggauuccuuaacuuucacuguccugcgguauuuaugcuugauuuccucugcaucuucauuucacccuccauaagguucugauguuuccuugauaugaagacgugagggugcccgcucugguuaagugucacugguaaagaaggcuguguuaugugcuuuuugaaugucauuagguuguuuauagaucacggauguguuggacagaugggaucauggugaguuuuccuuuaagaaucgucucguguucucauuccuggggcuggugcuuauucuucucucucauuuccuuucccaccaggaccaguauguuuuccucaaucaguguguuuuggauauuaucagagcccagaaagacucaaaaguugaucucaucuaucagaacacaacggcaaugacaaucuaugaaaaccucgagccagugagcauguuuggaaagacuaaugguuacaucgccuaguuccaaagcaaacccuuucugaagcuaaccggaccgucacacccacagugaaggagagcgcccugacgggacauguuuuauaugucuccuuucucaguucuuuguucuguucuguuagaacuacuuggagggcauggggcugugcgugcaaaagcauggcagauagccaguggggugucaggggcuguggacgggugguguggaaaucagcugccuuccugaucacuaaugggauggguucacuuuuuguuuuuuuccuugagaauuguggaaaaccaggaaaagugagcuauguuuuguuuuccaaacugguuuguucuccucuuuucuccccuugucuccccccucucucuccccccuaccucucuguuuuuuuuuuuuuucaagacuuuuauaugauucacaugcuaaagccaggauuauguuggguugaauauauuuuaaguaucagaggucuauuuuuaccuacuguaucuuggaaucuagccgauggaaaugcgugacuguggguguuucucacgcagggaggggcacauggcgccucuucugcguggguuucuauuugaacaugugccuuuucugaauuaugcuuccaugggcaaaacucaguagaugucucuauuuuuauauugaaucucagaauuggaauauacagacuauuuaagcaguagcuuagcaucagagagucgccuccucaguaacauuccggcucccauucgauuagaggaggcucucucugcggcccacccuugacacacguuugugccccacaguccccuucccuuucuuucuuuuccccucccaguuuucgccaaagacuuguguuggugagauuuucaucccauugguugggugagaauagaaauguaaaccaucaucaugagacucucuguggguggggguggggaggaagagaggaaucaacauaccauggugugcaccccuucucaucccgucuccuccuuucucuccuuucugucuuugguaagaaggauuauuuaaaggugcaauaugugacguagugguucacgaugcucuggguucuuaguaauguuuuacucagguugucauuuuauguaugugugugugucugugugucugugugugucucuguguguuuuauagcguggugaucugugaacauuucagugugaacucagaauaaccccuuuuccccucgaaguccacuggcuuuagucuaucugcagugacacacaucaguaucuacuguauauauaaauacuaaacucuuacaccagucauuccuaugaauugagguguacaaaguuugauuuguaucaaagauguaauuauuauuuuuaaaaccucuuuucacuacacugcugcuguaauuacuuugaauuuuuaaagaaaaaaaauguaguuuuuuuuuuuuuuuuggcuucagguguguauucaccaagaauuucagaauuuaugugguuuuauuuuauugguacauaaucuguaaacuucucaaggcauuaacaugacaagauuugugucuuuuauuuuaucuuguggcucagguuauauuugaagaaguuucaaguuuaucuucuaguaggcaaugaagucuauauaaggucuuaugaaggaaucgccaggucccuggacuccuguggcuguuuuccacaguaacaacacauccugcuguauguuugggacaaugguauccuguugaagaugagggugggucuucuccaaggaccuggccacugugggccccggaacugccuucugauguucugccuucucuguuccucgugucaccagcacuuugauggcugacuggaccugaucaugaguauuuguaggguuagagagggugacccauaauugaaaguccccugcuguguuucagcgcuguagugcugugguguguaccccccccccccuuuuccuuugcgguacugaaaggauugaaagaagagggucauggcauugucaugcuuugggggagaauuuuacuucucacauggaaacugcacuuuuuuuuuucuaaauccuuugcauuuugauguucauuuaguguacagcccuacagagaaugggcuggcccagguagcuugggccccuugacucaacuucacuggggaacuugacucugcaguugugaaucagggaagccaugcugucuccagguguggagugaagcugaccuugggcucauuauuuccaaaugcccugucaggucugucuaggaugugcugacuucggggugcuauacagaggggccuguccuggcaauaguucugugcaccaccucucugccuccucaguuuguuaggaaccauuguagaggguggugagggguccaaucccaugcagcgccuaugcccugccucaucugccagaaagcaugaggaaaggacuugccccuaaaguaguccuguagaagauuagagucccuuaaaaaaaucaaagcaacauaaucauaaucacaccauauaaaauugcaaaacccagagccgucuccacuucuucccgugugggucugcaaagucuuuaggccucagccccaacaagccauucccagucccaggaggaaggcuaguggcagagaggucuggaguuccaaaugggcaggucacaagaaggucaccaugccauuccacaucuggaggaggacugugugguggaguuugcauagcacagccauuggaaagggaagauuaaugacagaggcuaggguuggccagaggcagaaggcccuucuuacugucugccccaagcccucaguggaacugugaacaaaaguuggaagagccuggagaaauuugaaugauggaguucccccgcuaagacacugagaaaagcagccaggaugagacuugcugucagugaaagggcuacagacugguggucaacugcuuuggaggacuugagccauugacuggugucuucuaaggagaaaaaggcuuugccaccagagcugaaucuagcaacgauuggcaccagugggacauuugguguccauucucugaggccacuuugugaucuccagccagacuuuggcacaauggaccugcuggcuuugugcuuugugaaguuggaggcucuggggggugggggugggaguggggaggaagcagggaagggucaacuaugcagcugguucauucauacuuguuuucugggauggagaagccuggaauuaucccccacccccacccccgaaaugcuugauugugcuuguugagcuaaacaagccggugacugaagcuaguucaccucaaaacagaguugggaugccgcauuuuucagauugcugcguagcaacuguguguuuaacaccuguggcuuuuucucccuggggcacagaauagaaguguugauguggacucuaaacuguacuuuucuuguaacuauuuuggaaugaugcacauuucuaaugucuguuauacuuguacagaguauugcucuugguugcuuuuuuuuuuuuuuaaaggaaaaaaauggccugaaaaacuuuuuuuuuaaagacuuacaaauaccaaauauaaaaauaugucaacacauuaugucuucgauugauucauuucucucugucucugucucucucacucucucgcucuucugccucucucuccccccuccccccuuauuuuacaucuauaccacuuaccauguacuucacugguuuuguuuuauuugaccagggaauccuuagcaagaucauguuuccacuggaauuuucuauauugcuuuuuauggcuacuguuucugauaccacagacugggugguuuaagccagaagaauucuauuuuuauaaucuggaagcuggagauccgagaucaagggcugguagggacucccuccugguauggccucuuccuguccauauauggccuuuccuuuauacaggucugaggauccuagcgaugcugguuauggccuuaugcgcagcaucucauuuuaccuucuuugcuacugagaucccgucaccaaguagagucacauucugagcuaugagagguuuauaccucaggacguggcaaugugggugcauggggcuaauuguguguuucuuaguuugguagagagauaaccucaccuuaggaggcccccagaauuuuuagggggucuucuguugauguuucugaggaaucucaaaauuguugggcuacugugacaaucugauagaucagugguucucaaccuuccuagggcugcaaccuauuaauacaguuccucaugcuguggugacucccucaaacauaaaauuauucuugcugcuacuuuguaacuuuaauuuugcuacaguuaugaauccauguuuucugauggucuuaggugaacccugcagaacggucauuugaccccuccaagggggucacaacccaucgguugagaaccacugugguaauacuuuaauuucgucuuuugugucuccugauacaaaaugguuuuggggguuaagauagggccucauguaauccaaccuucuaauccucuugccucuacuuuccgaguucugggaauaagcaugugcuaucauuccccacaccauuuuuuuuuuuuuuugaguuauuuaaugggaaauaaaacuucaguguaauuucuuuuaguauguccaaguugacugacucaagggccuuuguuguuuaucacuuuucugauuaggcaaaaagcacaaacuuggggacagcugauaauguaguuacucaauagguuuguucugucuaaaggcagaaaguauguacuggacauacgugguaugagaauauaccagcccagacacggaacaguaagggcuuuucuaaccuuuuccuugcggucagcauuaguuggcagagagcugaaguuugucacaagagagaggaccacggacauguugcaagaccugggucugcucagaaaggcauggguugacaucuugcuaaagcccaaccaguuuaggaugaagcuucugguugggagcccuccccuguggguuuggucccugauacaccaggccaucacaucuucucuccugccgaugacccuggaacucaucaaaggguaauuuugguguguuaguuacauuucucggugucaugacaaaaguaucagacuagaagcaacuugaacagaggaacaguuugagggagggauuauaguucaucacagcaaugggagaggcugcugguuauauugcaucugcugucuggaagccaagcaugaguaggaaguagggccaguuuaugggccuuccuuugcacuuccuccauguagccuuacuacacggagccaucaccuggggaccacguguucaaacacacaagcuaugggagacauuuuguauucaagccacaauauucaguaaaaaaaaaaaaaaaaaaaaaaaaggucggaaaaaaagacacauaugaaugccauuagaauucgauguguuaauauucugagaugcuucaugcauugccuagggcgcagugauggcuauucaaccucaguuuuaugucuguuaugcuggcagugaguuguacauauguggacaaaccagacaucucugccugugugcaauuugaggaccuagggaagagugaggggaauuaacauguauauaccgauacacuguggccagaacaagucagcuuuguaguaucaaugggucagagaggauugaagagaagggagaagaaaugguguaugcugagacaauuuggcaauuguguaguugggagucuaagcuuauuggggauuaguuggaagcaaggcuuagucagccauggcaaggagguggggcauuggucugugaguaauagaagccaucagaguuucacacuggaugguggcaugguugggccagucacggaguagacaguuacagagggagacugacuuggugugauucagcaaugguuuaggaaauaaauaauggggacuugucaaguggugugauguguacaugcauguacauuaaaaguaucaggaguggggacuuuugggaggugauucuguugggaggguagaguuacauagcagguugucugagaccauuuuuuaaaaagaaauccaguuaacagcauuuauggaagaaaauggcaacauauuuuaaaauguguuggucuugcuuuacagaguuccuugaaugugacuauguugcuucauccacagcugaacgauuuuggauguuggguucuagguccuggcuguugcuggucugcuaggauccagggccuuguugacaucugggaagauguaaguagggagaacagauguuuagguuucccuagcagaaguaaucgcagcucucauauuucuccuggagucacagguccuuuuagggcugacuucauaucucuuaggccucuuggagaacaggagauccuagacuuuuaugguagcuguuaaccaggaaaacuuccuuauguuaacagguaaauugucccgcugaaagccucaguuuuagauguggccacuagauggagccagagcacugguaugaaggagcaccagggccguguaaggcaaaagaggacccagaaaaagaaacuuaacuuguucacuccugagaaaccugcaagucaacaagccaaggaagugccuuugcaugcauuugguagccuuuccaaucccgcuuauuacauaauauguucauguucauggcaaaaaaaaaaaaauaaaauaaauaaaaaaggaaaacaaaauaaaaaaaaucuuagaacauugau

SEQ ID NO: 901 - RNA, 9246 nt, Mus musculus
acaauaaaaauagaucaucuuaaaaacgaaagcaaaacccaggcuagccugauugaaggacagcuggaacccacugggcaaaccuagccuauguuccagagaagcaggcccucccuuuguuuuaaaaccauuaaauuuucuucaguuuauuuugaguuuuccugucacagcagccuccaguucagcccguucguuggguucguuggguuuguuggguucguuggguucguuggguuggguucguuggguugaagcugucucagguccugggcucuuucccugauacaccacucuuucucaccugugcugcugcaagccagcugcucucccacuuugcaggguaggugaguguccgagagaccugaucaaguacaagguucaggcugggugaagguggguaggucugucccuuuguuuuuguuuuuuuucuuuaaaaccaugugccacagaugguuuuguuacuuauuagagucugacugggcuggaccgacuguccagugagaccaggucuuccugucugucugcuccuuggcgcuggaagagcugaggcuguagaggcugccgcagagaccagcuuuucauggguucugaggauccgaacucaggccuucucauacuuucaugguguuaagaaaaagagauaguuucagugucucacacaaaggaacaugcaagcaagcaagcaaaaaaaaaaaaaaaaagguagcuuggcacugcaguuucucuuugugaaaagguuacaccaccacccaaaccacaacccaaaccagucuagagcucauacuggggaggucuguauucuaaugcagugggacaacugugucuuuuccccauuggcuggggccuaaccucaaugucuuccuugauuggcuagcuuuaaaagaauucugagaagaaaugaagaagguaauuguugguuggccaucucgugugugugugugugugugugugugugugugugugugugagagagagagagagagagagagacagacagacagacagacagacagagucagagacacagagacagacagacugacugacugagggguauuuuguguaagccaaaauuuuauuacuagguagguuaguuuaaaagauuuacauaaaaguuuuacaagguuggggaagauuuauagaguauugacccuugguagcugccuuugauaggcaggaaaaaauaaacauuucacacaauggcaaguacuauugggucacccucuccccagccuccccuucccacuuccuguucuuuauugccaccuccauccaguauguauguauguauguauguauguaugcauguaucccucuauccaauaucaauccaacuauguauguauguaucuauucaacuaucuaucuguguaucuaccaucuauucauauacuuaucaccuaucuaucuuaucuaucaacuaucuaucacuuaccuaucucauucuuuuuuuggcucaguugcucucuucgguucuuuacugcugcccagauccauccaauuuuagugccugggcccuuuuuccauuuucaucuuuuaaacccaccuuccuccuuauuaccuguucacccaccugacagccagugcauguucugugguaggugugaacuucaggugaaucuucaccaagaaguguccagccagacgggcagugagaaucccuagugguaagaguuaagcaccaggugcuggcauaucugggaaggaaacccuagcucuaguggggagagggguucuguaagggucaacgaaggcugucucauagaucagccagccaggauugagaaagaggggcaggaagcucucacuuucuagguaguagggcuggcuggagccagaguugggacuggcagcuggacuauugaggaauuugagguaugugaauagcggaagggggcaugugacaugugaacucuucaguuuaugucuucuuugcuuuaaagagauguugguuacaucuguuguuaggggaaaaaguauuucugcugagagguucagaggacaaaguagacagugguagacuguaaaacacuggauuuugccuaaggcaagggaagagaaaccacagugauuaugcauuccuuugucucucucacugacccuuaagcaguuugggacuagggaaggaaacuauguccuuucugugaagaggggcugguggaaaugugcuuuggacucagguuuguuaggccugcgugagccucucuuuccucuacccucaacagaggcaggcugagauagaugaucucuaaggcuugauuccaguaugacuggucauacaugucuccguugguugccuuugaagcccugaaguugaacaugccugguuuaucuuuacaccaaaaaaggccagaccagcuuugccccaggcccuaaggagcuggcgcuguaucucagcagaggaagugagugagguucugggagaggugaacuguguaauaguuuguucacaagcuuggagcauauauacugccuuaugcuaagggcuaacagagaggcucaggcuguguguuguucagaaucguggggcugcugugagccagcagcuccgugcacaccugaccgcccccauccugauuaucaggauuacucucugcugacacuaggcucacaguucaagucauuuuaucucccagauacccagcauucauuaagaaaggugcuguuucuaauaucucaucagacaauuggaaacccagaccagccuugagagauccagaguacuuuuuaaaauugagcugaauuagacaguuauccuuucucgaacaugccuugugcccgauagcauuucauugacuucucuugaguguuugaggaggcuaaguagggacauaaacccuguuugcaggugagaagcuugagacuggguuccguguagguaacugucagcucgaaccuacccacagggaugcagccagacucuggcugcaagucuguuuuugugguucuauccagggcaaacgugugauuuagggcaggacuaagccgacuauagccacugcuuguuuuugcaugacccaugggcuaagaauagcuuuuacauuuuuaaggaguugagagaaaaagcaaggaaaacuaauuucuuucuuucuuucuuucuuucuuuuuuuuuuuuuaaagauuuauuuauuuauuauauguaaguacacuguagcuaucuucagacacuccagaagagggagucagaucucguuacggaugguugugagccaccaugugguuucugggauuugaacuccggaccuuuggaagagcagucgggugcucuuacccacugagccaucucaccagcccaaaaacuaauuucauaauguaaaaauuguaugaaacucauguacuuauggaugaauaaagcuuuauuaaaacacagccauggguguuaguguccugguggcagacuucgcucucuacugacagacuuguguauccugcagaaccuaagauguaaugccuggccuuuuguagaaguugaccgagcgucggaucagggcauucauuaggcuuaaugggauguuaaaaguaaccagucaucuccuguguacugcaccagcuccccagucagcugccacuugaagaucccgggucuccuucuguuguuugauguccuaaguguccugugugccaugcauggcagugcccacaugaugugacuugcugagcugccaucuucucaagagcuaagucucucggagcagaugccugguuuucugcugagaccuuguauuggaugaugguuguccucaggcaguucacugcuaacaucucacuggagggcagguggaauucccuguguugucuaaaugugugggugaugcaggcuuucacugaaguggaaggaaguggaagguuguagagacaggaaaaccaagaaguaaccuucaccaucacuugcauuucugagacuauuuugacacaugguuaagaagggacucaagauccuaggcucuuagucaaaccugaugccauuguugcuaauugcuaacuugagaguguguccucuuaauuccugaacagugccuggguggcaccgucuuacauggcguuugcugucacucauagaggccugcuauguugcugugaggagcuuagcauuugucagaccugcugaauaacuguaggggguuggucuggugcugcuuauauucagaugcuaaauucuguaccucaagaucuguuugcuccaagaugauccuuauggauuccagccuugguuguguaaaccuugcuccccaauuuaaaacuauucauuaaauaaaacuggaggcagccaguuacaggggaaauagggagagauggaguuugaguuaucgugcuggagaucgcagguagugggcacgaggacaaggagagagggagaaggagaugaagaaggugaaggaggagaagacggagcgagcaagaggucuuugugacucauaucggaccagcagcacaugucagagucagaugucuccccaggacaccagacugcuggaggagaaacaacccagagaauuucaaagagcaaguguuuguuuggggaggacaauugggguaguagccagaguagugugucagagauuuagauuagggguaaucccccaguaauugugcagagccugauaaauaaauaacuaucauugcuugggcugcauuuauuagaagcuagaugacgauacauuuaauuaaaauauucuacaaguaaugagucuuuucuuuuuuuuucuucuuccccugacuuaguagcucaaaccaaacugcuuugaaggcccagcacacccaagccacagauuagaugagaaaacucaauaagcugugucguuggcugugggcuucagcccauugauuuccuacccuuccucaguucugaaguuuagggggauccacggggagggugugguuugugggaaugucugggauccugcgcacacgugcagugacguaacagaaguucuuuaaaagcaaaugagcuuguugaccccggcacccaugccaccauggcuucugggaucagaucagcccuggagguuguuggguagagagaggacugggagaggcuuagaggacagucagaggaagaguugguuggaacuggguccuggauuuucuucgcucaucugggagaaagggggagggauguuagagagggacucagacugcagcagggcagucucugagcacugggcccuagugaauggugugucuugucuucuuuuauccagaccuugagcagaugggcagugcacgagggagcugguugggcucagggacuggauucaguauuccaguuugagggucuggagucaagucaucaacugaagaccaacaaaaugucggucaggauuuuguuccuagugguggggguguuugucccacagguggauaacagauuaggaaauaaggaggugguuagugguagagagaauggugccauuuauauucucaguguggacguuguugacaagugacauuggccagaaggcucuuccucagagaagaacuuagaaagucaacaguucauuggugaucauaacuuuugauuuggguagcaaagaacaggucuaucaaaggccacacacucagaugucuucaggcaguuggaaacauaaauaaaugaucuaaaccuugaaaagucguacugucucucaaccugucauacgcucauauuugauagaggaaaccagcugugugggcaccuuguugcuuggcaacugugcugcuugcccucagcauuggggugauaguacugccagugcuguuugugcuuagcacuuaccccacagagagggucaccuagauccaauuaauggcuugaauguggccagauaagaacuuuuuuuuuuuaaaagaagacguugaacaucaaaauaauaguaauaaaaaagccaauucucccuauucuuaagauuuuaagaaacuuauaauuuuaagaaacacuguaggaaguugggcaugcuagaacaugcuggaacaugcuuauaacuccagcacuucagagcuaagggaggggugugacaaguucggggucauccuggacuacaaacugugcgugacuugucuuaaaaaacaaacgaacaaagcacuaucagucaaaugaaagcuacugcuagaaucaacaaugaagccucacuucagcacccccagguuuaccugugacgaggagaaagggcugggcagaggcaacgcccaagcccuuccagaucucuggggaucugugcucagucccaugcugugugaucugguggaggugcuaaagugugugagauccacuaucagccuucauaaaguccacagcuaggcaaaccaccacuuuccaucuuguauucucuguaguccauuggaagauuccauucaugguugaguuuaaaaggcuccuuagcccgcccuuucugaaaucuagaguguuugggauuguaugaaaacauuugcuuaaguaucugccgcacuaaaucugaagauuaaagcucuccugucucagaagacgagcagaacacuccccucggcugucuuggaacuugccauccuccugcauccgccuccugggcacuggcaugugaaccaugaauacaguguagagcaucaggagagucaccugguugcacucagauuucuugaaaaauuuaaaggucacuugaaguuucguugcugucgucuggaaugcacagacacauccaugauuauacugaucugaaauguggaauuguguucuuauacguuauucauaaggcucuuuuggggguguguggggguuggcaguaacagcucugguaaaaauacugacagaagcuucuggcccaagauuuucuaaagccuccuucaguucugcaucucagaguucgcaaggccucuuucagguacggccucugaccacguguuccucugcaccuuguggaagagcucauugugccuccaccugccucuagugcagcauagaggcagcugggcuuuuuuuugguggugguacccauuccguccacugaagcuucacccucagucuuugggcuguagagcuaugggugaugcugacucuuaagauggcaggaucaaauucugaguccuuuauuugcaugcgagguagaguguaugcaugccuguucucaucuugccacgcugucugcuuuccugcucaggcccugccuuugggcuccauggcggaauuuaaugccagguacugagaccaguucaccaggugaugccugacucuggggccuuucagcugugguacuugcugugugcguuuggugggacgccccaccugugugcuguucuuagaaggcaaggauuugccuuucugcggacuguauuucggggagcgguuggauaauacucacagagagauaagcuagagcaaugaagaaagguggccuuucaccaucggacucaguucgcaucagacccuauaaaauacucuuugauuuuaaacauugcuugaagccguucacauucugguuaauuacgucagugaguaaauauagcuguugucaucuggugugugggcuuggcuuuagaaggauaaagagucuauuguuaccccuuguaccucaguccguuucacucacccucgagcacccagcauguagaauagaaaaccuguggccuccucacuugcuagaaucacaggcugcuccgugauuucaguuucuuuugcaaaagcugcuucauucauucagucccaaugagcugacacaaggugucccucaggccauuugucaccuuggcuuuccugguaccuguugagaccugcuugcggaugaggcugcagagugcuuccuggaguuaaggccgaggguuccagggucaggcggaaggggugcaaaucuuuacuguaagcugaaccgugucaggacagggacaugaucucccagcugugcugucaaccucuguaagauagggaugaccauggcgucugcucccuguggucucaggaggcuuaagugagaugaugaauguaacacccaaugcagugacaggcuaggaggagagucgaugaacguuacagcaaguguagaccucccagggggucuguguagggcugucugucggccacaguuuuacauguucugucaauccccuguccuuuuccuuagucauauuuccuagagucuuuaggcaaggucuaaagacugcucaucuaggccccucuacccugaccauuugcucugccauuuucuuugaaguguuuccaggcuuaagguuaagguuaggguuaaaagguuaagguuaagguggucuggaucaccuuaagugcccccucugccuucgguagccugcaccaaucaaggauugaggcggggguugaguggcauggacugaaagcuucgaggucaucgggugaagugaaaggguagcuuugggguuuggugaggaagaaggguguuaggacaggaugagagaacacauaugggauauagauuguagaugaccuuucguuauuuuguaauugaugaaaugaauggcuuugggagacucugaagccccagaacacaaaggucaaggaaaguggaaccugcccuuuauuguucuuguucucauuucuucuuuuauuuuuaaagauacagaucucacuuuguagcucaggcuguccuggaacucauucaguagaucaggcuggcuuugaacucauagagaucuaccucccucggccuuccaagugcugggauugaaggcaugugcuuaauccugaacuucuugacccugcuuggcucucacccagcagaucaacuggcucucugaagauaagccuggguuaucuucucugugccccaacugaccccugcccacccaugugcaccccaagaggaggcuuaccucuguguucugugccaggggugcccuugauuucugccuuccuguuuggacaaugggagaugggagagacagucacuucagcuugucuccccuuucucguugugggccuccaggauucuugcacauugcuguugcuuucucauccacagccccacccacuuccccacuuauccuggcugagugugacaccuguaucugucaggcuccugacugacaccgcacacucuuaagaagagucaucugacagaucuguuuauuuucccauugaggaagguccuaacacacagggggagagagagagagagagagagagauagauaugucaucccggugaauggaugaggagacaggaucuggccucauucaccuucaguguucauggaaggcccugcuuuaggcguuguucugcuuuguauuccaaauuccaaauacaggguucuguauagaaucuuagccaua

SEQ ID NO: 902 - RNA, 19673 nt, Mus musculus
cguuucuuugggcgggccggugggcggagccuaagcgggcggcgcgccgcgggcgggccagugaagccggcgcccccgacacgugaucuggaaccggcugugucgcuuggugacuccgucuguccguccguccgcgggugccaucauggcggacgcggccagucaggugcuccugggcuccggucucaccauccugucccagccgcucauguacgugaaagugcucauccagguaugagucgucgcccuuuccuuccccgcccgcguccugucaggucgccaccgcccucugcgccuuuggguuggcucugcgucccaggccuucacccucucgagaugcugcccuucucuccccucaggaacaacuuccacggccucgcgccccucucggagacaucccgaggcucgccccgggcaggccggcucccuuucugcagccaacugccacccuugccuucccuggccggugacucuucucaacuuuguuuuuccuuucccugauccuggccgguugccaccgagggcuucccaacccuuuucuugucgccccucugauacuggcguucaccucaccucguucacuccuccucagcgaaauaucucaaacucgagacgugaaauaacucaucuaugggcaaauuuaaaauucuaggaaagccaacaucuuauuguucuuacucgguuuuucuauuugcuguuucuacuucuauucccguucagagauuuuaacaccagauacccggauauacacaaggagcgcauugagaagugauaaugaaaucagauuuccugaggauccauugagcgcuuucacaguaacccaugugguucaugacaaugaaaaucacguugguuagagcuggaaaucaguucuguuuaaacacuuuagcgaguuuaaauguaacaucaaaccccggaugucucucuugccucccuugccaaucugcuauaaaauauuucuaaaguggucauuuauauucauggguaaggaggccuacuuuuagcuggugauaguauuuucaauugcucuucuaacuuucccugugcugaucagggccauuuuuaagcauuuauugaggauugccauaccucaugcauuguguguccuggaaggaagcaggcuuuagaaucccuguccucaauguuuaccauucugaaaagagaaaaaaaaaaaagcaagacucuagaauggacuucauuuuuaaauuguucuucauacaaauuguugcuaaguugacuaauauaaguguagauguugaagcgcagagugaaaucugugucuagaacagaauugacaguauuucgcaguacacguaugaacucacuacucaauaguucucaaagaacagugauuuuagugacauucaguguuuuugccucaacaauccaauauccuaaauucugauuucacaauaccucgugcguugccaaguaucucaggagguugaugaaauucccaaauacuacuuuaaagcugcacuuucagugaguucagagaggggguuuuaacucagaaggaagaauugcaacaguagagcccaaacugcccuguauuuuuuuuuuuaaucucaaguaucccuuuggcacuauaaucacugaauauauuguacaaauaaaauggcaaucauuaauuuuuauggcucuguauauugcuaaugagucuguacauuuaacguggaccuaaguuguaauuauuuuuguaagugaauuacccagcuguaugcauuugccuuuguugucuaguuauccauguagguaggcauuugacgauggcucagugaauauuuuauuuuguucaaauaugaaaaauauuguaaaaaauaugucagcuuuaucgguaaacuaggcuuuccugacacaaugguuuguuuccuuguucuguuuucaguuuaauaaucuagucacaugguuuacucuauagacucaacucaaagggaaaguuggaguuuauugaacccagucuuaaucuauccagcagaacaaaaggcugauaaggaugauacuucaucaaugacuuaaaaaaacuaaacugcauuuuuauuuguaaaaauuauggggcugaggagguagcuugcuggcacugagcauaaggauggacauuggguccauuucagcaucaaacaaacacauuugagccugguuuucuuuuuacaagaccuuguagccaaaguauuccuggguauugcucaguguugaugcauuccuuuguuuuuaaaggugggauaugagccucuuccuccaacaauaggacgaaauauuuuugggcgacaaguaugucagcuuccuggccucuuuugcuaugguaggugccuuugauuuaucuggaaggguugacauugaagguuggaguuacuaaaagaaaauacacagaaggcauguugccuugaaauuuuuuguaaccuuguauuuggacuggaaccuaaaugucugacuuguguuccuagcucagcacauugcaagcaucgaugggaggcguggguuguucacaggcuugacuccaagacuguguucaggaguccuuggaacugugguccaugggaaagucuuacagguaagaggaaagcggugaauguucgcauauaucuuggcuaccuuuuaugcgguuuauuccacuacaaagagcaauuucaaagauguacuuauaacucuggcauggcaucucuuucucuugaaagacauuuucucuuuauugauuaacugaacgauugaagacaguauuucucugugaagcauagacuagccuaggucuugcuuaguagccuaggcuggccuugaauuugauuuaccuucugagugcagaaauuacaagugguguccacauaccugccuugaaaauuuuuucaugaaauaccuacuuuuccccaagaaacaggaaauucaugcagguugaaguaauugacuuugauauauaugaccuucuuccuuuaaaacagguucugaggagaaaucagagccauucaccuauacaguuuguuauuucuuaaacguuuucaauuuuuguuuguugauuuauuccagagaaagcaagcugauuaaaacauaauuuuuucuggaguuacuuuuuuaaauuucuaauauuagcuuagugacacauuuucuguaaguauuggaaagaagcagaagccacugcugugcauggugguauaugcuugggauccuagcauuuagccaguggaggaagggggcucaggagugcaaggccuauucaaguuuaaaguuuaaaaaaauaaaacugaucaaugcagguaguaacaugguuuuggaagccucaguccuagggcuccaugcuccaauggaauauggucugaucccaggucccucucaggguuccucugauuauacacaccuugcuguaugcuggaucucugguccuggugccagcugguguagguugguggcauggagaguagucauggcaagaaaaguggucucaggcacauugugcaggcuggccagggccuccuguagcuucugccagaugguggucccauuuaacuuagguuugcuuccaagcacucagaguggugaaaugcugcaguaccuaggcagcuuggccugugcauaacauaugcaucuacccaccugggcucagagacugguuugcagaaggcuguugggcacgcacccuucuuagagcaccugaaggugaaggaguugcagaagcuguugcuugugcacauugugaaagguacuuuauggguuaggaacacuuggagagauuuuauaaacuuuaaugacccagcugaagugaguucuguuugaccacuguuguaauuauuaucagacuucagcauccuaaagaccuucuggauaggccuggcuucaccagaacugugguuagaauuucaucacuuugugcccugcagccuuucaaaggcuggguguuauauuguauacagaaggcagcuacugaugugacauuacaagucuucaugacaagaaccuagcuugacggugcugagcuaucugaaguccccuggggacacacacguagauagcaguuggccugggagacauauguagacccagaugugcaaagaagccugcacagcuauggacagaaggcaagcaguggguuguaggaugucuucaaagggacauggucccagucugauggcaaaaaaccauacccuuggcuucuugagccgucugcccauguuacagacaugccccaugagucuuuugcauucucauauccugcuuaacaacacauaaagcaucguugccuacuguaaucccuaagccacagucggcugggaggcccuaggauggucagcugggcucaggagaccucuugggcaugggagguggagguaagagucuuucucuguggucuucacuguccuggagcucucuagguagauacagcuagacucugauucacagauauccucuuccuuuugccuuuugccuccugaaugcuagaauuaaagguguaugccacugcauccagcaguaauucuuuuuacaaaaaaaaaagugaugccuguuuuguuguuuguuugguuugguuuuuguuuuuaaucugguaagacuaggaaaugaaauacaggcauggucuagcaagccucuaugcagguagagaggcagagguaaaaguucaaggcuauauuggcuacgagaccugucucaaaaaaaaacagagcgaaagagaaaaaggcaaagaaaauaaugaagcuaauuaucaucuacuaagcuugaaaguguugggcccuucuauguucuaguccauuuucuauuuucuuuuuauccaacccuccagcaggaacucacuaugcugcccuagcuggccuggaauucacuauguagaccaaauugaccucaaacucacagagacccgccugccucugccuccugaguauauuuucuacuucuaaaacauaccagaagccauauucccucuugcaguauaaucugggguuuuauaagucacauuuucuucuccagaagagaaacccgucuugcuucuaccagaagcagucacagagcgaggaaaguggggugauacucgauuugaguaucaguucuguguucuucaucuuguaaaacaagaaucuugccuuaauuugguauuucugcuuuuuccaugaguagaguagcauagcgguuuuaacaauuuccuauuaaagagauauacauaguaaauaguguccugggaggguuuaguugugauuguuaacucuacccugccgucuuguuuuucuuggcacuacugggaauugaaccaaaaacuuaaaucgagguggggguaggugggggguggggggaggugacucaguugguagagugugucuggcguauacaaagcccuggguuccaucccagcacuugggaaauagaagcagaagcaucagaaguucaaggccauucuugacuuccuaagagguuaaaguuaaccuggauuacaugaagcccuaucucaaaaaacaaaccagguaugguagugcccaccuuggauggcugaggcagaauuuaccauggauucaaggucacccugggcuaaguaacuaaaucuucaacuuuacaauaauaccaucuuagagagauuuauguccaguugauuaauguggaguaaaaauuaggaguuuuucauaagaaaaucagugcuucucacuuucugucaauaccuucuguaacaggacacauuaauagcucuaauuagccuuuguuucugugucuucuguaguauuaccaggagucugagaaaccugagguauguugaagcuuucuaugugaaucccugucucuggcaaauuccugcuguuugacccucccuaggagaaaagccaaggcuuugccuuuccaucucagugaugugguaucuuaugggguggccaugaguuugaagacuucuauuuaaaaccaucaagauuucuguuuuugcuuuugauuuccaggaguuaggaucuguaacuguacaaaaagaauauucauccuccuuugaccgaguuaucaaagagguaagagaugaguucaccccaugugauugaaccaggaucauacauccugugcuuccaggucuauucccaagaaaagaacacaaucuucaguuuaaauuggguuuccugucuacuaacccaaaagaagagcguggccugcuguuggaaauaggugcuacucacucuguuguuaagacugaggcaauuuuuacauuuauucuuuuuuauguguguggguguuuugccuguuuguguuuugccuguuuguaugccugccugguaccugcagaggccagaagaguauuucuuggaacuggaauuauagagaguugggaacugcuguguagguccuaggagccaaacguguguccucuggaauagcacucaggcaucucuccagccccuaauuguauuuguuguuguuguuguuguuguuguuguuguuauuuauuacuuacuuugacacagucuuguaguccaagcuggcccugaacucaacgauccuccuuccucagcuugccucuccccaguguggaguugcaggaauauaccauugugcccagcuuugaaagguuucuagaguguugaaaauguguagcaagcuaauuuuuuauuuuuaucuuuuuguuauuuuauugagacagggucuuacuauguagcacuggcuggccuggaacucugucuauagauaagguuggccucagucucagagauccaccugccucuguuuuccugagugcuaggauuaaagcgugcaccauacccagcacacagacauuuugcacguuggcucuuauuuguccagagaugcuuuugugguauuacucuacgcugaaauguaccugucacuuguuugucuuccccaugcuuggcuucagaacuacucuaaggcuggagacguaguuuagcuuagagcuuuucccagacuuaaaaaauucaaauucgggcuggugagauggcucaguggguaagagcacccgacugcucuuccgaagguccggaguucaaaucccagcaaccgcaugguggcucacaaccacccauaaugagaucugaugcccucuucuggugugucugaagacagcuacaguguacuuacauauaauaaaauaaauaaaucuuuaaaaaaaaaaaauucaaauuccuagacuaaagcucuaaggugccacacuggcagaguugguguuccguaggugucagcaugugucuaaagccuaccaucucucaguguagauacuagcuucuuugaaaccugucauugugagagaaaguaaauaauccaaauucaugucucaucuagaccugaugccucaggccuguaacucaguuacucuggaagguugaagcaggaggaguagaaguuuaaggccugcuugggcugcagaguaagcucaaggccagccuagacaaugagacagacugcaugaagaaaguagaaaggggggcaggcguauagcuuguuaguagagcccuuaucuagcaugggugaggcccuggguucaauuccuacuacugcugaaugaaugaaugauuccagcucugcuaaguuuauucaaacugguaacccucucuguuucuuuguguguguguguuugugugugugcgcgcacuuucugauguuuuugucuuguauauagaauuggggaaaacagguugaaauucaugagagguguaaugaaauggaaaaaauauaacauuaauucuauuggagcuagcuuccugacucuaaaucaggaaagcuucagugccuaguccuuugcccuguacuguguuuauaggaauaggaauggcauuuacuuagauuucagaagugugcuuugauuguuucuagacaacucgagagaugauugcucguucugcugcuacccucauuacacaucccuuccacgguauguuuguaguugauaguauaaaaucaugucacuucuuuauucuguuguuugaucccuauuggauaauuagauagcuuagggugggcauugacuuuagggcucugcucucauguucuuuguucaccugcaucccugucuuuuuccagauagugucuuuagauuaaaaacaaacaaacaaaacagaacuuguaggauuaucaaaauaaguuucaccauaguuggugugauuuuauuuuaauugaaaagaauuuguuuuccauuuauuuuggcagaggagaggcaggccuucuauagcauaugugugaaggucagaggacaguugggaauccauuuucuuuuucugguacauagguucugaggaucaaacucagguugcagggcuugucagcgagcaucuuuaccagcuaugaugccuuacugacucuaaaauagucucgucucuguucuacagugaucacucugagguccaugguacaguuuauuggcagagagucuaaguacugguaaguguuugggguuuguuucucuuugucuuaauuuauuaugugugcaccucuuaucuguaugugcaccacaugcauucaguauccaugaggccagaagaguugucagauaccuggaaguggaguuagaaacaguugugaguccccauuuggguuuugguaacugacccaggguccuuuaaggccagcaaaugcucuuaaucaccaagcaucuuuccagucuguucuguuuuuaacuacucaagaaaauuaauuaaagcaaaaagaaaacauuacuacuuuauauuuuuaagguucuucagcauuuacagaacaaauuuauacuguugugucauuugaccuauaccaaaagcacuaaaauaagagaaaauaggcuuaggcuaaguuaggaaccuacucaaggaccacagacuacaagguagggccauugaugccaaaugcccucugaacuguauaugccuaccacacccuuuauagucagccagugucucuuugucuuucugucugucucugucugucugugucugucugucugucucucuuucuuucucucuccacccugcauagucagucagugccucugucugucugucucucuuauuuauuuguuuguuuguuuguuuguuuauugguuuuucaagacaggauuucucuuuguagcucuggcugucuugaaauucacuugguagaccaggcuggccucagauuuacagagaucuagcugccucugcuucccaagugcugagauucaaagcacgcaccaccaccuccuggcuaccccuuugcaguuaauuguuucaccuuucuuuaccguguauggauguuuugcuugcuuguaugucuguaccucaugcaugucugauguacauagaggucagaagagaacaucugaucccugagacuugaguuacagaugguugugagcugccauguggauccugggaauugaacccagguccucuggaagagaaaccagugcuccuaaucacugagccaucucuccagcucuaauagcuucauuuuucuagugaauguaacuacuuuauaagacucaaccaguacuagaaaauuguggggaaagagaguuauaaaauugauuuaucaaaagugauuauuaacuggguguugugagauauaccuauggccucuggccacuuuggaaacugcaggcaguucagggucagcuucuacuuaaugaauuuaggucagcuugggcuauaugaaacccuguuugugguggguggagagauaauuauugaaacucccuucucauugcucaaaugaucuuaauggccuuuaaccuuuuaucguugccuaguggacugugugacuccauaguaaccaucuaccgggaagaaggcaucguaggauuuuuugcgugaguaaauguuggguuugccuguaaaugauuuuaguguuaguagaaaagcuuucuugauaauaaagcaaugggucuuuauuuaauuuguggggaaaauguucucccagaguucacuuuauguuacgguguuuacagacaucuacuggcuuaaauuucucauuggaaagguccuauaccuccauuuuuuccuagcuguuuuauauguuugaaauaaggauuuuuuuaagcagugugucucauagcccacaguuugaccucagacugcauggggaugacuuugacuccuguuccuucugcacucgaccucugugaacauguggagaacaacuugggacaauuugggagaauccguuuucucuuuccauguauggguuccaaaauuugaauuuggauugauuuuggguuaacaggcauggugacaagagccuuaaccugcugagccaguggagcaggcuuugcuuuuuuuguuuuauuuuguuuuugagauagugucucaagcucacagagcucuaccugucucugccgcucaagugcuggaauuaaaguuauucaacaccaugucuaauuucuuugcuuuuuaguaaauauuugagguucauacccuuaaaauaaguucuuucacaauaaaguuaguaaaaugagaaaacuaauuuuuuaaaaauggcaaaguuauaaauguauuuuuauuacacuaggagaauaaguauuugcaaugcuugacuuuggaagagcuuaaacuacuguacuugacuaacaaaaauuuacuguggauaauaaaaugguccgauugauugauugauugauugauaguaaaagucaaacacaggccuuuucgcauucuccaccacugagauguacuacuccagauuucuuuuucuuuucuuuuuuuuuuaauuguuauuuuauguguauggguguuuugguuguguguauaugcagaggccaccauguguggaggcuagaacauggcgucagagccucuggaacuugagucauacaugguucuaacuaugagacuagucauuaugaggcuaggaucgaaccuggguccucuggcugagccaucucuccagcuccuagucuuuuuuuguuuuuuguuuuuuuuguuuuuuguuuuuuguuuuucgagacagaguuucucuguauagcccuggcuguccuggaacucacucuguagaccaggcuggccuugaacucagaaacccaccugccucugccucccgagugcugggauuaaaggcgugcgccaccaugcccggcuuuuuuuuuuuuuaaagauuuuauuauuauauauaaguacacuguagcugucuucagacacaccagaagagggcaucagaucucguuaagggugguugugagccaccaugugguugcuuggauuugaacucaggaccuucggaagagcaaucagugcuuucaaccacugagccaucucuccagcccuccuagucuuauuuuaaagaaaauaucgaugagccuggaauauagcagaguuuguacuguacuugcuuagcauaccagaagcuuuggguucagucccugucagcuauaaaacugagcauucuggaccauaccuauaauccuggcucucgagaggcaggcagaggugagagagaggauaaggaguucaugguuauccuuggaugcauagcaaguuugaggccagccuuggcuccaugagacaaacuuguguuucuggguuugagugacuucaugggacaauauggaacagugggaacauuaccuugcagacuggggugcagagaguuuaaauaccagcucucucauuuacaagcauugacaugcagcaaacaaaugucaaugugguuuugguuaguuuuuguuuuuuuuuuaauuuuuuuuguuuuuuguuuuuuuaaauauuuauuuauuauauguaauuacacuguagcugucuucagacacuccagaagagggcaucagauuucguuacggauggucgugagcuaccaugugguugcugggauuugaacucaggaccuuuggaagagcaguaggcacucuuaaccgcugagccaucuauccagcccuaguuuuuguuuuuuaagacauaguuucguauguuccaggccuugaaccggcugcauagcagaggaauaacuugaacuccuuccugcucuuccugucucuuucuacugagugcuagaacugagugcuggaguuacaggugugggccacuauacccacuuuguauaguacuggggagccaggcuuagggucuccugcuucaagcacucucaucagcugagcucuguugcuaaccucuggaaacacccuuuuccugucuuguguuuggaucauucucacuugacuuuuuuuuuuuuuuuucuugccaaauuugaguaucaaauaguuuaguaaaacuauguuaaaucucuucuguaaagcaccuugcaaaucuuuggccuucccuauuaugguuauuaauuguaaagugagucauuggcuguagguuauagcugaccucuauuuuuaaaguggcaauagaagucauuacagguuagcauuagauuaugagaaguguucauaaugacuagacuguuucauugaucauaauuuuuugcuuacugugucuucauguaggggucucauuccucgccuccuaggugacaucauuucuuuguggcuguguaacucacuggccuaucucaucaauaccuaugcacuggacagugggguagguuauggcuuugguaaaauaugcuggugagggcuuucuuuguauucacuggcagccauuuuagcuguaagaaaaaugguaguuuguuauaugcuagacagaacauuauacaguaaaaacuauuauuugacuuuucaaaggcugauggcauggccaugcuauuuccuauagagggauaaaccuagaaauucccucaagucugacuugagugugcucauggaucuaguccugauguugucagagcuucaugacuuuuuuguuuuuuguuuuuuuucuuuucugaugcuuaacuucagagugcacaagacagagaauagcuguuugguauauuuggagguuuucugcaucuucugggauauuaaaggggcuccuagaaaucucagccugagagguuuugaggucugaauuaucucuuguguauaguauaaguaagaccucccacaggcuuuuuucuaugguguggaacuguuaccaacacaauuuuucauuuuucaaauauugauacgaguacauuucuuccuaauccaucauagugugauaagaauuugucaauauugguggaugaggacaauccauuuagaaaucuuuugauuucaguaugucaguugucuugauuggcaguuuuuuguugagguggggucugaacuauguagccuggcuaaccugaacuuacaucugucucucaagugcuggguauaaggcaugcaccuccaugcccagcugccacuuuuuuauauucaucauagguauuuuguuuuuauuuuuaaacuucauuuucaugcuaucaggcugauaauuuagaaauacaaucuauuggugugcuuguaaguuauaacuuacuaucugauuuguauaugauucauucugauagagcucuuuuccuguuuuagguuucuaccaugaaugaaaugaaaaguuacucccaagcugucacaggagugaguuucuaacuuucuuggaauuguuguucuuuuguuuuuugcuuuucuuauaaaucugaccuguucgaucacuguuuuaaagcugcuagaugucucccuggaaaucuccaucaaaugcauuacucuuugucaacgguaauaaugcaguugcugcuaccucacagcagcauuuaccccacgugguuuuuguguuacucagcuuuccuggggaaguagggacagcggcacguuguaucuuucacaucacacuuagagaacugcacccuuuguacucacacguuuauuuuauguugugggagccaaggcaugcauguggagguaagcgggcuuuggagagccagcucuccguccacuauguggguuauaaggauugaacucaggucaccaguguggcaacaaguacuuuccuuguaacucugagccgucccauguggcuuggaaaacugcgucagccucccagguagugagauggccagcacucaucacaccagcuaaaagugugcuucggaggcacuucccguggucuuugagaggaugcuuguguuuucuucaggguacuuugaagcacuuuauuuguauuaguuuaagacuuuuacucuucaguaaggaguucacuuuuauuugaaugagaccccaauccuaggguaagaagaaucuucugguauuuugauaaauguuagauauagaaguauauuggggcaaaagagucaccucuagcuggaacuauguaaaagcauuccgagguugcugagaaugcaagacugcugucagaauauuggagcauucuagcacuaggccucugagcaaaggagagugaugagguugacugagaaugaauugcuaacucagcugucuugcuguuuugcaguucuuugccaguauguugacauaucccuuugugcuuguaucuaaucuuauggccgucaacaacuguggguaaguacuuuguuuuggggggggguuuuggcuggugcuuguacauguuugcauuuagaagcuagaaguuaauguuuugggugucuuccacaguaguugucccucuuauuuauaaaggcagagugugucaccaguucagcuggucuaguuacacaguuugccauggggauccuugugccuacuaaguguagaauauggggcaggguuguaguauucagucuuaacuguugagcggguccagggaauccagacucugguccuagggcuuucguggcaagggcuuuacccacugagccuuuuuuuuuuuuuuuaauuuauuuuugcauucuuggagagcugaaaccaagucuucaugugugauagacaugcauacuccaccaguuauuugcaaccccuguucccuucaucuauguuagcaugugucuuaauccuaguacuugggagguggaagcagggagaccauaugaugaucaaagcuaaacuuggguguauaacaaguuuaaaggcaaaaugugcuacaugacauccugugucagaaaaagaaaaauggggcuaaagagauggcucaguggagaagggcgcauacugaccugaguucaguucucagcacccaugucauguggcucacaguuaccuauaacucuagcuccaagggauccaacucgcuguccugguuucuaugggcacccucacacaaaugugcacaaacauauucacauauacauaaguaaaaauaaaaucuuuuuaaaaaauccuuuaaaacuguucuaauagcugacuuaauaugucuuuuagacauguuccuguuuuuacaagaaauagcuauguggaauuuuuagucaaguuugacgacauuguuuucugauuuuuagagcagucuucauguguagccuagcacauaguuuaaaauaaguugaauagcuguuccugguaaugagcaucuuuaaugcuaauacucaggagacaggggcgaguggaucugaguuugaggccagccaaggucagucagacucuguaguucaaaauccuuggccucugggacccucuuagccuccaggaaggcaggguguacagacauucaugcaggcaaagcaaccaugcacauaauuuuuuuaaaaguuuuuuguuuguuuguuuuguuuuuucgagacaggguuucucuguguagcccuggcuguccuagagcucacuuuguagaccaggcuggccucgaacucagaaauccgccugccucugccugggugcugggacuaaaggcgugcgccaccacgcccggcuuaaaaaugaauuaaagaauugguuauggauuguauucagguaggaaaguguagucaacaguguuuauauuuguuaucauaucuggauucuuuuuuuuuuuuuaagauuuauuuauuauguguaaauacacuguagcugucuucagacacuccagaagagggaguccgaucuccuuacggaugguugugagccaucaugugguugcugggauuugaacuccggaccuucagaagagcaguucuccccagcccccauaucuggauucuuugugaagaaaaauaauuuauaaauucuuuuucccagaugauuagucauguaguuguucauuuaucuauuaauggaaaaucuaaauauauaaaaaauaaaaccaagucaugauucuggcaaagaauccaauagggaugagaggcuguugauagagaugggaaggaaaugagagguaugagggagagaguaauagaauacauacuacacauguaugaaauugucagauagcaaaauuaaugaaguaaguuuucuguuuguugacuugaaaccuaacuauaggaugguugauuuugcuuuuuaaaaaaaaaaaaugauuuauuucauuuaugugaguacacuguagcugucuucagacacaccagaagagggcauuggaucccaugacagaugguugugagccaccaugugguugcugggaauugaacucaggaccucuggaagagcagucagugcucuuaacugcugagccaucacucuagcccugguugaucuuucuucugguguaauuugucucauugaaacuauuucucagggaaccuaugcgggaauuuugccaaaaaucuguuaaugauguaaauaauguuuucaauuucaggcuugcugguggaucuccuccuuauuccccaauauacacuucuuggauagauugcuggugcaugcuacaaaaagcgguauuuuuaucucuuguuuuguuuuuguucucuuaaauuaccagcuaaaguaaagaaguacaaucucuacauguuaaccacaagccauuuaaugauaggaugaaaguuacaaauagaauccaaaaagauaauuauccuaguuauuuaaguaguagccugauuucaaacccuuuuccaaacucacccuuauuuuggugcugggaauugaacccaggaccucacacaggcugagcacaugcucugcacugagcuccgcccagcagacuugucuuucuguaacuccugagaaccucuuauguacuucuuuccucacaguuagaugugaagacugaaaauaagacauuacuuuauuuaccugacaaaaguuugucaaagugauaccuacagaacuagcuguugcuuccuauuuuguuaguggaugaguuugucaaaacuauaguuuaugguuacugcugggaauuauaucauugaccaaauauuuuugaucaaucuagacgaaguuuuauuaggcacuaauauaauggauagacuaacucuagcauggggucacauaaauuggccaucaguuuacagauggguuugaguggcaaucacuuuuaaaggauugcagagaaaggauauaaagaagcucuuuguugcauuacuucacagaacccaagauauagaugagaaaggcuuuguucacagaacucaggcucucccagacuagacucugaaugaaaaggcccaguuguuacuaugguuacauuugcucacuguuuaugcuagcugaauccaagcuagaaucuuugaguucagugccauugauguuguggguuuccuucugaguuuuacuaacccuuucuuguuuuaauuugauuuguuguuuuuauuauuuuguuuuguuuuuguuuccuggagugcuaaggaucaaacccagagccuuccaaauaaaaagcaagagcucugccacaaugcuaccuuuccauaacuguuuuucaauuucuuuuugugguguuggucacugagcccagggucuugcacauguaugggaaacccuucaccacugagcugcacccccagcucuucuccagaccagauuuuaacuguuuuuauaggacaguuuccuacugcgguucccauucccauucccaagcaaugcccuguuguaggaggaaagaacauagaaaacggguugaggugccagacagaccucaucugggaaaucauugauccuguacaugcuuagagaaucugugcuauaucagauaaagcuaagcauuuucuacaacauucucagacuagccugugaagaucuguguuauucauauguuauucaaacaacaguguuucauauaugaaaaagacugguauaagagguacuuaaugaaaaugcuaugacacggcuuuacuggguccagucuugacguacucauuucaguuacaucuccuagaaaccuguccaguucugugugcugguuuagauuugccguguucaucuucaugcuagacuuuauuucuauuucuuuucuuuuccagggaaauaugagccgaggaaacagcuuguuuuuccggaagguuccuugugggaagacuuacuguuaugaccuaagaauguuaaucugaagauguggggcagggacagugacauuucuauagucccaaugcacagaauuaugggagagaauguugauuucuauacaguguggcacgcuuuuuuaauaaucauuuaaucuugggaaaauggaggugauuggugucugccuuuuuuguucuuuguccuagcacaacaucuuuuaccacugggguuccccauuaguuauuugaagugagacauuuauuucuccaaauucuuguuuuaaacagaaaacagacacauuucccuaaaggaacaagcagguuuucauguagauuugagucucagguuagggcuuugucaaaugaagaauagaaccccaauaagaagcagcuaauucuauaaguugauaaaauuaagaaagcauaccaugugggaguuuaugaaugaccugaguagacagaugcuagaaagucagcagcaaccacuagucuaccucccaccaugcuuccaagcagccgacccaucuuaccuuucagugcugcugaguuacuguagauuucugccuucuguuccuacagaagggaaaggcaucaccaccaccaagaagaaggucagguacagaggcuuaaggaagcuuugggaaggaagggaguaugauggccuuucacuccaaagaagcuccuagccucguguagcacgagaagcaagcacugcagcacacacagcagcaccccgagugcucagugcccacagccuccaaggucuggccucaccgcggcucccauugccuauaagcuucugcuccuaagcguuuguuuccuucuuguuacugcagaaggugaguaguuugggucuuauuucugaugacacccuugaaaguguaacuccuuaucugaugacguggaccaaaguccacaugguucuuaggauauuguccagcucaaaugucagacccucaguuaggcauguaaaaaacacuuaaugaaggcaaaaucacuuuagaaggaaaauuuucaacucaagcauugagcuccuuccuauucacucaggccuuucaauggcaguuaaaaugcucauaagaugagaaagcccuguggugucgauuccugauacuuugccaaaugaguaagcacugacuuugcugcuuuuagacuucugucaaugcagcagaggccaugauguuagguagugugagcgcgcagggucuucucccacucaggguuagggaugcgaccagaagcucaugaguagcuuaguuugaaaugucuuugaugucaaaaguacuuugucucaaaaguaauguaaauuuuauauucuauucauuauuaucugcaucuguuuuaauauaaaauguguuuugcauuaccuacucuuuucucccagaaaaaaagucaaguaaagaugauguaggaaaaugcaccaugcuuagccugcugcuucuguacacauauacgcuccccgguucugagcaccgcuggcugugagaaccuguccaccaccagagggcagcagaacuuugguugugccugugcaucuggccugcugaauggucuaggauugcucagugaaaauuaaaagucuuauuucuagaggugugacuuag

SEQ ID NO: 903 - RNA, 4832 nt, Mus musculus
ucaugacacagggcaggaccauaaggcugacaggcagccccacuuuauuggcagaguccaggcgugcugagcaggcagucaugcucggaccgguggggcguucgggccgcggucccggcucggcaugcaugccccacggcucucccgggcuccuccaagcagaggcucagagcucugggggcuugagggccggcgggccggcggcggcgaggucaggguacaccaggaagccugagaaagugauguacuugccgugguugcuguaggcgccauagccaucgugaucguggcuaaguagccagacggcgucgccgcgccgcagcggcagcaucacgcucugacucugcaucucacggcgccucgaagcgccgucgucguaaaucauggccugcaccucgucgcgguucuucaucagcuucaccgacagcgucuugcgcggcagcuugcccagcgugaaggagaagaaauaggcucccggcaggcggcagcggaacacgccggccgccgcgucgaagucgccaccuauguuuaccagcucggugucgaaggccaacggccgguggcgcgggccgggggcggcguccgagcccaccaggcugcgcgugcgcgccgcggagaaggccgagcgcggcuccggggccgcggggccgcgcgcaggcgcgucggcgucggcguccgcguacaccagguagccgcugaagguggcgcccggcgcgccgagcgcguacugcggagcgccgugcagccgcagccacaccgugucgccguagucgagcugcagcauggcgcucuggcuggccgcgcgccgcgcgccuggccgucgcugcucgucgaaagccagcgccugcaccucgucgcgguugcgcaccagcaucaccgacaggcucuugugcggggccuugccggccgugaaggagaagaaguaggcgcccggcacgcgacagcggaaccgcccgguggcugcgucgaagucacccccgauguucacguacaccuugucgaaggucaccgccaucuccgacgugcccuccagcgggguggugcgagccgccgagaaggcugaccgcagcuccgaggagccagggccagccgggcccagugcccagcaggccgccgggccuaggaagcccagcaagagcagcagcauggcaccuaggaggggagagaagacccgggcaggggagaggguuggacaguagcugccuuaccugucaucucuuccuagccuuacucuugacccaugccuugcucucuguuuuccuuccggcuuagacuagcuuaguacuucacacuuagagugucucauugucaccgggagggcuuaucacagcacccagauucgcccuccacucucgaauuuguucugagucugggauggggcuggagaauuuggauucuuaguggucugauuaacugguucagaggguuuuuguuugguugguuuuuuugguuuuguuuuguuuuguuuuaaagaacuggauuagcccaguaauucuccaaacuugugucuuuaaguaugagagaauccuuuugcaaauaagaccugacgcaugugccacagauauguugaaaugucuugguuagggcuggagagauggcucagcggguaagagcacugacugcccuuccaaaggcccugaguucaaaucccagcaaccacaugguggcucacaaccauccauauugauaucugacuuccucuucuggggcuauuggaagacagcuacaguguaauuacauauaacaaauaaauaaaucuuaaaaaaaaaaaaaaggaggaggaggagaagaagaagcugggugugguggcacacaccuuuaaucccagcacuuggaaggcagaggcaggcagauuuuugaguuugaggccagccuggucuacaaagugaguuccaggacagccaaggauauacagaggaacccugucucgaaaaaagaaagaaagaaaagaaagaaauguccugguuaaugaggccaacagcccuguccucucuccucagcccucuucccucucuggguguugaggagaucucaguuucuaacagccagcacucccucugcacuuuccuggggcuuuucucugcuccuuggccugcccuucacagaagacacuggcucuuauguccauuuccaccaugacaguguuuuuagucuuaucuggggaugaacggaggagauagcugcucucuaaccacuuuccugaccucugcuccacugaaggguccaccaggaucucuggacuccccugggguccuuccugaaccgcagagguccagccaagcuuuaaguuagugcuuucccugugaaacagaaugagguaaggaggggcuggagagauggcuuagcaguuaaagaguuuagcugccauccagaggacccaaguuugauuucccagcaccacagggaaguacgcagccaucuauaacucuagauccgauacccucuucuggucuccauuggcagcaggcacacaugugguucacaaauauacauacaagcaaaacacccauauacauacauuucuuuuaauuauucagggggauaacucccuuugucucuuugugcuuggaggcuggcuggcuccugugggaaggagagagucauggcuauugaggcuugggaggacaaaauaaaauucugguagugcucuggcaggauggugaggucaucagcuucauuugggaguggcagacacuuagaccuagauaugggacuuggaaugaacugcaggcacucggacacugagucgugccccggucaccuuaggcaauuuuuuuuuuguuuuguuuaacucucugaguaaggcuucauccguguaaauggcacaauggagggccacacaaacuggugcuaagcauacgccacccagacagcaauugugagcauggucuguacugggacaugguacugggacagaccuagaggcgacuguucuuuaccccuggggaaagcgauauggucagguucuugacaugacaagguuagagccucaguaaauggagagcuuggggaagcauuauccagucccugggagucacuaaugcugggauucugucaugcuuuaacguggacuccaagguggaggcaggcaggcaggaagcuagagacagacaacucggggcaagagcuuuucugggaaguacccugaaaguguguguagccuugagucucuugcagauuccggggguugaggggcugcugagagcggccagguccagcugugcagcuguggcgcacuccuggauguucgccugcaguccacugcccagcugucagaauaaacugcacugccauauaauucucacaagaaagaccucaaguccagcugaacgcugacuccuuccauacuuuucugacucucuguccuauggguuauggggugaggguagggaggagggaaaggguccauccauaguagugagaacuacaccugagaaguguccgguccacucuguuucuucauacaaagcucuuuuggacauauagauaagcccucuuccauuuuauggaugagaaaucuggugccuaaacgagggguacacguuuuggcucaaggucauccacugaacucuuagccuuaaacagaggguuuguucuuuuuuuccauuucaaaucagugcgcuucucuaccagcucucccucuuacacaaaggucaauguguuucccgccucagugaccccuuuugcaaaaccagaagagacaagggagcgaaggaggaagcaaacaaaggcaagcacagccucugucauuuguuugcugagaggugggagcucucccucugcccggcagcuuuccuggcaggucuucgcucgaagcuccugcccaccuuauccuuugccaccuccccucuaagucagaugaacccaccagugccaaagguucuuguguguccaauacccuuccuaccuuccguacuccacugcacaugccccugaacccuggauccuuuccucuaacaaucccauuccccagcaggucagaggaggaugguaaggcgucaggugggucucagagcuccaggaaaggaaauggcugcacaaagcucuguccaggugaagcucaaaaauagucaucuucaaagaggaaaacugggacagagcuggauagacccagagccauagaaccaauggagaaggugcagcgaugucagacuaagggcaucuccaagccccuagcgccuuguucccauaucccaguuaacacugcuuucaaaccgugccagaaccccccuguaucuuccuugaaaguccgcauccuuccaagaaugugagccccacuuuuacagaagcagucaauaagucccuucucguggggaaaaaugccccauuaagggguccccgcaagccccuuuuccauuaucccugcccuccaccccucccucugaaguaaaagccccugagccucuuucaugaaaaagcgcccagguccuccuuuccaggaaaagggaccgggucccucgugccucccgccgcccccgcucgcauagaagagaagccugcgcccccgccuccuccgggcugcccucaccuggcugguggcgggcgggucggcuucggucccagccggcuauccugcucggugaggacgccgggcuacacacuggucgcccgcgcugcggcuugaccgggccuccagggguggcggggguuuagccggcgacgaguggggaccccggcaagggaggcgugagcaagugggaaggacagcagaagcugaagcggagaaacgcaagggcggggagcaggggaggcggaggggagagcggaggacgagggaggggcgccgagcaguugggccuggggcaccgcaccgagccugcgcugagcauggg

SEQ ID NO: 904 - RNA, 7444 nt, Mus musculus
cuucuuccgggcggacgcggggcgggaagcagagguuccggaucugagcccuggcaugaaaggagguaucgcagguaagaaagacccgcagguggggaaaccgugagguguacguagcccuaucucgguacagcggaggccgaagagaagaagacgcaacgaaccgcaccggugagagaaagggaaagggugggcguucuggguucuaaguucuacaccgcgccggcucuugagcuaagcuuuuuuaauggggggcggggugggggggggagacgauggacgguuuccuuggagaccguuuccuaggcgacuccagguggcacggucagauugcacaggguuauggacuuccuugugcccccggccggggacggcugggcucucaagggcuucuuuaagaacucacuggagcgagagguaaguaagaaacagcagcuuagaaaagaguaaaaguggaaguccaggcccaagccucaguauuggggggucugcacucuuauguccaggcaaagagggaauguaacaacaauaccuggaugucuuaguuuggccuaauuaugcuucuccagagucucauuaguuguauauccaaauuauuugguuuuaagaucauaggcuuccuccuucgucuuuuucaugagcuaaccuaagucccaagucuuuuguuacaucacgaucaggaauauccaauuuuaccucaaggaaaaacaacagaguuggaacuuuuaauugaauucauuggaggagaggccccacugcaggaaaacuggaggaauggcauaggccacauuggcaagaccaggaauaaggccauucuggacccacuuugcuccagugucucccuucucccugucuugacuuggacaguuggauucauggacugugucugugaauuacccaaauacuuagggugauauugcuuugcagauaguuggcaaagagagaaguuggcuaccauggagucaccagaggagccuggagcauccauggaugaaaacuacuuugugaacuauacuuucaaagaccggucucacucaggccgaguggcucagggcaucaugaaacuguguuuagaggaggagcucuuugcugaugucaccauuucaguggaaggccgagaguuucagcugcaccggcugguccugucagcucagagcugcuucuuccgauccauguucacauccaaccugaaggaggcucacaaccgggugauugugcugcaggaugucagcgagucuguuuuccagcuccuaguugacuauauauaccaugggacugugaaacuucgagcugaugagcugcaggaaauuuacgaggugucagacauguaucagcugacaucucucuuugaggaguguucucgguuucuggcacgcacgguacaggugggcaacugccugcaggugauguggcuugcagauagacacagugaccccgagcucuacacugcugccaagcacugugccaagacccaccuggcccagcugcagagcacagaggaguuccuccacuugccccaccaucuacucacugauaucaucucagguaagcucacgaaagggcuuaccacaccuaacugggcaagagucauguucagcagauggucuggcucaggagaaccccaacuuuaugugacuaacuguuguuaguuuauauuauaauucccuuucugguagauuuuagauugagguugauguucgguguugagagucagcauagcuacugucagacaguacaguacaguaacuaaagaauaaaaagcugcaucacuuuuccacaaaaggaaauaagaagugccugauguuuucaucugcccuguaucuugaugguaugcaggacuuaaaugaauugaugaagaugaaucaguauaucuaaaauagcuagggaugguggcccaugccuucaaucccagcaugugggagacagaggcagaagcaagcagaucucuugugaguucuaggacagccaggucuacagaaugaguucuaggacagccagagauacacagaaaacccugucucaaaaaaaaaaaaaaaaaaaaaacccaaaccaaaccaaaaaaaaaaaucuaaaauaggaaacauuuggguaauagccauagguaaccagugaaguggaacuauacuuuagauguguacucuauagccugaaaggugacuacgauggcauauugugcaauccacucugcuuuuaaaaagcaaggcagggcuaguaguaugacucagugauguaguguuucuaugguguauaugaguuucuggguuuggucccagcacugcaaaaugguagugcuggggcaauuucaaguuaacgucauauuuaugugugcauaaagauacauauaaugguggucuaauaaaaugguucaaguccuuuuuucuuuuuuugagacagugucucuuuauauagcccugacugcauguaacucacuauguaaaccaggcuggccuuaaacucagagauaagccuaccuccaccuccgccucccaaaugcuaggauuaaaggcaugcucuacuacagccagcuguggugcaagucuuaagagccccuuuaagauugccauucaugagacuggauagauugcuuagugguuaaaaccacuuguugcucuuacaauuaaacuaccaaggaccaugguuuaauucccaccaggaacgccaguuacagggcaucugaugauggauaccaagcauacaugugguauacagauauaugcagacaaaacacaacacacacaaaauauuuuuuuaaaaucacuaaaaacgcaguaauauugccacuauguucuuccuuuggcucucacagaugggguuccauguucccagaacccaacagaggcaauagaagcuuggaucaauuucaauaaagaggaaagagaggcuuuugccgagucacuaaggacuagcuugaagguaaggcacauuugauucuuaaggguuggcauaaugucucugcauuccucaguggcccucaguggccuucucucuauuuuggcagggggaaauguguaucuuuugguauguguguaggaguccacugugugggucacaaggaucaagcucagguccucaggcuuggggcaagcggcuuuacugcugaaccgucucacuggccguguguguguguguguguguguguguguguguguguguguguguguguguauagagguauggaucagacaguaagcuaucagaggucuuccucugccacgcuuuuccuuauugccuugagugucucuuaacugaaguuuaccauuggcuagaauggcucaccagucaacaaauacccaggcucaauuugucucugcucccuccaaacucccuacaagcauguccaaccauguccaacuuauuacauagaugcuagagauuuuguagggaugcucaggucuucauuccuguacagcaagugcccuuagcccccugagccaucuuccaagccucugaccugccucuuuugauagucacugauuagugacuagcuugaaguuacuaagaacuggggagucggauguguuuucuggucccacaagcauuccaucuauggccuucaaaguucauaguuuuugcuaucuucuccuaugcuaucuuuuuuuuuuuuuuuuuuuuuuuuuuuuuuuugguuuuucgagacaggguuucucuguauagcccuagcuguccugaaacucacucuguagaccaggcugaccucgaacucagaaauccaccugucucugccucccaagugcugggauuaaaggcgugcgccaccacgccuggcucuaugcuaucuuuugaaagaacggcuuucaguauugaguuaaccaguucuagccagauguuguggcuuaacacauguggcauacaugaaacuagacuccccgucauaguucaaggccagcauaggccauauacgaucgugucucaaaaguaaaaacaaaagcagagaugacuugggauguaguucaguuacuaggaugcuugcuuugugucguggaguuccugguuuaauuucuaacccugaaaaacaaaaacaguaagagcagauguggugcaugcuauaaucccccuggaggcugaugcaggagaaucuaaguaugaacaguuugugcuacgcagcaagaucuuguuugaauaaacauguaaauaaacuaaauuguagggaugaacaaaacaaauucucugcccuguauaucaagggaaagucaggccaugaggcccggaccuuuaaggauaccugucuuaguagagucuucacaugagcugaugucagaauuucaauuuugccaacaggaaauuggggagaaugugcacauuuaccugaucggaaaagagucaucccgcacgcacucauuggcuguguccuugcacugugcagaagaugacuccaucaguguaaguggccaaaacagcuuaugccaccaaaucacugcagccugcaagcaugguggcgaccuguaugugguaggaggguccaucccacgacgcauguggaaauguaacaaugccacuguugacugggaguggugugcuccuuugccccgcgaccgccuccagcacacccuaguaucugugccugggaaagaugccauauauucccugggcggcaagacacuacaggauacccucucgaaugcaguuaucuacuaucggguaggugauaacguguggacagagacaacucaguuagagguggcugugucuggggcugcuggugccaaccugaauggaaucaucuacuuacuggggggugaggagaaugaucuagacuucuuuaccaaaccuucccgacugauccagugcuuugacacagaaacugacaagugccacgugaagcccuacguacugcccuuugcaggccgcaugcacgcagcagugcauaaggaucugguguuuauuguggcugagggggacucucuagugugcuauaauccccuucuagacagcuucacccggcucugucuuccugaggccuggagcucugccccaucccucuggaagauugccagcuguaauggcagcaucuacgucuucagggaucgauauaagaagggugaugccaacaccuauaagcuugacccugccacuucagcuguaacugucacaagaggcauuaaggugcugcuuaccaacuugcaguuuguguuggccuaaaacagugaugagaagaacagcugacuccuuugcccuccccuugugguguauccccagucaaaucgguaaucccccaguucagagaaauguguuaguuugggcauaugugagaaaggcagcgccucaacccauccccaaggcucaugggaugcucuguguagggcuuuucacacugcugcugcuugaacucugccauuauccccugugauccugugccucacuucagacugcuuagagccagccucuucucagacuuaggcacagccucucuuaccagaucaguguuaaaaagaagcaccuuggcucccaugcaggaagacagaggcccauuccucuugucuauagccagccgaguggcuacuugucacuuuccacaaagaauuaaguaugagaguuuuggaugggacaguggacuaagcuaaaaauguacuucaccagcaagaaucaacuguaaaauucaagauguuccuucaaauguuuucucaucugucugucaggaaaagaaacuuugguuggauuuuuggcuuauacaaacagauaagccagaaaguagaaacaauuguuucugauuaauagcagaaacuguuuuccagacucaaauaaaaacagucucuggucuuuuaaaggcucuaagcuaaauaaagaguuaggaacuguucauacaaauaaacguuucugaaaugauuugugugucuguguugacuccugaaugggugacuucuaaagggaaacuaauuguagacuucuuccauccugacucagcaguccugccuacaccccauauauccuugaacauucugaucacuccccagaagugugaggggagucccacagggccaggggaaaacuguauuuuuauuuuuauuuuuggaccugcuagggaccaaauuggggccuuauuauacaugcugggcaagcacuuugccaagucauacaauuaagauuuggauucugacaguaauaagaacagcucuagauacuucuuucccucucuaggauuaaaugucuuugauuuacagugccauuacacacauuagaaacaacagaucucuguuaaaauuaauauuuccuuaucccugucaaagaaaauaagauuuagccagacaaucuuguucucuguagccauccaaguguuauuucaggaaggaaggcaaaggagacacauuaucuaccagucagcacauuugcaguguggucggguuaagcugcuuuguccuguaaacuuguuacuauaucucagggagauccaaguucuuuguuauccacagucuucagacucuuaagucagcaugagagauaaucaguaguuaauucuuugcugcccuugcagugaucuccuuguggaacucuuugagaacuuccagcuggcugggccugauggagaugugugaccggauuuuggcgaucgcuucuauagccuccucugggcuccaguuguguaccugaagagcaagguuagaaaaucaaccaagaaaagaaggagcagguauaacaaugcccuuggccuaugagcagaugcugaaggacucucagaauuaacuuuuaaaaagauuugggcuggcaagguagcucaguggauacagguacuugcugccaagccugaaaaccauagccaagaguuuggucccaggaauucacaugguaaaauuagagaacuaacuccugccaguugucuucugaucuccacaugagcgccaaggcauagacaugcccacauguacuugcacauauaaauaaagugaauaauguauaaucaguuuucuucaaguaaaugaagacuccauagagagcacuuugaaaaccaugcuucagcugggcuaagagguacaggccuguaaacccaguuacucgggaagcugaggcaggaggaccacuacuucaaagcuggucugaguuauaguucaaagccagcccagcugacuuacuaaagucauguuuuaguaaaaagaaugcccaggauauagcucacugguagagcauuugguuaacaugcuuaaaucacuugggcucaaugcccagaacuaaaacagggaagaaaaaaaaaauccuuugcugagugugguaugcuggaggaucacaugagcacaggaguucuagaguuugaggccagccagaccuugacaggaaacaaaagcacagguuucaugagcacuuuuaacuaccacagucagcaaaaccccauauuuucuauguauacucucauuuuugagcuaggauuuuaacaauaguuuaauaaauauauauacauauauaugcauauauacauacacauacauauauauacauauauauacacauacauaca

SEQ ID NO: 905 - RNA, 10094 nt, Mus musculus
uuuuuuuuuuuuuugguuuuucgagacaggguuucucuguauagcccuagcuguccugaaacucacucuguagaccaggcugaccucgaacucagaaauccaccugucucugccucccaagugcugggauuaaaggcgugcgccaccacgccuggcucuaugcuaucuuuugaaagaacggcuuucaguauugaguuaaccaguucuagccagauguuguggcuuaacacauguggcauacaugaaacuagacuccccgucauaguucaaggccagcauaggccauauacgaucgugucucaaaaguaaaaacaaaagcagagaugacuugggauguaguucaguuacuaggaugcuugcuuugugucguggaguuccugguuuaauuucuaacccugaaaaacaaaaacaguaagagcagauguggugcaugcuauaaucccccuggaggcugaugcaggagaaucuaaguaugaacaguuugugcuacgcagcaagaucuuguuugaauaaacauguaaauaaacuaaauuguagggaugaacaaaacaaauucucugcccuguauaucaagggaaagucaggccaugaggcccggaccuuuaaggauaccugucuuaguagagucuucacaugagcugaugucagaauuucaauuuugccaacaggaaauuggggagaaugugcacauuuaccugaucggaaaagagucaucccgcacgcacucauuggcuguguccuugcacugugcagaagaugacuccaucaguguaaguggccaaaacagcuuaugccaccaaaucacugcagccugcaagcaugguggcgaccuguaugugguaggaggguccaucccacgacgcauguggaaauguaacaaugccacuguugacugggaguggugugcuccuuugccccgcgaccgccuccagcacacccuaguaucugugccugggaaagaugccauauauucccugggcggcaagacacuacaggauacccucucgaaugcaguuaucuacuaucggguaggugauaacguguggacagagacaacucaguuagagguggcugugucuggggcugcuggugccaaccugaauggaaucaucuacuuacuggggggugaggagaaugaucuagacuucuuuaccaaaccuucccgacugauccagugcuuugacacagaaacugacaagugccacgugaagcccuacguacugcccuuugcaggccgcaugcacgcagcagugcauaaggaucugguguuuauuguggcugagggggacucucuagugugcuauaauccccuucuagacagcuucacccggcucugucuuccugaggccuggagcucugccccaucccucuggaagauugccagcuguaauggcagcaucuacgucuucagggaucgauauaagaagggugaugccaacaccuauaagcuugacccugccacuucagcuguaacugucacaagaggcauuaaggugcugcuuaccaacuugcaguuuguguuggccuaaaacagugaugagaagaacagcugacuccuuugcccuccccuugugguguauccccagucaaaucgguaaucccccaguucagagaaauguguuaguuugggcauaugugagaaaggcagcgccucaacccauccccaaggcucaugggaugcucuguguagggcuuuucacacugcugcugcuugaacucugccauuauccccugugauccugugccucacuucagacugcuuagagccagccucuucucagacuuaggcacagccucucuuaccagaucaguguuaaaaagaagcaccuuggcucccaugcaggaagacagaggcccauuccucuugucuauagccagccgaguggcuacuugucacuuuccacaaagaauuaaguaugagaguuuuggaugggacaguggacuaagcuaaaaauguacuucaccagcaagaaucaacuguaaaauucaagauguuccuucaaauguuuucucaucugucugucaggaaaagaaacuuugguuggauuuuuggcuuauacaaacagauaagccagaaaguagaaacaauuguuucugauuaauagcagaaacuguuuuccagacucaaauaaaaacagucucuggucuuuuaaaggcucuaagcuaaauaaagaguuaggaacuguucauacaaauaaacguuucugaaaugauuugugugucuguguugacuccugaaugggugacuucuaaagggaaacuaauuguagacuucuuccauccugacucagcaguccugccuacaccccauauauccuugaacauucugaucacuccccagaagugugaggggagucccacagggccaggggaaaacuguauuuuuauuuuuauuuuuggaccugcuagggaccaaauuggggccuuauuauacaugcugggcaagcacuuugccaagucauacaauuaagauuuggauucugacaguaauaagaacagcucuagauacuucuuucccucucuaggauuaaaugucuuugauuuacagugccauuacacacauuagaaacaacagaucucuguuaaaauuaauauuuccuuaucccugucaaagaaaauaagauuuagccagacaaucuuguucucuguagccauccaaguguuauuucaggaaggaaggcaaaggagacacauuaucuaccagucagcacauuugcaguguggucggguuaagcugcuuuguccuguaaacuuguuacuauaucucagggagauccaaguucuuuguuauccacagucuucagacucuuaagucagcaugagagauaaucaguaguuaauucuuugcugcccuugcagugaucuccuuguggaacucuuugagaacuuccagcuggcugggccugauggagaugugugaccggauuuuggcgaucgcuucuauagccuccucugggcuccaguuguguaccugaagagcaagguuagaaaaucaaccaagaaaagaaggagcagguauaacaaugcccuuggccuaugagcagaugcugaaggacucucagaauuaacuuuuaaaaagauuugggcuggcaagguagcucaguggauacagguacuugcugccaagccugaaaaccauagccaagaguuuggucccaggaauucacaugguaaaauuagagaacuaacuccugccaguugucuucugaucuccacaugagcgccaaggcauagacaugcccacauguacuugcacauauaaauaaagugaauaauguauaaucaguuuucuucaaguaaaugaagacuccauagagagcacuuugaaaaccaugcuucagcugggcuaagagguacaggccuguaaacccaguuacucgggaagcugaggcaggaggaccacuacuucaaagcuggucugaguuauaguucaaagccagcccagcugacuuacuaaagucauguuuuaguaaaaagaaugcccaggauauagcucacugguagagcauuugguuaacaugcuuaaaucacuugggcucaaugcccagaacuaaaacagggaagaaaaaaaaaauccuuugcugagugugguaugcuggaggaucacaugagcacaggaguucuagaguuugaggccagccagaccuugacaggaaacaaaagcacagguuucaugagcacuuuuaacuaccacagucagcaaaaccccauauuuucuauguauacucucauuuuugagcuaggauuuuaacaauaguuuaauaaauauauauacauauauaugcauauauacauacacauacauauauauacauauauauacacauacauacacacacacauauauguauauauacauacacacauacauauauauauacacaugcauacacacacacauauauauacauacauacaugauauauauauauauaugaaguuccuauuucuagaaguaggcauagcacagugguuaaaugcuugccaggcuugaaugaagcuuacggguucaaguccuggcaccaaauacacugggugccuagauacaugacuguuaacuugagaggggaggcaggaggaucagaaguuuaaggucaugcucacugacguaacugacuuugaggacagccuauaauacaggagacuuugacacaaaauacacaaaaacuucuaugggccucuggcagcccuuuuccugaaauucaucaccauagcuaggaaaaugaguacuuuuuaaauuuaggaguguugccuuuauguuucaaggaugcacauggauuuagaacucaucagaauuaaacaacccuagccugcugggucaaaucucauuuagaccaaaguacucuccugagauuacugcagcauauuuuuuucuucaugguauuuuuugagacacagucucacuauaucuaccugguugaccugaaacucaugcuaugcagagcagguggcuguaaagucaaagagguccuuuguuuucacuuccaaaaugccagggguuacagcugcacaccaccacacccagcuuccagcaaagucucuauaauagcauugguauagcucagucacacacaguccauauuaacagggcuaggccaguucuuauauuuccuuaaauuaccuauuugacugaaaaauauuaugcaagaaccagacuaauggccaaaaaugagucaccuggaaagggaaagauaucagguaaugauaauggacgauaacacauuuguguuuaaauauuuuuaaaacauuccacuugucaaucaauacuuuucccucccauuucagggaauaaaguuggggcuucauauauguuaggcaggcacucuaccacugagcaaaguccccagccauauacacauaaaauaagaaaauaugguaaaacaacaaaaacucaugucagagcuuuauccugaaaugccauaaagccagcagugaucagcacuacaacacuaaguguuccgaccugcuguucuggcccuugagcuccauaguccgguaucugagcauguccuggaaccucauccucccaccuccaucucacaugugcagguccucacacucaguuugagucucaugcacucuaggcaagcacucuacuauugaauuagccccugccaugcuauuuaaacugggccaggugugguggugcacuccugugaucccagcacucaggaggcagaggcaggaggacugcugcaagccucaauuauauagcccagucucuauaaugaauuccaggcuauucagggcuauauaacaauauacuaucucaaacaaacaaaaaauaaggcucuuccagucuucugcuggguuuaacaaucaaacuccuuuuuuuuuucuuuaagaccugugcaggcaagcacuuugacauaccuucucauuuaaguuuccugucacauuuaagcuaaagaaacagcaucagagaggagaauccacauuuaucuauccugacugguaagggcaggaccagagaagcuggccugugcacaaagcauggcuguuuggcaugaugccauauuuccuucugacagccuagaaguggguaauggcucacuccagcaaggccugucaguacacaaugcuacugaacaucuggaaagcuguaccaaggcuacuccagcgcuacuuuuccuaccugaaucagauaggcugccaccauuguggcacuucuggaucgaccagccuuacaaugcacauagacacacuggcccagugccugguacuugagagcaaacuggacuccuuuguggagauuggccaagguugggaccccagucaugucgacugugcugagccguagcugcucaacuccugcuuucuuccauuccuagaaccagaacaaaaaggaaaggaaaaucaaagaagcuugagguaaaugguuugaagaggaggucccaagcagcaaaacagccagcaaaugccaggguuuacuauaagguaacucuuuccaaagacagaaaugcuauugaaagcucaccuuccacuaagcagacaugcugcuauuagaacuauguucaaauauucuugaaaugcuuggaucuuuaguucuuuuauuagcucuauaaaaucuacugugggucuagagagacaguucaguagcuaagagcacuuacugcuccuggaggagaguucaguuucuagcacccccauugggaggcuuauaaccacuaagcaccuaccaacauagucgggugggggagaacacuaaccccagcucccaguuuguggggaggcaaacguauaggauaucuaugaauuugagucuacauaauaaguuccaggccaaccagagcuacauagugagacugucucaacaaaccaaaaaacaccaccacaacaacaaaaaaaaaguuuaaaaaaauucagcugcgggcuagaaagauggcucagugguuaagagcacugacugcucugccagagguccugaguucaaaucccagcaaccacgugguggcucacaacuauccauaaugagaucugaugcccucuucuggugcaucugaagacagcuacaguguacuuagauauaauaauaaauaaaucuuuuuaaaaaaauucagcugcaaaaguuacggggcugaaggauguaggucagugguguagugccugccaaguuagcuccugagauuucccccacuuaaaauaacguuaggaagcauguuuuugccuuaguuagggccuaugcagugauccagcuguaggcaaggaucacuaguaaaauauauauucuaccauuagugcauaaauauuuuuuccacuuuuugagagguacauaguaaaaaaaaggggguuauuuuuaaguuaaaacaacauacuuuagacaagagugggggcucaugccuaaaguuccaaggcuaggaugcugugaguagaguucaagaauagucuacccuauagaauaagacuuccuucacuccuuaaaaaaaaaaacaaaguaaaaugaaaagccuaccugguuuuguguaacauuauuuaagaaacuagagaaaugaaauaaagccuuuuguuauauuagacaacaguguuuuugcuuuaagacuucaaauacacucuagcugcuuuuacuagcuucuuuguuguuguugguuuuuaaauaagguuucauguaagcaaggaugaccucaauucucacuguguagccaaggaugccugugagcugauguuccugccccuacuucccaggugcugaagguacaggugugggccuccauguuccuugcuauuuuagcaagucccugcaacuuaaugacugcaagaaggcugguuuaaucccaccaaucaaaucagcagaaccugaaggcauauuuuugcuuguauaucaacugaaccagaaccacuuucagaguuguuaaauaugcagcuaaauccuguaaauaugcagaauauaucaggguugaggggguggaagugaggguggcuggaggcaggaacuugcuacuuuagcaaggcugccagaagguccuuaggcauccuggagauuuggagauuucuuugcucuaggcuagugccaucuuacaaaggcagcaacucacaugucaagcguugucuguggcuuugguggccucuccguuuauacaguugaucacauuagugaguauuaacucugacagcuaaugacccccuugagaccugugacaauauuuugggaaauuccggggacagucauguucuuuuguucuuuuucuauaaagggcccuauauaccccaggcuagccucgaacucguguguggcucaggaugagcuuggaugccugauccucuugcuucugggguguugggaugucggcccugugccacuaccaugccuuguuugccuucugcacugagcuuuguguaucccaggcaagcaguuuaucaacugaaauccauccccagcccacucugcagauucucaaugauaacuauuaacauagcauauauaauaaggggugcucuucuuuuauaauuuucuuuggagcagggguuucaagacagaauuucauuauguagcucuggcuaaccuugaauuuacuuuguagaucaggcuggccucaaacucacagagaucugccuuccucugucuccagagagcuggauuaaaagugugcaccacuaugccuggcaggaagaggguacccuuuucuuaucugugauuuuguuuuuagacacaggcucauguagcccaggcuggccuccaccucaccacacacuguggcuggucucaaguucuugaucuucccaccuucacucacaaagugcuaacauaacagguaugagccacacucuuaaagaaaugcuuuucuuacaguuggccuucgucuccaaagcuacaauaacuaauucaaaccugaugcuaaaauauguguugaaaugaaugaaaucagcaaggcacauuguauuagucaggguucucucgcuccacucccugagccaagcauauucaaaccaccacacacaagucacaauuuuaguuacugagguuagugaccaaaaucacaaauacaaaauggguguauuagcacaugccuguaaucucaguacuuggaaaguggaggcaggagaaucggaucaggacuuaagaccccugucucaaaauaaacaaacaaaggaaaaguagcauauacauguacaauucugugcaugaagaacuguaccccccguccccauuuugaagcaggacuuccuuguccuguguccugacugacccagagcucacuacauacaauacaccaagcuggccuggaacaacuucuugccuuaagggggcugaaauuccaggagugagccacccacagcggguuagcucgcucuuuuuagacaauggccaggacacauugaacuccugggcucaaaagauccugccucugccaccugagucuccagacucgcaagacuucuuucuggcuuaucagcuucagcgucuuuccaccugcagccauuugagcuugacccacauacacagaacuugagaaggcaacuaggucuccaacacuggucucggagacaaggucacccacggcguccuuccucuuccccuagcuucuccagcuuucccaggcccgagugcugggccagccaggccagagggcccggguccucaccuucgagguguugcacaggaaucgggucucguacuccucguucauagugaucaccccgcgcacguucucguccaguaccagcugccgaggcaaagaggaggcucagcgagggccgcggggcgcccgcagaggcccugggcccgcucccggcccggcccggcccggcccggcggucucucacccggcgcgucauguucuucagcggcagcgcgcccagcagaaccguguggucgaugcggugguaccagucgcggugcgccgggccgcgcacccucccccggacacuguguagagcagcgucggguagaagagcacccgggccaggccggccuccagccacgcggaggccgccaucccgccccaccccgccaggcgcaguggcgaggcgccccaccccgccaggcgcagcggccagccaccggccccggggcucgcgaccagccaccgcgagaaggacgcggaggacgagagcugagggccaccugaugccucccgacucuucgaagcugaguccccggagucccggcccugcccgagggaucccggaacaggagccauggcuccaaaggagaggcgccgcgaggcgcggcgaggggucggguggagggaguggaauggcaagaucgggugaaacugugacccugccuaaggagcagggccggcucuccaaccccugaccuuagggaggggccgugaccccggagugcacccaucacuaaggaggaggcucagcagagaggcuccucuaaacagggaaggcccuggagaagccgagucugccuguaaaaaaagcggugguugucagcugcucuugggggagcagggaaccugaacuugaaccuaggugguggucuacugcccugugucugucugucugugucugucucucugucucucugucuuuccccgccccccccccucuccuuuuuuaaaaccaggucacacuaugaagcccuaaaugucuucuacuggcuauguagcuagcuccaggacacacaaaggaacccugucuca

SEQ ID NO: 906 - RNA, 10094 nt, Mus musculus
ugagacaggguuccuuuguguguccuggagcuagcuacauagccaguagaagacauuuagggcuucauagugugaccugguuuuaaaaaaggagaggggggggggcggggaaagacagagagacagagagacagacacagacagacagacacagggcaguagaccaccaccuagguucaaguucagguucccugcucccccaagagcagcugacaaccaccgcuuuuuuuacaggcagacucggcuucuccagggccuucccuguuuagaggagccucucugcugagccuccuccuuagugaugggugcacuccggggucacggccccucccuaaggucagggguuggagagccggcccugcuccuuaggcagggucacaguuucacccgaucuugccauuccacucccuccacccgaccccucgccgcgccucgcggcgccucuccuuuggagccauggcuccuguuccgggaucccucgggcagggccgggacuccggggacucagcuucgaagagucgggaggcaucagguggcccucagcucucguccuccgcguccuucucgcgguggcuggucgcgagccccggggccgguggcuggccgcugcgccuggcgggguggggcgccucgccacugcgccuggcgggguggggcgggauggcggccuccgcguggcuggaggccggccuggcccgggugcucuucuacccgacgcugcucuacacaguguccgggggagggugcgcggcccggcgcaccgcgacugguaccaccgcaucgaccacacgguucugcugggcgcgcugccgcugaagaacaugacgcgccgggugagagaccgccgggccgggccgggccgggccgggagcgggcccagggccucugcgggcgccccgcggcccucgcugagccuccucuuugccucggcagcugguacuggacgagaacgugcgcggggugaucacuaugaacgaggaguacgagacccgauuccugugcaacaccucgaaggugaggacccgggcccucuggccuggcuggcccagcacucgggccugggaaagcuggagaagcuaggggaagaggaaggacgccgugggugaccuugucuccgagaccaguguuggagaccuaguugccuucucaaguucuguguaugugggucaagcucaaauggcugcagguggaaagacgcugaagcugauaagccagaaagaagucuugcgagucuggagacucagguggcagaggcaggaucuuuugagcccaggaguucaauguguccuggccauugucuaaaaagagcgagcuaacccgcuguggguggcucacuccuggaauuucagcccccuuaaggcaagaaguuguuccaggccagcuugguguauuguauguagugagcucugggucagucaggacacaggacaaggaaguccugcuucaaaauggggacgggggguacaguucuucaugcacagaauuguacauguauaugcuacuuuuccuuuguuuguuuauuuugagacaggggucuuaaguccugauccgauucuccugccuccacuuuccaaguacugagauuacaggcaugugcuaauacacccauuuuguauuugugauuuuggucacuaaccucaguaacuaaaauugugacuuguguguggugguuugaauaugcuuggcucagggaguggagcgagagaacccugacuaauacaaugugccuugcugauuucauucauuucaacacauauuuuagcaucagguuugaauuaguuauuguagcuuuggagacgaaggccaacuguaagaaaagcauuucuuuaagaguguggcucauaccuguuauguuagcacuuugugagugaaggugggaagaucaagaacuugagaccagccacaguguguggugagguggaggccagccugggcuacaugagccugugucuaaaaacaaaaucacagauaagaaaaggguacccucuuccugccaggcauaguggugcacacuuuuaauccagcucucuggagacagaggaaggcagaucucugugaguuugaggccagccugaucuacaaaguaaauucaagguuagccagagcuacauaaugaaauucugucuugaaaccccugcuccaaagaaaauuauaaaagaagagcaccccuuauuauauaugcuauguuaauaguuaucauugagaaucugcagagugggcuggggauggauuucaguugauaaacugcuugccugggauacacaaagcucagugcagaaggcaaacaaggcaugguaguggcacagggccgacaucccaacaccccagaagcaagaggaucaggcauccaagcucauccugagccacacacgaguucgaggcuagccugggguauauagggcccuuuauagaaaaagaacaaaagaacaugacuguccccggaauuucccaaaauauugucacaggucucaagggggucauuagcugucagaguuaauacucacuaaugugaucaacuguauaaacggagaggccaccaaagccacagacaacgcuugacaugugaguugcugccuuuguaagauggcacuagccuagagcaaagaaaucuccaaaucuccaggaugccuaaggaccuucuggcagccuugcuaaaguagcaaguuccugccuccagccacccucacuuccacccccucaacccugauauauucugcauauuuacaggauuuagcugcauauuuaacaacucugaaagugguucugguucaguugauauacaagcaaaaauaugccuucagguucugcugauuugauuggugggauuaaaccagccuucuugcagucauuaaguugcagggacuugcuaaaauagcaaggaacauggaggcccacaccuguaccuucagcaccugggaaguaggggcaggaacaucagcucacaggcauccuuggcuacacagugagaauugaggucauccuugcuuacaugaaaccuuauuuaaaaaccaacaacaacaaagaagcuaguaaaagcagcuagaguguauuugaagucuuaaagcaaaaacacuguugucuaauauaacaaaaggcuuuauuucauuucucuaguuucuuaaauaauguuacacaaaaccagguaggcuuuucauuuuacuuuguuuuuuuuuuuaaggagugaaggaagucuuauucuauaggguagacuauucuugaacucuacucacagcauccuagccuuggaacuuuaggcaugagcccccacucuugucuaaaguauguuguuuuaacuuaaaaauaacccccuuuuuuuuacuauguaccucucaaaaaguggaaaaaauauuuaugcacuaaugguagaauauauauuuuacuagugauccuugccuacagcuggaucacugcauaggcccuaacuaaggcaaaaacaugcuuccuaacguuauuuuaagugggggaaaucucaggagcuaacuuggcaggcacuacaccacugaccuacauccuucagccccguaacuuuugcagcugaauuuuuuuaaaaagauuuauuuauuauuauaucuaaguacacuguagcugucuucagaugcaccagaagagggcaucagaucucauuauggauaguugugagccaccacgugguugcugggauuugaacucaggaccucuggcagagcagucagugcucuuaaccacugagccaucuuucuagcccgcagcugaauuuuuuuaaacuuuuuuuuuguuguuguggugguguuuuuugguuuguugagacagucucacuauguagcucugguuggccuggaacuuauuauguagacucaaauucauagauauccuauacguuugccuccccacaaacugggagcugggguuaguguucucccccacccgacuauguugguaggugcuuagugguuauaagccucccaaugggggugcuagaaacugaacucuccuccaggagcaguaagugcucuuagcuacugaacugucucucuagacccacaguagauuuuauagagcuaauaaaagaacuaaagauccaagcauuucaagaauauuugaacauaguucuaauagcagcaugucugcuuaguggaaggugagcuuucaauagcauuucugucuuuggaaagaguuaccuuauaguaaacccuggcauuugcuggcuguuuugcugcuugggaccuccucuucaaaccauuuaccucaagcuucuuugauuuuccuuuccuuuuuguucugguucuaggaauggaagaaagcaggaguugagcagcuacggcucagcacagucgacaugacuggggucccaaccuuggccaaucuccacaaaggaguccaguuugcucucaaguaccaggcacugggccagugugucuaugugcauuguaaggcuggucgauccagaagugccacaaugguggcagccuaucugauucagguaggaaaaguagcgcuggaguagccuugguacagcuuuccagauguucaguagcauuguguacugacaggccuugcuggagugagccauuacccacuucuaggcugucagaaggaaauauggcaucaugccaaacagccaugcuuugugcacaggccagcuucucugguccugcccuuaccagucaggauagauaaauguggauucuccucucugaugcuguuucuuuagcuuaaaugugacaggaaacuuaaaugagaagguaugucaaagugcuugccugcacaggucuuaaagaaaaaaaaaaggaguuugauuguuaaacccagcagaagacuggaagagccuuauuuuuuguuuguuugagauaguauauuguuauauagcccugaauagccuggaauucauuauagagacugggcuauauaauugaggcuugcagcaguccuccugccucugccuccugagugcugggaucacaggagugcaccaccacaccuggcccaguuuaaauagcauggcaggggcuaauucaauaguagagugcuugccuagagugcaugagacucaaacugagugugaggaccugcacaugugagauggaggugggaggaugagguuccaggacaugcucagauaccggacuauggagcucaagggccagaacagcaggucggaacacuuaguguuguagugcugaucacugcuggcuuuauggcauuucaggauaaagcucugacaugaguuuuuguuguuuuaccauauuuucuuauuuuauguguauauggcuggggacuuugcucagugguagagugccugccuaacauauaugaagccccaacuuuauucccugaaaugggagggaaaaguauugauugacaaguggaauguuuuaaaaauauuuaaacacaaauguguuaucguccauuaucauuaccugauaucuuucccuuuccaggugacucauuuuuggccauuagucugguucuugcauaauauuuuucagucaaauagguaauuuaaggaaauauaagaacuggccuagcccuguuaauauggacugugugugacugagcuauaccaaugcuauuauagagacuuugcuggaagcugggugugguggugugcagcuguaaccccuggcauuuuggaagugaaaacaaaggaccucuuugacuuuacagccaccugcucugcauagcaugaguuucaggucaaccagguagauauagugagacugugucucaaaaaauaccaugaagaaaaaaauaugcugcaguaaucucaggagaguacuuuggucuaaaugagauuugacccagcaggcuaggguuguuuaauucugaugaguucuaaauccaugugcauccuugaaacauaaaggcaacacuccuaaauuuaaaaaguacucauuuuccuagcuauggugaugaauuucaggaaaagggcugccagaggcccauagaaguuuuuguguauuuugugucaaagucuccuguauuauaggcuguccucaaagucaguuacgucagugagcaugaccuuaaacuucugauccuccugccuccccucucaaguuaacagucauguaucuaggcacccaguguauuuggugccaggacuugaacccguaagcuucauucaagccuggcaagcauuuaaccacugugcuaugccuacuucuagaaauaggaacuucauauauauauauauaucauguauguauguauauauauguguguguguaugcauguguauauauauauguauguguguauguauauauacauauauguguguguguauguauguguauauauauguauauauauguauguguauguauauaugcauauauauguauauauauuuauuaaacuauuguuaaaauccuagcucaaaaaugagaguauacauagaaaauaugggguuuugcugacugugguaguuaaaagugcucaugaaaccugugcuuuuguuuccugucaaggucuggcuggccucaaacucuagaacuccugugcucaugugauccuccagcauaccacacucagcaaaggauuuuuuuuuucuucccuguuuuaguucugggcauugagcccaagugauuuaagcauguuaaccaaaugcucuaccagugagcuauauccugggcauucuuuuuacuaaaacaugacuuuaguaagucagcugggcuggcuuugaacuauaacucagaccagcuuugaaguagugguccuccugccucagcuucccgaguaacuggguuuacaggccuguaccucuuagcccagcugaagcaugguuuucaaagugcucucuauggagucuucauuuacuugaagaaaacugauuauacauuauucacuuuauuuauaugugcaaguacaugugggcaugucuaugccuuggcgcucauguggagaucagaagacaacuggcaggaguuaguucucuaauuuuaccaugugaauuccugggaccaaacucuuggcuaugguuuucaggcuuggcagcaaguaccuguauccacugagcuaccuugccagcccaaaucuuuuuaaaaguuaauucugagaguccuucagcaucugcucauaggccaagggcauuguuauaccugcuccuucuuuucuugguugauuuucuaaccuugcucuucagguacacaacuggagcccagaggaggcuauagaagcgaucgccaaaauccggucacacaucuccaucaggcccagccagcuggaaguucucaaagaguuccacaaggagaucacugcaagggcagcaaagaauuaacuacugauuaucucucaugcugacuuaagagucugaagacuguggauaacaaagaacuuggaucucccugagauauaguaacaaguuuacaggacaaagcagcuuaacccgaccacacugcaaaugugcugacugguagauaaugugucuccuuugccuuccuuccugaaauaacacuuggauggcuacagagaacaagauugucuggcuaaaucuuauuuucuuugacagggauaaggaaauauuaauuuuaacagagaucuguuguuucuaauguguguaauggcacuguaaaucaaagacauuuaauccuagagagggaaagaaguaucuagagcuguucuuauuacugucagaauccaaaucuuaauuguaugacuuggcaaagugcuugcccagcauguauaauaaggccccaauuuggucccuagcagguccaaaaauaaaaauaaaaauacaguuuuccccuggcccugugggacuccccucacacuucuggggagugaucagaauguucaaggauauaugggguguaggcaggacugcugagucaggauggaagaagucuacaauuaguuucccuuuagaagucacccauucaggagucaacacagacacacaaaucauuucagaaacguuuauuuguaugaacaguuccuaacucuuuauuuagcuuagagccuuuaaaagaccagagacuguuuuuauuugagucuggaaaacaguuucugcuauuaaucagaaacaauuguuucuacuuucuggcuuaucuguuuguauaagccaaaaauccaaccaaaguuucuuuuccugacagacagaugagaaaacauuugaaggaacaucuugaauuuuacaguugauucuugcuggugaaguacauuuuuagcuuaguccacugucccauccaaaacucucauacuuaauucuuuguggaaagugacaaguagccacucggcuggcuauagacaagaggaaugggccucugucuuccugcaugggagccaaggugcuucuuuuuaacacugaucugguaagagaggcugugccuaagucugagaagaggcuggcucuaagcagucugaagugaggcacaggaucacaggggauaauggcagaguucaagcagcagcagugugaaaagcccuacacagagcaucccaugagccuuggggauggguugaggcgcugccuuucucacauaugcccaaacuaacacauuucucugaacugggggauuaccgauuugacuggggauacaccacaaggggagggcaaaggagucagcuguucuucucaucacuguuuuaggccaacacaaacugcaaguugguaagcagcaccuuaaugccucuugugacaguuacagcugaaguggcagggucaagcuuauagguguuggcaucacccuucuuauaucgaucccugaagacguagaugcugccauuacagcuggcaaucuuccagagggauggggcagagcuccaggccucaggaagacagagccgggugaagcugucuagaaggggauuauagcacacuagagagucccccucagccacaauaaacaccagauccuuaugcacugcugcgugcaugcggccugcaaagggcaguacguagggcuucacguggcacuugucaguuucugugucaaagcacuggaucagucgggaagguuugguaaagaagucuagaucauucuccucaccccccaguaaguagaugauuccauucagguuggcaccagcagccccagacacagccaccucuaacugaguugucucuguccacacguuaucaccuacccgauaguagauaacugcauucgagaggguauccuguagugucuugccgcccagggaauauauggcaucuuucccaggcacagauacuagggugugcuggaggcggucgcggggcaaaggagcacaccacucccagucaacaguggcauuguuacauuuccacaugcgucgugggauggacccuccuaccacauacaggucgccaccaugcuugcaggcugcagugauuugguggcauaagcuguuuuggccacuuacacugauggagucaucuucugcacagugcaaggacacagccaaugagugcgugcgggaugacucuuuuccgaucagguaaaugugcacauucuccccaauuuccuguuggcaaaauugaaauucugacaucagcucaugugaagacucuacuaagacagguauccuuaaagguccgggccucauggccugacuuucccuugauauacagggcagagaauuuguuuuguucaucccuacaauuuaguuuauuuacauguuuauucaaacaagaucuugcugcguagcacaaacuguucauacuuagauucuccugcaucagccuccagggggauuauagcaugcaccacaucugcucuuacuguuuuuguuuuucaggguuagaaauuaaaccaggaacuccacgacacaaagcaagcauccuaguaacugaacuacaucccaagucaucucugcuuuuguuuuuacuuuugagacacgaucguauauggccuaugcuggccuugaacuaugacggggagucuaguuucauguaugccacauguguuaagccacaacaucuggcuagaacugguuaacucaauacugaaagccguucuuucaaaagauagcauagagccaggcgugguggcgcacgccuuuaaucccagcacuugggaggcagagacagguggauuucugaguucgaggucagccuggucuacagagugaguuucaggacagcuagggcuauacagagaaacccugucucgaaaaaccaaaaaaaaaaaaaa

SEQ ID NO: 907 - RNA, 79118 nt, Mus musculus
cggcgcuggcgggcggcgccgcggugguacguuccccuucgccgcccgcccccuccgcggcggcccuccccgccggugguaggugccggaagugccgccauuuugggguguucugcucuggcggcagcggcagcggcagaggcggcggcggcggcgggacgcggaggcucccccgggauucggccucagcagcgaggcagcggcggcugcggaggagcaaggcagcagcugaggcagcggcgggcucaggugcagccgcuggugagugcggcggccgcaggauaacgggccgcgggaugaagggagggaaagagagggaggcuggagggaggcgccgcggggcgggucagguucgggcggcuacgggucacagggcccuccgggugcggucgcucccgcuuccccgcaccccggggaccaggccgcggacugcucgggacucgggggcccauucgcguccgcccggcgcgugccccugcucccagggagacccgcccuccucguggccuggccccggcucccuugcccuuugccuccacucucccggccccgagggcuugcuuccugcaccgcacccgaguccuccucuccggguccgcugggcgagaucgcggcugucuacccgagacgccgcuucccugacccugucgccccacguguucuucgugcccacccccggggguguccuagauucccgccccuagaaggcagcgcuccucucgauccuccggagcucuugcaguucucgcccuggggccgcuuuggcucgcccuaccccccacaucaggugcucgcucgcccagucaaggccuaguagcagggcucgaaucucgcacccaggagcggggacggcucuggagggugccuucuucgcuaggucccaggcuuuggauuuaaagucgguaguggugucucgguuguggugguucugacaggauguuguuuuaauuuucuccgaccauugcauaugcuuuuuaaggagcuucucauugguuuagagacugauuccggggagaaagugugagauuuuggucagagcuugguuuagcacaacagaaucucuuucuggugcucagaguuaaugcuguauauaaaagcuguugaacaguuuuaaagagcauagacucuguugauaaugucugcauuguuaggagguuacaaacacccuuugcacacacuuaaaaggaacuuaaccuuuaaaagaucucuucucugucuucuagucucugaguugaagagguuugaauugcacuuuuucacuuuuuccaguuuguuucuuuuuagauccuuagaaugacggugucuucagauggaauugcuuagaguucuuuuugguuuuggcauuaacaaguguacuuggaaaaucauggagguuagaauggaccaacugcaacggcacugauuuuuuuuuucucucuauacuaguuuuuauauuaguaguuuuauugccugagagugugguuucugaucaugaccuagggaggauugaaagccaugcuuaugguaaagcaaagcugggauuugcagcuguuacuuuagcuggcaagcuuaugaguucucuugguuucuucuucuccaccaccuguuucucuuaagaauggcucuuggcuccagagccuacgucuccauccucucauucauucuuacccuuuggguuuucuuuucccaaggauccauuagcaagaggggcuguuacaguugaaaggguugcuuuuuuuuuuuucuucagugcuuuggcuuucucacaaaggaaagugacuuauuugcccaagguuauuauagcaagugcuuuuaaaacaucucccaccaaagguuugcuugcuuugccuuuguaaaaaaaaauucacaacacuaucacacuaucaugagcaaugaugcagauuuaagaugugauggaauggcaagggcucugggcuugaaguuagaaaaucuacacaauuuucaaaucuuuuugcaguagguuacuaguuggucaagucauucuuuuauuaugauccuuguuuuaaucuccacaauccucuagaaauugguguccauuaguguuaguuaaccaaugauuguaccugugggcugcugggcagauagugaaaauuggagccagaaugacuuauguucuaaagaugucugcauacuuuucuuguuacagaaguugcagauucauuauaaaacauacugguaauucaaaugggaaaaaaaucuuaccuuucggagauuguuguuaaaauggguguguauguguacaacuuuacccugugggccccuccaacccccccaagacagggucuuccuaugaaguccucacuggccuacaucccaagugcugggauuacgguguauacugccgcaucuuuccaacuuugucuucaucacuuuagccuucuuuugucaguguguguucuuuuguguuacugggaaugcagcucuuggccucccacaguugauaggcaugcugucuuccacugaguuuuuucccuaguccacauccuuuucuuuuuuuccuagggguaggaucuucauuuucuacagcucaggcugaccuugaaauucccuguaauucuaccucaguuucccaagugcuggacuacuggucuaugccaccaugccugucuuguacaugguggagaagcauuuauuauuuaccaaaguagacuuauccuaaucagcuugguuguguuguccccuucccccaucuugaauuccugaccucuugccccgucucauaaguuauagaaaaacaagugugucacuacgccuggcugugauguagcuuuaauaguaggugguaggcuuuacuagccauguuuuauucuuaaguauaugguguuucaucagcuuguuuguauaacacaugcauacugcccaggagggucagaagagaaugcugggacccccaggaguuggaguuagagaaauuguaggagaugugacucggauucucugagccaucucuccagcucccagccacacuuuaaauaauuuuaaguaaugaucuguaguauaguuucugcucacaagagauaggccaguagauccuccacucagcauaggagcagaagaaucccucauuuaaagaugugggucagaagaaagaguaagacaggaaauuaacagagaccuauuguauauauguccacuuuguguguguguguguguguaugcucuaauaagaaguagguuguagaugguagcaguaguggauaccuugggggaaagacagcucucaccuagaggaagcaagagcauaggcuucucugugcagggauuuuggucuucccaacagauagaucuguacccccugccucccugagacagggaggguuuguguauagcccuggcuguccuuaaacucccagagauccucuugccucugccuucagaaugcugggaucaaaggugugugcuaccacccagcuagcucuguacucuguaaaccagcaaguaauaggauuugauuaaguucuuucaucugccuuguaaaaaagugcuuuuuuaaaaauacaauucauacaccauauaauuuauccauuuaagguauacaagucaguggcuuuaaauuuagaauuacugguuuuuguuguugacaguagccuggcuaugucgcccuggccagccucaaacuuacuauuguagacugggcuggucugccuuccaaguacugguacuaacagaaaugugucacaugccuggccuguuuuuguuuuuauuucuuuuccuuacagguuuacuaucccauauucuaaaugcuugaguccagaggugcucugagguuuaagaccuuuguuuuuauuuuucugagacaaugucucacuauguaguucaaaccagcuaaguagaccaggcugccucaaacucagagaucuaccugccucugccaaauauuaggauuaaaaucaagugugcaaugaugaccaacugggguuugguuaaaaaagauuuuuggggauggagauauuuacauguacauaaugagauaucuugaaguaccaacaugagcucuauuuauccuguauacuuuucuacauguagacucgggugcccggcauagauauacucagaaguaggcaggccuacuuauguggugauuguguuugagaaacccucaugcuaguucugugcagcuauacuaguuuauuuuaaauuuaauucauuaauuuugccacugggccucacuauguagccuugacuggccuagaacuccaguagacaaggcuggugccugucucugcuuccugaguacugggauuaaaggcauguaucaucuggcuauuuuaauugugcauucuuguguguuuguggagagagagaaugaauaugaauauguaugccacuugugugcaaagugcccauagaagccagaagagagcauuggaucccucuagagcuagaauuacaggcuguugugagcuaucugauaugggugcagggaacugaacuagauccugacagaguaugaaauggucuuaaucaaucacuaaaucaucauguaucccaggcuaaucuuuaaucugcuguaaauaugaggaugaccuuggaagacugauuccccagugucuacuuccaaaggcuauuucagagguauaucauuaguucaauuuuuuguggugcugaggauuuaauccauacucagagcuuugugucuauaaagcaaguacccugccaaccgagccucaucucaagcccaccuaggccacuuuauaacccaucagcagugauaagcauuccaggugcuuugcaaugcuuguuucugugauuuuguuuaaaauauaauuauuugugcagugucucuauguauaggugugugcuuguugugguacaauguggaaaagaagucagaagacaauuuuugagauucaguuuuuucuuaacauaugacucuuggggagagaguugauucuuuucuucuaccaagagggucccggaacucaggcugucagucuuggcaacaggcugcuuuacuugcugagccaucuugaucuugcuggaccuuguagccacacuauuuuauuuuuaauuuauuuuuauuuauguguaugaguguguaucuguaugucacauguguguacccacccauucggaucagaagagggugcugguugccuaaaagcuggaguuacaggugguuguugugagcugucccauauggguagcugggaaccaaauuuggguuuggguccuuuggaagagcauagcaagcauccuuaacugcuaagcuguaucuuuagcccccauagucuuuuuguguuuaauuagaauuguuauguguaugugugugacuguauguaucagugguguccuugaagucagaagagguagucagauccucuggaacuggaguuacagaugauuguaagcugccacauggguacuagaaacugaacccagguccucuagaagaacagaaaaguacuuuuaacugcugauccaccucuccugucccuauuuuuguuugugugugauguugcuauauagccuagacuggucucuguuguagucugccuucaucuccccuuuuaguuuuguucugauuucaagacagucuuuuuuuuuuuuuuuuuuuuuuuuugguuuuucaagacaggguuucucuguauagcccuggcugucuagacagucuuuuguaucccaggcuggccuuaacuugugguaggggcauggauggcuugaaccugugguuuacuugucuccacuucucaagagcuaggguggcagauguauaccuuuccuuauauaugugguucuggagcccaccagauuaaacauacacacacacccgcaccuacuuuacacuuuuuguuucucgauacaggauuuugucccaguuugucaucaaauacuacuuguagcugagggugaccuuaaauucuuucuuuauuuuuuuauuguuugagacaagaucucucuagguauuccuggcuguccuagaacucugauguagaccaggaugaccuugaacucaccgugauccuccuacuuaugacauccaagugcugagauuaaagaugugcaccuggcuauccuacugcuucuuaccuguuaaaaauugagauuccagaugugccauuaugucuaaucuaguucaacuguccuuucucccccaccccuuuuguuuuuagaccaaaucuucuuucuuuguaguugggacuggucuggaauucauuaugucaccuagauuggccuuaaacuuauuugaauauauuaucuuauccucucucccaaguuggaaccuuaggcuugagcccaccaugccugauuuucugaguugaauuucuagcaggcuccagaguuggcugcuguugauuuacccacucuuugcuugauauaucuuggcacacagaaacagccaacaggcaaguaaaauagaaacaagaaaaguuggauaaaaaacuucuguaauugagaguugauguuuuuuuuuuuuuuuugguuuuucgagacaggguuucucuguauagcccuggcuguccuggaacucacuugguagaccaggcuagccuugaacucagaaauccaccugccucugccacccaagugcugggauaauguuuccuuuuuuaaauuguagaauccuuaauguagaagcuuaaugguuugaaaaaguggugugucuugcaugggaugcagcuugagaggaaaguugugauagccugacaugcaguauuuauaaauuguuaucaccauugugaccuuuccccccacccccacccccaucuuuaaagauaacuguaguaggagagaagcuuggguuaagagcacuugcuguucuuccagugaacccaguuucaguuugcaguacccauguguuagcucacaacugucuguaacuccaguuccaagguaucugacacucuuggccuuugugggucagcacauguggugcaccuguguauguagaggcaaaacacacacacacccguaaagauaauaacucugaacuuaauaccagaauuaacuuauaacuugagcaguguugguaauuuccucuguuauaguacuguacuguuuuucuaaauguuuucauuuuuugagaauuuuauacaauauaugucuugguguuacuguuuuaguguagaaauacuaccuaaagcaacuuggggaggaaaggguuuuuugacuuccaguuccacauuguaguucaucauuggaaaucaggacaggaauucagacagggcaggaaucugcagguaggagcugaugcugaggacaugaggggcaugcugcuuacuggcuuuuccucauggcuugcuuugccugccugccugccugccuccuuccuuccuucuuuuuuuuuuuuuuuuuuuuugagacaggguuucuuuguguagcccuggcuguccugaaacucacuguguagaccaggcuggccucgaacucagaaauccgccugccucugucucccaagugcugggauuaaaggcaugugucaccacugccuggcaaagguuguuuucuugaugagauuuuuacacuuaucuaauaauuguuuuuuuguuuuuuuaaucuuuguccuaaaacugucuguuagaauuccuuaaacaacauuuucuuuucuccuuuuuucuuuauuucccccaauccuuuauuuuuuuuaauuuuuuuuaaagauuuauuuauuuauuauauguaaguacacuguaguugucuuaagacacaccagaagagaguuucagaucucguuacagaugguagugagccaccaugugguugcugggauuugaacucgggaccuuuggaagagcagucagugcucuuaacugcugagccaucucaccagccccccccccccccaaugaaauuuuauucguguguauaugugucuuugucugccaguauuagcaggggccagagagggcauuggaucuacugagcugacugacauggaauuugaacuagcaucaucuagaaaagcaaccagugcucuuaacugcugagccaucucuccugagacaucccuuguuucggaggcagucucucauucauguagccuaaguccaauuuuguauguagccaaugaugacuuugaacucuuuuucuuuuuuuuuaagauuuauuuauuguuauauguagauauacuguagcugucuucagacaccccagaagagggcaucagaucucauuauagaugguugugagccaccaugugguugcugggauuugaacucagguccuuuagaagagcagucaauauuccuaaccgcugagccaucucuccggcccccgccuuugaacucuugaucuuuaugccugagcuuuucaaauguugacacauaugcuugauaaccuuuucuuggcuuuuuaaaaacuuuauuuugugugugccuacauuuguuugcagcugggcgugguggcacacaccuuuaaucccagcuuuaaucccagcacucgggaggcagaggcaggcggauuucugaguucgaggccagccagggcuacacagagaaacccugucucgaaaaacaaaacaaaacaaaacaaaacccauuuguuugcaggugugccaugucuugaacaaagagaaccuagggcaacuugugguaguugguuuucuucuuccaucuuuacauggaguuuggaagucaaauucagcucauuagacuugugugguggcagcuaguucuucuaccuuuuuaaaaguuggguaggguauagugguaggguaucauggugcagucuuuaaucccaguacuugggaggcagagacaggcagaucucuugaguuugaggccagccuuguuuacaaaguaaguuccaggauaaccagggcuacacagugagacccugucuugaaaaacaaaaccaaagcaacccuuuacuuuaggaagcugagagucccaggccuguaagcuauauagcagcauugucugaagaacauuauccccaacugccuuaccuugccucucccccauaaaacaaaaccugacucucauaagcuggagaaugaauguuaaauuuucucuaagcaaaaggauacagagcugguauuuuuucucucauuaaacaugauuuuacaaugcagccuggucugguccaggcuagcccugaacuuugaagccuggugcuuuagcauaccaaggguuguuuguuacagaaguacuucuguucuuggaggauuucuaacuuguauacagagggcuugaauuucauagaaacuuuuccuuucaaaaaucgagaaagccuagugaaaggacaugauguaaauauauuucauuccaugauuuaaagcauuuuaacuuuaaauuuaaauguaaaguuuugugacuuaauucugugugauaucaaaucaaggacuuugugccuaaccuuucaagaaaaggacgaaaguuuuccaagcuucugauucuuguuuuuucuuucccuacacuuagaauacaugguagcaaauguugaagaguggucuaguuuagugguuauauugaaauugaagauauuauaauugauuagaaugugcuucuuugguauauguucagucuacccucuaauuuguggcauugauguucaucucuaauaaaaugaagcugacuaauuuuuuucuucaccagcuuuguuuguuuuguuuuugagagguugucucuauguaguucuggcugaccugcuggccugcaacuagcaauauggucuauguuuccucaaacucagagaucugccugcuucugcuucaggaguucugggauuaagcccagcuuucagagcgguuaaguuuggguggguagguaggucugucuauaugucuuaucuuucuuuuuuauugauucucucugaguuuaacaucaugcaccccaguccaacucaucugauacccacucaaaucuucccuugcuaccuccccacucaaaagaaaauaaaaauaaacaaaaaaacccccaaagcguagaaaacaccuuuccguagaagcugaaugucauaguaugucccacagucuaccccucuguccacacauuugcuugcacauguucauuauaaugagucauuggucugguucaaagucucucgcuucugugacuccaucaauaucagaugcucaccagugguuguccuguugaugcccugugucauggagauccugcagcuuuggauuagcaagaccagcccuuucacgugcuccaacgguucacagaugaggcagauuuuggggugggccaauucaaagcccuggaugugggcuugggagguagguagcagagcuggucagcugaggguggggugggggaggggugcauggucagcucucccacucucauccucuugggcugccucacucauucacucaugccuccagagccagcacugcugcccaguugaagccuugggcccucucuccccucucccaagugcugcagugggcaagaggcuagggcaguccaaggacucucucacugucagggcuggcacaucuguuuuccuucucagggccagcuccacugugcugccccagugaggagcagggcuaacucucccagcuaguagcagguggcaagaaggaugagggcaucaccuccaaacccacccucucaugcuugccacucaccagcugcaguacuugggguccuguaccuugccugggcagcaagaggaggugguccugguggagggggugcaggugagccugcccuaccauucaugugcucugaggugguaugggcauagggguaaugcuacucccagaccccugccuccacucaccacccucacaccaccugaggcaguugggugagcuggcucagagagaauaagcugucugcugagcuguucaguuuuuaguguuaggccuuuaauuuuguaagguccuuuuuuuggaguuauguaacauugcuauucuucagcaaaagcaucuccagguuaggaacuguugcaaguguaucuuuuuuaucuuuguucuuuuacuuuuuuguuuccuguguggugggagcaaauucuagaagaaaauaggggaaugugauacuuggugauaauguagggcaacuaauagucuauucugaguagaccuuuuuuguuuuggaccugaccuuauuugguuauauguuaaaguuuucuauuauauaugucuguccccuuuuuuuuuuuuuuugagacaguguuucuagagcagacuggcuuuguaaucagagaugccaccugccucugccuccuugaguaaagguguaugucacuaccacugggcuggagcagaucaucuacuguagaggcuuuucccaguuucuuugugugggggacauauucuuuuccacaauucuccuucccccacacacuguagucaccuagcucagcgguucucuccugggccaauauugucugucguggugaugcuguguuugguuggagugggcuauuacuauggagaaaccaugugcuguuuauuagccauuugccuuacucugacugccaucugagcaggaaacuuguagggacuaaggagcagaaggauaacaugauagugguaacuacuugaaauuuuuaaccauuugauauuguuaucuagcugaugauuucuuucugaagaauaucuacugguuauggaauuagagucacuucaagcuguaugagaggcuuucuucaaggauauuucacuaggagcuauuuaucugguaaaagauuauuuguuaggucucuauuucuuuuaugugguagugaggggaacagggucauggcuauauguaugguagacuagucuguauacuccugaguuaaugucccaggcccucccuuguuuuggaacagggucuuacugaguuucccagcuuggccuugaacucuugauccuucuuucucagucuucugguguagcuaggauuucaaacuugggccaucaagccuugcuaggucccuauuucuuagguaguuaagagaagcaagcaucacauuuuguuuuuccaaaacaagguuucucuguguagcccuggcuggccuggaacuugcucuguagaccaggcugaccucgaacucuugagaucagauugcuucuaccuccugaguuguugggauuaaagaggacguccaccaggcugucagcauugcauuuuguauuuagcgguguucuucggcuuuucccugcuccuaccuaauucaauucguauuugccuuaaaacauuuuaaagcugggcuauacagagaaacccugucucaaaaaaccaaaccaaaccaaaacaaauaaaacaguuuuuaaaagggauuuuacaaauucauuuuuuuuaugccaggcauggugacacauaccuuuaaucccaguauuugggauaccaaggcucuaugaauucaaggccagccuagucuccauagcaaguuacagaccagccagaguuacauggugagagcccuucucaaaaaagagaauaguaacaguaacaguuuauugcaugugggggcaggguguugcacagccauaguguguacaugugcaggucuaaagacaucuugguauaguggcuucuccuucuacccguggcaucugaggaaugaacucucguucauuccuguaauagcuuuaugcuaugaguucauauuuuauuaaugauaccuucauuuaaguaaauuuuuaaguguuuugaggaacaaaucacccuauguuuauuguauuuuuuauaucuuuguaggagcccuggucaugcaguugguuaguguguaacauuuauauguuaucuuuuaguacaggcuuucaggcaucaaggcaggccaugaagucaggguccucucaccuuuuccccuucccaucacugggauaauagaagugaguuaugacuugaggccuuccuucagguuuuuguuuguuuuguuuuguuugauagaacauuuucuugcccuggguguccugcaacucccucuguagacagacaaaucugucucuguugcugucucugccucugccuccugaguuauugggguuaaaggugagcaccaccacugcccacccuuaauguuuuuuuuuauaacuauuuauuuauuauuuauuuaugcauacaugacugacaaaauaauauuguauccugauaggaaauuuaaugaaccauuauuuugcaaaguuuuugugagacaugggacuuguuuucauuuuuuguuaaguaacuuauuuaaaaugacuuauauuuucuuuuccuuuuuuuuuuuuuuuucuuuugagcuaguguuucucugugaaguuccuguuguucuggccucagccuccugaguacuaggaguaaaggcguguggcccacuuuauuuauuuuuuuuuuccucuuaaaaaaugcuaaugggcuugaguagaacacaguaauguagguugaaugucacuugagacuuuaaauaaagggugccgaugaguggcugugugcccagucgcuggagucuaucugguguggacucaguaauuucaugaauuaucuguaaugggaauauagcaguguuuuucuuuuugagaaauguuaauaaggcaaagaagaaagcuaugaauaugacacuuuagcauuucugauuugauuguuuuuauuucauuaaucauuugaguuuuaguaaguagacagacuauaccagagaaauguggaauuuuuuuugggggggagugguuuuucgagacaggguuucucaguauagcccuggcuguccuggaacucacuuuguagaccaggcuggccucaaacucagaaauccaccugccucugcuucccaagugcuggaacuaaaggcgugcgccaucauugccuggcugaaucuccuuuuuguuucuagauugugugcuauuaaacugauguagcaaacugauguccucuaagcuuguauucacuuucaaguuucugagaauucaugagaugauacuuuauuauauauucauuuucuuguuuuuauuguaugcuguuucuuuuuaauagcuccuggauauauuuucaagggcaauuaaaaaacagcuuacagaccucuuuacuaaauuaauuuggguuauagauggaguugggaaacuagaaacagagccugugaccagcuacagcagaauuuaggugaguaaaugaccccagcuggauucugaacugcuuucuugaugccuaauuccuaccuuuuagcugacguaauuuccuuugaaccauuuucuccccuuuaagcuuguaaauuugagauuguuguucugcuuuauaagauucaggugcuuuguuuuguuuucaacguaucuuacuaacauuuauauuuagacucuaaaauuauuacuauuuaagaucagugauaggcuuuuauggacacaaggacauuucuugaacuucucaagauauuuuucuagcuuucaugucuuuguagccuugauauuaaagaucauugcuaugaaaucaggugcuauuuuaaauuauuauuguaauuuuuuguuuuuguuuuuuguuuuguuuuucgagacaggguuucucugucuccuggcuguccuggaacucacuuuguagaccaggcuggccucgaacucagaaaucuaccugccuuugccucccgagugcugggauuaaaggcgugugucaccaugccuggcuggccuguuuucuuuuuaaaaaagaaaacacacacacacacacacacacacacacacacacacacacacacagguguuuugcuuacauauaugacuuugcaccucacacauaccuggugucuucagaggcuagaagagggcauuggaucuucuagaaacuagaguuauaggcuauuguuuguugauaaugugguugcuggaaauuaaaucuggguccucuggaagccagugcuuuuagcugcugagccauuuuuuuuccaccuuagagcuauggcucaguguugaauguuugauguucuugcagggacccaaauucaauuccuagcacucacaaggugguuuagaucucaguaacuucaguucuagggaguccuaugcugccuuuugacuucugcagacaccaaaggucuucagacaacacaccuguuguggacauacaugcauguaggcaagauacucagauaaauuaaauaaauauaaaugauacaugagugaauggucugggacuguaacuuugauagagugggugccuaucuauagguucaauucccaauaugacaaaaacuaaaacaagaaccuaaaaaagggaaucuucugggagcuaaauggcacuguacauugguggagagugguaguuaucucuuauacacaaauccugggaugauaugcaccaccaguauuuggcaggcugaaagguuucuaaagucauguaaggaagcuaaaguuucuugaaguugcuauaguugaauaguugaaacuauuguuuauuuuuugagucagaguuucucugugcagcucugcuuguccugaacucauuuuguagacuaggauggccucgaagucaaagaucugccugccucugccucccagagugcugggauuaaaggugugugccacuacugcuuagcugaacuuuaaacucuuauaaugccaacacuuacauaacauagacaccgugugaaaggaaauagaaacacaaaguguugaaaaugucaauuuacuuucauuuuuuggagggggauuugagggaauuagguuagggucuugugauauagccuaggucagccucaagcuggaaauaauucuaaaucagccuuuuagugcuagaaguacauuaccagugugugauacuauaaccuauuuguuuuuaugaacagaggaaaaggauugagucuuaaaaaucugagucuuucaaguaagagcuaaugauaauuuucaguauuuauuuagaauuguaugcugugugguaguacuucuuaaaagcaguguacuaaagaaaaguagaucaguauccugaauuuugagauccgagaacaucaaaaaaugcuuucaggaaagaaaaaagccugcuggauccacccccaggaauccuagugagucuccauggcaacaaccuccuugcuuacaacuugucacuguguagcugucacugggguucaaagaaaagccaguaucaagaacuguguggcauuaacuacugauaaaaugcuguugcacauuugcaauguacuagaaauagaaaagaaaguuuaagguuuuaauuucuuuguucuguuaacuagaagcuuuaaaaaaagcugccuaauuaugguaaggugcaucagugggaagugggugggugacagaggaggucaggaaucuuaagagaauuuucuuuccuuucaguuugcaacuaaggagaaugaaaugcuguacuuaaguucauacagaggcagaggcaggauuuuaccucaggccuuuuaacauuccccucucucuguuuagugcuuucuauaaguaagagaaauuauauuucuauuccuuauuuuaagcauguaccuguagacacacaugcaugaugguugucaguguggaggucagaggacaauuuggggagaauuaauucuucccuucaaccauguggcuucuguguuagguugccaugcuuacuugcaaggaagguccuucauccacugagccgucuuguugggcuuacugcuggagcucuaagagaagucacuuuuugugaauuuuccauuuaaagcuagaugcuugguuuguuuuuuguuuuucuuuucugucuguagauaaaaguaauucucuuucucuuuuuaaauuaggguaguuuauuucuacuuuagucaugcuugucagucaugagaagacagguaauucuguaaaggaauuaugucaugcccaagcucuagaaguuugaaaagauaauaccauauuuggaauaagccaguccuuuaaugaguaggaaggaauaugugauaauaaauguuauauugagcuuaauguacuuuuuaaaagguaguuaauaagaugacugugagcuaaagagcucuacucccuaaaaaaagccuucaguaauuuguuucguuuuguuuccuugagucaguuugauguugucuagucugucuucaaauuuaacuauguaguagaugugggccuuaauuccuuuuccugcuguccuauccucugaaauuauaggcuuauguuaucuguucugacuuccucccacucccaccucaucuuucucacuauguaggucucucucucucuagucuggaauucccuguguggaccagccuugaauuccuaagaccuaccugccucugccuccugagugcugggacucaggcguuugccaccacaccuggauuugaaauauauuuagagucagaaaccaaucgggcaaguuguucugugggguuuuuuuuuuuuuuuguuuuuuguuuuuuguuuuucaagacaggguuucucuguguagcccugacuguccuggaacucacccuguagcccaggcuggccucgaacucagaaauccgccugccucugccuccugagugcugggacuaaaggcgugcggcaccaaugcuuggcuguucuguguuuuuauagucugcuuagguguuuucaucuuuguuuaaagauggguacauuuagacuggauaugcuauuauaugccugaaauucuaguacauggaaugcugaggcaggaggguaaggaauuggaggccagccaaugugaaaacccccuaaggaauacaaaaauuaaaguagguacacuuguuuauuuuuuuaaaaaaagguuagaggacaauuuaaaucagguaauuauuacuuagaauuguugacugagguagggucuuuagguucaguuuugauugucacaucauucauuaugcaagucaucuaagaccuggguggaucaguaaguguuucagcuuuaauccgugccucuuguuuaaagcaucuuggaaaggaacauuagguaaauaguucaaaguuuacugaaaaccaaagugaaaaugcaguugccagucuugcugucuucaauagaauagagagcacuguaauuaaaagguagcaaggcuaggaguguauccagugguuauaacguuuaucuagcauacagaggucccggguuggacuacuaguacuauaaaaaagaaagaaaaggugauuauuaaucaagaaucuuguuuauguagcccaggcuagccuagccucuaaauuuaggaugcuccuaucucugucucuugaguacugacugggguuauaggugugucaacaaacccagcucugaaguuuuauggaucucuuugauccagguugucaucuucuaacuuuggcucacugggacagucacagugcagcucagauaaaccucggacuuuuaagagccuccugcuucugccgaugcauucucagguuuggcuuguugucauuguuuuuauuuuuugagauagggugucuuguaaccuaagguuuaugcuugcuaugcagcuggggcagaccuugaacuccugacauguuuuccucucccaagcgcugagauuauacguaagugccaccacucuuggcauuuuaaaauuuuaagauuuuggaaguugaugaacacagcacuagucuuguguucaagauaauugacacuuuguuagaagcaguugugaaucuuaaaaccuagucuucuaaaguguuccuuuuccuaacucuaaaauaucauuagucuuauuugaccaaugaauuuucuuuuggauacaagaucuccccaguaagcuggacuggaacugucuaccucguuuuauuacauuuauuuauuuguauggauauguaaguguaagugugugagugccaauggagacagaggacaacuugaaagagaaaguuuuguccuuccacuaugucguaacuugggaucuuauucaggccauugggcuuugugacagggccuucuuuuuuucuuccccuuuaccugccaagccuuaccagcccugccuuuguuuugcuguuuguucucuuccuggcugucaucugaauggaugcugggauuauagaugauuacagguaugugcugucauaccuacuucuccuucaguuccuuuuggguaggugaguggauuagguauugcgacuuuauugauuucuuagugaacuaggguguguaaaucucuuagcucuaucuuuguaguccaaguaguucuccaguggugguaggagguacuggggauugaacccuuggccucauguaugcuaggcaagugcucuccuauugggcuucacccccagcuguuuguucuuucuuccuuuuuccuccucuaacuucuuccucuuccuuuucuaagauuuauuuauuuaauguauaugaauguuuguuuuguuuauauguaagucugugugcugugugugcagcaccgguggaugccagaagagggcauuggacuccuggaauuggaguuuauugggaucacagagguuguuagucaguacugggaauugaacccugauccucugaaagagcagccagugcucuuaacugcaggccaucucuccuguccucaccaguuguucuuaaaccuugauccuccuaaccccacacaguuauucuuacucucuagcucuggagcugccgaucucucuucccuuucuuuuccuguacuggggauuuacuguauacuuuuguguucuauuaccagggucagcugauacuguguuugaauucuaaacagccaugcgcuaugagcuucuagaaagaaaacaccauuuucuuuaccauauagucagccauauuugcuauagugccuggucuuugccugugccuucuuuugauugggagcacacugaagaguauccuaaaggguaucuugauaccuccuccuaagaagccuugaagccuccauuuauagguugauucacagugggagagagccacauuugaaauuuauuuuucugauaaugugacuuuucuuaucuuuuauuucugugcugucuuuuauauuuuuuguaccucuugcuugagcuugcaccuucugcauaguuggcuauuaugucaucuuugggacuacagagugaaaguuagaagauuuuaaaguucucagaauaaugucgcccacaucgcacauaugucacauuuugaauuuacuagcuaagccuccagauaugugcuuuauauacaguauguucagcauacugacuuaugagaacccaaaaacauuaagacuuaaaucacuuuuguuuuagacaaaggcugguugugugugugugugugugugugugugugugugugugugugugugugucugucugucugucugucugucugucuuuaugucuaugugucugucugguauggugugugucuggucuaucuaccaucccguuuguuccugugucguuaugugccauguccaucuauaccuccauccauucaccccccagguucucaguauaugguucuaguuggccuggaacucacuuauuuaugugagaccaaacuggccucuuauagagauccaucugcuucucccuucugaauguugagauugaaggcaugugccaucauaaucagcuuuggguuugauuugguuugauuuugacaguaucucuuuccucuauuauguagcucuggcuguccuggaauuugcugucagaccaggcuggccucaaguucacagagcucuaccugucucugcuuccuuaguggugggaauaaaggccugugccacacuaugccuggccuuguuuuugguuuuaacuacaccccccucccaaaaaaaaccccaaaaacaaaaaaaaaaaaaaaccacaggcucucaaaaagcccagguugaccucaaauucagugucuagacaaggcuggcuuugaacuccugauuuucuugccucugcuucucaagggcugagauaagguauguaaaugcacagcuaauaguuuucacuaauugagguauagaacacuuuuuguauucauagcuugcuuuccuuacucauaauuccuuucuuuugcuuuuuuauuaguuucuuugauuuuaguuuuaacucuucccuccuccuguauugucuuacgugacuuauuuaucuugagacaaaguuuuauuguacaguagccuauguuagccuuuaacucagagcaauccuuuuugccuucugagagacaggcauggguuaccauucccauuuuacuuuuuuuccuucaaggcaagaguagaauagacagggguggccuuaagcuugcaccugcccugccuuuauaaaucaccagucuguugggaauguagcuuugcccaucuugcccaagcuccugacaucccuccccccauugguauguuauauaaguaauuuugugcauaauauguuggggcuuuuggaaaauuugaaauaucuauugguuauaagucugugggccucagcauagaacucugauacggccuuaccuuuuugucacugaggaaauagguucagagaggagacugacuugcaaagucagugugcuauggaggcuuauggccauuuuuauuuugagauuauauuuuaauuauccuugcuguauguaauuauggacuuuuguguuuaauuuuguuuaauugcuuacacauaguaaaguauguagugauuaaagcugcguuacauaaaauacagcauauccaccauaaguuucuauaaugaaccaaagcuguuaaaacaaagauguucaggguuuuuuuuuugguuuuuuuggugggggggauuuuucgagacaggucacuuuguagaccaggcuggccuugaacucagaaacccgccugccugccccgccccccccccccccccccgggggugggggggcugggaccacgcccagcuugcuauucauauucuuaaagauuaaauacaaaagaugguacacaucauuaagagaucucagugacuggagcauuuggcaugucuguucuaugguauaugaauguucuuuuaaauaacugcuacagguuuuguuuguuuuggguaugucaaguagcaagacuuugcacuggaagaauauguagugggauuaggaauucaaguuugcuguuguuucauuaucagugaaaaagaaaaguuuaaaauucuaaaaacuuaauuugcaaauaaaaauauugagcuauuauggguuguuuuuuguuuguuuauuuuuguuuuuuguuuguuuuuucaagacagauuucucuguguaacccuggcuguccuggaacucacucuguagaccaggcuggccucaaacucagagaucugccuaccucucucugccucccaagugcugggauuaaaggcaugcgccaccacugcugccuggcugagcuauucuuuuuuuuuuuuuucuuuugguuuuuuuugagacaggauuucucuguguagcccuggcuguccuggaacucucuguguagaccaggcuggccucaaacucagaaguccaccugccucugccucccaagugcugggauuaaaggcgugcaccaccaccgccuggcgagcuauucugucuuaauuugacauuuucuuuguaaauguuagggagaaguuaggcauggaagaaacuacuuaggauuucugugauagccucaucacacauuuagcuguguugagaagcuaauacucuugcucagcaguuccuuugcuggcagaaugauauagugguguuccucaccaaggacugucaugucaucaguauuucuaguccuacuugugugacuccagguuggccuccuaacuugguacagcuguggaacuccagacccuccuacuucuaucucaaguaguucuuauuuuguuuuuugcuuuguuuguuuaaaauaguggcuugaaauuuauucaaaagacuaaauaguaaucuuggaaguggaagaauauuuuccugaaugugguaggugagaaauguuugagggaaugcugaauuacugucuguguguguguguguguguguguguguguguguguguguguagggacuccugagugccaggauuacaacaugcccaguuuuauuuuucuuuucuuagaauguuuuucucuaaaguaggcaggaacuguaaguaauaugauauuaaucucauaaaacugcauaaaacauuuuagguugacauuacagccgcccccccccuaaaaaaaaaaaaaaaaccaaaccaaauccagcaacagaggaacuucaguguauuccaaaucugcauuuccccauguugaagacacuguaggugaacuuagugaaaguggguaggcuccguggaauaaaagucuaccuuugcucucuccucucucuuuuuaaaauuuuauuuauuuuauguaugagugcucuaucagcauguacaccugcaugccagaagaagguaccagaucucauuacagaugguugugagccaccaugugguugcuuugaauugaacucaggauauuuggaagagcagccaguacucuuaaccacugagccaacucuagccacuacaauuuuuuuuuuuuuguugguuuguuuugagacaagauuucucugugaugcccuggcuguccuggaauucacucuguagaccaggguggacucagacucacagagauucaucugccucugccucucugccucugccugagugccccaccacugccuagcugcucucuucuuuuaauauggguaacauuauucccccugcuuuggcucuagucagauauugucagccauuacuaucuugaauauugauugaucuuaccuggagcuacacaggaaguguuagaggucuucaauguugguauaguuucaauuuguauuauaucgucuucuauauaaaacacuacacucuuaauaccugcuuaauuaccugcugcauuucuuuuuuuuuuuuuuuuuuuuuuuuuuuuaaaucaucuugccuuuuucaacaucacccuuuuuuuuuuuuuguuuuauuuauuuauuuauuauauguaaguacacuguagcugucuucagacacuccagaagagggcaucagaucucguuacggaugguugugagccaccaugugguugcugggauuugaacuucagaccuucggaagagcagucgggugcucuuacccacugagccaucucaccagcccaccugcugcauuucuuaucuuuaaagaauuuacugccuggcagugguggcgcaugccuuuaaucccagcaccugggaggcagaggcaggcggauuucugaguucaaggccagccuggucugcagagugaguuccaggacagccagggcuacacagagaaacccugucucaaaaaacaaaacaaaacaacaacaacaaaauuuacuguagucagaaauugaguauucuuguauuucacagugaagugaaucuuaauugcuuucuacaacaauuuuggaaacagauacugggcuugauuauauaagccagcauccugagaaguauauuuaaauaaucuguauggaccagaacaaaaauaucagaccauccccaacaauuugagaguuagggugaccagagaguagugcagguuagauuguuacuuaaaugugggagguagccuguuuuguucauuauauuucacgauuuaaaugauaaauugagccucauagcuguugcuguuuuagcaagaaucugaccuaguaaaaauuuuuuucagucuuuucaguuccugaggcuaaggaucuuagaauagcgacuguaauuauuggggcacucccugacugagauagaaccucucaaaccuuccuuuaagccugugcgcuucucuguuuuuauauggugugugugaacagaaugcaugugugagagauaauugcccuuucacuaauggcccccuuucaguaaccauguauggguaaagcugcucaguuaguucccugcuccucccucacagagugcagagcagagagagggugcucugcggaagcugcugcuccacuuugcagcuuucuauauuuguacagcaacagcaggaacagcccacuagcuaggcggugcaguuauccugugcacccacauugcuucagaccugcucaggauucagccagggcuugaaguuuguguucuuaacgugcguccaucugucugucuguguacauuucuguggaggacuaagguuuucaaguaaaagaggugacuuacuugucuuuuuugguuugauuuguuuagguuugucaguuacaaauuauagaagauugagaauuuugggacuggguggagaaaagaucuguagucagcuaauauuaucuugagcagaugccaggcugguggacuuagugucaggagguuucugagcugcuuuagaaacacggcucacugaagaagugcuuugugaucucaaagaucagcucggaagagugggacucaacacauuuucuguucauguaaauuuugaguauaaaaaaacugagauuuugugugcaucaagaucuuuggaguggguacaguaggacuauuaauuugccuuuugcugagaagagcuguggagaauaucuggcuauuuuugguuuccaagcaaucuaugcuguugucuggauucauaguacuuugcacaguuuugccugacaggccuuguaaugucuugugauaucauaccuauuuagggaguagaggggaaaugaucgauagcuuucaggacguuuuccaagcugcuaagguugauacuguuuuaaaaggagacuuuuguuggcuugcucugagauuguuuuaaucagguaauuccagucuugaucacuccaucuaaauaaagagaagcucuuuguuuuacugguuccuuuuacuuccuucccccaccucaucccugugagucacaggcuguagagcugggaauagaacuugucagcugaguggggacaagacaguuugcuguacauguuuauaacuauggcucauuuggagaugagaagacuucagaugcuggauaaacagcuuuacugaggugacuucuaucugcaucuggguugguauagaugcagaauuauguggcuauuugcugauguguauugugucuuugagacucuggguccuguauaccucagaacacucuaaaagaauugacuauaacaacauauugacuuaaucgucuucuuggcaggucuuugugcucaucacauuucuacuguuuucucauugauaucugaacuauuagguaggggcucuuguuaaagaucaaaaucagugacagcucuuaguuguuguaacaacaacauaagaaauccuggcuguccuggaacucacaucuuguuuuuacagcucagacucaacaacugauaccaugguuagcacauuuauguuacagauuuuucuuuauuuuugguuauuuaaaauuuuuauaauuuuccugccuuuauuauuguucuuguuggugguguuauuuuguuuuuguuuuugagacaaaauuucucucuagucccgacuguccuggaacuuucucuauagacugggcuaaccuugaacuuacagaucugccugcugcugccucccagguccugggaauuaaaggcaugugccacuauggccaguuccugcccuuauuuauguguauccauuuugaaagcuuccacaaacuuauuugauauaaugacagggauaaauaaauuucaaggaagaagagauagcaggcuggagaaauagcucagugauacagagaacuggcuguuuuccuagaucaucuggguucaaauuccagccacccacauggcagcucacaacuaccaguaacucuaguuccagagaaucugauaaccucuucugacuuccaugagcaccagucauauacaugaugcacauauuuacuuguagacaaaacacucauaaaauuaaaaagaaauuauuaauauuauuuuuaaagaacugcacuuaggcccagugguuaauguugaguaacaagaaacacuaugccuguuggaugcuaacgggcacaguuggggggcugaucuauggucaggcauucuccccuuccucuuuuuaaugagaaauauuaccucugaauuuauugaccucaccuuuuauuucuaauuuuauacuguugguuauuuugccuguauguaugucugaaucacgagaauguaguaccuggggaggccagaagaagaugucaaaccccuagaaacuggaaaugcauagauaguugugagaugccauguggguccuggaaaaugagcccagauccucuggcagcacagccagugcuuguaacuguugaaccauuucuccuaucuuaacacuacugguuuuucauguugauuuuuguguccuguuaacuuugcuaaguguauagcagauccaagaguauucugauagaaucauuagggucuguugaguauaggaucauauccuuuacaaauagagguacuuuacuucuuacuuguaucuuuccuuucuacucauguagccauuuugaagagauaugaucaucuggcuaaagauuaaagcuuucuuucugguacuuccuuucuacuggcgccaaauuucacaucuagaagcauaacaguaaugggugcuuauuugaguauuuucugugacuuacauguuauauauucgaguccugauaaacacacugaaaaaaguacauacuauuuuuguaacuacuuuucauauaagaaaauacauaaagauguucaacaauuucacaaaacuaacuaggagugcaucucaguugguagggugcuuagcugacguccaggaaacccugggauugcuuagcacaucauaaguuaagcaugcuguugaaugccuauacuuccagcaccuugguagagauagaagggucaguaguagugaguuaaaggccagcugggauacaugagccuauauuucaaaaagaaaagaggcuagcaagaugacucagugcguaaaggugcuugcugcagaagccuggcacuggguuugaucucuggaacccauguaaagguggaaagagagaacgaacuccacagaguugucaucuaccugcacaaacuugcaugacaugcaucuuuuccucccugugauaaugaccuuuuuuaaagaagaaaaaucaguguucacaaaguuaccugguuagcaccagaaacuggaaauggagaaugcuguuauuacuuagaguuggugguagguuuuaauaauaauaaucuauguccguagguuuauaguaaauauauuauggggugguuuuuguuuguuuguuuguuuguuuuuuguauggugauugaauuuagggucacauacacacuagacaagcucuuugccauugagcuacaaucuaugacacauacccacaccuuuauuugauuuuuuuuccauugagagauaaccucaguuauuuauuuacuuauuuauuauauguaauuacacuguagcugucuucagacacaccagaagagggcgucagaucucauuacgaguggaugugaagccaccaugugguuucugggauuugaacucaggaccuucugaagagcagucggugcucuuaccugcugagccaucuugccagcccaaccucaaauuuacuauguaguuaaauauggccuucaacaccugauccugcagcuacuuuuucucucucaugaugggauuauauguaccaccaguuugaguuugugaguauuggggauuaaacucagggcuuuguaugcguuaguuaaacauucuaucagcugagcuauaucuucagcccuuuccuucuuaaucucauccuaacccccagucuugagaggugggugauggaauggaaggacaagcaagcuuuugccugguccgaaacuaugaauuucuaugaauuuugucaggauaacagggaucuguucacaagacgugaugcuaaaggaguuugugguugaccauguaauugccauccagaauaacaaaaauaccauucugucuggcacauuauaaacaaauaccauaaagaaugaauuuagacagguaaauaaucaguuuggguuuuuucuuuguuuguuuguuuguuuguuuguuuuuuaaaacaauaagaacaaaaucccaaacagccagaugugauugcgcgugacugauuucaccacuugggaggcugaggcagcaagaucuugaguuaggaggccagcaugaaguaaauaucaaguuucagaccagucuggauuguguagcauaacucugucucagcaagauggaacccauuuuugugaaaauuuuuauuuguuuguuuguuuguuuguuuugagacaggguuucucuguguagcccuggcuguccuggaacucacuuuguagaccaggcuggccuggaacucagaaauccaccugccucugccucccaagugcugggacuaaaggcgugcgccaccacugcccagcugaaaaauuuuuaaaaaggcauuuauuuuuauuucaugugcauuggugucuuucuugcauguauguguguaugaggaugucagaacuggaguuagaaguaguuaugagcugccaugcggcugcuuggaauugaacccuagcccucuggaauagaagccagugcucuugaccacugagccaucucucuagccuuagauuucccccacccccaccccccaaggcagggcuuuucaggcuguucuagaacuugccuugaacucagagauuugccugucucugccucccaaaucuagaauuaaagguaugcaagugugccaccaccuccuggugaaauauuuggaguucugaauuaaagauugcacuuucccuuggauguauguagguugguuuguuuguuuguuuguuuguuuguuucuaaugcaagucauagauuauuagcaaauucauaacaacuuaaggcagagaacagguucuuucaggcccuuuucuuuaugugugguuuccuaaguuccaaaauaguggacuuuaaaaaaacaauguguccuguccucccuccauaucucugugaauguauaucacauguaugaaugccuguggaggccagaagagggagaguccccaaucuaguuacaggccauuaugagccaccuaggaugugaguguuggaaccaaacucagguccucuaaaaaugccccaagggcacuuaaccauaaccaucucuccagcccuggguucucuuuguuauugacagagcuccuguuuucuaaacaacuuguuuuugugaaaaugaaauuacugacuacuuuaauuuuguaaaacagccaagauauuuuaaggggugauuugaaggaaguguugcaaauccuauaugugaguguuuacaugagagaagcucuuuaaggaacacaguuggaaagugaugaaaccaugauaauugaauuuauucuucaaaaagcaguaaaguagaaaaauacuuagaauguguucuuccauuguucauccuuagaaaugcccuacuuaccaauuaaugaaagcagaguuaugcuuuuccuuuuuggugcuuuuuuuuuuuuuuuuuuuuuuuaaaagccuagugugucugggaacucauuauauuagccuacccagauuggcucuuaaacucacaauuuuccugccucguccuacuggaugcugaagauuacagguaugaaucacaagagguagcggcuuauaaacaaauaccacaauauggguaagggaaagaggggcuuuauuuauauggauuuuacugaaaugggccaaacagaaagacugaaugaaguuuccugcuucucagcaaaacaggagaaccauccuuaaauaagacauauggaaguauccugcuugagugccuguguuugggaaggaggugggagcagaugguacaggcagguuucuuggcugcuugcuuggucaggguuuuggagaugguagaacuucuaugguagguucuguggaagaguggauauguguuguuugcuuuguacaugccugccuaaaaggugaaugagcaagcauagggugaagauacugcucuguuggguaguaugggaguaaggaaaaggaaaaaaaaacuagaaugauaaagacuacaguugaaucuaaaccuuccacugagauuagggagacaaaagcaagaugcaguaugagaaacaggauuccaggucuuuugcugucucuagagcugcagguaccguauuucuguacuauuggcuuuuuuauuuuuuaaacugaaagcuguuuugauuucuuuuugagagagagggcaaaagcuguauguauagaacuugcuuuuuauagcuaucuuagcuaggccuuugccuuccuuacuggaauucagcaaaugauguacuuugcuuuuacaggaaggacugacugaagacaguguacauguagauauauagcugagugacuaaaaauaaccccaaacuuuuaaaauaggcaaaauacaaggcuuguaguucagauugccugagugucaggugaguugcuagaauaauuucaaucagcaugaugcaguuauccaguuuggauauagugcugguuuacuggacaguggcuguuuguacaaaugaguuuuaggcaaagcaagaaaaaaguacaagaccaaaauguuugugagcagcacuacauaaauugggguguuuauguuauacuuuauaguuucuguuuuuaaacauuuaguguguguguauguguuuauguuauacuuuauaguuucuguuuuuaaacaguguguguguaugugugcaugcacgcgcuagcgcacagugcuuguaguacugugugaaagccagaggacagcuuggaagagcuaauucuuuucaugucuuucaggaucaaacccggauuaucaugcuugguggcaaaguaccuuuucauguugagcagccagccaucuugcuaauccuaugcuucauggaaucuuuuaaaaauuuucuguaggugcuaggguacugguagcauacaccuuuaaucucaacaguuggaaggcaaagacaagcauaucucuaugagaucuaggccagggcaggcuaggauuaccuagagagaccuugucuacacacacacacacacacacacacacacacacacucacgcacacucuugacuaaaugauacacaagucaugcaucuacuuguaaacaauucaaccaguaguauacuucuacaacuguuuaucuuuucauauauuuuguuuuuauucaaaccacgugugaaauucuuuuccauuauguaaauagauucugaccacuuuuuuuuuaaauuauuuauuuauuucguguauguggguacacugucuucagacacaccagaagaggacaucagaugcccauuacagaugguuuugaaccaccauaugguugcugggaauugaacucaggaccucugggagagcagucaguucuuaacugcugagucaucuuaccagcccuuguuuguuucguuuguuuuuuuguuuuuuuguuuuuauagcuuuagaauguuguguuuugugguuauccuacaauuuauuuaaucagacuucaguugaccauguuucuuuagguuuuguuguugcagacaguguucuuuugaaugucccuguccauacuuugcacauaccagaaucaaguuuauuagcagacuauuuuucaagaaucagaacuucaggauucaaaagcauauccagcuauuaguauuaaccagauauuuugaaauuuccuuuuuguaguuuacagaugaugguauucauuaaggauauuauuaguagaugggcuagcuagaugguucaguggguaaggucacuagcugcaauucugacaaccugaauuugaugaugggaacauggacaugcucuaaauaaauaauugcauaaguuucuuaaagugaaggauuauuaggagagaagguuaauguggucaaaaacaaucgucuuguaagcaauuacuagaguaagcauaagauuucaaaguauuugggaaauuuaaauuuuaggugggguggggcuggagauauggcucagcaguuaaagaguguuugcugcaguuuccagacagagguccugaguucaagucccagcaaccacauggucacuuacaaccaucuguaaugggaucugaugcccucuucuggcacacagguauacaugcaaauaugaacacuuacacauaaaagaaauaaaucuuucaaaaaauuuauuuucaaaacauaguuauuuuuaugucaguggcuauauauguuguaagcugccauguaggagcuaggguuugaaccuggauccuggaauagucagugcucuuaacugcugagccauuucucuagcccaagaaacuuucuuuaaauaucagaucuugcaguguggggagugacaaauucccugaaaaagguaggagcagacccucugaaacuucauuuuaaaaaaucauucauucucgccuggcaugguggcucaugccuauaauuccagcacucggaaggcagaggcaggcggauuucugaguucgaggccagccuggucuacagagugaguuccaggacagccaggacuauacagagaaacccugucuugaaaaaccaaaaacaaacaaacaaaaaagucauucauucaugggacagcaagccuuucuacgggucugcauguggagcuucuguccuggggcauauguggagaacagcugcuuucuuuccacuauguuggucucugagaugggagaccuguagauuugauagcacauuaccuucacauuucagccuuucaggugcccuacucuuuuuuuuuuuuuuaaauuaaagauuuauuuauuguuauauguaacacacuguagcugucuucagacacaccagaagagggcaucagaucucauuauggaugguuaugagccaccaugugguugcugggauuugaauucaggaccuuaggaagagcagucagugcucuuaaccgcugagccaucucuccagcccccaaggugcccuacucuuaaacuucugaguuuaugauguuuccugggcuuauaaauccucucuuuuaauuucacccauuuaugcuccuuagcaauuugaaaaaugcuuagugucuguccuguucagagcuuuucucuuaagcuguucacauguguaugagcucaguugaucaucaaaauuaccuguaaauuccagguaauaguuguaucuaauguuuguuuacuaaugacuuuaaggaaaucagauguugugaugcaugccuuuaaauccuagcacugggaagcagaggcaggcugaucucugaguuugaggccagccugaucuacagagcaaauuacaggauagccauggcuacacagggaaaccaucucaaaaaaacaaaccaagcaaacaaaaccuucaccaaaacaaaaguaaaagcagagacauacacaaugguucacacauggaaucccagcauguggugggcagaaguaggaggauugacccaaauucaaggccagccaagauuacauagcaaaucccauuuccucucuauucuccucacucucaaagcuaaccugauguggugguacauaccuguaauuccaguucuugaguuaggugaauugcuauaaauucaaaaaaagaaaguaagagugaagguuuuuguuuuuuaaaagauuuauuuacuuauuauaugugacuacacugugagcugucuucagacacaccagaagagggaaucagaucuccuuauggaugguugugagccgccaugugguugcugggaauugaacuccaggccucuggaagaacagccagugcucuuaccugcuaagccaucucucuagcccaugauuugaguuuaucaacaaaaaucuuuauauacuuuauagccauaacacagugacucaagaaagcccagcuccacugucuaguuguggaguuagaaucacuggauccauccucugguuugcuuaaucuggaaaauggggguaaagaugcugaagaauugcauuugaagccagcaguuuaucacaugcaaugugcucuuggaagacugagccuggagcaucucaacuucaagucuagccuuagcugcauagcaauauccugucaaauaaauaaguaaauagaugcaaaaggagaaauucucugaccauacucaggaaaauaauuaugaaaccauuuccaggagguuguguaggauaguuccuuagagacaucaggauuacaaaguaauuuugaaagcaacuuugacaguauuuuugaaaaaccaauaauucuagccaggugguaguagcacaccccuguuagucccaguaccagggaggcagaggcaagugaaucugagaguuuggaccagcauggucuauaaagugagcuccaggacagccagggcuacuacacagagagacccugucucgaaacauccccuaccccaaaagaaaaaacuuauucauauucugccauauucuacacggcaccaacauaugguguaguccugaugaguuucacauguggguggaaaucaaaacgcaucagagaagagcaguaaugacucacuagauuuggcuuucugggaggacagugacauuuagaggaauugguaguuuuagaacauaucagaauugagugaacaauacuuaauauuggauauuguggaaaagucuaguguuagucuuuguuuuuagauuaauacuuugucugucauaagaaucucuguagcgccuucccuucuucacacauuggaacacugaauucaaacgagagaggaaaaaugcuaugccacagucuucauucugcccaguaagaaggcacuuuggcuuagacacuguaugcaaauuggcugcacauuuucuuuuacccaaaacggagagugcugcuaugagauggauacaagaagcagcagagaaaaaggacauuucuuuuccuuuucacuuauugucccuucacuuuauaugacguugaauaggggagaaagagacuacuuaaugggauuugacaauuaauuagauuauugaagauaggaaaagguuuaaauuacuuuuuuucuuuaggcauguauaugauguguaugaguugaaguguaaauguuguugucugacgaaaacuuucgggggucagcucucaccauccaaauuguugaggcaggaucucuguccuccaggcuugucagcacacagccuguggggcaauuugccuuggugauuuucuuggccaccuaccucaauggcuuuucuuaccuggguuccagggcuaaaacucauguuucaugacaagugcuuuuuugcgagugagccauugugcacauggggaacagaaaaggaaugagugcuuuuugcaagucuuuucuauuauuucuuacuuccacuuaaaaauugguccaacaggacuggagagauggcuuagcgguuaagggcacugacugaucuucuagagguccugaguucaauccgagcauccacguggugguucacaaccguuuguaaugggaucugaugguaugucugaagagagcaacgcuguacucacauacauaaaauaaauaaauaaauaaaucuuuaaaaaauuggugcaacaacuugauugcauuugaucucuuuugugauacaguuuaagcuucuuuauagauaaaauaaauuuaaagaaaugaauuuauuuauugugagccaagucacaccuccauuaacaacaggaauucuggcuuaccuuaauauauauuuuaaauuaguuuuuauuuuuaagaguaugaguauuaucucuguauguaugugugcuauuuuuguacuugaugcccuugaaggccagaagauagcaccaugucccugggaacagucauugggggcuaccauguggguauaaggaacugaaccuagguucucugcucuuaccauugagccgucucuccaaguacaugcugcuccugcccccuccccccuuuugagucuugauagcucugucugcccucaagcguguguguagaccaggcugauuuggaaccuauaccuacccaucugcauaucaagugcuuguagugacuugcccacuccuggcucuauuuacacauuauuuauuccaagcagguguggcagucagaggauaacuuguaggaacccuaucucccuggauauucaacucaaguguaugguugugggaaggcuccuuuaccuucugaacuaucuugguagcccccuuuaaucuuuuauuuuauuuuuuaauuuuugauugguuuuguuguuguuugugaaaaagauuuuauuuaguguuaaaagcaaagaaauuauucuucccuuccuccccccccccccaauacuuacaggaagugaucuugaugaccaguaguuaacaaguaaaguuauuucccaagugaaugcccaaaagcuauguugcucagucuggccuugaacuauaagucucagguuuuccaaagcugagauuacaccaauguacuauuuuauuuugugcaacuuggauuucuccuaagagaaaagagaaaaaaaaauucucccuccacaaccaaaaaucacuuaacaggaacucggggcaguccuguaugcaccgacaagcagcucaguccggaugcuugugacacuaugcaggugcuuggaacucacccuggggcuuccugcagggagagcaggugcuuggaaccacgcagccagcucuucagcccugacaguuauuuugguuuugaaguguagugcuggcugucuuggaacucacuauguugacaacacugcuucaaacugaagagauccuccugccccugcugugaguaaaggcuuaugucaccauaccacucacagucauagucuugaagaggcucuuacaccaguuguaucuuucuacuuagaguuuugucuuagaaaaaugagacuuaguguggcgauaugccugugaacccuuuccuggcagauucaaggccaccauggcuguguaucuuauuccauaaagcaagauccugucucaaggaaggaaaaaugagagggagaaggaggagagagauuauuagucagacucaauuuuauggcccuagguauuuaaguaaguauuuuuaacaguuuauaugcaugagcuuaguggaagacaugguuuuggucuugcauguugcuggugauugaaccuguuuaugcuuaccuaagguuuguaccuaugacugagcuaaaucucuugcauggugcccagagagaguuuaacuugaaacagccuuuuaucuagaaggcugcuuguauauaaaacuugccugaguuccugugaucuugaagaaauuacuguaugucuuugugccuuuauucauucaaaacguagagacuaaguauaggauugaaauguaaaguuuccaaaaccuggggcuggagauauggcucagcgguuaagagcacuggcuguucuuuaaagguugugaguucaauucccagcaccaaaugguggcuaacaaccaucuguaaguggauccaaugaccucuucugguaucagugacaacaugcucauauacauaaaaaaaaagcuuccaaauagaagugggcucuaaauuguuaguuauaguuauuacuguuuuagaaauguuuggacagcuccccagauuuuucauaguugggguuugcaaacuuuaaucacuauauucuguaauuauagauuuauuaucuuuauaaauucaaaucuaaaugcauaccugcauauguauuauuauugauaauaauuugugcuuaguaacacuaaagauagaaaugggugcuacuaaacuaguauauaaauauaaaacuaguaaauuguuauugugaaugaacugugcuaguuuugacaguuuucagaagaccuaggguuaccuuggggacauggggaacagauagaucaccucccuuauuuccccgucuucaacuuucauagccucauugucauguuuuugagucaaguuuuuuaagacuuccaaacuggaugcucuuaaauucauuaguuucuuguauucugucaugagcuauuacccccacccccauauaaauaguuugaguugaggacuagccuuugcugcacagugagagccuguuucaaaaacagacagacagacaaaaaaaaaaacaccaaaguuuuucaagaaauuaaugagggcauuuacuaacuauuuggaaucuugcuaaugagucaugcauuuaagacaguuagaucagugaguauugucaugcuaccagcucuugucucuggagugugugauucaguggacuguguaaaugccauuuuccuuggaaggacagaguuuucucauugauuagaaugcagacauuuagaggaaagugaaaaauaauagaaagagagguguuuguuaucauucuacuaagaaaggcacaggauaccugaaaguuuucucuacuggucagauacaauuuuuuuuuuguuuuuuuuuuuguuuguuuguuuguuuuuuugguuuuuugagacaggguuucucuguguagcucuggcuguccuggaacucacucuguagacuaggcuggccucgaacucagaaauucgccugccucugccuuccaagugcugggaucaaaggcguccgccaccacgccaggcuuucuuuguuuuguuuuguuuuguuuuguuuuguuuuguuuguuuguuaaagauuuauuuauuuauuuauuauauguaaguacacuguagcugucuucagacacuccagaagagagagucagaucucguuacagaugguugugagccaccaugggguugcugggauuugaacuccugaccuucggaagagcaguugggugcucuuaaccacugagccaucucaccagcccagauacaauuuuuaaaguuuccuagaucaucuuauuuucagcauccugaguuguugguugcuuguuuaacaaguagauacugcuguggguuacucacagcuuccuugcccuuuaucccuugguauccuccuuuguacuguguuuuauuuuaugacagagguguauguaguucaggcuggccugaacucuugguccuucugcuucuacuucuagugcugcugaguuuauagguauguacuaccuauaccuggccauuucucugcuuuaaaggugguagaucaaaaucaggaagacaaaacuuuucaauaaaaugucuucuaguguaugacacuagcuccucucuuaacuugcagguaagggcccacuguagaagacaguuuuaauucuuuuugugagggugcuuuaguuuucacuugaacuacucuuuggaaccaggcagaguggugaaugguuguauucugaagauuggagguagagacagguagagacauuguaaucuaaggguauauauagguuauggagugagacuuuguauccaaaagaaaaacaaaaacccuucuuugguugucuuaauaucaguuggggagugauaucaggaauugaacccuguugccucacacauacuaggcaagcacauugcuacuggacuacacuucugagagacccugccugcuuuuaaggaacucaugauuuucucuugcuagacaggcuauuucuaaugccauaagaauuacuacaaucucuggguccuaguauaugucccucauaccuuccuauuuuagccuuaaccccaagcuuugcuuuuugcucaugguauccuagaaauuuccugacuagcauguaagucucauaaaucauaccuaucauaauguggaagaaguaaugcuguaaaaacuagucacauuacaagccagccaugaugccuggaauugcagcaauugggagcugaggcaggaucuggagguuauccugggcuaccugaugaguucaaggccaaucuggaauaugguaugagccuaugucuuggaaagauuaacauaguuagcacugugcucuaaaacuauuucgcucaguucuuuacauccccuggaacaucauuaacaauggaaauuuuaacuuggcucccacucuucaggguaacucuccaggcauaccaucucaauuaaaguugggaccuccuauguuaugcuuggauuucuuaagagaaacagacacgaagaaaaacuauaugcggauuaucuuccauaacaucugaauucuuaagagaaguuccugcccuaaaugguguuaauacuguauaggacugaaugaaguguuguggauuuaguaaaugcaagcaccugucuuguuaguaacuuuuucucuuuugugcuaggaauugaacucaggcuuugcauaugcugagcuuaguucuaccucugaauaaauccccagauccccuuuuaauaauguuuuauugagucugucucauuuuguagcucaggcuggccuugaauuuaagccagucuucuuaccaaauacuaggaguauauguuugagccaccagguccuacuuuccucuuaauagcuuuugaugguauaguacagguuuaaguaaaucuuuuuuaacaaguuuuguuuugcuagccuuaaaacucgagaucugccuacucugccuucuaaaugcugggguuaaggugugcuccgucaugccugguuguacaaguuauuguugcuacuuuuaguaugaguuuugcuuuuauaauuauuggaaacaucuuugcuuuauugacuauaaauuaauuuggucaauaugaaaacaguuaagagaacucuguugccgggacucggaaggcagaggcaagcggauuucuuaguucaaggccagccuggucuacagagugaguuccgggacagccagggcuauacagagaaacccugucucaaaccaccccccccccccaaaaaaaaaacaaaaucucuguuaaucccagcuauuugggaggcugagguaggaggauugcaaguuguaggguagccugacuaaccuauugaaaccuuauuucaauuuuguuuucuuuuuuaaagaagcucagucccaaucacugaaaaagaaguugaaacaaacacacaaacuugagcacauguucugugcuaguuaagaagagucuuuguuuucagagaaaguaguuccaggucuagcuugcucuuugaaauucuuaacuuuucagacagacacuguccuugcugacuuugagcagcacucugauuaacuagacagaguauagcuggaaggaguuauaaauggaaguuuguagggacuggggcaguacggaaucaaucucuacuuacaagauuguucgauaauguuuaaaaauaaggcaaauugguuuugugguuucucucuuugcuuuuaccuucaguuacuuucucauuuucugauuauuuugguuuuagugguucaccaccacccuagggccaccaagauaaauuuacaaagucagaaacuugacugccuuuaaaaaauuuaugccugcuaccuaccuauuuggggaauuugcuuggggggaaauagcaauguucucucuacccuuuagcuuuucuguagccuccugccccauaccaggggaggggcuggagaucuaguucacuugacagagugcuugucuagaaccuguggaucacuaacuuccauccgcaucaccucauaaacuacacugguuugguaugauuguaauucccaguacuggggagguggagggaggcaggcgggucaggaguucaaggucauucuuugcuacauaguauccaaguaugcuagucugggauacagaagacccuaucucagacauaaaaagaaaacaacaaugauuauucugguuaauacacgccggaggcagaggcagguggauuucugaguuugaggccagccuggucuacaaagugaguuccaggacagccagggcuacacagagaaacccuaucucgaaaaaacaacgacaacaaaaaaaaaauccuaauuauucuaauaccuaacuguaccaacugaaauucaaccuccgagacuuguuauuuguugugagauuugggggcaaauaucuuuaauucuccaacuuccaguugauguuuuaaaaugacccuugagacuggcggugguggcacacaccuucagucccagcacucaagaggcagaugcaggagaaucuuugaguuugaggcugccuacuccacaaaaugaguuccaagauagccagaacuacacagggaaacccugccucaaaaaacaaacaagcugaggggggggggaagggggauggaggccaagacuaagcacagagaagggucucuguucaucuuuguauuuggugcuaaucaagaaggaugagaggagcaaugauuaaaaaccaggggaaggaaacaaaacuuuaucguuuucaaaauaauucugguuauucugccuuuuccuacuuucucaguaucuaguacaugggaaguuuacuaguuuccuacuuucucaguaucuaguacaugggaaguuuacuaguuuccuacuuucucaguaucuaguacaugggaaguuuacuaguuuccuacuuucucagugucuaguacaugggaaguuuacuaguuuccuacuuucucagugucuaguacaugggaaguuuacuaguuuccuacuuucucagugucuaguacaugggaaguuuacuaguuuccuacuuucucgguaucuagcacaugggaaguuuacuaguuuccuacuuucucgguaucuaguacaugggaaguuuacuaguuuccuacuuucucgguaucuaguacaugggaaguuuacuaguuuccuacuuucucgguaucuaguacaugggaaguuuacuaguuuccuacuuucucgguaucuaguacaugggaaguuuacuaguuuccuacuuucucgguaucuaguacaugggaaguuuacuaguuuccuacuuucucgguaucuaguacaugggaaguuuacuaguuuccuacuuucucaguaucuaguacaugggaaguuuacuaguuuccuacuuucucaguaucuaguacaugggaaguuuacuaguuuccuacuuucucgguaucuaguacaugggaaguuuacuaguuuccgcaccgaacaguccuccuucaugcauuauuuuagacuugaggcaauuuuuaaaauguauuucuucucucuucacauacacuccccugcagaauuuccaccauugucuaauuccuguuaaaaacucagaaagaccuuuugcucuaaaguaauucuuucacauuuuugcugcaacaacaaaaccacacacacaaaaauauaagucauucuuucauaauuuugcaaaaaauaaaaguuaagugccugauguugcuucuuaauguuauaucaaaugcugcuuguuccagccaugucagaaucaggcuuuuuuaaaagaacuagaagggcugacaugguucagcgagguucugaguucaauuuccagcaaucacaugguggcucacaaccaucuguaaugugauccaaugcccucuucugguguacaugaagacagcaacaguguacucacauauauaaaauaaauauuuuuuuuuaaagagcuuagaaacuuaguguugcugguacuugccaacaauacagacacagaggcauguggcucucugugaguuugaggccagccaagagccacacagugaaacucugucuugaaaaaacaaggaaaagcacuagaaaccugggcauggugggacuccuugaaucccaacacuuuggaggcagaggcagguagaucucugaauuugaggccagccuuguuuacagggugaguucuaguauccagggauaagagaaaccugucuuuaaaaaaaaaaaaaaaacagguuaaaaaauguuuaagacuaaacagacauauaaggaaauaagccaagcugggauuuaaucacagcacuagggaaacagaggcaguuugaucugugaguucaaagcuagccuuagugaguucuaggacagccucuguuacacagagaaaucccguccuaaaaacaacaacaaaaggaaauaagauauauccagaaugaaagguauaggaggcagagauagguuaacccucuuaacuaacagcagacccuaaguuaaaccaccugccaccccuuguuucuaaugggaguauauguaagcaaagauuguuuuuucaauuaaggguuauuuucugugaauaacugacuuuuuuaguuauuaauuucuuuaauaucuguauuuuuacauucauaauuuuuacuauugcuuaguguuauaaaccuuuaaaaaaacugaguuaauuaaaaauuauuucucuuucccacaaguucauugaguuuaauuauacugagcuagcucuugggaccugccuaaaagagacacucuucuccauggaguaacauuugcauauuagagguuuuugaaucauaaaauggauuuuaauagcaguguuuaagcacagaaauuguagggccuccacuuccugcuuucuuuaaaaacuuauuaagcaacuuucagggaauucuuuugaauaaaaauucugucugggggguuaaaaaaucaaguguucuuagcccuaggcuugaucaaagugucauagggaauauauauccuuucagaaguugugcaguacccaaagguucaguuaugguuuccauguuuaaguacucuucuucccuuugauagauaaugugauucuaauuaaaguaacuagcucugcagaucagucuggccucaaacucagagaauuuguauguuucuaaugaauuauauagaaauauagugacaaccagcaggauuucuugaaacuuuauucaucuuuaaguuaauucuuaaauuaaaaagucuaauuugaucuuugacucaucaaguucuuuaggauggggcuccugguccagcgauuguaagagaacagacuuuccaguuacuugugcagucccagcuaggguguaccuacaaucuagaggguuggugaacuggacuguguauuauuugaaaacucuucucagcugacacuuacuuaugcuucaccuuuuaguggaguugggcgugcuuuugcuacguccaucugcaaaguugaucuucagagaccuuugacaaaguauaaaaaccauuuucuguuaaagaucuaguauuggaaugguuauguguaagcuuugaagagaaaaccuagcuccaacuuuccuaggucagguguagauaggcaucagccauuguuacagauuagaacuaccucuuaauaugcuauccuuccuucuaugguuuaggaauuugugcauuuuccuucgauuguuugagauagggucucauguuauuccuagcugcccuugaauuugcuauguagcggaggcuuaccuugaacugccuuuaucuuccaaaugcuaggaugacaggcauguagcaccagccccauuucauuuugcuucuuuuauaagcugaauauagcauuuuucaaaguuuccuauguugugaacugagcuugggugaagggaaaucuuugaaguaagacaaccccggugauaaaaauggaaaggaagccugugaaauuugagggcccucagagcuaaguuuuagaaucugccuaaauauugaaaugccaccauuuguuguuuagggggacauggaucuaaauugagaagggagcacacaucugccuugguugcuaaguauauccaucucaacagcucauacuggaauuuuauucuugcuuucauccgucuugguuucagcaacaguguuuuuacccuuuggcacuagggauugaagccguguuguuauacauacaugcuagguaagucugccacugacuuaagccccuaggccuuaaggaggugagggaauagagaguuagcuugcauuaagcuuuccuucccuaugguuugaauuugugucccuaauagacacccuaauagacaggugguuugguuuuuguguuuuuuguuuuuuguuuuuuuuuuaaugaucacuacuggcuuuuguuuuuuuguuucauuagaaaggucaguagauuaguggggcacauguuuaaucccaauacuuucaaggcagaagcagguggagcucugaguuuugaggccaggcuagucuacagaucaaguucuaggacagccagggcuacaugguaaggggugugugugugugcagaauauuacuauuauuauauaauauaauauauaauauuacuguuccuuuuaauuucuaguaaagauucagaagaguaaacauauuuugccuguguccaccuagugagugauacuaacccaggguuuuaaaaggccugucugaugagcgacugauuuauugcuuuauccuuagcacgucuaaaaagaacagggccaguguggcagaaguaguuggucaguagcaggguuuagauggccaguuucuccaacagccugcuucucuuggucuuacuucuuucuguucaaaucacacaggacaggugugaguaauagcaaauuguuccuucuuuugugacuguuaugggauuaauuugaacccuguuuauugcagucuucaaacacauggagacuaaguuuaaacccaaggccaacaauuagcucuuuaaaaguguuuucaccacaugaggugagguaggcuucuugguuacuuuuuguuguuguuguugcuguuguuuuguuuugccuauuugcuuuuuccuucagguaauuuuagaucuguggggccuuaaaucugauuuauagggaggacuuuggaugaugugaaacaaguuuguguuucuucugcuuuguuggcuacacuaucuucaugaaucugacacacuauuuaucugacagugcacuuaguacugcuucgccagggaaaaucacacaaaacaagccuggugcaucagcacuuucauugugugcugagcugagccucccuucacauggucgcauccccauuucaguccaauacucccuuucccagccccuuccccagaccugccucuuucuguggcacuuacugcugguuucccugagcuccguuuccacuuuguguuuuuuguggggcccaggaagcuaaagcuguguauauuuguggaucagacaagugcagcaaguuauuaucauuggcuucugaaggggagagugaggugauggcugcguuuaaguuggauuuccuuccagaaaugaugguggaucauugcucuuugaauuccaguccuguguaaguauuuuuguuguccuauuuuuaucauaagcagagggaacugggcuguuauuauuauuuggugaaaccggucccuuaaaagaaacuucuuuagaaagucuacauuugauuuuaauuacuuagucuaauucuuauaacugcuaauugcuuccaggaugaaacuaaguucuuugcaugaggguacacuugauauaugacuagcaacauuaguucaaguguacuggcucccaucucuuaaaacuguaguguuuagccauacgacagauuccaagguguuuuuuaaacuggcuuuacugcuuugaguggguaugcaauaguuaaauaauccuuugggaauuaaauauuuuguuauuguuuuuguuuuuauuuacuuacuuuuuauuuuuuuugagacagggucuuguguaacccaggcuggucuggaacucccucuauagccgaagaugaccuugaacuccugauccuucugcuucuacuucuugggugcugggauugcaggcaugagccacaaagcucaguuugccagacauagaacccagggcuuuuguguauauuaggaaaacacugucauccucagaccugauugcuauuuuuugagauaguuucccuauauagcucgacuggccucaugauccucugucacaucugcugaggugcuauguuuguauacaaguguaacuauaccccacuacacuaguuuuuaacuauuauauauucuuaagcucuugucacagagaacacugguaguuaugaauauuacuuaguauuacauguaguguauuuugcauucauacaguauauuaugaagauaauucugaacuuucauuuucuucuaucuucuugcuaauugaaauacaauucagcauguaauuucaauaauauuagcauauccucaucauuaaaaaaacaaucaguaaaacaaaauuauaucauuuuugauaggcaguuugcucaaauaaauugugguugcaggaaugcuagcuaggcaaaauguuaaccugacccugaguuggggcuauagggaaccugaguucuggacuugguagagaaggaucccauuuacagccuccacuucuacaucagaccucaguuguguauuauuuguuauuuuaaucaguguccuugguuuuauccacuuuacuaaguucaaaauacccugaaacaucaaguaaaugcaccuuuauugaaaaccaagaguguuaagugggagaacguucccuaggugggaaucuuuaaaguuuggccucucuguucaaaucacacaggacaggugugaguaauagcaaauguuuugugagauaguuuugagagcuuugaaguuagccacauuacucuguuaaaaugguuuguaugccuucucuguaguccuccagauaguaauuuaaauuugcuuuuuaaaaaugacaguucuuugcuaccaaauauuuuuagcaauaguuaaaaggaugauuuacaguguuaucaagauuuagcacacgaagugugccuguaucucagaauauaugauggcuaagauuggaguuuguggcucagauugucuuuguguucuaagcaguuuccuucuguguagcuguugccuuuguugagccuccuaguguguuccuccucccuccuuuggccuuuucuuuuugugcuagaaaucagcucacugagcagacaaacguucugaggucacuccagccagacggccucuccucccuccccuuuuuuuccuucucuacuuucuacauaaagggucucauguaucccaggcuggccucuuaaaucgaugugacugucauuugcuucuacuuccagcuuauauaaaauuuaugcugggauucaaacuugggguuuccaagcacucuaccuauugagcuaccaaccucagcccaguuccuuuaguugucuaagauguuaaacuaacccacgauucuaucuaugacaucugugacagaaccauugcauggacaucacugggaauuuuaaaauccggguuaauuuuuauguuaaaguaagguucaagacuguauuuuaaguauaauguguaguuuuuaaauguacauugaaguuugaaauaaauggauuuacuguggguauuuugaauuagccagagguugucaugucuaauauccaaaauuauuugcaucuguuuuuguggucugucuucagcaaagcuuuauaaggcuaacugcuuugguuuuugccccuauucuacagacgaggagcucaguugagagaggucaggacuugcuugcugaagacaaaugaugucaaucuugaacacaacacucuuuuuuggagggggugguuagaucagguaucagugaguagcauauacuucaugucacuagaucccacucccauaugaaugguacauaugauagaauggaacuuauaaagaagggugugugacuaaaauuauuuugucuaggaaugugauugaucaguauaucauuuuucaaaaacaaaauuuuuuuuagcaacacagaagugaugaaagagucccaaaagccucagggaggccagauacccuguuuccuguucugcucaugucucucugcuucuucccuuuggucauggugaaaucucccgguagcucuuuucauuugcuuacacuucaagaaacggaguucaaagagcccugagccucuggcucucucacugauuaaucucuuuucuuagcuucuauguuucucaggacucucuacauucuuuaacugcccucaguccccuaacuugauucuaaaccugucuauuagauaucuuuguuugaugucuuccuuacagaaaaacaauuucccaaauuguguacauuagaauccaugacuccauuuuuuucccucacccagaguuccuaaagcuccucguccuacugaaucaugauguaaaggugagaauggcagcaccuuuauagagauucccccugguuuccauagucucucuccacccuaauuuauuucuucuaaauuauucccaggauuuuucuuuugauauauguaugcgugcacacauuuggaaguggggugugcaaggcccacuuuguagcccagguuguccugaaauucacuauguagacacggcuagccuugaacucauauguaccuaccugccugccugccugccucugccucaggagugcugucauuaaaggcuugcacugccgugccuggcucauuuuguuucuauuuuugagacugucagcuuaagcccagguuggucuuaagcucaugaugcacucaccuugacuugccagguccugggguuacaguugugcacaguuucagcuggcuugccaaggacuuuuuuuuaaaagaaaagucugaucauuuucuuaauucuuaauuaagacuuaggauagcagagaauggucguacauaucuguaauccuagcaguuggaagcuaaagacuagagagagaaaugggaguucagaauaauucucagcaacauagggaguccaaggccugccuauauauguguaacucugucuuaaaagcaaaaggaagggaagacaaaggauuucuuagauugaaauaaacaccaagcucuuuguguaucacagaaaauucaucuucugagucugucaaaguuaccucuuuaucuaucuugguuccuaaucauuucacuuccuucuggucuauuaacucucccccccccccagacaggguuucucuguaguccuggcuguccuggaacucacuuuguagaccaagcuggcuucgaacucagaaauccgccugucucugccucccgagugcugggacuaaaggcaugcgccaccacgccuggcuggucuauuaauuucuguucucuaacucccaugugcauuuucuuucuuucuaaaguucgcuauucuuuucucuguccuucauggcucuuagguguucaguccuauaugccauguaucauuucuccuaguucaucucaaauccuuggccuaugccccuuuuccaaaucaagccaugucauuagccacaucuucuguuuuguuuuugguuuuguuuuguuuugagacaguaucucauaagguagauacuggccuggaacucacagaggucugccuccugcuuugauagugcuggaauugaagguaugcuuagccaccauaccaaguaacacagaauuuuuauauuugcuaaauaauuuguugaguguaguguuuucacuuguuuaguauuacuuucugaggcagauuguugcucagucuuucauagaaccauaugauggugguguugguauucugacaccauaguaagaacguguuuguuuguuuguuuguuuuuguuuuuguuuuguuuuugaggguggcagcuagagggagaucuuacaaaaucaaaaccuugacauuuucuccaaacuugagggaagaagaggucugcuucuaaauuauauuuaguaucuagugacaggucucccuuuauccaaacuaaaauuauuuccauacaucauauacauuuucugucuuguucucacaagaaaaauaccuggucagcaacacagacuccuuuuucugagcccuuuaaauuuacaugaauucucuuucuaccuuccuuuccauagcacaguauaugcuagggacuuguugaaacugggagguagcuaacuuuaugugaauuuauauuugcuaaaaagguaaauggguggguaacuggaaauuuuucuauuuguauaaugagcaaagaggaaaucaacuacuaaugacaggugagugacaaaauaaugaaaacuuuugacaguuauugagggcuguauguaugugugugagcacaggguuguauuuggcugugcauacuguuugggugcauguagaggccagagauugaugccaagaugucuuccucucuuuugcugauucugaagcucaguguuugagcuagagugacugaccagugagaucugucugucugcuccccagugcugggucacagagugcuccccaaaacccaucucuuuaaaugaguaugggaaucugaacucagguuuccaugcccacacaacacgcacauugcuuacugggccuuuucuucuuuuucagucaugcuagggauugaauccugguuuauagcaugcuagaugaauauucuaccuggagguauuaaccuacagggaaacuuaacuuuuuccucucccuuuccccuuuccccccuuuucccaugucuccccccuuccucucuuccucucccucuuccuccucuuccuccuccuccuccugucugucugucugucugucugucugucugucggaaccauacccuggucuacagagugaguucuaggacagccagggcuacacagagaaacccugucuccaaaaacaaaaacaaaaauaagacaaaaacaauucugucuuauucauuauacaaugcuuuuguuauuuaucaauguauaccaugucuaacaguauguugaccuauauaagugccaaguaaauauuggaagcaggaaugagucacugaauaguuguagcucaugauaucuagagcauguugagucugucugaaaauuugaaccaucuaaguaguacuuuucaacugguagacuaccucauucuuuacgccgugguaaaauauuuccuuauaagaaauuagauauggccagucaauggucucagcacuugcuaagcagaggcaagaggaucuuuuugaguuccaagacagccagggcuacacagagaaacaccaugcaggggaaggggggguguuaaauuaaauaaauaaugagguauguaagcuuauuuuguauuugucauuauuagcaguuuuaauccaugauugcuuaauuucaauuucugugaauagggaauucuaaaaaguuuaauuaaaaguuggcucuggucuuugggccuugguucacauagcacugacuuugauaauucuuaaagauguagaguugauauauaaaaaagcagaugggcuuaaaaguuucgaaaggauuugaagcuggcacuagugauaaaagcacuagggagucuuuuuucuuuuuuuuuccgaggcaggguuucucuguguagcccuagccuggaacucagaaauccgccugccucugccucccaagugcugggauuaaaggcgugugccaccacugccuggcggcaccagggaguucugagugaggagaaaaaccggccauguucuacagcagugauucuuaaccuuccuaauacugugacccucugaauauauauuuauuuaugugguugcuucucuuucacgaaugccaagaaaauaccccaaguguuucuuuugucuuuuuuuuuacauuuauuuauuuauuuauucuuaagccaccacugugaaagugucauuagauacccuccacccaaagugggggguuugcaacccacaaguugagaauuacugcucuacagaguaaguucagggcuaucucuaacaacuuacugagacucagucuaaaaaaaaaggaagaggugguauauagucuaguggcagaguacuugcuuagugcgugcaaagccuuaggcucaaucaucccaguacccccuuccccuccucccaaaagaagaugagauggagaauuuggagagaaaaagguuugucuaggauccugaguuuccacugguuuuaguuaaguuguaauuuguguauauauccauguuuuugcuucacacugaagagggcauauaauaaagauagagauggugugcacauauggaaggaaaggacaagccuguguaguugcagcuucuauuguaauauaaaugaauaaaccucuuucucuguagaaagagcugucagcuuauuguucaaacauacccugagaaucacugggguuugguuaaucuucucuguaaucaaaacauaaugaaaggugggugcuacuaaaacugaugaaguuguuagggucauacuguaagaagugacaccacuguuucacuacuuaauguugccuuuucaaagagaucucucuauuuuuaugugcauuggugcucugcaugucugugaaagggugcuagaucuucuggaacuggaguuacagacagcugugagcugccaugugaguccuggaagagcagccagugcugguaaccacugagccaucucuacagccccucaugucuuuuuuggagggaggaaaucuuuuuugguggaaaucaugaaagcuugguuucuauuaggacaguaagguuaaaaugcugaagacccguuauauuuuuacagugaccugccauauuucuuccucccacuccuccuugcccuuugucuucagacagugucucuguauaaccucaguuuuccuugaacucaagauuuugccacagccucccucgugcuggaacacaggugcaugccaccauccuccaccacccaugguuauaaguuaacacuguaaaggaaaccaguaggcaguauauuccaagauggguuuuucaacauaugugugguauauagguacuaauguacagauauguggagaccagagguggcuuuucuaucgcucuccacuucuuauuuguucaauuaauuuauugagacaaggucuugcuauauagcccugacugaccagcaacuugguuuguagaucaugaugaccucugucucugaaguacuggaauuaaagguugcacuuccaugccugguugcugcucuuauuauuaucaccaucauuaucauuuugagacagggucucucacugcaccuauaacuugucaauuaggcuauacuggacugccaggcuuuuucuguagaugcugaauacccaaacucugucccugugugugcacuuuaacauugagcuaccuccccauuugcuuccaaaauaacuuuuuaauaacuugauccuguggcaacuguguaaucauaggaagugguagcuguccuuuguuguuguuuugaaacauguucucauauagccacaacuggcuucaacuugucuguguagccaaaacuuuuccugaaccuccugccuucacuucccaagugucaggauuaugagugaguucuacuacaccuggguauaauagcugugcucaaaguugagaguccucuuuguauauaacacucauuuuggugagauuaauugcuuaaauaagaggauuuugagggccagugagagggcucagugguuaagagcacuggcugcucuuccagaggacaugaaguucaauuuucaauacccacaugcagccauaacugucuguaauuucaguuuuaggggcucugauguccuuuucuagccccugcuggcaccaggcacacaugugguacacagacagacacaugugguacaugcagacaccacacacucacauacauaaaauuuuuuuuuuuuuuuaaaaaaggaaagaauuucuuggaaccguuagcaagaaauucacacaacuaugaaccaagcccacucacuauaccagguguagcuaaaggaaugagcaggaagacuauggauacaacucagugguagaaugcuugccuguaaaccugaguucaucccaauacuacuuuacacaggaaauaaaaagggauaagauuagcugggugugcuagugcacaccuuuaaugccagcagaggcagguggauaucugugaguuuguggccagccugucucaaaauacaaaagaaaaggguaaacaagauuaaaaucauuacuaccuuugaagaguuacccguucuugggaaaguuauuuagagccacaugaugacagaagauuuuggcuauguaauugauggaaauuuaguacuguuuauaaccuagaaugacacugacuaauucaaauggagaauuauagagaaccauaagucacggacgggcaaguguuagcugcaugucauuuugauuuuuuuuuguuguuguuauuuuuaaugauaggaucuuuguauuuaguccagauugguuuugaacuuaaggcaguccugcugcaucucaaaugcuaaaauuacaagcauacacaccacaccugauaacuaauuaaugcuagauucaacaaaagugauauuagaaauaccaucuauggguguucacuuacaaggaauguauaaauugaggcauagagguuaaauggcuuucauagauuaaacauuccuugcuaguuuuugagaauuuaaauaguuaaguugagauguuaaauuuuuggguuuuuuuccugauacaggguuugucuuuauagcccugguuguccuggaacucacuuuguagaccaggcuggccuugaacucagaaauccugccuuccucugccucccgagugcugggaucaaaggcaugcgccaccaccacccggcguuaaaauuuuuaaauguaagaucuuaaaauaguggauaagacuuggaaauuggugguaccuucugaagaaacauuuaugaugcgagauugcccuuaaguucuugacaguuugcagagugggaauacauuuauucaaguaggaguguuuggugucagaacuggaagaaguuguggaauuugaaauggcuguaguugcuggaaaacuacagugcaaggucucagaaacagcaaguacuaguuacauaauucagaaaacaccuaggaugacaacaacuuccauuacagucaguuuggcaguuuaguaagagauagaaccaacuuacaagcaucauaugcuuaccuuucggagcgaucauucugaugaauuuuuuaauaauuauuuucuuuuuuuuuaagauuuauuuuauuuauaugaguacacuguagcugucuucagacacacaagaagagggcacugaaucccauuacagaugguugugagucaccauguggucacugggaguugaacucaggaccucuggaagagcagucagugcucuuaaccgcugagccaucucaccagugaauucauccucuggugaauucuuaauuugaauuuugaaaauuaaugcaucucuucuaacaucugcuuaacagagacugucugauuuaugcauguuaaaaaguccugaaucuuaccuguaauuauuaauccuuuguuacuauuucauacauuuaaaaguccuuauuagcugaugagauggcuugguagauaaaauacuugcccacaagucuggcaacaagaauucaauuucugccgggugugguggcacacgccuuuaaucccagcacucgggaggcagaggcaggcagauuucugaguucgaggccagccuggucuacaaagugagcuccaggacagccagggcuauacagagaaacccugucucgaaaaaccaaaaaaaaaaaaaaagaauucaauuucuagaacccacauaaaggaggaggguagaacugaugccacggagugucuuccaaccucagcuacccaaaacauauacaaauaauaaagacaauuuuaagagauuuauuuuauuuaguuguauccagauauuauuuaaauuugauguagagccaggugugaugguguacaucuuuaauaucagcacuugugaggcacaggcaauuggaucucugaguucgaggccagccugauauacagaaugaguucuaggacauccagagguacacagagaaacccugccuugaaaaaccaaaacaaaaguaacaacaaacugaucaaucuuugggaacuuauaguuucugagaacuuucauauuagaaaagacgugaugucaauuuuuuuaaaacuuaguaugucuuaaucacaguggugaauuuaguuuggaaucuaguagaaugaacaaaauuuagguaaguuaaguggaaguagugaaugaaguagauuuucuccuauguuucaaaaaguuguugaaaaucuuuagagaaaaaaaagacccucugguaugcaauauaaauaacuucucacuuuaucucaugcagcucaaagaaaaugaacggcacccuggaccacccagaccaaccagaucuugaugcuaucaagauguuugugggccagguuccaaggaccuggucugagaaagacuugagggagcuuuuugagcaguauggugcugucuaugaaaucaacauccuaagggauaggagccaaaacccuccucagagcaaaggugagcuuuauuuuuauuauuauuauuauuauuauuauuauuauuauuauuauuauuauuaauauauggaggucagagagcaaguugagaugcuagguucuuuucauuauguggaucccaggaacugaacucaagguuagacuugaccagagccccuuuacuaccagcaaguacuuuuacccauugaauaggcuugcucaaggccagguuuuuuuuuuuguuguuguuguuuguuuguuuuguuuuuuaacagaguauagaugaauggguuuuaaaauuuuuuguguuuguuuugucugagacagggugucuguagcucuggugguccuagaacuugcuguguugaccagauuggcuuccaacccaagauauccccgggccuuugucucugaacuguuuggauuaaaggcaugcaccaucauaccuagccagguuuuuaauuccuguauuacacuaugcaucccaucucugguuaucaggauaucugugguuugaugggaugguguccuuuuauuuuaacuauguuuucuaauccaaacacauuuaauggcuuaaaaauauaauauuaacgugaccacaugaguaugauuuauaagaugcaucugggcaguucuuuguaaguguucacagagaagcccuugcaggaugauuuaucaacagaagggcuucauuuuaggcaacuaguuggcaguagccuacaaaauggcuaggaaaagaaagauugguuuuuuuucuagagauuacagcaccaugugcauuucagaagaccaagaguaaauaagcaacauuagcuuugugcauggaaguaugcucuuauuuuccaaauuaccaauuuagagugauuuuuggaauagcuauucuauaauacagaugugaggagcaugguugucauguuuacauaaaaaguuaguaagucagggaucuagaaacagaacaauuuucucugcguggcauaauuaaccaagaauaaaaguuauuucugaaaaugucuggccauacaacaugaauuuaaaauccuacugcuguauaauuuugagagaaaacuauuguauuuuaugagacuugacaaguaucagaacacuaaagcccaagauuucuaagaccuuugagucucuaauucauauauaaaacaauaccaaacaguaagaagcaaaauuauuugagaaugaaaaauugagaaaagauuguaaguucucauucuuaaguaauguuacagucugauaggugauaguuaaauuggaaguguguggugagaacuggcugugaggaagagucuggagaggcgcacagcacuuagugcucuggcugcacgugcaaagauccagccuucuucacagcagauguaaauccagucugaagggagccauugcccucuuuuggccuccucaggaccaggcauauaugguacacaaacaaaacacccauacauauaaaauaaaauaauaaaauaaaauuuuuaaaauugguugugauagagggaguaguuuauucugagcaagcagagagaaaaucaggguuaggguuuccagaaaaccaggguacgagaguaguaacugugucuagcuugguggcuaguuccucuuccucagcaucuuaaccuaguuugugguaggacagguuaaauggaauggcacauaaccuuuguaaagagagccuuguagccaggcaugacuguguauacuguaaucaaaacucuuaguaggugggggcaggaguucaaggacaucguugauaauucaaagccagccuaugcuauaugagaucuugucucaaggggcgggggcgggggugggguggagaagcauuuucccagagaaguuacagaagcaucaaaagaagauuucugcugacuacaaggaagcuagaaauaaaaccuagagcuauaauagacugggacaaagaaaggugcuuuaaaaaucaccccuuugucagguggucauggcacaccuuuaaucccagaacuggaaggcagagacaggcggaucucugaguuggaagucagccugggguacaaaagcuaguuucaggacagcaagggcuacacaaggaaacccugucaguacagcaccucuacagcuccccccaaaagguaacagccuucaucccaaccuuuucuucccucaguuuuaguaagcucguucagguuuugaauuucagcagugcuguagggauagaaauauucuaagaauucuguuuucaaggcacuaauuugguuuuugcaaaauuuuguuuauucagggugcuguuuuguuacauuuuacacccguaaagcugcauuagaagcucagaaugcucuccauaacaugaagguccucccugggguaagagcuuuuauaaguuaaugugguguccauuuuugugcauggggugugcuugugcauguuggacauauacuaaaaagcauuuuggaggaaaggucuuugcugugggaauuacugugaaaaggagaauauaaagggaacauuucaaagaagagagagaccaaaaguaguucuugcugccaagaguuuucuguauuuuaacuuuaugacucacguucugucuauucuuguguuuuguugaguuaagaucaucaggcagacaugaguccagaggaaauucuaaaggcuguuguuuugguauacucuuuaaagucuauauuuuuaaaaggcauuaaugggguuggagaauaauacaaggggauuuucuuuuuagaugcaucacccuauacagaugaagccugcugacagugaaaagaacaaugguaagcuuccuuccuucccccuuuccuuccuuccuucuccuuuccccuuuccuuuccccuuuccccuuuccccuuuccccuuuccccuuuccccuuuccccuuuccccuuuucccuuucccuuuucccuuucccuuuucccuuuccccuuuccccuuuccuuuccccuuuccuuuccuuuccuuuccuuuccuuuccuuuccuuuccuuuccuuuccuuuccuuuccuuuccuuuccuuuccuuuccuuuccuuuccuuuccuuuccuuuccuguuugcuauucuuagggcaauuuuuuuaaaguuuuacuaagcuagaaaaauagaguuaauaauagagaaaauauuauacauacacacagacagacguauuugccagaugugggggaguauacaguguggauccaggcauuuagaguuugaaaccccuugagucauaugagacccagaaaacauagaauguccuugaaaaguauaauccuuauagacaagguuaaggaguaaaguggagcagcugggaagaagaccuguuagugcuuuaggagagagcuuucugagcucaguagcuacaaguccauggucauugcaggugcugugauccugcaguucagccacaagcuaugacccagguacuuuucgagccagacauggauucagacuucuaauaucuauagaagcugaacauaaugguaguggucaaaaagcuagaaauaaucuuuguuucacuaccacaacugaacucuuugagaaaaugcaagucuaaugaguucaugagcuaauaacaggaaguucagcaggaagcucagagggcaguuucucucagaaccacuugggaaaaaaaaccaggcagacuuuuccggggcuguccuacuggcagcuacacuuggugccguccuggaggacuuguucuucuugaaugaaauugugggaauuguacaaguuccacaguagacuccaccugaaauugggugauagcuggcucauaaaaguucauuuaaacaaaauaaacaauguuguagaaugcccagaggcuaaaacauuaauuuuaaauucucaagaguuccaguuagaaacacaaagaaugacucaggagucagagacaggaggaucucucugagucugaggcaauccuagaaaauuccaggacauggcaaguucugagacagccauagcuauguagagauaccugaucgagguggguucaguugggggauaggugggggacaaaagaccaaauguuauuuacaguuuaaggaaaaaauuuuaaaauaaauaaaauuuaaaauauuggaaaagaaaaauucucacugaaggucuucuguuuauugaucauaucaagugugaaagccuuuucaugguacuucuagaacauaguaagggcaaggcaaaauacuaagaacuuugcauuuaauaucuacaggcuuagccuaucaaucacacacugaugggugaauuuaacuugaacaagaauacaaauucuccauauccuauggaaaugcuuccaaauaugcauaauuuuaaauuacuguuuuuauaucauuauauaauuggcuguugcaguuuuauaccauugaaauaaaaugaugggaagaagaaaugugucuuagaaucugugaaguaggugguaugauacauagccaggcucaaacccaagagauuugguucuugacucuuugccuuuuguguuuuacucuuuuuagcuguggaagacaggaagcucuuuauugguaugauuuccaagaaguguacugaaaaugacauccgagucauguuuucuucguuuggacagauugaagagugccggauauugcggggaccugauggcuugagcagagguggugcauuuuuagagcuuuuaaaacagauacuugucuuaaauuguagucucuuauuuaacuggacuaguguaagucagaucccuagucaccauagacgaagagcuggggccugcuaccucgaucuugucaauauuucuaguugaucuccccccacccccauauuguuuaaggaguucuguccucaguuucucuugauguccaaaauggaauuguucuuuccauauuuacuaucagaaugaauugagauucuuugcuucuuccucaaaacugucuauugucccuugguagcuuuuaguacccuaucaugacauacaaguguaucuacugaacaagcuugugaaccccugaaaaguaagaucauauuuguauugcuaagaugguaucccacaauaaguuagauauucagucagugucugucagauaagccucuaaacgaaugaacauugauucuuuucuugccagguugugcauuugugacuuuuacuacaagaaccauggcacagacagcuaucaaagcaaugcaccaagcacaaaccauggagguaaggagcagagagguggaagaggagaaacaccccuugccugacagugcagggguaggcugucuauuaaagucuagggcuugugcaacaccagaucacccuggaacuuaaaaugucuaccuuagcauguaaaauacuguuucucaaaucagagggcaccugaugcucuuggagaauaauuguguuugauucuuagcauccacauggcagcucacaaccaucuguaacuacauuucuagaggauccaauauccucuucuggccucuguggguauuggaugcaugugguacacauacauccaaguggaaaaaaacacuuauaaaauaagguaaacaaaucuuuuaaaaguuaccuuauuggagccagagaugaagaugaaugcuuauagguccagcaguucaugcuaagacaggagaaucauugaaccuaguaguuuagaaucaaucuuagcaacauagucaaaucuccccauuuuaaaaaugaacagaaaaugauuacuagaaauaaauugccuuugccauugucugucagagagucacuugugaaaaauagaaugcagccgucauaucuucacaaaggagaauuucugccuugacucaggaagaagugguguaaauuauaggugucuguccacagcacgcagcagcagucagagaacaguguauagagguuuguuuccccuucauacauucuguggguuucagagaucacacucaggccaucaaguuuggcagcagucauuuuuacuuacugagccaucuuucuggcuccaaaagaaggaauuugauccuuugguuuugguguuuauaggguugcucauccccaauggugguaaaguuugccgacacccagaaggacaaagaacagaagagaauggcccagcagcuccagcagcagaugcagcagaucagugcagcgucuguguggggaaaccuggcuggucugaacacacuuggaccccaguacuuagcagugaguucugugguuugcuuucugcagacuuugcaagcucccagcuguuucuucuucugcugucucuagcuaacaagcagugucauuugcaacguuggacauguagagauauuauauaaaaauguaggcauugucauuaaguuguguuagucuaccuuaugguuccauauugagacuuuuguuacaauuaaaguaaaauguugauuuuaauuuaaagaauuaccaguaucucauuucccugccucuaagagaaauccuuaagaaaaucuucacuauucaggaucauuuuccaugucucuuuauauaagauguugagaucaccaucaaaaucuuuauuaaguccccuaaaaacaugacagauguaucuuucagcagacugaaauaugacuuugagucauacagucuaaaagaagguccagaucuauaaucuauuauugauguuauguuauaauuuaucauaauauuauaggggauuauuagauuuuugagucacaaaagaaagggcaucuuuguccauaguugcacaugacuauaguucuagugccugggagaucaaggcagaaagaucaugaguucuaggucagccugugauccacagugaguucuuggccagacugaaaccucuuuacagauaagcuauaaauggcaaaaccauugagucuguauggauagccuggaaaugcucauauagggauaacgaaugcagucauuuauuccuuauucuucuaaauacugcuuauguauggaaacaagaaagguaauuauuuguugacacacaccaaguuuuaauuagucugaugcuuacugguuuccauuucuaaaauaguucucaguuuauucuaacuagaaugccuuuaaaaugagauuuuuaaaaaggguaaaggguuguuauauauauuucaauagauuaaauuaguuuuacugcuaggaacauugagaaauauugugguuuucugccagaauaaugcuuugaaaauuaucucuagccaugugugaugguguaugccuuuaaucccagcacucaggggacagagacaggcagaucucugugaguuugaaaacaccuugaucuacauagugaauuuuaggauagccaaagcuacaguaagagagacccucucucaacuacacacacacaggagcaugcaaccagaauuacuauaguacaauccagugugauacacaaacacaccuaaaauacuauaaugugauccaaugugaucauuuaaaauaguuaaguggaaggcuggauguauugguguauaccuuuaauccuagcacuggggaggaagaggggcaggugggucucugaauucaagaccagucuggucuacauguugaguuugaggccaaccagggcuacaacaacaacaacaacugguugaugguuguaaccuaaagaaugugauguguuggccucacuaggagagcaugggagagaggaagaaacuaggaauggcaugaaccaaggugugcugugcugggguccagauuguuucucugugcuaguuuuguccuuuacuaugcuguacucugcugcacagagacuugagcuugucucacuauccagagaauggucuuuugagccagggcacuagcucugcagucagacuugcaugucuguuggcuuggguuauguuugacuuuguucucucugggggcuucugcacucuugcuuugcugugcuguagaguuaucccagaugcagaaccagcccucacucucacucuuguucuguuuuuugguguaaugucuagcuuuauuugcagcuccuacagcagacugccuccucugggaaccucaacacccugagcagccuccacccaaugggagguaagugcuucccugcugcagaggagcaccagugcacaggucagcagacagcuuccucagucugagagauggguaccauuugugucaaaauguuacugcucgugacauaagucucaggacucagcuuucuugauucuaucaugugacccuguuguuggucaaugccacuuagcucuuuaguugugugguaucuuuuaaguuccuguuggggaaggaaaauggcaaagaaaacuuagggaccauucaggcuuaggccauucagaugcagaaaaaaccuauauaguaaaguuaguuucuaugacuuacccaaagcuacuagaaccagggaguuuuuguguuucugaauucaugcuguuguugcuguuaagguuuauggaaaauguaaguaacagauacaugguuuauagcaaaaugaagcucuaaagacagucaggagccaggggcuaucaaaugagucugaagaggcagaaugugaggaguucuacaguagccugugccuguacccugcccagugggguguaguuaggcauugcauugagaaaggggagcacgggcuggugagauggcucaguggguaagagcacccgacugcucuuccgaagguccagaguucaaaucccagcaaccacaugguggcucacaaccaucuguaacgagaucuagcgcccucuucugcagugacugaagacagcuacaguguacuuagauauaauaaauaaauaaaucuugaaaauaaagaacgucuuaaaaaaaaaaaaaaaaaagagaaaggggagcauguuuggugagcugcauuuuacauuuuggaguuuugauaguaauugguuuugccuuacuuucucuauugauagccuguccucuaguaaaaugcuuuacaaaauguacaacauaauucaaauuuguucuuauucuguguuuucuagguuuugcuuaaaauucuuucccucacauuuuucugauaauuaauuuacuguuacaauggcaguguuuauucuucauuccuucuccuaauacuguucuuuccuguuauucccauggagccuucuagaucuccucccugcuucuuuccccuccaaugcaccuaucuguguguaagaagaccuuacuuuacuguagcuuguagauguucccuugggcuccuuccccuugguagaucacagguauucucauucaguuuugcccaccucuguauuagugcucauuuggaguucuguuauauugaacuagcaagcuguucucuaaggaaguggcuuuaaauuucuuccucccugccggggauagaucccaaggccucaugcaucauuagcaugagcuauaccacugaauuagaacccuaguauuuuaaaguuucauacuaaaugauaguguguucuuauauaguuaguuccucuuugucugggaccaguuuccagucauugcuggaauaaaugaugggcaucuaaucugcuggcugaugcaucuuuuuggauauuacaggguuaaaugcaaugcagcuacagaauuuggcugcacuagcugcugcagcuagugcagcucagaacacaccaagugguaccaaugcucucacuacauccagcaguccccucagcguacucaccaguucagguaagggaugauagggaauguuguguaccuuggacacauccucucuuugaaggcagagucaagggcaggggcaguccaucuuggaaagaaauuaacacauaccagguagguuguauuaugaacaacagauucagaggucauggucaggcugucuucugucucucuuuguuuuuugagacaggucucuauuuaugugaguccuggcugucuuggacuugcuguuuggaacaggcuggccuugaacucaaaaaagauccuuauucugccuccugaaugcuggguuuaaagauuuuguugaucaugcccuuuuuagauuuguuuuuguuuuuucauuaaauuuuuuaaaauuauuuauugagacaggagagaugguucagugauuaauagcauguacuagucuuucagcagaucugggcuugguucccaguacccacaggagguaacucacagcuagcuauaacuccagagaauucgacuuccuuuucuaaccuuuauguccacauauacauaccuuuacauaggugcacauacauauaguuuaaaugauugugugugcgugcgcacacgcgugcgcaaauaccauguaacagucagaggacuacuugcgguaguuaauucuucucaccucguggucccaggaauggagcucaggcccauaggguuaguaaccaagcaucauuaccugcugaaccacccucaguagucauuuuauuauuugaaaucucaucauuuuuaguuuguuguaaccaucauuugugccugacuuagaaggacaauuaucagaauucagugauugcaaaaucccuuuuguaaauagaaaagccgaugggaucauucuugugcuuugguuccuguuggcaagagaaggcaagugaugauuuaacuccugaauuucuaauagcagggucuucaccgagcuccagcagcaguaauucugucaaccccauagccucacuuggagcccugcaaacauuggccggagcaacagcuggccucaacguuggcucauuggcagguaaugggcaagcccugguugucaucagacuacuuuuauaagcuaccccaguauagauguaccaguagaauaauugccuugcuugcccaagaaaaauuagaauaaucaugggauuguaagguaaauccagacucugcugcuuagcuagcuguaaccuuggaccauuguucuaauacucauuuucucagcugcaaagcagaaguaaaagaauacuuugaaggguacuugguuaaaugaggccaggugguggugacacacgccuuuaauuccagucccuaggugggaaagggagguggaccucugaguucaagacugccauggagaaacccugucuugaaaaaccaaaacaagcaaacaaaauacccccugcccccagaaugaagugugaaaccagcaacuggagagaugguucuucuguugaggccuccuucuacuuuuccagagguccuggguuugagucccagcacacacauccugguucacagcucucuguaacuucacuccuaggguaguggacgccuucuuuuggccuccauggguguggcaugaauguuauacacagauguacauacaggcaaaauacccauacaaaauuuuaaaauacaaaaacagcuuuuacaaagauaauguuaaacgaggacauagagcccagugguaguaauccuagcgcugggaagauggaggcaggcagauuucccaaaacuagccuggucuacagugaguuccaggacagccagggcuacacagagaaacaaaacaaaaaaccagaguggguggagggugugaguaaguaaagauggaaaauggaccuagccauuggugagugguaucaggccuaccaugugcuagaaaacaguaaugaagagaguagugaugagaugugggaauuuguaauauucacguagcauuaaggucugaaauaggacuagucagaugaauagucuaacucaauggguaguuaaaggggaaauaaagucaaauuuggugaggagagguccauuucuuaguaacuucaguguauuugucuuuaguaucagaugaaucuuucuaguguauuaaucuugcucuuccuccaagggauggcugcuuugaaugguggucugggcagcaguggccuuuccaauggcacugggaguaccauggaagcccucacccaggcguauucugguauccagcaauaugcugcugcagcccuccccacucuguacaaccagaauuuauugacacagcagaguauuggugcugcuggaagccagaaggaagguaagugcaccagaauuagaagucaaggucuggggcaagggaauuagguagacuaaccuuucccaaccaaggcuaagaaccaacugagaaagacuaugaaguacagugcuuuuugccauuuugugagaagaguguuugggugaaucagaacuauauagauccucuaaggaugaagcuuauuuuuuaaauuaagaaacaaauaggcauuggaauugaucuggucauuugacaaggaucuucuuuuguuagggaguuuuuggucaugaaucuaccagaggauugucuaaauauuccucuuagguauauuauuugacauuuuucucuuugacuaaugauguauguccuaaaugagauacugagaugugaugggaucaagugagauagcugcuagguuugauagagugagaaguacaugaauagaaguggaguuaauaucuuuugauaaaaauggaauuacuauuaagaaagacuucauugacaguuccugcuagcaccuuaguguuuagguuugacuaacuggguuuuuauaaccacgauuugauaaggugucacacuacuguaagaaaaacaaguagcuuuuuuggcuuuagugugugaaccaguauuaaauagagacccagaggaugugaggaagcaaaccaaguguguguauaggagaagaguaauagagugcagaaauggcaggugcauggaccuggaugccauaaugggccauguguuugacgacaacuaggagacauaaguggcuggagaauggcuggauuuauuaucaucuuagucacucuucauuagaaaaucacaauguaaguaaagacaauauauuuuccuaugaguucaguguuaaucaugagcacuuuuguguguguguaguuuuuuuugugguuuuucaagacaggguuucuuuguagcagcccuggcuauccuggacuugaauuguagaccaggcugaccucgaacucaccccuucagaguacuggaauuaaaggugugcaccgccaugcccaguuucaugggcacuuuuuaaaaaugucuuuuuuuuuuuuuuuaacuuagauguaguuugaguaugguuaaauucagaacuugccuauuuugguauaaagcucugagcugauacaguguugaagcacccuccaaaaugagagccgcucauuagaagcucucuagcaacccauugucauucgccacuccaucccugccucaguacucguggcacucccaguuauuugucauccuuuagugccggggcagaguguugaaaacuuauuuuuuauuguuguuuacuugcuuuuguuuggaaggcaggucucacuauguagcccaggcagacuugaauugaaguccuccucuuuuagacuccugaagaauagaauuacagacugaagcuuguuuugacuauguagcccauuccuccuccuuuuucuuauucucuuguggccucuguuugguuuuacuacguacauacuugcagaucugucuucuuuccaaucccuguauacucucucuggcaagguaugggccuuuaacauccuuccaugagccaggcauagaauggcccacaauuuuaaucccagcauuuagaaugcagaggccacugggucucugugacuuugagccuggucuacauagugaguaggauaucaagagcuuauaaugggacaccacacacacacacacuuuaauucuuuaauuucagcacuugggaggcagaggcagguacuuguuucgggaaaaaaaauuccuuccaagagaugauacauggcuacaugcaagggaagaaaucuacuuuuagaauuacugccaucuagagaaucuguuuaauucucccucagagaauaaauguauuaagauuuuguuaaaaaaaagugggaguggguggguaggggaguuggggggagaguauggggggcuuuugggauagcauuggaaauguaaaugaggaaaauaccuaauaaaaauauuaaaauaaaaaagacucugccuucuccggcagccaucuuuccaaaaaaaaaaaaaaaaaagauuuuguuaguguuaguauagaugggaaugagagaccauuggccuuggugaugagcauacuuaacacugauacucuuccaaucaaugaauauuugaagguccagaaggagccaaccuguucaucuaucaccugccccaggaguuuggagaccaggacuuacugcagauguuuaugcccuuugggaaugucgugucggccaagguuuucauagacaagcagacaaaccugagcaagugcuuugguauguugaccucucuucugguguaagaaugggauuaaguauuuugccacugagagagaaagaaaguggcugcugacaaauugagaaaaaucugaguuugaguuugaccuuagcagaucauaugaccucuuucugagcuuuaguuuuaucuguaguagagguagugauuucugcucacaguauugguccagaggaacuaguguauagaaauggcuuugcaaggggagaaagaauacugguaaaugucaggcaguagcuuugagaaccugauuguaguuucaugugguugucauugccagaauugucguucaugcugagaacaaauaagauacgaacaaggacugaacuccuugcuuuguuagguuccucaccuagguuucugcuugaacacacagguuuuguaaguuaugacaauccugucucagcucaagcugccauccaguccaugaacggcuuucaaauuggaaugaagaggcuuaaagugcagcucaaacguucgaagaaugauaguaagcccuacugagugcuccccucugagacuggagugagaagaucuucugguaagugggggaggagcacccuuaaucauucgaagcccuaaggcuguguguuaacagcccuggacccugaucccugccacucucgcaggcacagcuugcccugaagacucagcuacugccuucugugggagugucgcuucguacagaggacaaguuugugcuuugguuuccaguguuuuacuuuggaguuuaggugccauauccugagggguuuuguuuuguuuuguuuuguuuuguuucuuuuucccuuuauuuaaaguuugcuguguuuguaaccaguuuguugagaaggaccaacaccaguccaccuugaggaagagggaaauggguuuaaaagauaauuagaacaugccccaaaccauggaaagagagggcugagcagaacagaaaguugauccccgaagucucucucccuguguggaaagagugagaacuaagucuaaugagguacggggugggugagugggugaggugucuuagcuucuagaccccuuagaacuggcugcuuucuguggaaaugcugaauuuaugccaccuauuuuucuaauuuuuguccuggauuucugcccuucuuuccuaaaaggggguaagcaagucucaugaaauaaugcacuuuucaguuagccugaaauaugcaaauaggagggagauacccaugacuaggcagcccagcccgacauucguguuauauugauugcccugccugguugguggcuguuuaggggaagcagccagagaggucauuuucauuaauuuuaacaugaaguuagaauguacccauuuccaguagucucuuuuguagaaaguauauggaaguucauaacaccaaggaauguugccuccuucucuggccacaguuuucucaugaggggacauaagacacucuuaacagcaucucuagccaacaagggugcaguucaugggcagagcagucaagaagccaucugauuaagggaagagagaccugcuucuuggugugccugaaucaaggucacuucaagccacuuugcuauauuugagcagagccuaguauucaagaagguucagaagugcauuucugauuccuuaaugaagguacuccaaaagcuguguucccauaaggucuggcaggccucuccucuagccccauuuucuguccuugaagacagaagaaaguauaggacguuuacaggcuccauauggauuuaguguucauuuaccucaguauuaacccauguucauuuugucaucaugcuuacaguaagcucccugcugccuuucaugggucuuaacuccagccuuugccagugucccacauagccucugggcucuccugcucuaagagaagcugugggaaugugcaucugagcagagguagcccuauaaauauaugauuaguagucacagccagggccuggguuccugggucauuggaagcuuaaaccucauaaguuacaagucuugacuccuagcagcagagauuagaaggggcuaaccugcuuuaagucagauagggacucuccuugucaugcugucccuguggauaacaaacagggauugaccaucuugcuguuguacaggaaguuguuagugguguguuaucccauugaugcugggacagcuguucucuuauagugauaaguugagucuguuguccucuuaaacaugaaacauacacuucuuaagcugaaccacguaaacuugaauucugugcacugggagaaaaguguccuguguuucaagauaaaacuguucuaaaggcuuccaggguauugauggaauuuuuuaaaauaaugcaaaaaaaauaaaaaauaaaaaacuuuaaaaggaaaaaaaagaaaaaaaugcuagguugggcaggcacugcucagaaucccaaccggccggaaccaagaauguuguuucuauuuuuauagaaguuuuauacagcuccgggguggagaauauuuauuaccuaaauuauaucucuggaaaaggccaggauuuuguagaauccagaaugugauuguuguacacacagggugcuguguaugauugaaacuacugacuuucugugaccguuugcagcccagguaaccuguccaaggggaaggcuaacauuaaugcugugaauuggcagaggcgagagcugugcuccacagggagcugccagugcugugcucccuaaccuucuguucugccuuccuccucggccagaacaucacguucucccugcuccucugguucccucuagcucucccauuucauuguccacagauuuguccugugcuccaggaccaaaugaaacuuuccuaaugauauuagaagcaaaggagugaccccaccuuuggaacagaccccaaacuucauaccuacuugugauuucuaaaaggagcacuugccccagcagagccauggucagccauggcuggcucaguuagccagcuagccagcuggggagaccauguacuuccauuaucccguuugcccagugcauuagcacagcacuagcacuguccucgagcacaguucccuccccaggccaaagaugguuuuguugaagaagcugcuccccuauaagucuugaugugaaagggcucagcuuagaguggagacugaagugacgucuuaagcaguccauuucuguuguguggagguuucacuuacaguguuuucugcuguaguuuuguuucguggauuauaucaugccauugauuugccuucagugcagcccaaccacuaucuccuggguuccacaagagugcccagggcguauguggaaccuuagggcuuggauuucugggaacaagggugggccauccuaggauugagcaagaaacucuggcccucuaucuacccuaaguagucucccucccacucuaguuagcaucuuuuguugcugagacccugcuugcccagagacugucuucauguguuaggugcuuugcaggaaauccaagccuuagguuccccucugucucuggcaguuggauguucucuugguguccuucauguccuuuugaacuuuccccuguguccauuguuagcaugugcaaaaguucuugucauuucccaccccugcccuuccccgucuccucauuucagggcugcauacagugaguguccuguucucucucucuguuuggauguauugcucuguguaacucaguggaucucccucuuucugguuuguuuuuuuuucuagauuccugccguuuguucaucguugugccuaaagcaugucgauguggcgucaaguacaucguccaaaucccugucucuucagcuucucugaugcuugaacucucaccuuugaccuuguguugaccuuugaugcugauguguauuuuauuauguuuguuucuuucuuuguuuuuucuuuuuucuuucuuuuuuuuuuuucccuuuugugcugccaaauugguuuugcuagaacgacugcugaagggaaaauauuuaaacuugcauuugaauauaaaaaaaaaucuauuuuucuagaacuucauaagauaaccacuugauuuugugauuccaauucuuuguaacugucucagagcagcccuacuagcacaugccgugugguguuuguauccuugugaacacacagccaguccgcuuccaggcuuuguuccucugugugcuuaguuuuaaagacaacuuugaaauaaacaaugaaauaaaagaugucacuaaaaucuuugaggcuccugaacacauuuugcugacauaguuuuggggcuugaggagaccgcauguuguuauuaauuuuuguuuuucugaguucucaacugcagaaaaaugucugaaauacacccuuacccccauucccuuuucacugaaugcugagguuugggccccagcuagccuuuuuucuuuuccuuuugugguucuuccugaagcagcccugcagggaagcccuagggucccucuuccccuccccuccccucggcucagccagcucacacccgugcuucuuccuacagucuccacagcaaaaugugaugcuuucaacuuuuuuggguuuuguauucuuuugccuuuuuguuuugaauuuuuccuuuccuacuaagauuaugcccagaaaaaacaaguugugcauguuuccugcuguuucuucacaccuucguauguaucaccuucaccucucuguuuucuauaguuugugcaaaaacugacugauuuaaagggguuucaaagaagauguuuuaaauuguuaugggguugauuuuuuuucucaagauuguaucguuuuauuuugaaguggcaacuuucuccucuauugcccuuagaguguuugccugugcacuuagacugucacucuuugugguggccuccaggucucagugggggauccaggaggcuggcugcucugcucagggaguacagggggccagaggcagaagcagaaccaaagguggcuguggguaggcaggaugcuuagggcaucaaggcuagaucacggagggagggagggcaggcgggcaguacuucugauuacccagaggaggccaucggugcacugaguggcaauauaccugccugccugcgcuuucccuaggugacaagcacaauaaauacuacagucuucacacuguuuacagcucugggcaccaaccaccccgcacuggcucuucacuauggcucugcucuuacuuagcuaauagaguugggguaagggcaagaaacuguuuuuaaauugggugaagagccagauagcuacuguucccgggugccaggccagccaguucuuugguuuccuaagggaaacuuacccucuucucuuguagcaccauccagccucagggucuuggggacuuggaagaaugugaauagaggaggagaggcuagaggaaaugaguagacagggauggaucugugaagagcagaggcugcagggaggauuuuugacagaucccacugagacuuaagcacuggugggagggaaaguggaagcaagguuguccaggaaaggguggcaaggugcagcaaaggauggggguggggagagaagcacggucuggcaucauccacucucugccugguguugaaggaacuccagcacaguuucugcucugggaccccuacagguugcccaauauauuaugcuugaggccaccuuacuaggaagaaauggcagccaagugggggacuuaaguaugcugcuuaagguccuggaaggggugguaggaugccagcgccuagcaugagagagccugcugugugcccacagucugacugcacagagcgccucugucggcaggaggugcugcgguccccuuccuguguacugagaagcugggcuugccaauauaguuugcuuucgauuccaagaggagcucugggaaaaccuguggauaaaaccaaaugccaaauguuggacauuguuuccuuuuccuuuucucucugauuguuuuaauuguuccguagugguuuuaauggauuugagacccuggagcggcagcugccuuucugauuuccagcugcuuuuugugaauaauuuaaaaagaaaaaaaaaagaaacuuuacauuuuggagacaaaccugugugaguuuuuuauugguacaaacguuguauuuaacacuagggguuuuguacaguuuuuugccuuuucuacuagaaaacaauguaaagugauuucacaaugugaagagaaaaaaauugccacuaugaccaaacgcacagucuguucugcagcaacaacgggauucaaucaacucaaagucgugauucagccguagaaaugcuuuucuugaccuuguuugagcuuuccuuuuuuccuguuugauuuauaaaagaugucuuuugugugugaacuuguguuguacucuguagaaaauuauggauuuugcuuuaaugguuuuuaaaaaaaaaaaagggcaagaagagcccgugucgcuuuucuuaccuaaucacaguuuguguaguggauuaaaaaaagaaaaaguuguuaaaaguuuggagcaagggaguauguguuuaaaaggacucuccuuccuuuuuguguguguuuccuuuugucccaauggggaaccuaaaucuguuuuaauugcacagacacacagacaaaaagucauuuuguaucugccaagugugguaccuuccuuuguuuauuugcuauuaaacuguuugagaagaac

SEQ ID NO: 908 - RNA, 12363 nt, Mus musculus
uaagucucagaaguuuuuauuuugugguugccaucagauggauuagagauccagaacuugccaggguccaagccugucucuuaaccaauaacagucaguccacaaugaucccacaguccacgggagaucuuccugagaacagccgcccaaaccuagccuuuggaagcuugcagucuagaaagccagugagaugggcgagcuuaguagcagaggcucagcgcugccucaugucucugcuuugcagccggagccuggcgacugaggcagcugcucagcuuugccuuagguggacuccugggcaacguguuucugcaccugcugccggaggcgugggccuacaccuguaacaucacccccggugagugagagcaugaggcaggauagaagugcagaacuggugccucucccccggguuaaccuaggcccugcuggcuccacagggucugggaggggggugugggaagagagauccagaaaagcuuguuuaagagggaaggucuaauccugaugcccuggccucuuugggaggucuaggccccagcugcuuguucaguagcuaguuccccuggcaaccccucaaugcccuggacuagcucugaucuaggcccuauuccaaauggcucccuucuagccacuggcuuggcauggccuguuagugcucccccugcagguggugaagggcagagucugcagcgacagcaacaacuggggcuaugggucaucgcuggcuuccugaccuuccuggcguuggagaagauguuccucaacagcaaggaggaccccagccaggugagccccaagccccagagccuggauauagcaguugguuuuuguuuuccuaaaguagaacccaaggccuggagaagcccagggucuaaguuaagucuaagacaucuccugacucucuuuccuuacucuugagagcaacauuauuagccucugaaguaguuuaacuauauagaucagugguucucaauuggagucaaagacccuuucauagggguugccuaagaucagcugcauguuggauauuuacauuacaauaacauagcauaacaguagcaaaaauuagagccaugaaguagcaacaaaauaauuuuauaguuggggguuaguacaacaugagaaaccauaugaagggguugcagcauucggaaggcugagaaccaccguuguacauggguaguaacagcagugugggcuugaggucugacucugaggagcccagccugauggaucgaucagcaaagucuagccagaucaaagagguauucaucgucucuuauccucucucucucuuucugccugccugucugaguggggggcaucuaaugucuccucucuuuccuucuucuggcuguaggcccccagcaaagaccccacugcugccgcgcucaauggaggccacugucuggcccagccggcugcagagcccggccugagagccgugguccggaaccucaaagugaguggcccaugcgggccccccuccugcagcugcagagcugaauggcugacucggcucugccucccuggcucagccugccuuucucuccccucauccaggucaguggcuaucucaaccugcuugccaacaccauagacaacuucacucaugggcuggcuguggcugccagcuuccuugugagcaaaaagguaagggaugggaccucuggcauuucuggugggaaugacaucgaugucuaccggucagaucaaucuccgaaacagucucuacuucuugcuuuuauuaacaguaccuuugugaagccuagucucuauuccucuccuggaugcugccuuagucucuaaacugucucccuucaccuuuauuguucucaaagaauucuuuuuguuugcauguuugugcuggugccacgugugugugugcgcgcuugcgcuuuuggaggauccucaagcuggauuuggauccccuggagccguagcuacaggcaaguugugagccaccuagugugggugcugggaacugaacuuggguccuuuggaacagcacuaagaacucucugaucccccuaccuccacugcacccuuugucccaagcuacuauuguugccagcagucucuguuuggaugccucuaucaagcuccuauacuuggccuugcccaccaguagacgcuucucccuucaccucccacugccuucugugcucuggucccagcauuuuguuuaccccuaacacuggccauucacugugcccucugcccggaauguucuuccucccacucuuggagcagcugacuccucaucccucuggccucaguuuaaaugcacuucaggagguaucugcugcucgcacccuccaguugggcacccauccauacucugucacagcccugcucaauguggaaccguggagguguuuguguuuuguaauccugacuuaccaagcauguccaacccgcagcuuggggucgcacgugucccggugugcugugaaugcagcccagcacaucuguagaugacaucauauuaccuuauuaagucugagaagcaagcuuuagucacugcugucuuuccuauggcuacaguauccugcccaaacuugcagacuaaaagcagaauccauguuucugagggacuggguauggggaagccuaguaacccaguaaaggccccacagacucagacucaaaucucugcagaucgggcuucugaccaccauggccauccuccugcaugagaucccccaugagguaagugcccagauccccaagguucccaugcucaacaugggugugcgaccuguuuggggauuuggggugggccuugcccacugagguggucuagaggaggaggggggcucggcuucauuagauacuggcccgggugaggggagacaggaggguggguguuccugugaucugguucuugguugaacaucugacccuuuccucaggugggugacuuugcuauccugcuccgggcuggcuuugaccgauggacggcagcuaagcuacaguuuucuacagcccugggaggccuucugggggccugcuuugccaucuguacacagucccccaaaggaguagguacgagagugguagacagugguguucaagagguacaccagccaaaaggcuccuuugcccugcugcuauugggguagugucugccuggugucccggguaggaggguggggauacauacagugccggagcucacucccagcuggcccuccccuacagaggagacgguggucuggauccugcccuucaccucgggaggcuuucucuauaucgcccuggugaauguguuaccugaccucuuggaagaagacgacccguggugagcaaccuacugggaugaucgcugggcccaggaggagcugcugccucuggcagccuggccuaagucuccccucucccaacaggcacucccugcaacaggugcugcugcucugcuccgguguucuggugauggugcugcuuucauuguuuguugaauaaccacugcucacagcccacucugcacagcgagcaaugagacuccagucuguucugugaccaagugugagaggcagagggugaaugcuagagaggagccucucacugcacagaggguguguggugugcacacgcagccagagugggagagagaccgacacugugaccccugggugcagagcccagagcccaacguagcaccugcccagacaccccacugucaccuagcagcaaggaaugacagcaccggugccagcacaggccucacuucucauugacaaagaaaccagcccaaggagcccagggcuacagcccaaagagagggacagagcccaaaguuguuccuccuuggggcucuagcccaagagagaaaagaaaaaaacaaacccucugcuuacacaucuaggccccaagcacuguagaggcagaggcaacacagcuuuucccugcuguccauuuuccuuacccuuccuacuuacccccucuacagccaaagaaaugggaggugggugcuguguagccccagccccgacucagcacugauguccuaccccuccccaacgcugagcaggcagcugcuccaagaccucucucuaggggcagccagccuggcuagcacguuuccccaacaaauauucccuggccacacgggcagcucucaccaccuccagcugccaaacagcagccugcaagucagcaaguaguccaggcuagccgucucucagcacagcucuccgggaugcuccugccagcacaggguccagcaggcaugcaugccccaggcagagacagugagccuugcugcccucuccagcucaggggcccuuguccuuuggguuaagaguaagauggggguggugagggcuccacauugucagugcucaggaaugugaacuggaagaaugcugaagccauaauccccaacuauuucccuuggcugacacccagguacucagcuggcccaaucuacagccagacuccagcccugcugcucaacuguggauguuagagauguggccacugaagagucugacugauccacagcaguuaugcuguggcucaucuuuaucuguaaauacuuguucuguagauauaaauaaauuacuuagaccggcugccucuuccacauacuagggcugucaaacagcucuuccuaagugcucuugacaggucuguuacacuugcugugcaucucaaaugguuuccuauuuuccugccauguuucauuguuggcuuuuuaucccaguaaugcuugagcaccaauuugagccuuccucaccauuggugaucuuauggauguaaaaagccaagguauuuauuucccuguuccccuuuaacaguucucaccuggggacuuagagcuacaaagucaucuccuuuuacuucagugagauuguaguucauuuaagaaagcuagguguggugucagacuguaauaucagcaaccaggaauggagacagcagaggaaucuggaguuaaaaggccagccuucgcuacuuaagacccugucucacuugagccuccccacaccacccauuucccuaacaugggcuggagaagagggucuuuaccaagcucccuuccucugacugcaccauuauccucacacagcagggggcacugcaucuccaucgguagcugaaggagaauccuccacuuuucccaaccaauaaacagccuucagcagcucacugguugggacaaaccaucuguguggugcacagaugagcccagaguaaguaggugggaaacagaaucugccacgcccuuaacugggaaugcucagcugccagugucccaucagcacaacagucaagagggagauagucaagagggagaucuuccaccuaagcugaccuaagauaagggaccaaagccuaaaagguccaagcccagcugucuuuacugucagcaggugcucaaugagggcugccgcugccugccugucacaugagcccugcaggaggcugauaagcacaggccaccccugucccuguccaccacuuuacucagccucaagggauagagaagaggauccugcgaugcugugagggagaagggaaggugaggguggugccuacacucgcuuguuucauggccaagaguaaaucccaucugguuaggaagacaggacaccuacauguaggccagagaacaaaaaucacacuuuagcugcugagcgccuggagcaagauggagccacaccauaaucgacaggcagcacauggguaggggaaagcuagagagcgagcaagguggccugcagagguaugccuguagcuugcaguagucauguccgcucgggaaaggggaggggaagaagaaaggagcagugcuuuuuuuuuuuuuuugccucuuuugggcaauaaaguggaaauuuuuugaggauuaacaacuuugaaaggccuuucaaagguugccaaagccacugguaaaacagcuggcuggaaaguugaaugaugggccagacaagguggcacacagcuuaaauuccagcacucuugaaacuaaucucaggggccacaggccaaccuugucuacauaaaguuccaggcuagcaagacuaccuguaagaccuugucaaaaaaaaaaaaaaaaaagugacugauggguuugaaucccugcugugcccucacaacagugcacuuucagcgcagcugcccaaucgcaccuguaaaaugaggacacccaggccagggagauggagcuaucgauagacacacucacagcauaaccugaguucucaggauccagguaaauacacggacucucuagucgcuauccugauaaaaguuaugcauuaagaccuauuuaggggcuggggaauguaucuuauaguuggcagaguucguaccuaacaaauacuaaauccuagguuccauuccagugccacauaaaacugggaauggugggacaugccuguaaccucagcacuuggggcagcaagaauagggcuggcaagaccacagcagacugaaggcuguggggcuucauacggagcagggcagacggcagaacucaguuggugagaaaacagcguggaucuugcuaaagguuaguucgugaaccagaaaaaaugagaaagagcuaauaaagucauggaaaaauauguggcccaaaagucuggacacuaggggauuauuuuaacaacuaaaacccuaaauguugguuuuacaagacaagaacuagaauaccaaauaugcaagguggccucuuccuucuggacucuuaaggucagagugauggcaaugaacaguggaaagaugacauaaagaggcugggggagggggcacuggggaggacucaggcaacagcugugcuugcaccuccugccauggggccucacccagacagcugguuugggucccauggccaucuauagaauuuuugaggcuguagcuucugagcaaaaggccuucuccauacauuccacucccacccagaguccacagaggcugagaaagacuguggcgaagaacagaaaacaccuuuuauuaucaacuuuagcccucagaccagcggacagacuagagguguccccuaggcauaguauuguagguuggcuuucuucuuggccugaaccuccaggaugcccuccauguaguccucaugagugaguuccguggcuccccugcgcaaugcgaucauacccugcagccggacagagaagacccagaaugccucccugcacuuccaacuuccuaagugugggucccugaccuacccagggaaagagcaaggcuuccaauaacccacccacccacgcugaccacucaccgccuccacacacacggccuugcacugggcuccauugaagucaucagugcaccgagccagcucuucauaguucacaucaggacuggagaaacaagacaccacagagcuugauuagucacggagagggaacagcaaagggaagauguccuacuauguacccaucgcacaauaaucaacuugcuuucugcuagcaggcaagucuuuacugacuuuucuucucaguauaaaugagauuggacaaagcuauuuacaggaucacugauacaccagacuucuagaacccugcaucugagaucccaggaagaaaguuugccugaguugggaacaugggguuauacagacaaaagacaguaggauugcugaugaagccgugcaucauccagcacgauguggcugcccaucaucugcccucaugccaggcacugugccugagauucaccguggcuaauucucaaguuucaaaaacaacagacuuuagagguuuaggucacgugcuggaaacuggauagaucuaacuucagcucaucugguccugguuagauucuccuacgccaugcuugggcugugcccaucuacugggcugugcugugaaggccuauauucuucaaugggaggaugaggcacaggugacuuugagggucugagccccaacaaaacucuaccucaggcugugggggagaaauggaggcuaugugcaugcacagggugggguuggaguggaucagaggcuggggaacaacaguacaggaguuuaaaaauugggggcucaaaaagcuguugcacugcccggugugguggcucacgccuuuaaucccagcacuugggaggcagaggcagguggauuucugaguucgaggccagcuuggucuacaaagugaguuccaggacagccagggcuacacagaggaacccugucucgaaaaaacaaaacaaaacaaaacaaaacaaaacaaaacagcuguugcagcugaccugacauucaucuuccgugaguggaucugcaugauucuggcucuggccuccucguugggcauuggaaacucaaucuugcggucuaggcggccugagcgcagcagggcuggauccaggauguccacccuguuaguggcugcaauuaccuaaggaagaggggaagcagcaaccugaacagaagagcaggccauccacucacaagcacaaguuccaguaggaacagggcagccggggaauggggaaggcagagcccgagcugucaguccugagacagacggugagcccuguccucaccuucacuugaguguugggcugaaagccguccagcugguucaguagcuccagcaugguccucugcaccucucggucuccugccuuuucacugucgaagcugcgguacacaggagcccgagaugccagugacaucacggcauaagcacaggcuauuccaauuuguccagggaaaugguugccucaacuugaggcucccagcccagggacugguacagagaaagguucaccaauaauuaacugcagcauucaaagcuugcagaggcgucugggaucagugcugggcuagugacaaacagugggcagaaauagccagggccagggcucuggcucugagcaaugcaugaucccagagaacuuugcucagaaauaccuagaaucaggaacccagacagccaaccccaaggaaggguuuuugcguuuauaaacaauggcuggcaaacacccagugaauggaaagagcugaaaacuaaucagauacugggaggauaugugugucggggagagcgagacuggaagaacgggccacacaaaucuaguauuuaugcuaaggagcaauggggugaccuaggaaugguucuaaauaguguaugacagacuuugaaaacaugugaaaugaccagauuucuuuuuugagagcaagguguuagcugugagaauuuaggaagcagaaaaauagaaguguuacuacccagggagagggggaaacaggaugagaaagaacuagaauuuagcauagcuuggaguugugcucccagcucaccccucaccccaagaacccucaagucccuagccguccuuuaccguuugguaccaauggcauccaauucgucuaugaaaauaauagauggugccuucuccuuggccagggcaaaagcaucacggaccagcuuggcgccaucuccaauaaacaucuguaccagcugagggccugccagcuucaagaagguggccugagagaagggacagaucagagcaaaggcacaagaggcccaaagagucaagccuaugucauacagcugcaaguaccccuacccccaccuugccccccacccccacacaccuuggucugagcagcacaggcucgggcaagcagagucuucccuguuccaggcggcccauacaucagcacuccuuuugggggcuggauacccaaguucucaaacuucucuuugugguucauaggcaagacaauggcuuccaccagcugccaggaagaaguccugggugaggaaagugaugcccugagggauccuacagcccaaaucuagucugcaucuuuccuacucuaaugcaggagucuucucuccucucacaccuggucugcacuggucccauggcucagagaguaagaguguuugcugugcaagcaugaagaccuaaguucaaaucuccugcacccauguaaauauccaggccuauaaaacacaaguccauaaccugggugcugugggucagagucgggaguuugcagccuaguuccagguccagccagggaccauguaucauagggaagaguagaguacagaucaggcuauuugacauuuucuguguauguaagcacuuacacaaguacuuacaccacacacacaggaaggagggagggaaggaaggaagacacuggggcaaaaacugggagccugaguggaguuuuugcucuggcccuuuauguggacaaucuccaaucucucuggaauccaggcuucgagcaccugacagucuuuguuuugucuugguuguuuucuuuuuccuucccacaguaagggaauacacucuggucaguuagaugaaaaaguaaaaaggcuggcauggccucccuuaccuccuggaucugcuuguccaggcccccgaugucacuguauugcuccgugggccgcucguccaccuccauggccuucacccgagagucauauucagugggcagggucuccaggaucagauaggagucuuuguucacacccugagaacagagcauggagcuuuuguguuuaucccgguucugucuaaugcuccagaggacagugauuuguagucuaaacagagagcuacagcacuggcaaauugcaagaaucaaagaggcugcagacagagucgcugcagcaguggcaaggcagcuuacuggagaaucccugcccgugcgcagguaucacucaccaccaggucuccuggcuucagcuuuucugcauccaccaacccaaucacuggcaggaaguaugucuguaggaagaguuacaggcagucguagcuacacggaaacucccccaugcugcccccugcccaacugugacugagccaaccuuaccugucggguagaaguuuugaucaccgcacacuugcccuuccucugagaguccaggucaauguuggcaccauccuccuccuggucauuggggucaacguccagcaacuaagaaagaaaauaggcucaguucccuucccaaaauccacuacugugugugcucaaacaguucccuaaacccacaaggccacaggccuuccuucccuccucagucuagccuuaagcuuaauaaacauagaugauguguuaggggguugacaacaccuuuguugaggugcugcuucuguuugcaaaguucaucugccccaagaaggaacaaaagaagaaaauggcagaaaucugugacacuucuaaggucuuugcagacuuaaacauugcuuuuuacacucuacccuaugggccccaucccuagaugucuccaagccuccugccuccuccucuucccacacacagacacacaccucgaugacauuggagacaagguacggcaggguuuuguucacuuugauuuucucacuguucucuuugauuuugucuuucauggcuuggaguucaugggugacucgcaauacuucacucuucaugaucugggauaagagaaaaccaauguucaacccugauucagccugcauucauuacagcccucuaauagaugagguccagguuacccgggagacccauccaaccagaucucaggcuuucugaaggcccagccuguacauguccaaacugcagaggucaggacaagaggccagugggaaaaccuccugacaaagcggcugugggacagggcuagguauuuuccauggguuugagugugaauucaucccucucugagccucggguuccucaucuguaaaauggagaucugagaacuccgcugccugcaccggagccaggagcccaccuugaucucgcugucuaacagccgugugcgcuggacaaucucuuccguggacaucuugagcaccuccuccccaaugccaucuugcuguucaaauaagagaagaaguacuuauuuacuguaacucagagcugccaucccacggucccacagcccccucagcgccugcuuccuuaacccaacagcaggaugaagucgggacaacccaagaagcucugcaaccaguccagaccggaccuggccuuccagccaccuccuuucccggccuccaagaacgucuaaccuuauagcccaaacuuugggacgccccucaggucucccaacacucaccucagcuucaucccacacggucgccaucuucuccugccgagucacuggacucucgggcgucggcagcagauucauuuccugcaugaagaggccgaaacugggagugcgcacgagccccugagggagcccagcgcagccuuucucaacgucuucucuccacccguggagaacuucacccgcgauuccugacgcgacagaacggguucuguccgcgucuccgagcgaaucugccgcugggacuccacgaaccaaaccgaggcuacagggcccgccccguggcucgccgguugcuccgguuugugcgggagcgagggcugggcugcu

SEQ ID NO: 909 - RNA, 731 nt, Mus musculus
cuuuuuuuuuuuuuuugccucuuuugggcaauaaaguggaaauuuuuugaggauuaacaacuuugaaaggccuuucaaagguugccaaagccacugguaaaacagcuggcuggaaaguugaaugaugggccagacaagguggcacacagcuuaaauuccagcacucuugaaacuaaucucaggggccacaggccaaccuugucuacauaaaguuccaggcuagcaagacuaccuguaagaccuugucaaaaaaaaaaaaaaaaaagugacugauggguuugaaucccugcugugcccucacaacagugcacuuucagcgcagcugcccaaucgcaccuguaaaaugaggacacccaggccagggagauggagcuaucgauagacacacucacagcauaaccugaguucucaggauccagguaaauacacggacucucuagucgcuauccugauaaaaguuaugcauuaagaccuauuuaggggcuggggaauguaucuuauaguuggcagaguucguaccuaacaaauacuaaauccuagguuccauuccagugccacauaaaacugggaauggugggacaugccuguaaccucagcacuuggggcagcaagaauagggcuggcaagaccacagcagacugaaggcuguggggcuucauacggagcagggcagacggcagaacucaguuggugagaaaacagcguggaucuugcuaaagguuaguucguga

SEQ ID NO: 910 - RNA, 8634 nt, Mus musculus
cgcugaccgcgcgggucccccaugguaugaggcggaagcgccucccccgccgucgcuccgucuagccccccggagccgcgcgcgucggguuccggacugucccgugugacguggcugcacgccggggguggcuccgggcugggggccuagugguggggccgggcgaggcagagcggggcggggcgcgacacugcagcuggauggccgggcccgcccggagcgcugcaucugcugccgcugccaccucugccacugcgcggugagugaucgcuggacccucaggccggcguccggggcgggauggaccgugucaguucccaaaccugucgcgacucguccucaguuuaggaguugaacuugccugcucuuuggcucuuuaccucugacgucccacgcucugccccucagcccucccugcugccccgcuucuugucuucuccuuccaccagacauucuagcucauuuuauugacuuuccuuucucuugcuuucuccuuucucuccauaccccauacuucucugcugaaccugugguccccccuugccucugcaugacccgcuaaggucuuggccuggcgagggccugccuuggucccagugaagcuuugcucguuuguuugugcugguguuggcaguggcggccgcgaggggucggggagggcuggggcaggggucacuaauuauggccugaagauuccagacauaggcuuguagcccaccaaucagagaccgaugauuucucucuuaacauccauuggcagaugaggaaacugaggcaguuucaaggucacagccaguagaagacggggcagaucacauuuaaacuuuccagauugaacuucuggcuugguugacucacauccccauccggcugccaucagucugcagagcacauuccuucugcgagugcuucagaccuccccuggcauucagaggacuugcauucccuccucgaugccagcagcuaccugcauugucaaguucaccucauauucaucgcuguuagggagcucuguuaccucauccauucccugaugaggacacugaggcucaggcucauaagggacuacagucaguuaacaaucuagagcaccaaauuaauuagccauaaguuaguuaccacagccucuggcucuggcaacugugaggcaucucuucucuucagccccaccucuugucucuuggugcccaagaauaagaucauuuaggaggaagagguuuggacuaugacucaguuuccccaccuguguuucuuuguaccacgccaucaagcuaaacagugcuggcuuuagacccuggggugucuuuaccggcacauucuggcagccaagccucuccuggcagcuagaggcacccaacagggauggucccuccuccgguggcugaaggagcccagccagugccucacccagucauuaaggaaaguuuagccucaggcggacacauugacacauaggcuggagccagcucagaaggaaaauaugugugguucuugggagacguguagaugggcagagggugcuccgugcacccacccuggggauuguuuccgcugcagagugagcaggagggggaugccauggccgguugagaggugggaagagacgcugugcuuccuaaguggggugugugguccagggaggcagcucacgugagcagucuuuguguuuucuagcgcccggcaugccuggaugucccugcccuggcugugguauggcaggccaaaggcuccucuuccucacuguccuugcccuggagcuccuggaaagggcuggagguucccagccagcccuccggagccugggggcugcagcugccugucgccuggauaauaaagaaagcgaguccuggggggcuuugcugaguggggagcgacuggacaccuggaucugcucccucuugggcucucucaugguugggcucagugggguuuuccccuugcuggucauuccccuggagauggggacccuguuacagucagaaggugaguggcccuucagcagcugaggaucagaggggagggaaccugcugccggcucuggggaaaugccaggucucauguaccagguacaccagacauaguaugccuagcauggaguccagugucaccuugguccugugcgcauaggguauacauauucauuuguucacucaugcaugcaucuguuuauuauuucaaucaacaaacauuccccagacucguuaugaagaauggcuggcaauauggcugccauacuaccugggcucaaaucauggcucugccacccaccaacuauguagaacauggcaauuuacuuaaccucacucugccucagucugucagacuuuaaaauggggauaauaaggccgggcagugguggcacacgccuuuaaucccagcacuugggaggcagaggcaggcagauuucugaguucaaggacagccugaucuacagagugaguuccaggacagccaggacuauacagagaaacccugucucgaaaaaacaaaaacaaaaacaaaaacaaacaaacaaacaaaguagggauaauaaggcugagcaugucauuuaguaguagaaugcuugcagggguuaggguggggguuggagagauggcucagugguuaagagcacugacugcucuucugaagguccugaguucaaaucccagcaaccacaugguggcucacaaccaucuguaaugagauccgaugcccucuucugaugugucugaagacagcuacaguguacuuacauaaaauaaauaaaucuuuaaaaagaaaugaacuuuagaaugcuuaccuaacacguucaaggccuggguuuaagucccaacucccccaaaugaacauacuaacuucauagaucauagaugaagcacuuggaggacugccuggcacaaggaaggggcagguguguaaaggcucaugguggacccuaggugcagaggugagcaagugcugcagcccccccccccccguccgugcccaguuuugguuagugguauaagggcuagggauguaguauagugguucuguguccagcagcucagugcccacacugcauaccacacuggaugugauagcacacacuugagugaagacaggagucagaagcucaaggccaucuucaaguacucagccaggcagaggccagccucugcuauccuuucucaaacaaauaaaaaggaaggccggagcuggagaggcggcucagcuguugagagcacagauccaggugugauugccagcacucgugucagguggcucacaacugccuaccuacagcuccagcaggaugcucuggccuuagcaggcaccugcacucauagaauacauacaguuaaaaauaggaagaagucgaaaaggaaggaaugguuaaaauggcucaguggguaaaggugcuuacccugcaagccuggugaacugagugcguuccucaaagacguguaaagguggagggagagaacacuccauaaaguuggccucugaccuccacaggugcacccauguauccauacucacacacauuauaaacaauaguaaaauaaaugaagaaauagaaagaaagacucagccuuuuaccaauugccaggcucaggaccauucaguaaugcagauggugccuggcugcuggugccucccaguugugaacagagccucccuggaccugucauguccaugcaguaagugugucucucagacagcccaggcuguggacagcucugugguggaaugauuacuugaugugugugaggccugggcagcucugugcaguaugcauugggaguguuggcauucccauuuuacaagugcccucuggccgccagccuggaaacagcagggucccaguagggcggugucccucuaggccucggcugcucuaucaucugaugagaauaauauggcuuccaaaucuggaugugcaagcuaguaaaagucccaagguccuaccaguuuucuaaggguggcacuagcugaggagagaaauucccauuuaaucaacauuugcucugugcuuggugguuuaauucugccaagauccaauuuauacauggguaaacuaagucucagaaguuuuuauuuugugguugccaucagauggauuagagauccagaacuugccaggguccaagccugucucuuaaccaauaacagucaguccacaaugaucccacaguccacgggagaucuuccugagaacagccgcccaaaccuagccuuuggaagcuugcagucuagaaagccagugagaugggcgagcuuaguagcagaggcucagcgcugccucaugucucugcuuugcagccggagccuggcgacugaggcagcugcucagcuuugccuuagguggacuccugggcaacguguuucugcaccugcugccggaggcgugggccuacaccuguaacaucacccccggugagugagagcaugaggcaggauagaagugcagaacuggugccucucccccggguuaaccuaggcccugcuggcuccacagggucugggaggggggugugggaagagagauccagaaaagcuuguuuaagagggaaggucuaauccugaugcccuggccucuuugggaggucuaggccccagcugcuuguucaguagcuaguuccccuggcaaccccucaaugcccuggacuagcucugaucuaggcccuauuccaaauggcucccuucuagccacuggcuuggcauggccuguuagugcucccccugcagguggugaagggcagagucugcagcgacagcaacaacuggggcuaugggucaucgcuggcuuccugaccuuccuggcguuggagaagauguuccucaacagcaaggaggaccccagccaggugagccccaagccccagagccuggauauagcaguugguuuuuguuuuccuaaaguagaacccaaggccuggagaagcccagggucuaaguuaagucuaagacaucuccugacucucuuuccuuacucuugagagcaacauuauuagccucugaaguaguuuaacuauauagaucagugguucucaauuggagucaaagacccuuucauagggguugccuaagaucagcugcauguuggauauuuacauuacaauaacauagcauaacaguagcaaaaauuagagccaugaaguagcaacaaaauaauuuuauaguuggggguuaguacaacaugagaaaccauaugaagggguugcagcauucggaaggcugagaaccaccguuguacauggguaguaacagcagugugggcuugaggucugacucugaggagcccagccugauggaucgaucagcaaagucuagccagaucaaagagguauucaucgucucuuauccucucucucucuuucugccugccugucugaguggggggcaucuaaugucuccucucuuuccuucuucuggcuguaggcccccagcaaagaccccacugcugccgcgcucaauggaggccacugucuggcccagccggcugcagagcccggccugagagccgugguccggaaccucaaagugaguggcccaugcgggccccccuccugcagcugcagagcugaauggcugacucggcucugccucccuggcucagccugccuuucucuccccucauccaggucaguggcuaucucaaccugcuugccaacaccauagacaacuucacucaugggcuggcuguggcugccagcuuccuugugagcaaaaagguaagggaugggaccucuggcauuucuggugggaaugacaucgaugucuaccggucagaucaaucuccgaaacagucucuacuucuugcuuuuauuaacaguaccuuugugaagccuagucucuauuccucuccuggaugcugccuuagucucuaaacugucucccuucaccuuuauuguucucaaagaauucuuuuuguuugcauguuugugcuggugccacgugugugugugcgcgcuugcgcuuuuggaggauccucaagcuggauuuggauccccuggagccguagcuacaggcaaguugugagccaccuagugugggugcugggaacugaacuuggguccuuuggaacagcacuaagaacucucugaucccccuaccuccacugcacccuuugucccaagcuacuauuguugccagcagucucuguuuggaugccucuaucaagcuccuauacuuggccuugcccaccaguagacgcuucucccuucaccucccacugccuucugugcucuggucccagcauuuuguuuaccccuaacacuggccauucacugugcccucugcccggaauguucuuccucccacucuuggagcagcugacuccucaucccucuggccucaguuuaaaugcacuucaggagguaucugcugcucgcacccuccaguugggcacccauccauacucugucacagcccugcucaauguggaaccguggagguguuuguguuuuguaauccugacuuaccaagcauguccaacccgcagcuuggggucgcacgugucccggugugcugugaaugcagcccagcacaucuguagaugacaucauauuaccuuauuaagucugagaagcaagcuuuagucacugcugucuuuccuauggcuacaguauccugcccaaacuugcagacuaaaagcagaauccauguuucugagggacuggguauggggaagccuaguaacccaguaaaggccccacagacucagacucaaaucucugcagaucgggcuucugaccaccauggccauccuccugcaugagaucccccaugagguaagugcccagauccccaagguucccaugcucaacaugggugugcgaccuguuuggggauuuggggugggccuugcccacugagguggucuagaggaggaggggggcucggcuucauuagauacuggcccgggugaggggagacaggaggguggguguuccugugaucugguucuugguugaacaucugacccuuuccucaggugggugacuuugcuauccugcuccgggcuggcuuugaccgauggacggcagcuaagcuacaguuuucuacagcccugggaggccuucugggggccugcuuugccaucuguacacagucccccaaaggaguagguacgagagugguagacagugguguucaagagguacaccagccaaaaggcuccuuugcccugcugcuauugggguagugucugccuggugucccggguaggaggguggggauacauacagugccggagcucacucccagcuggcccuccccuacagaggagacgguggucuggauccugcccuucaccucgggaggcuuucucuauaucgcccuggugaauguguuaccugaccucuuggaagaagacgacccguggugagcaaccuacugggaugaucgcugggcccaggaggagcugcugccucuggcagccuggccuaagucuccccucucccaacaggcacucccugcaacaggugcugcugcucugcuccgguguucuggugauggugcugcuuucauuguuuguugaauaaccacugcucacagcccacucugcacagcgagcaaugagacuccagucuguucugugaccaagugugagaggcagagggugaaugcuagagaggagccucucacugcacagaggguguguggugugcacacgcagccagagugggagagagaccgacacugugaccccugggugcagagcccagagcccaacguagcaccugcccagacaccccacugucaccuagcagcaaggaaugacagcaccggugccagcacaggccucacuucucauugacaaagaaaccagcccaaggagcccagggcuacagcccaaagagagggacagagcccaaaguuguuccuccuuggggcucuagcccaagagagaaaagaaaaaaacaaacccucugcuuacacaucuaggccccaagcacuguagaggcagaggcaacacagcuuuucccugcuguccauuuuccuuacccuuccuacuuacccccucuacagccaaagaaaugggaggugggugcuguguagccccagccccgacucagcacugauguccuaccccuccccaacgcugagcaggcagcugcuccaagaccucucucuaggggcagccagccuggcuagcacguuuccccaacaaauauucccuggccacacgggcagcucucaccaccuccagcugccaaacagcagccugcaagucagcaaguaguccaggcuagccgucucucagcacagcucuccgggaugcuccugccagcacaggguccagcaggcaugcaugccccaggcagagacagugagccuugcugcccucuccagcucaggggcccuuguccuuuggguuaagaguaagauggggguggugagggcuccacauugucagugcucaggaaugugaacuggaagaaugcugaagccauaauccccaacuauuucccuuggcugacacccagguacucagcuggcccaaucuacagccagacuccagcccugcugcucaacuguggauguuagagauguggccacugaagagucugacugauccacagcaguuaugcuguggcucaucuuuaucuguaaauacuuguucuguagauauaaauaaauuacuuagaccggcugccucuucca

SEQ ID NO: 911 - RNA, 11701 nt, Mus musculus
cuggucugcagagggaguuccaggacaaccagggcuacacagagaaauugucuugguagaaaaaacaaacaaaacaacaacaacaacaaaagauccaaccccccuccccagcauccuuccuccaaaagaucugaacaaggcugguggaaaaacauuuguuaagagccagaggugcucagugguuaagaccgugccuagcaugcacaaagguucagccccagaauuacaaaaacaaacaaacaaacaaacaacaaaacaaaaaugcccaaguugguaucaccuuaagaaacugcaggaaaggagcuagagagauggcucagugauuaaaaacaaugcuguucuuucagaggaccugaguuuaaaucccaguaccuacaugcuagcucacaacuaccucuaacucuucuuccagugcccuuuucuggucucugccgucguacuuaacuuauaguauacuuacauacaugcaagcaaaauacucacgcauauaagaaauaagucuuuaccagguggugguggugguucaugccuuuaaucccaguaguuugaggccaucuggaucuacagagcaaguuucaggacagccaggaguacauagaguaagauauauacaaaaaucgguuuuaaaauaucuuuaaaauaaaagaagagaaaaggucugaggcauccuaaggaccuggaaagcaaguauguacaauguagggcaacucacuuuuaaguccccuccuacauaugcaauaguccuggcuagccugacuauguaaaccagggcagccagguuuacacagagaagucuuuuaaaaaccaaaaccacuuuuauuuauuaauguuaugugugugccuauacccucaugccacagugggcagaguugguuuuucccucccacaacauggacucuggggaucaaacucagguuaucaggcuugguugggaucagaugccuuuaucugcugagugaucuagucagcccucauacuugucuuauaugcaguauuggauucuucuugaccuaugagcuguuaaaaaaagagaaaaauaugcauauauacauauauugucauauacacucacuguguauguauauaguccagaagagggcacuguaucaccuggaaguggaguuacagacaguuaugagcuggcauguagguacuaggaauuaaacucagguucccucugcaagaauagcauguguucuuaaccacugagucaucucucuagcuccucucuuauaguuucuuucuuucucucucucucuuucucucucuuuuuuuuucaagacaguuucucuguguagcccuugcuguccuggaacucacuuuguagaccaggcuggccucgaacucaaauccgcuugccucugccucccaagugcugggauuaaaggcgugcaccaccacagcccagcuuuucucuugcaguuucuuaagaugauaccaacuugggcauuuuuguuuuuuuuuuuuuuugcaauucuggggacugaacacuugugcaugcuaaguaagaucuuuaccacuuaacaccucuggcucuuaacaaauguuuucccauuauccuuguucagacuuuuguuuuuucaagacaggguuucugugcagaccaggcuggccugugugugagauucugcgaucaaacauacagccuuguguaugcuauauaggugcucugccacagaacuggauauccagcccuuaaaaaauacuuugugugugaaggcuagagguugacagcaggugucuuucucaguuguucuccaucuuauuuuugaaacgguuucucacuguaccuggaacccacugauuuggcuggaguagauagcuagcaaguucugggcauccugucuccacccccagcuggaauucaggugcaucaggacaagauuuguauaggaaugcuggggauccaaacucaaguguacuuauaccaaccaaguccucgucccuaacuccaaaaaauacuuuaaauucugacugaccucucuguuuccuaggcgaccuggcauucacggcacaaccucauuguugugggccgauacccagauccuaaucuuaaaaguuguguucccuaugaacuaaggacaauagauguguuugauggaagcucagggaagaugaugugucagcucuaugauccaggauacuccgguauuacuucggugagacuugggcccccaaacagugaugggaggaagcagggaauuucucauuagaaguaguccccauuuacugccucuguacugccuucaacccagcuucacaccgauacucuuacuuuuguagcucaaugaguucaauccuaugggagacacacuggccucuacuaugggugaguaaaagcaacuguaucucaaacugucuaagccuggcccuauccgaggcugcaguggaggcugaauucaccguagcucugcccuauucgucccagggcagugggcaguaaauauaucuuggagacagugguaucuggccuaggucacccaucugguuuuauuuuagucauggcaaugucagucuguuaguuccccaagacagccccaaccucugagacagaccagcaacagaaggugucauucagacuucuuguuucuucuagguuaucauauucucauuuggagccaagaggaagaugggucacagaaagaucaugaaagacuaugaagauggugugggacagcaauacuggaccccacagaugggaacacauucugugaggaguggcagcuguuuguuaauaggccaaaaguacccaauucuuaggguuggagcagggacacuugugacaagggauacugugggacuaggaugcugacauguuacugcucuagauuuugcuccagaaaauuaaagaguaaaccagcuacgcucagggucccagcuauaucuagccuggaggccaaguuuaugcuagagccaagguacuuuucuuuuuucugauguauaggagcaaaauaaccagagaauuuuaaaacuuuuauguucaauuuuagcauggccaauaaaagcauauccuuuguaucuaacuaaaaacccaaaagcccaacaggguuucugaguagaucuaguacugaccugguaagagugcuucuuggaugucagaaauggggaagggaaaaaaggcacagaaccagcacucacagucaaaaccuucauuuccucggagcuacuucagcccuauuuggggccacggucaagguguacggucccugaagaguccagcccagcugaggagagucaccucaugauuccauguguuucacuccuaccuguguccucccacugucauccagguacagcccaaguauccuucagaccugccugugguugacacugacgguagccucagccaaaggaugacuuugcuguuggaugacccgaguucuugauagccauauuuuauacuccuagugauuugcaguuuuugccucuaaaaaaguaccaagggacaauguccuccaagccauuugccaaagauaugggcuagaagauaaagagcaaggcucgguggaagagcaaggcagaucaaguaccagcuucuucagguuuucauggggguuuuguuguuuuguuuuuuagucccaggucuugagugaaaucugaaugcuugucugcaucucaaguccuuagggaauauagaagaggcaaaucccauuuagagaaagccaguguccaacacaguacacgguaaacaucaggcaugaagauggugagccccaggugccgcacacccagccgagccucacucauucauuugggcguagguaaucaggaaggcuaacccugucccugggcugggaucagcaauggucaggagcgaggacucagcccaccuccccuaggaggcagagggaaggggacugagugguugucaagcauggucuucccugucugcaacauggugguagccaggaggcugggccugcauccggaagaggauggugaggagcaacacuaugagaaggaagaggauggagccacagacagccaaugccacaauuaccucugggcaggggagaggaagagaaaggcagaguuaguauucauuccacaaaugcagagcaccuaccccaagccaggggcugcugacaaaauggaaauacagaggugggcaagacagccugcuccuggagugugcauucuagagaagagauccaguaaacaagcaagcauuccaugguaaugacacauuauugaugcuacaugaauaagaucagucagaaaucacugaggaaauaggaccagaccugggaucaagaaguaaaacaugaggccggccuggucuacaaagugaguuccaggacagccagagcuacacagagaaacccugucucgaaaacaaaacaaagaaguaaaacagaugagagcagagacauggaguagggguaggaggacacaucugauaggagaacaggcuugguguucuggauucagcaagauggagcugaguaugcaaggggcacuaggaaacagaagacauccaggccaagcagaggcagggcagucaugguagagaaccugggucuggggugagauuaauacaugcacauuuuaaaaacaaacaaacagacauggucuccuguagcccagacugucucaaaauugacuguguaguaaaggaugaccuugaacuucugauccucuuccccccaccugagugcuggaauuagaugugugcaccaccacacccaguuuaugcagugcugggaauucaauuaagggguucuuuuuguaguuuaggugguagaucaagugcccuaccaacugagcugcacaccuagccucaauuuauuuauauuucuuaagaaaugaauucugcugucuugauauugguaagggcaagaauaguuuuugagcaguuaaggcaagaacugauaguauuagacuggagaggcgagagcucaacaucugagaagcagaacaaucugcuagugacuggguggcaggguaucaggaagauaaugccuaaugguucacggugugacuaugagacuaauguagcacccauuacauugacaauuguaagauaaacaaguagaucugaaaagagaugcuguuuuagacacaacguagaugccucaugugacauccauggagagaagaggcagcuggggaaagccuagcucagaaguucuaaaucuaagcauauuacaaaaguggaacuuaacuuaccauagagaugagguaggaaagccaugagauuggaugagauggcuugggagucaggacagauaggaaaggggguagagauaagccucaggccauucauuauuuagagacggggaaaauaguaaggaauuuguagugaguaaaaaaaaacaaaaaacugaaguccugagaauggugguuacuguauugcagugcagucggggagggaauccaggacuuuauacaugcuagccauggauucuacuacugagcuguguuuacaacacuuaaaaaaaaauguguuuaaggaagaaauggcaacugugcugagagaagcugacuaagaauugauuauauauauauauauugauuauauauaagaagacuaagaauugauuauauauauauauauauauauauauauauauauauauauauauauauauauauauauaauugauuauauauaagaagaaggugagagaagcugacuaagaauugauuauuuuggcaacaguuucauugcagcaaaaggugauacaaaauuguuuaagaucaagucugagauaaaaagucugaagaaguaaagccagaauguaggcaacucuuuaaaggagcccucaaagagaucagaaagugagaccacagaagugagucucagaagucuuuguuaagcuuugcaaugcaacuuauccagagaagagaccaugauccuaguaaaugggagaagagacugacacaggcuaaguggagaggcugcaccugaauacuaucuuacaucagcagguaagcugauagauggggugggagaaugacaguccucuccugguaaugcuuauuucucagugauuagaauaucaccugagggugaagaauggagagaguacauaaauauggucuuaggcuuaaggaggcugugcagggaaaggcaggaagauggcugcaaauauaucugcucccugaagauuucugcaugugaccugaacugucccagguauggguaauacagaagcggguggcagcucaccugugucugcaguaucauuugcuagcuggcacuccuucugccaguccuuggguaugacaggcucugugaggcgaaggaaauccugcagugggcaacggugaggacagccaggcaggaucagaggccagggugccuucuuacugucauuccgaaaguacaucucgacugagaaauuccugagaguugacaggaagcaagauagggaugcucaccaugcccauaacugagucucuggguuucccucagccaucccagugccucuuuagaagacaccugguagccccacuuacccauuaucuuccugguacaguucaaauauguggcaggaagcauagggagcuugcuucccauuguagacauucaaugccauuugcagagcaaccaggguagugucaugcuguaagggagaagggcugcucaugagauuguugcuccuccacaucccaggaacuggaucgggggaaguacccaauuccuguuuucauacuuguguguugggugggugggaaggagcagggggauaggguugaugcuuaccgcggaauaaaccagaagcuuagggaauugagagguaguugccauuagggucagguucuucaauaucugagccagcagaacuccugaugaagagaaauuccaagugucagugucuugaaccaucacugaucugcuucucucaucauaugcuagucuuagagaauucuucuaguucauggggaccauacuggaacucuauaccaucuacugcuaagaacugucaaguuuauagagaagacagauaaagcaagcuauuaguauguaaacacagguguagaaacgaauaggaggcacugaucaugacuuaacaguaugaacacaguguaaacuuaagacugcuucauaguacauaagauguugguuuaugccagagcaacugcuguaugcacacuuugaaaacuacugcauucucaaauguuugagaauggguaccccugaaugcucaaaguaacuggcacauguauuaccccaugucuuuucucuaaaagucuuagcaauucucuggagggagguauguaguuaggaaaaagaggaagggucuuucaacaugggugagacuuaagaguaagaaugauaggccagggcuggagagauggcucagugguuaagagcgcugacugcucuuccagagguccugaguucaauucccagcaacuauuugguggcucacaaccaucuguaauaggauaugaugcccucuucugguguaucugaagacagcuacaguguacucauauagauaaaauaaauaaaucuuuaaaaagaauggcaggugguuagcacacaccuuuaaucccagcccuugggaggcagaggcaaguagaucucugugagaccacacagaguucaagcuggcuugaccagaacuacauagagagugagaccugugacucuagcuaaauaucagacaacugggagauuugggcaacuagcagggauggccgggagaauuaucuuaggcagccuagugugugagaagcucccacagcagauuuucagugcuggagaguucugaggaaaggguaguggcauguuguccuugucacucaccccccugaagccgggccuucuguacuugcucguggaucccgaagaggaagaggaagcugaaguccuuuagcuggcucagacgcugcacgguuuggggugaggcccagggcggcagaagcagcccauggguuugcuguguaucgcagcgggcagguuagcucccuaggccuaggccagagccucuccaaggguggcuuucuuccccagguggggaaggugccuguguguaugagggaggaagaggagagcagagaggugaggcagaggggccacugcaaccauggcagacauuggaaaggaagcucaagcaugaagagcagacucagcacagaagaaaucucacagcucugagcucuggauggagaaggcacagagugcugacgacuaguaaaccauuucccacuuugagguucuuuuuacccaugagggaaguuccuagguuacauaagcacgggcuugcugggccuucccaguggggacgguaguaucaaggcgaugugcucuauugcccuagagaccuggaccuguugaggacagaagagcaaucccaacaggcaucuuagucagcucaccucacaaaagagugugucauacacauuccagauggucucuagggucacguuuguaagcccugucucguuggccaccauguucagaaauugcuauaaaaaacggagcaggagaucagcacuguucuggagaaagagcaaucugaugaccuacacccacgccccaacucacugcauucugaauacuucuguucugauacucuggugucugccgagucucauucugcagcugcucauaacggggacauggacccaaaggaaacuucagcaacuacaaauuaaggaggaaacaggcagagaaggagucugggaucaauaggcuuauaaccauaguuguucccucaccacuuaagaagggcuggccagucuuacccugucuucagugaugggcacagugugaacagggauaggcugccaugaaauguuaggguugaagugcugaacuucauugggagggaagaguccagccagguuggccucagcacucaugagaguacgaucgaagucugugcuucgcacauaaaccuguagauuggcaacacaaaucucuuuguguguagaagcacuuuugcuccuccccagagccccaggguagaaccuguuguugauuacucaguacuuuauaaacuuaccaugcaugcacacccucucugcugcuucccuauucaucaaggccucaaacauucagcuacaggcuaucaccacuauauaaagcacucagacugugggaaugacucuaguucaaacacucuuuccuguucuucaaaagcacucauuugguaaacuaucuggucuuggagacuuaaauaauugguuugucucccaugaagaacagaguccuugucagccagaauaguacauccccauccauacacauggagacaagaucucaguauguaggucuguccuaaaacucacuaugaagaccaggcuagccucaaacucaggaaucuacuagccuuugccucccaagugcuuggauuaaagguaugugccucuaauucagcuuggcauucacuuuuuuuuccuucucuuuugucaaaacaggguuucucuuuguagcccuggcuguccuggaacucaagagaucugccugccucugccuaacaagugcugggauuaaaguugugugccaccaccacugguuugguacacacucuuaauuccagaauuugagaggcagagacaggaaaaucucugaguucaagacuagccaguaccauaaaaugagacccuguuuaaaaacacaaaagcaauacccuagaguccaaauggcaaauaccacucuucaccacacucccuuuccuuuuauaaaugggaagaaggggggaaaaggaacagcgaggugacuugugaaaagggaggaagaaaauagggaagcgaagggcaagcucaggguagagcuaggucuuuagggaacaguaaucuagaggauugagacaacuguggcugcaagcaguaaccauggaacagcuaucuccacugggguaagcagagaaccucaggagcuagcacauuugccagucuucacugccccucccccgauuuagcuuggcucuguucagcuuauuagacugcucuaauauaagcucuauuauagagaucauaacucuaugguauaccaucauaggaaaaacauuaccacagugcuuggcccucaggugacaauaaaugucuuggacaaaaugccuauuuauuguuucagagucagaaaguacuuuaucagacccuuccucaugucuaaguuggaccccuggucaguuuugucuuuucccagacaagcagagacacuucagacuccagagccguauucuagacagcucuuagaugucuuguccagggaccaaaaguucaagagggaaccuugacugcccaggcucauccuuagauucucugcagucagaauauaauccaaagaucccaguccuuuugccaaucaaacucccaaccuuaccucuugccugugguaagagguguucagaaagccaugguagcguugccgcagggccuggcccagcucccagugcuguagcaucccuuccugugggcaaaccugagaguuaaaguccaaagaggagcugggcaugguggccuuuaaucccagcagucacucucugaguucaaggccagccuggucuacaaagugaguccagaacagccagggcucuguuacacaaggaaacccugucuuaaaccucccccaaauccccaaccccuggggaaaaaaaaaaaaaaaguccaaagagaggggauuagccacaaguccuauguauggcauuuaggcauucuucccuuggcaagaggugaauuugauuccagaaguggccaguuguaaugauacuguccccugcacagaguuguuaagaaaucuggucauagccagagauguagcucacugugcuuagcauagacaagguucuggguuuaauuuccaaaaccacaaaaacaaaacaacaaaauagacaucugguccaucagaacccaugugggaagcuaguaguuuaaggagccccaguuucugugcuccagaugugauucauuccguagcauaucccgagaccuugcagguuggcuuuugacccaccuugguuagcugaccaaaucccuggggccauuucucuuccugauagggguccuugggauaugucuucacuggugaccgaucuccaugucgauacagcugagcaaagaaaauggugugucuauagaaucagaagggucuucuaguuaaggacaggacccaccucugcacaugccaggaaaggaaauuucacuccaucuuucucuacugagcgaugaaaaaagaccccaguucgggcgaugcaauguaaccugagauaauagguaaagccccaaagcacagguagaagaguagugaaagcaacgccuucugggggaggaagugggcaaugggacugggaaaacaaagaucaaagucgucuuuaugggugacuuucaaccuuuuaacuaaauucccauccuagggaagaauaucuccuacucggucguccugcccuaaaaaaaaaaaaaaaaaaaauagccuagggcuccaaaucaauucuuaauccagccgcacaacccacuaugggccagcgguuuccuaaaccgguucuuucuccuccuugagaagugagaccccggccccagaacacaagcucugccccucccucuaccagccggccuuugcccuuucagcuuuggcgaacccguuggugacuccgucacccauuaccaagguaacaaagcguagacuccgggccuguauggguggcaucaccguuaggcacaugccaagaaggaacuggagaagagccgccuggcuccaaccagucugucugccggccaucacuguuguaggcuguguagcaagagg

SEQ ID NO: 912 - RNA, 5259 nt, Mus musculus
cuccugcucucuccugagccgggugaccccgcagcggugccccugacccgagagacaggagggaacgcgggccagcggggucccaggccucuggugcucagggguccuggagucacaguucgcuccggguuggagagcccaagggaccgccccuuaggggaccgugcgcgcucugggaagcaaccggccuagcugcucucuauccagcacgcacauuuccaacccagcccccuccacgcccuuagaagugugaguacgugcgcgcgcggauuuuuuaaaagacaacuuuaaaaauaacaaaaucguguuguuucuaaaucuggaaggaaucacugacguguguucuuugcucaguagaguccacucacaaaaugggaagaggggcggcugaggauaacaacgguaacuuaggagugacaccagcugcugggggcugacuuaggagcgugaaauggucuccuuuaguugccuguguugucucaaagacgagcaucacccguggccugaggacucuggccgcgcgcguuguagcaaaucucaaauaggagauuugaaaccugaggaugugguuucugaaaccaauuucaacucccacucucuuaaggcuugggcaaaucuuuucucuuuaucuuuuucugccucuauaaaaccugacagguaacccagcugaccuaccacugggccgugugccccaguuaauuaaugauuguuaaacaacugcaaaugagaggggcuugggaaaugucuaaucacagccauggugcuuugcauuauuuggaaucaguuaacaucgcaccuagcgccugggggcguuuaggcaccuagacagaaagugugaaaauacaagaaugaaauuaauuacagaagcggccuauuaaaaccucauuaaaaauaaaguuggcagcuaggcucugggauguggggaugucaggauacggaggcucaggauaggaggcuguucaucagaccacagggaggaaaggaugugcaguggaaaacaucugguuucccuuggggucagaucuggaaucggaaagcagaaauguugcagcugauccuaauugucccuaagguacugggagggggcaaaggacagaacauuuugaguaguaggugaaaggaaacagacacuggcucagaaucccaguucccagcucccacucccccaggggcucagauuucugugcccuaggaacgaacagaccccuuaauuacacagugcauggacagugucauccaucccucagccugaucaguucaaaaugaaaugcccaggcccagagggccaaagacagaaacccagcaagaagccacuuggcucacaguaccagguggcagggugaucuacagccagcuuucaggacacucagccucaccuugaauuucuggaauguccuaaccacugagccuucauuuguuuguuuauucgcuugaggaaacaucugggucuuugcuuuaugcuaaacccuaccccagguuuugggacuauauggagaaauaaggcugaacccuauguauucaacaacgauaagaugugggguuggacagucccacaaguaaacugaggcaggaaggaccacccucuacaaaagcacaauacuugguugggcuugaugaguaggaguuagucauggagagagguauucuaggcaggagcaauagggugugccgagccccagugguauuggucugugauucuaugacccagcaauucuacuucuugguaucugccauagacaaauguguacaaauacagccagaagugccaggauguuuguguauagcacuauucaaaaauccaagagaaugaggugcaaaugcccacaguugcugaagagauaaagcuguggcuuauucuacaauuccagaacaggggaaacauuuuuuuuuuuaauuaaacauuucauuugcagugcugaaguucaacucagagcccuguuucugcuaugcaaaugcucugcuccuaagcuccaccuaagcccaagaugcacacauauucucaugugaagauguccagcauacuguucagugggaagaaaaguacagaaaacuguuuggaaaggaaauacaucacacugauuuuggaagcugucucuggcaaaggagucucagguugacauguuggaggagucaccgugagaugcugagguguggcucagugguugguggaaagcuuccucagcacacgaagacccgugguuaaggccaugcacugaaaagaaauuaauguacuuauguguaauucugcaguucuguuaacuuguuuuauaagacagggucucacagcucaggcugccuuuggaagcuggugagguggcugaugcuggccuccacuucccggaugcugggugggauuacagcagugggccaucaggcccagccaaacuguaauuaaaaaaacuggggagggauagaguguaggguugggccuaaaacaugaguguccaauagaauuuuuuuucuagauguuuuuuucuguguaucccuggcuguccuagaacuagcucucuagaccagggcagccuuggacucacagagauccaccugccucugccucccaagugcagggauuaaaggcgugcgccaccacugcucagcaaauucugugcaacgguagaaagguccuacagcugugcugucccauuguuagccagucgauacacauggcuucugagcacuuggaucauagcuagugucuccaaagaaucaaauuuuacucuuuucucuaguugaggguggggcaccuuguguuaccaaggcuauccuuaaacuccuggaugcaaacaaguuuccccgcuucagcuguuuucuccucgaggggaugguacccaggccuuucacauacuaaacaugcacucuaccagugagcuguaccccugcccagauucacccucuggagggugaagcucagcacauagaggacuccagggagggggaggcuccucugaaggcugccuuguuucuccaguuucucucagccucuggauauuaccccagcauuccugaaagggagcugaguaguguaucugauuuaacugcuaugccuuuaagaucccaggcaacuccggguggaaaaacuggucagaguuaggagagugggggguuacccucauuagaggaggcugauuuccaggaagaacagcagaggaagggcaccagagaagaaaugcagggcaggcuacagagcacaaagcuguuuccaagugcagggaccugcucagggcagaaccuaugguuaguaccacagacaggcaggagguggccaggagcuaccauagcaccuccagcuuccagucuguguaugucagcgagccuucugccuggugacugaacgugauacucagugauacuugcuggcccuuucacugagcgcauuuucugggaacacccaccucgugccagauacccccuagguguucagcccucaacuugaacaaagcagauaaaaaucucuaacuuccugaaaaucuccaguaaaaucaaauaauacaugauuacgggcugggguaaacauuuuaaaugggugagaggaagagagugcagggcugggagugaaacucaguagugguagaaaguaugcuuagcacaagcagugucuagggccgugugcuaauaauagauggagcauaauuuccauuaggaaagugugagaaaagacucuagaagcacacuccucucuuccccccaaagacccaaauacaaaaugacagccaggugaagggaaguuguaccuaagagcauuccagaaggacuggugacugauggggaaagggacccugaaaugggaccuugaccuucgggaaggaauguagcauuaguggggcauggugacugagagugaggaaggccacaacaugcacauacugccaggcuucaugaguuccuuccuaggggaggagugagcugacuggucuuggaugcuggaugaggaagggacuaaggaaucggcagacaguagcuucgugugguccacaggcuaaagaaugcuuuuuaacacuuuucaaggaugccugaaaaguaaaacaaacaaaaauccacaugaaauuaaaauuuuaguguucaaaaauaaaguaagccuugcccacuuacacacuaagugucucuugucauuuucucacuacauuggccaaagguggagcagagacuguguggucuucagagccuaaaauauuaacuacuuggcucuuuugacaauaaaacuaagugaccugaggauuagagagagacuaaaaguaggaagccuaaacaggagguugcaacagacaccaggaugagaggacagugaccuccuccaucuccaugguguggagcugagauguggaugggcugaagaagcaauuuaaggagagagcuuccagaacuugcuaauggcaugugggagacugaggcagggggaucaucgugaguuggaggccagccugggcuauacagagugagacccugucacaaaagaaaaaaaaaaaaaaagaagcaaacaaagcuagcaguggugacuggugccugcacuaccaaacuuugugaggcagaaaaaggaaaccuuuccauacaaguuugaggccagccucuucaacagagccacgagacccuaucugacuggggaaggugccaaaagagagagggaagaggaaaagaaaaaaagggaaagaagaauugaggauggauugaagagaugagauacauuucuuuuuuucuuuuuuuuuucuuuuuucuuuuuuugguuuuuugagacaggguuucucuguauagcccuggcuguccuggaacucacuuuguagaccagggcuggccucgaacucagaaaucugccugccucugccuuccgagugcugggauuaaaggcgugugccaccaugcccagcugagauacauuucaaaaugacccagaacuugugguccuggaguaggaccuugguaacacuuggggacaugggauaagguuuguggcuuagcuaguauuguuuuaguguuaacuucugcauccuugaccacacagugauuuugaggccagcauggacuacagugagacccugaaccaaaucuauaaccacagugggcugguaagcugaaaagaugucuaguaguuaaaagcucuuuacagcucucacaaaggaugggaguuuggguuuccagcaacucuguugggcagcuuuucuguaacuucagcuccuggggaucugaugcccucaucuggccucugaggucacuuuauucgcauguacauaccuacauguauauuuuaaaaauaauaaaauaaaucua

SEQ ID NO: 913 - RNA, 21414 nt, Mus musculus
uccaagccaggcauuuuacuaaaugccugccauucagcgccagggccgagacaggaggauuucaaguacaaagccagucugggcuguggagacagucucaaacaaaagcaaaaacagagcucugaugacaaacaggucccugucugccuccugugaugaggugcugaaccacugagguugcagacaaacuaaagggccaacuaacaccaccucuuuccuccacgugcaacaggguggugaggucgaggcuguaccggaccccgcagcagcaaaggggcaaggagccaggggccuuuggcuuugaaggaagagacaagcuggaggccccggagacagugcccucagcuuuggcaccaacgcccaacccauaucggugggagcccagagagugagcgaagggccacacugggcagggaggcaggacggagaggacacugacccacagggccccuugggggcuuuauuuugacaccacuuuguuucaauacaaacagugcugaaagaaagucaugucccucuggggagggaugagggaagaguggucuguguuguuugggagcccaaccugcaauccacagguagagguugggccagacugccaguguggcaggugagauggcaccaaggaggacacagugcguggcccagcugccaguggguggagccugcagcugcaggcccucacacucucacugguugauggggugcuguccaggaccccuaaaccaggaugaugcagaugauaaaagcugagcuccagggcugcuuucucucagucuuagcuuccucagcuaacagguucacagcauccaggcaggacacacagaugagacucaccauagggccaaggaggacacaaagaggaccucaagcauagacagagggcgcugugacccacaguaaugguagauaaaggcucucaaacaccuaggcagaagucagccuucaagggacagcugugacaauggaagagugcucaggccuccgggcuaaucccaaauaaaaccuuuggguaccaagcaaaaguucuagcucuuggugagcuaccaggauccuucuccuaacccuucccuggaacccagaagaggccacugacaggaacagcagugacgaguccagaacuucucccugagggcugauacagcacaacucuugcuaggccuccccuguuuccagaagauggacgcccaagcccccagaccaccuacaaggauccuagagccugcagaagccuugugccuucccuccuuggggaagaauuagauccauaaagccauccugauggagcuccccccucacucccagugcagcaggccaagcagcagcagcuuuggggcaagacuggagaagaacacuagcauggagggagagugugaggggaugaggacaaggacucgaugcacaggcugaagacaagggcugaugccgaccauuccccgcuccaagauccucccaagucauccaacucacacaccacacacacaaagucaacaacuccccagacccacaagaccggcaucuccagccugggacucaggguucuugcugucgucaccacaggccugagccauggagccuggaucaguaggaaccguagcgauccugaguggggagaauaaaaacacaaagucagagccucccacagaaugagggcuggcuacugcagagggcuggggacccccauguuggaaguuugugguggaagcugggguaaaagccaccuggauacuaaggaaaaggcaaguccugccuggcagaaccugggaggaggagagagcaguacaaggaacaagcuuaggcaaaucagugcagacacauuaucaccuuagggagaggcuuagcccaaacucagggauggagaguaacuacccugccaaacccaagugcucucuaaagagcugcccauggcuacucagcauauuagauacaguagaaggcaaacuuuuucccagguccagcagcgcagccucaccuguaaggaauucaucacaccauuggccagcacagccaucuugccagccacagacuugacacccugcuuaaacugggcaaugucagcuguaggaaguacauuccccagagauacaguuccuguaaaauuaagggaagggguggucaagagcucugcaaaaagcccuucccaccaacagggcaccccagcugugcucaucugaugccagugacaacacugaggcccuaccuccuccaugagcuccauccauguuuccaaaaaggucugaagagcugauggcacugcugcccgaaagcugcuguaaccgagaccuagcuucauacuguguggggaaacgacaaggcugggcgauccuuggccagugauaaaagaacucauuuaugccggauuagguuaucccgaugcuaaggccaagaacagaaagggaagccccggcuucuaccugcugccgccacgcagacaacuucacuaaccucagaauccaccucacgaccaaagaacaugucggacgagauggcuuuggcuccugcaaacuucugccgugcuucacuggacucaaggccugagcuccgagucuccacuucccuccgacucgcaguucugugggcaagugcagaacaccucugucccuucucauuacccccagagaaaguucagagaccaaaaacuguagccacuauggcuuaucacgucuauccugugacucugagauucaagaaccuuucccccagugagcacccuccagaagaaagccaagaucuccucucccuuuucuucacugaagccaagguacaaagagccucaacuaccuacagcagacagagugagggcuuaggcccacuguggucucacuaagucgcagaaagaaggucguccuaucaucccugcugcuguccuuguccuacucagaaucugaagugaccacaucuguuuagcagacucacgccgcccaccucuccugccauagccacucagugccacgaucacugucucagaaucucgcugauguggguaagagggcugugcacuucacugaugaugcaggcucuaggcugggguucuauaacuuuccuuccaacaacccagugaagcuuacuuauguccuauuuuacaaauggauggucuacaguaacaaaacaaugcucauaguagaauagaguaagauuuucaaaaagcaagggaccuaccagguggaaaacauggguuuaauuccuaauacugcagucaaucaaaacuagaagcauauagccuacggaaggaacaucguaacugaaacggaaaaucaggcuccucccaccauaaaacagaucccaagcuaaaagcuccccaccugucuaaugaauggucacuagcuguguguggcuauuuacaauugcuaaaauuacaucaaaaacauuaaaauucaguuccucagcagcaccggcugaacagccacaagccagugcagcugucaaucauuuccagcacugcaucaaguucugcagacagcgcugccugcccacgauaccuuucugaaauaggccggaugcuggagaugguaacuucagguuccuucucuucuacccuguccauaccccaggcugcaucugaaucccagcgggaaccaaaaguuucucccaaggaaaagggguuguccuuguaccuagggagauggcagaguaagcagcucagagaaaccugugaaggaacaaaacagccaagucuaugcccccgcaacagccuuacuuuggggguccagaugcaaauguuccaacaucaucaaacaagucaagcugugaacgggaagauuucgcacucagcgggguuuccugcucaaucaucugcaucucagacagcacagaaugggagauggagcuguggagaaagcacagcaggccaaaggcugucaaugagcaucaucagcuguucacggaccaagagcagcagccaggcugaugggucuguuuguccaaccgccacccacaaugcagcuccuggccugugcacugggccaguccaagcagagaacugugcucugaacugugugugaugaccugggaacaaacucagaaauguuaacauaccagcuuuguucucucaaaaggcuuuucccuagacaauggcuauugguugucgucuuaauaaugcacaccgaaugaugagugcucagccaccauuccuccccuuuucgcuuuuguuuguauuuucuaaggagacuggcuaugugaccagcuccuccucccucagccuuuccaguguugggauuacaggcaugagccuccaugcccagcuccauccagcuccauccuuacucagaaccucauuacaccacagacucuaucuucccuuccugagauccugacagaugugugcaugaggacaccagcugcuccucaugggaucacgugaguccuuacucauuagaaaagagaagaggaagaaaaggccucuccuagcacagggucuggucaugaccugcccugcccugccagugcucccuagagugggcagcagcauaggcagugccucacuccugucaggauccgcugcuguggucacacacucaccaagaguccaaacuauaaacucccaaggaaugaauauuuugcaacuggauuuuaaauaagguagacuagauuuaaguagagauuaugcugcacuguaaaaaaaagaaaaaggaaaggaaaggaaaggaaaggaaaggaaaggaaaggaaaggaaagaaaagaaaagaaaagaaaagaaaagaaaagaaaagaaaagaaaagaaaaaccacaggggcuagagagaaggcucagagguuaagagcacugguggcuuucccagaggacacacguuuaauuccuagcacccacaugcagcucacaaccauccuaacuccagucccaggugacccagacuccucugaccaugagucauccuuggcuauguagcugcuuugaggccagccugagcuacauaagacuguccaaaaaaaaacaaaaacaaaaacaaaaacaaacaaacaaaaaaacagccuguuuuaagccagccaagacuaaugagacccugucucaaacuaacaaacaaaaauaagaaaaccagggcucacucccuaggacauggcaagggagaaaugaccuccauaugugugccauaggacacauaggucccauauauacauacauaaaaauaaguaauaacaauguaauuuuaaaagauuuaguaaaugauuuaguaaauguuggaaagagugcucaaugggguaaaagcauuugcuaccaaguccaguggccugaguuuaacccauggggcccagacagugaaaggaaaagguucccauaaauucugacauccaucauccauagcggugcacacgcgugcagacacagacacagacacagacacacacacaccagaaaaaauuuaaauguaauaauuaaaaaaaaacaccuuacauacuaauuuuuuauaaaucaacuaaaacccccgauaugggagcacauuagaaacugagacaggaggauccgaaucucgggcacuccucagcuauguagcaauuuggaagcuaucuuaggacacaggaaacaaauaagaaacaaaaugcacacacacuuacaucauacgugagcacacuccugcacuucacuaaugacacgagugcuuacacucacagcauacagaccgaaagggaagaagguaauaucaaguaugugugcugaaagauuaaauuacaacaaucagaccugcuuuguaggguauaguggcgcacgccuuuaacccugguacucagcagaggcaggcggaucugaguuagaggccaacaugguucacagagugagucuaggacagccagggcuacacugaguuuaaaaaaagcaaaaacaaaaacaaacacaacuacaaauggauuuagaauuaaaaagucaauucauuugccaauugcuaggucuggagcuucgaggaagcugcaugccaguuuccucaucuguacagaguuaacaaggccuccucccuaggacuauuaugucuaagacauuucucauaacgacccaugccuccugacaagagccacggcacuggcuaagugcagccaggaccuugugaauggcaccaguagaugaugaugacgauaggcuguuuugagacagccucccagaacccagucugacugugaauucccauguagccaagaucacucucaacuccugcuccugcugcuuccacaucccaagugccaccauuccucaaagauacauuuuagcccaggccagccucaaacuugcuauauagccaagaaugaccuugaaccucugaucuuccugccuccggaguacuaaaauuacagacuuacaccaacacaauaguuuuuuauaguacuaaggauugaacucagagcuucaugcaagacaaacacacuaccaaccaagcuacauccccaggccccagauacuuuauuuuaaaagauuaaaaaaaaaaucuuacuaucuuuaauuccagcaauuggaagguagaggcaaaaggauuucugggaguuugaggccaguccagaauauacacuaagaccauauuuuaaaaagaaaaaaaaaagcacuauuacugaaaucccuaaauauuaacucaaaaugcuuccgagaguagcucugcuuuuguuaagcaaagcacagaacacaaaccaguaguucuggaacaucagacucccagcuaggcagugaugccccacccccacaaacacacacacucacacaaacacagagaacuccccaacccagaggcauuugaaauguggauagucugagguauuauuguaucuggaaggacgaauggcauuuaguggacaaaaaaagcaaaaagcccuaagguucucaggucuuggggaaaaaaacugcucagucacaaagcagccauauuaauaagugccguccuaaccuggaguaaaaaaacagcaccugauccugcucucuuaaaacuuaggcaacuaacacguguggccaaccacuguccaagguacuuuaaaacaacaacauuuucugucuuuagccucagaggaagacuaagcaaggaacccugacugacuggguagagccuguucuggcucccagaaaaacaauggcauuuuucuaacacaccagggcccgagccucaccuucgggacaccaagcccaugcccagccuuucagccugcucucgcuucuuuccuucaagauucuggagcuuuuucuccuccuucuugcgaucaaucuggagcuccugguaggccagacgcauggaggcaacccuggagggaacgaacacucagaggcugccauccacgccaccugccaccaacccccacacaagccaagggcaccacagccaucacgcacauggacucuucugccugcuucuuggcaucagcugccugcugcucucggagcuucucugccaccugggccugccgcucaaucucaguaaagcucugguugcucaccuucugagcucccaggccuuucuuggcacccagcugaagagaaaaccaugugaugugggaucuggccagccaguuuccucagcucccuccccacuguggccacugcggucacacccacaaugaagggggucuccuccucaguauccagugagcauucuaagacaacggugguucugcuggagcuggugaugagcuuggcaccgccgccacacaggucucaggaaugaggacagcaguuaaugcugacuggggccugcugugugccaaguacuagaugugcucuaaguacuagaugugcuuggucuugcucacugcccaggagaccccaaagacaagugccuuuaaaucacuuucacagacaagguucagguaagucuaggaccuuugucaguacauggaagaacugaaggagcccaacugcagcucacaaccacccuaggauauugccucaucccaccuaccccuuucuuagcggcugcuggcuucuucuugccaauaauggagcuuuucaguucugugaggaagaaggugaacaugagcuaggacagaggauggucagagacuguggcucaguucacaccaagcagcuucccaacaagagcaugucaaaagaauuccuucagacagaaagucagaccugcccuaccagcuccagccaagacuguucaagccaaagacggacaagguuaggggagcucacugaugcccaagucaguaagagccuacacccgaggcaccaaagacaaaguacccaaccaaagcgacaguuguuaggcaggggagcugcccgacagccucagcugcuagagcagggaacuggcaggcaggggacagguuucccaagcccugguuaccucugguacaagagggcccuuuagcugacagauacauggacucuggaggaaaaauagacguguggcuaacaagggcccaccccagaagcuucauaaagcucccaaacccagaagccuaugcagagccugcuucaaagucugccgucucacagaaucaacuggauagccacuggcuuccugccccaacccccaagagucaacagaacaaaccaaggccagcaaaggaauuguuuaccauaaccaagucugaaggccacaaaggagugggaaaggcugaacuuugaaaggacagcauuaccucuagccaggagcagcucaaagcuauccccacaccucauggacaaaauggcccaguccuaccugacaccagucccauuccagccucccauucuuugacuagaucuaccucuacacucaaauugacagccaucugggcuugucagcucaaaggcucugaggucaguauggcagugcccacccaagaggaucaguugcucaguguccuaugguugggucacaugagugggcagcagaaaucuggaacaaauacuugaggcccacuuccucccagccccccacccccacccccgccagcugucauacccagagaggcuuggggugagguuccgagcagaucaguguuagggccuuguucagguucugugaaugcaauugacaggaguuacauuaaggaggugguaagacaggagucacuggcuuuccucagcucgccaucaaaagauguaugcccaccccuuccuccaaggacuaaagagaaaccuccucugagcuccuaugucccuggccaaguguuccuguacccuaguccuuuuccaggcccaggcacuugguugagaucugggcagaacucacgugccaggcuacugcucucugaagguagggcugguugcugagucccugaaggaucaguggcugcuguaucccaagcaggggccuaaaaaggaagccagaucauagaggccucagugagcccuccuaaaaacccacagcuaccuguggauaggaggcacugcccgcuacaauaagacaagauuggagaucagcaauuuuacuuaccaguuaccauggaagacaaauguaggaaaacagccucuucaauucagagcuaagcccauuccccuaacugauagcacuaacaacucuuacguauugaccaugcaccagaugcaaauccaaggugcucacagauacaacagguucaguggaaguaacuauguucaggcccuaggaaguaacuaugucuccauuuuagaaacugaguuuucccccagguuaagugacuuagccacaucacagaaauacuugcagagaggcugggaugugacccaaggcucuaacuucaauacccauugccaacagaggggagagcuuuuuuacaggugggucacaggaggggcaauccucauugucuccaacuucuguuccuuuuuggaaguuguuuagggucccugagacuucuugagcuuucaaacuauucucuacuccaggauccauuucuaaggaggauuccacuccacucccauaagaagcagguaguaauuaccaauucugaacuacaaacacucucugagacauuguaccuaaacacaagaauuuaugucaugaucacaaaaggguauauacagccuugguaaguaaagcauuuaucagaggaaacaucccugugguacucaccugaguauguucugugaagaaaucagagucuuucuucucuggagagugacuuggagcacuguucauacugucuauccaaagcuggaagagaggagacacugaaacucagggcuguuacuaucucuuaucccagcacccuagcccaggaaccagcacucacaucaguaccaugccuagucagagcugcacucccuaacugccggaucuucucucgguacaucugggcagcucggcucguauauuugguguuagcaucauuggccauacauccguguuggcggaaaaaagcagucuggagagcaaagagaaggaguaauauguaugugcaaauacucucgccaaagaaaacuguauucacacuauaggagacacauuacuaaacaauugggcuauuauuuauucaggaugacacacuacugacaucagcagguuuucaaagagguaaacgucuuccaagauuucuucucaaaacaagacagaacaacaaaaccuuuuauuuguauuuauuccaugugcaccccagcaugugugcagaggucaaaggccaaguccauggaguugguucucuccuuccaccuuauguggguucccucaacugaaugaacucagguuaccagccucccucaauaaacaccuucacucacuaauugaccuccuccaaaauuccucaaaaaacccaaaaaccaccaugccagccccuccccguaagagcagggaacaaggucuaggggacugaagaauguauguacuucucuguucagcuauccucccuccaggagcccacaaaaccccaaugacuauggagacacugcuacugccagagagcaccugucuaguucaguuuguauuuccuuuuuuuuuucuuuuaauuagguauuuucuucauuuacauuucaaaugcuaucccaaaagucccccaagcccccccccccaguuuguauuucauuaagccucuuugaaagaagcuguuuaaauuuuucugaauuuagaaaaguguguggcauguuccagagcugcaaacucucggaacagagaaaccaaacucacuuugagaaaucaaggaaaaguuaaauacccaggcagaaggauggggguggaagaagguaaaggaacguuaccgcauuggcauucccgccgaccugcauacaccucagcugcaaccagcuccaguucgaauccaacucuguggaccuguguacaagggcugagugucaccuucccuaucaagacuaaaccugucauucggccucaggcuucuguggguguccaggaaccaucagucacugucccauuuccuccucucuccccuguauuugaaaucauugcgcuucgccuaauccaaaggguacuaauuauuucugaaaaggagauccgaaaggaggucgacuucugagaaaugcaggcacggguuuggcucuucuuaaaguuuggucaaagucgcacuggagaccuacugggccaaucuuucugcaauaacaaggucaaugcaucuaagcucucccccaaacugaugcugaguaccauguuaacugugaagagagaagucuacagagguggaaccccccgccgcccuccgcccgcaagcccccgcuguaggcuaccagaacucccgccaggagaaauccaaacaucaaauucaggaagguccaaguccaggcgcccucuccccgucgcugaccacgcacacagcccccguggaggcacagcacccucacacagaaccuaccugauaaagcugagauggacacccaaggagcgaugcacuccggagcagucaauacacaaaaauacaccguaagugaugcuggcccaacuaggacucuuggcgccacaaucgaaacaggccuaaguggaaaagacgacaagcgaacgguuagggcccagagucgaggcccggcgcuagaaaccacaagaaagccuccaaccuccguccucgcccucccucagaccccaggggacaagagacgucuucuccgccggcgucaggacccguaccccgcccgcucaagcaccuuguuggugggaauugcgcgaagucucuuaaaaauagucuggauuucggucuugcucgggcucgccgccauuuucucuccuucccagacacaaccgcgaccgacaggucccggcgcgggccaauccucggcggcgaaggcaggcucaccgcgccggucacgacagggccccgacccgccuacgaguggagugauucgaccagaucugggccaaugaacgucgggcggggcugaaacaugacguuagcagccgggagcuccaccacgggccugagagugaacgccgcgcugcgccuggccaauccgcagcccgagcgggcgacggcucguggacuggcccaaacuuccucacgaguuccugcuggacccggguacccuacguaccgcucgaccacuggcuguaggcgucaggcagagagccaugguaacagacucugugauggacgaguaaugauuaacaaucucccaagugcucauagccccauccggaaggcauuggcagggcuccagcucagcucacaauccagcaacuggccuagagcagaggccagcacacaacaaccuugaucaccaagucccuuccaguccagauugcacuccugaaauuccggggcagauaccaggaggcaacugccugcccaaucccaguuccauaacacauggcacgcccacgggccgaccccgugccucccaccagcaagaguaggcuaucaaaagacgcucacaacacuugaugggguuuuuauucuuaaucaaauuuaaugcacacuacaagucacaaaagaaggugcugccagccucaaacuacauucuccccaaccucaccccaggaacuccuaaacaguuuaggagcuggauccucccacucugggaugacccaaauguucccgaggaggcucgggcaccucucgacccuccaucauuccaaccuccaacucuagacacagaccccugcccuucaugggcccugagacuuccuccugugggaaaagagagacagcagcagcacaugguucagggccuucagguccagcaguccaggaaggguuaagcucuggcccaggucagagagacgccuugguagggcugucagggcacucaggcgcccacacauucuacguaauuggcaggguacagaccaaugcggccacucugcagcuggcccuggcaccagcccugcucauccuccucgcucaucuucagcaacucuuccccugaagaaagacaaaacagucauugcccaaagcacuggcuuuacuggucucaaaacuaggucauggacugggggauggaauagcacaagggccgacaaacuggaggauacccaacucagaccaggauaggacacagccaggaaaagccacccaaccuuagaccccagggaggcaacugucaggcugcagcuggacccugagcagccugugaggauggagucccuggcuuucuucgucuacagcccugcucuagcaaguaggacgggggcugaagugggaaggaccaugaaagggcccagcauaccugcucggaagcucagcucaucagccuccuggccagcauagucauaaagcgcccguacccucaccccaguggcaacuuuccggggacucuccucaucugaccaguccucguccugcccgcuacuagagaggggaacacaaggggcacaacucagggcacaagacccacuguauccaguacucaagacaaagggcuuggcugcuuggcggcgggcagggaggagccaagugaacagccauccugcugccacucacuacuguggauacaggucuaucucugugcacaggacuguuauacagccaaacuucgagagacaccggaccauggagcaaaucuaaaccucggugaaauuaacucucccaagauggccgucgggcacugaugugauaggaaagcaggaagaagugguaacaagcaagccauagagcccggucuugguuuuguucaggaucccggcucucaccccggggacgauggggacuggggugggggugcggugccaucucuugucgguacaaugcuggucagaguaaccucaucugggcuccggccacccuucuccuugcggcugauggcucucugugugucuaacgaccauuccuguggagagauuuuggcccaccuucacugacuucaucgcaaaccuugucauccuuuugggauccacacugagcccaacccaggcccacccagccucuaagaccugccucaaacuguggccaguucauggccaugccaggcccgugugugcuccgccaccagcgcagauccucuucaucacuggcagccucaaugcucugcugcaggucucgauggaguucauggaaccuaugaggcacccagucagacagggaaggccaagagccccuagaaugucaaauuaugcagccccaccagaacccagaggaggucaggggagccucucuccagcgcgccgucauacuugucgcuacuggagaggucgagguguugaugcagggugagcaagacauccuugaagaagagaagccgcuggcgcucagcagccuggcagcucucaaaagccugcuccauguccuccauguagcgugggguguagcgauuuagcucggccagggucugcucauacuggguuuucaucugggugagagagaagggaggcagugaggacagacugccuuccacucaggcccgcaccagcauucucugagcauagccauaggcuagaccugaagcagucagaccuggaacucacuuccuacccucaggaacugacagaagcagccuaauaagggaagugguacacaaacaaacaccuagaagaaucuggaugaagugcaagacagggucaaucuagaugauaaggugagauaaauccaaguaggcucccuggaggaggagguguuauagaacugccaccccucagaaaggaugaaaugcuagagagaaggacacuccgggcaggcgacagaguaugcaauaugagaaccgauuccagguaacuaagucuccaacuuccugaaacccagcuauuucucucuuggguaaaaaaaaauaaaauaaaaauaaaaaaauaaaaaguaaaaaaugccauucuucaaaaucccauugcuuuccuggguaaaacauuguauuuccucauguuucucucucucucucucucucucucucucucucucucucucucucucucucucucucucuguguguguguguguguguguguguguguguguguguguguguguguuggaggcagaaugucaacacggggugccuuccucaguugcucacagcccuuagacaaacuggccauccagguccagggauccaccuguccuguccauuccugacacacacccauucugacaacuccccuuuaccacuccagcugccuugccuagcuuuuaccuucacaaccagcacuucaccaaccaagcuaucuccucaggcccaaguuccuccuguuuguuuguuuguuuguuuguuuguuuguugagacagggucucauuacaguagcuuuuguuggccugaaacuccauguagacagggcuaguagcuucuauguaauccaggcuggccuugaaccuauaaaaauccaccugccucugcuuccugagugcagauauuaaaagugugcaccccaacacccagcccaaguuccaguggcauccgggaguagagcaggaagagccuagggucugaaaaggcauccaggaaguucugccaggggacuguaccuucucugccuccuuggugcagcggcccacccgcuccuguaauuuucgaagcugcuccugggacauggagcugucugccuucgcguggcucucccgggucugggcugucuucucauccuugcgggcugugugguagcucuucuuagaagccucaaccuaacgaccaugagaacaacucagaauccuagccgccacacccuggucccgcguagaccuggaaggugccugccuccucugggaagcacugcuccgggccucaccuccuucagccucuuuagccagggcuucugagcuuuacggaaaccauccucugcagcccggcuuucccgaaagccccccagcacuggccgguggaaagccccucgcugccagguccgcacucgcucgcugucuggaccgugcaacuucucccucaccuccaagugcagcucgcucagccucucagccgcagugaagaaggcaugccaggccuucuccagggugccguacugugggccugcagagggaugagcuugggccaggcggguuugcuaacuuaaauacgaccuuccccuccccgcauacugcucugagugccagacaggggcaugguaggagcugaggugcgacagcugaacagcagcagugucaaguccuguguuagaauucccuacucugcucugacaugagcgaucucauuaaucuuugacuucacuacuacuauggggacacugccauugcuaacguggaccgggcaaaaauaaacaacaacaaagcaaaacaaacaacaacaaaaaacuaaaccuagagacgucagguuaacuuguccaaagcggaguaaaaccaugucugcugcacaagcucuguaaugcccaggaucuuccuacccagauaaaagaccuacacuccacauuuagcuuuuccuagcugugacuucaggcaagucccuucucugaccuucaguucuguucuagaaaacagguggaguaggaagauagcucccucuugcccugcaugcuugaggucuuaaauuccauccccaagccccacaaagccucaggaagcugcccugagggucccacccucauaaccuuugaggccuuugguaggccuguauacuggcucacccuucuccacagcaccccuccacuugcgggcccagucagccagcugcugggcguaggccuucucaaugcgggcacguucuuggaagcagcuaaccagguccccacacagccugugcccauccucaacccucugcaccguccgucuguaguugccagccuggaacacagaaaagagagauggcuuuaugagcccccuuuccagcuggggcugauagauaggcuacuccuggacagguggcugagcccaucaagaaagggacaguuugcugccacuccggacccaguccccagccgcuuaccucccagaaacugcccccuaggaccuccccuccggcguccuccucuggagccaugguaucccugcagcacggaaugguggcagauguggugcuguggagggcaggugauuaaacagaaaagugagaccugcuguuuggggacuaggaagaggccuucuaguaguccaaagcuuugucauuuugccauccccacuacccaaggaaugaccggaggaauggccgagcagcagaaggcuagaaguccccaggaggagccaggagaaaggcaaagauggcagcuuccaaguucccuucuccccguggagcuacccaucucaguccauccucuacauaccuggggucuccagaucacuuccaggacccguguccaagucuccaagcugccacuaugagccugucuugauguuaacaagagcacagagggaguaaagauugagagcuuccaguguccagggcggugcccaguacccccaauauagcaacugcugucagaagugccagauuccaggcugagaaugccagacuggucacacaauucagcaagggauuaggugacagacagggguggguggugggcagaaagccccacacuccuacuuuagaugagaagagaacucuugccuagcuagaccccuuggaugacaaggcaaccccaugaacaaaccaguccaagugaggaggugcccugucacaagccccagcaaguguccaugcugagcagacuggaaagagagccagaaggccuggcccuaucaugaccaggaaguuuuuggacaacugugccuuacuguccuaagggagccucagcucacucuaaaguggaaauucccccaccuggucaguguccaugcuacgguugauguaaaacucaaaacuggcaaugaaacacuugaaagacccgucauuuguaaggagacacuugcuugcccccugccaccaccacacaacauccaggagugucucaaaggguccuaagguaacaauuccauucugccuucaaaaaguccaggguaauuuuacccccaaagucaaucagucucucucucucucucucucucucucucucucucucucucucucucucucucucuccaccccacccccacuagaggacacagugacaugcagccuccugccuccaggcaaggucuuagcucuccccaguaccaauugacucuuaguccauagaaggaaauuacuuucuucccugagauagcccaaggccguugggacaguuaggucaaggggacaagaguaugagauugcagcaaccaaagcaggacucugacacagugcucucuaaacugggaaaccucuacucacucucaaaacuccaaauuugacucuguuuuccucagggcucccuauagccccugugcucucagucccacuauauauuccauagguuuagacuggaucuguccaaagucacugacagacuucugcaguuuugguucacguuacccccgggcacuagaaucaguaacaacuaaaucagaaaacaaaggacuggaggcuuagcucagagauaggacacacuugagcccagagguuagguccaucaucagcaccaaaaaggaaagaagaauggcccaucugaagaucagaaaagaugcuggcuacagcagcccugagaaaagcccggucuaagcugacuuccuacaucugcuggcaggagggagacuggccucucccugggaccucauuagccuauagucaacgaagaucccuagacacagaacaaacugccccccaaguuccacuagcucuccaccuuguuuccucuugagucagccccacuuauccagaauggcuugccagccagauagggugguggggagcaguaauuauaaaucauugagccauccaggaccuggggggcccugccuacuccagucuccugcucccggcucccaggagagcugcccccaacccguuccuucucccuggccccagaacagagcaggcugugugugcagugcuggcacagcucccucaggccucacagagcaaacacuagcuggagccccaggcacaggcaggcccggcaccccggcuucaucgagcucuugggguggaccuggcaccuugggcccuguugaggaggauuggcaucuugugccuccugacauuagcagagacccacaucugagugaacacauccuaccacagcaagaggucagagagcaagaacagguaguuaaaaucuuuccagcccaggcucuccacuuagccugucagaaggcuucugggacacuggcagggucucuucccagccgcuagugcugaacugggaguucugggcuucaggacagagcccacucuccccaccugagcuccaaagguuucugccuuguuccuuucuuacacauaagccagcccccacccuuuuccaguagcuggggacacaggccuggaagagagcaaagcuauccugcccagcccaguccuguguccugagucacaggcugcgcccaagggcuuccccagcagccucucccagucagccuguagacuuggauuuagaggugcaggagggucuggcugcugaaccagagaggggcgcuuaaaaucaagagacuggcacagucuuuuggaaggaugggggaggggguggcucaaagaaagggggaggaggcagagccagggaggggcauaacaaaggggcacuuuuggaaacccgaccugccggcugaggugccugcucgcugaugacgcacuccuaaccuccacaccaaaucacagaacucaggggcugccggucuuuggccuccacccuuauagacagcgccacccgacaaaccaccuccggaucccagaaggcucgguguugaacaacuccaagccgguggagccagccacaggauaggcauagccaggccuagacauggaggcucuaggacuucuuggacaaacuuguugaacuuggucucgguggggagguggggccagcugguuacugcagcggggaaggggcgcugccuacuaggguuagccauacagauaguggcgcgaaggggcggggggcgggcuuuuuacagaggccccuucuaggacuucagaacgggcgcaaggagagcaguuggggacccucuaggcacccugagagaugauuugcuccuccagcuggacgccccauuuccccuggcuggccugaagaaacgccuaauuagcguaggagaugagauggccuugcgcucaguggcagccaauggccggggucuccggcgcgggaguccgucccauugccaacuucaggagucgaaggaccaaagagcaagcuagagccaccaugccgccgccgugccccccagcucccccuccaaagcacucaccguguccucucaggggcccucgguggguuagggggaucuggccacgcucaguucggaguccuaccacucccggguccgggccaccgccuccuggagcgcuucgggcccucccccgggaagcccggccccccgggcccgcccucuccgcggagccgccgccccaaccccaccgacagcauccccgcagcggggacugcaggcaucccugcgccagguggcucgggaugcgagccauaggaucugcuccccgggugcagagaaagcuggagccaauagucuaaggaggugcagcgaggcuaccagagagcugugagcuuugucgcucuccgaccuuuccagagacuaggaggccggugggaaugagcgggaacuugcacacuaaucauuaggguggaauucggggacaaaacugagggggcauucuuugcugagagcaccuagaaaguuagagguuagcuacagggagacagauucauaaccacccacuccuuguaaccuugaaugaggguuagagauaccuucagcgguuaucugcccaagaucucuaguccggccgaagcgagacuagaaaagccaugccuaccuagagcagcucugcuugcagcuuuagcgcgcauuccgagaccugagacaaacacgcggugggagugggacaaaaaaacacgaacuccucccccuccguguucacgguuucagauuuucuaucucaacauaucuuuaaaucccuuggucucaccuccuaguucaauguagacuuuuuccgaaucgucucgaugccaccccacccuaaauagaucccuucuucacugcuccacccccagccucucgggauuucagagcuugugggucuguuauuuauauucacuggagcgguccaagaauguucugaggcugaccuaaucuccaccugcucggcuucuccgccccuccugcucucuccugagccgggugaccccgcagcggugccccugacc

SEQ ID NO: 914 - RNA, 2949 nt, Mus musculus
ggcauuuuuuacuuuuuauuuuuuuauuuuuauuuuauuuuuuuuuacccaagagagaaauagcuggguuucaggaaguuggagacuuaguuaccuggaaucgguucucauauugcauacucugucgccugcccggaguguccuucucucuagcauuucauccuuucugagggguggcaguucuauaacaccuccuccuccagggagccuacuuggauuuaucucaccuuaucaucuagauugacccugucuugcacuucauccagauucuucuagguguuuguuuguguaccacuucccuuauuaggcugcuucugucaguuccugaggguaggaagugaguuccaggucugacugcuucaggucuagccuauggcuaugcucagagaaugcuggugcgggccugaguggaaggcagucuguccucacugccucccuucucucucacccagaugaaaacccaguaugagcagacccuggccgagcuaaaucgcuacaccccacgcuacauggaggacauggagcaggcuuuugagagcugccaggcugcugagcgccagcggcuucucuucuucaaggaugucuugcucacccugcaucaacaccucgaccucuccaguagcgacaaguaugacggcgcgcuggagagaggcuccccugaccuccucuggguucugguggggcugcauaauuugacauucuaggggcucuuggccuucccugucugacugggugccucauagguuccaugaacuccaucgagaccugcagcagagcauugaggcugccagugaugaagaggaucugcgcugguggcggagcacacacgggccuggcauggccaugaacuggccacaguuugaggcaggucuuagaggcugggugggccuggguugggcucaguguggaucccaaaaggaugacaagguuugcgaugaagucagugaaggugggccaaaaucucuccacaggaauggucguuagacacacagagagccaucagccgcaaggagaaggguggccggagcccagaugagguuacucugaccagcauuguaccgacaagagauggcaccgcacccccaccccaguccccaucguccccggggugagagccgggauccugaacaaaaccaagaccgggcucuauggcuugcuuguuaccacuucuuccugcuuuccuaucacaucagugcccgacggccaucuugggagaguuaauuucaccgagguuuagauuugcuccaugguccggugucucucgaaguuuggcuguauaacaguccugugcacagagauagaccuguauccacaguagugaguggcagcaggauggcuguucacuuggcuccucccugcccgccgccaagcagccaagcccuuugucuugaguacuggauacagugggucuugugcccugaguugugccccuuguguuccccucucuaguagcgggcaggacgaggacuggucagaugaggagaguccccggaaaguugccacuggggugaggguacgggcgcuuuaugacuaugcuggccaggaggcugaugagcugagcuuccgagcagguaugcugggcccuuucaugguccuucccacuucagcccccguccuacuugcuagagcagggcuguagacgaagaaagccagggacuccauccucacaggcugcucaggguccagcugcagccugacaguugccucccuggggucuaagguuggguggcuuuuccuggcuguguccuauccuggucugaguuggguauccuccaguuugucggcccuugugcuauuccaucccccaguccaugaccuaguuuugagaccaguaaagccagugcuuugggcaaugacuguuuugucuuucuucaggggaagaguugcugaagaugagcgaggaggaugagcagggcuggugccagggccagcugcagaguggccgcauuggucuguacccugccaauuacguagaaugugugggcgccugagugcccugacagcccuaccaaggcgucucucugaccugggccagagcuuaacccuuccuggacugcuggaccugaaggcccugaaccaugugcugcugcugucucucuuuucccacaggaggaagucucagggcccaugaagggcaggggucugugucuagaguuggagguuggaaugauggagggucgagaggugcccgagccuccucgggaacauuugggucaucccagagugggaggauccagcuccuaaacuguuuaggaguuccuggggugagguuggggagaauguaguuugaggcuggcagcaccuucuuuugugacuuguagugugcauuaaauuugauuaagaauaaaaaccccaucaaguguugugagcgucuuuugauagccuacucuugcuggugggaggcacggggucggcccgugggcgugccauguguuauggaacugggauugggcaggcaguugccuccugguaucugccccggaauuucaggagugcaaucuggacuggaagggacuuggugaucaagguuguugugugcuggccucugcucuaggccaguugcuggauugugagcugagcuggagcccugccaaugccuuccggauggggcuaugagcacuugggagauuguuaaucauuacucguccaucacagagucuguuaccauggcucucugccugacgccuacagccaguggucgagcgguacguaggguacccggguccagcaggaacucgugaggaaguuugggccaguccacgagccgucgcccgcucgggcugcggauuggccaggcgcagcgcggcguucacucucaggcccgugguggagcucccggcugcuaacgucauguuucagccccgcccgacguucauuggcccagaucuggucgaaucacuccacucguaggcgggucggggcccugucgugaccggcgcggugagccug

SEQ ID NO: 915 - RNA, 2515 nt, Mus musculus
cuuuuuuuuuuuuuccuguuuuucagauucaucagauuucuuccccugccccccagcugggaaaaaaaaaaaaacaccucccagacacaccuuugcccuguuucuagaugggauccagguugcuuugauauauaaucuccagagucacuggguaaauaacuuugugucugcccaaccugcaggccacucccuagaacagaaccagggauucuguagggaggggcugggcaggccuaugccagggaacucauucauguuggggcagggcagaaggcugucagucacagcagucacguggggaugugagggaccuccuaggcacaggcagauuaugcacacugcaguuucucggcuggaggaaucaggaauccuacuccuguagggccaugcggacagaccggcuauugccuguguuguuaggaggagcgcaggugaucacagugagcucugcuuacccagggcuugguugaucccaugaugcuuugagagggccacaaggaauccauagaaagucagccucuggacauugcucaggaucucuuugacaagcgcuggugguggacagcuaaaagggagaauucggagggcagauuuaaucuaagugcuauuuuuucauccacaccugcaggacaucaaagcugggaggcccugcaggagcaggccauacugcagacagaggccucccugcaggagcaggccauacugcagacagaggccucccugcaggagcaggccauacugcagacagagggcugguaugcuuacugcuguucagcugguggaauuagagauggaacauguacucugccacaucccaacccauaacuaucuuuuguacagggaacauacaagaguggggaagaggacacugcuacugucagcuucuugccuggaggcugugucccucaagggccuuuguccuauacaggacaguuuaaccuucccuuucugugaauguuucuguuucaaauagccaaagcuagucuucccuuagaaaaccagauacuugagcuagucuguccucagugugcuuuaggcacacgugguuauguuuuaaaaucaugaccauccuggggcauagaaacccugaaccaaucaaaauauucugcuagagacuuguucucagcagcaaccugaucuccagggcugagguggggccucugcccaugcccaccuguacuugugccggucacacagguuuuccaggcgcugauagaacagugaugcuuccacuccauccagcauaccggcaucacccaaggcaggucguuggcgguguugcccacuggaugauguugggacaaucacuguauugggguuuuucccagauagcaaguccugauagauggcagccacacucuccaggaauucugguaccaucagaauaggaaggaacaguuuaggcaaggagguuguauuucaucucuucaccaugucuuugcuucuuugugucucagucuguccagcuucaguguagaugacaaaauaccuggagugacuacugcccucaugacacuuccuggccuagauagggacacccugaagacuugcagagcacccuacucagugacagguuugcuauguacuuacuuaucuguuuccuugcuggaauguaagcuccuugaacaauggcgagggucaugacccgauguugucuccugucccagugccuaguacuaugcuggggcacguuacaggcuauaagguuuuuuguuuuuaagagaacacauggacauucucacuggcuagccccacuucaugaggccaucugcuucaugaaaaugugcuggaggcugcagagaguaucauguuacugcccaggcuaggccucuuucaguguaaucaauauaacuugaaagaaaauaaaaaauaucauugaagagggaagagccugagccuuacaaacugcuaauuuauuaaucacuggaaggugaauuuguuuucccagcuuuguaggcagcugcuguugguaagcagugacuuauugccugcucucaacucagagcccuguagguuagagguggggaaugcgcccaaacauggcugcucuuuuccuaaggucuaagggcuucagagaaaugagauauagaugcugauguugcuacgugguguggccccagguuuagcccccaucugaacagcccuugggcugcuaucaaguaagcauaauguggcacccgagugcagccaaagcugacugcaggacugguuagcaagaaggugaucuccacagucuagagauagcguucuuuaugccuuucuuuauagauguaacaauuuuuaauuuguacucccucgcauuugaggugcauacauauauauuuauucaucuguuuuuauuccauuaagucagaaggggcuuaaaggugcaacuggaaugaacuggggagcagaauggaagugugagauagcgugugugugucuuugauuacaaucauguaccauugugucugguuuacuguguguuuauuaaaagauaugaguaugguuaaaaaaaaaaaaacaagacaaaaca

SEQ ID NO: 916 - RNA, 56393 nt, Mus musculus
cggcuucaacuccggcaguacaggaggcagcagcagcccggagggcgacuugcagggcgcgccggccgagcuggacccgggacgcuuuucaacccgggggaacccuccgcugauucucuccgccccggcgucccuugggagcccgcgggacccccgggccggcagggaacgccggcggcggccgcagcaccaugaggcggugguggggcgcgcugcugcuuggcgcccugcucugcgcacacgguaagcggcgucgcagcgcccgcgccgaccgggccaccgggaaaguuugucccugagacuggucgcugcaggacucgccuccugggagugggaccgugaggcuggggccugaagucccacccucgagcucacuucgagcaccaacccuggcagagcgagcggaggaaagcaauagcagcccccgcagcucuucuagcacgagaggggacagcgguggugggacucguccccgcuguagucugggccggguggaagaagacccaagacgcucucucggcuuccaucgcugcucuuuaacgagccaggggcggguucccuuucagguuaaggcagggcuucugugucccuggugcgugcgaaugaaugugugcaaagaaaggaaggcggggaggauggucgcuaaacccauaaauuguaaacaguucucuuuccagggacugggggaucuuggguggauugcggagaggggcccagcugaaucugaguuacuugagcauccgggauucauggacuuggggagcaauuucucggacucgaaacccugcucucucugaggguccuugguucauacuugcgugcagcaucuccccuaaguggaguuuuggguucccucuccuggcugcggccaaucagcuuccugccccggauccuccccaagggagggguggggaacagcgauggaaaagagguuggggaggaacuuugggaagaaacugcuggaaagcucccucagaucgguucuggcccggguaaagcgcaggggcgcguucuuugggaacuuccaaaggcagccucgcgacccgugcaguggggccuuggccuccggggagcugggcggauggcagcggcacugcugcuucaucugcuccuuauuaauaacguguucggugcccggacgcaacuguuaugucuacuuaggacugcaguggaaucugcuucucugcagcagcuugggaacgugggugcacccggagauuuagcagcugccucugaguuugugcccaaagaucaaagaucgaucuuugaacucucaacuauauucacccgccggcuuuuccacgugggggagauccaguucuucgauucccuggcugcgggacgagggggugggguucagaaagagcggucugcagauccuggcgauucacggguucuuucuuucacauggaggagcucguguggaaagugcagauuucggaacuugccuggcaggguguggagcugucugggcacuuguuuuaaagauuguuuuagcucccgaguccaaaacaaaguucuggugucugcuauuuaaaccgcucguggguuuucaauggcuuuuuccaugugguaucuaacgccgaccgagucuuuucucuccgacugguagucuggccgacccacguuccucuucgcgccucguucucccccucucgggcucucuccucgaagguuauuuguagccucuucggcguguuaggacagcagcccuacugggguaggaauguaacuguucuucccaccacaugggccccuuaaagggacagcuaugcuuuugggggguuuccccccuucggguuucaagggaaggggauggaacuuuccucucggcccccuggaggaaguuuugaaaaagaucaagggaaauagcuaggcacuaggaaaagggggguggggugggggcuaaaacggauaccaacaaagccaaagaggagauugucgccuucugccccagggaagggggagcuggaagguuccggacugagacucgccaagaggaauucacugcuccagagcugcugucaaaauugcguacauuacauuugcaauggaggaugggggugagaacaggagcagagaaucguggauucuuaauguuuugcagugggaaagaaaaaaaaaaaaacaacauuagaggguucucaguaacuaguugagguucauuuuuaaaggagaagguuuaauagaaauuucuaaguugagacuuccugugcauacggaguaggcagagguaggaaaauuuugugcuuugcagggcuuaauacugagccauccuuggugaccuuauagaagacagagucacaaugagguagagcaguugcagagucuguaaccaccaccccccacaaaucccaguaagaucccuaguacuaaguucagguccugaagaggugcuucugaaagcugcuguguguuacuuacacagacaaccucagcuaggagugaauucaauaccagaccaagguguuaguuuagauuuuauugauccucucaggauuucccuagagccucuccacuugguguuagccuagaucacaauccacuguucagaauuuagaaggauguggccagagacauggcucagcgguuaaagcacugcauguuccuccagaugaccuggguuucauucccaucucauacuuggcagcuccgggauguguaacuuugguuccagggaaucugacgcccucuucuggccgcuucaaguacuccacacauguggugcacagccacacacacacaaaguggagguaaaauagcuaagcauggugcuuaucucugugaugcuagcuaacacuugggcgacugaggcaagaguuguuaagcaaggaugaggucagucuggguugcguaauuugaagucauuccagacuagacagcaagacccuuuucucaaaaacaaaacaaaacaaaacaaaccacacaaaaaccuauuucacucccagcacuuaguaggugaaagcaagagguuuagaaguucaugguuauucucagauaccuugugaguucaaggcuggcuugggcuucauaagacucugucucaaaaacuaaaguuaacaacaacaacaacaacaacaacugcucuugugauuuaaauguuaagguuuuuguaaggaagugguaguagccacggguauuuucauccugugcgguacgacuggaguguauauaaaccacuucacuuggaaucuuuucuagggaagugaacccugacgauccuggccgggagugcucgcuuggguagauaaagacguuucugaagaugagugcaaaauaguuuagcuuaagacuggucuuauuuauuuccaugugguuguuguugugaccacgguugucaaggaacuugagugacauugcccuugaucucucgggacucaggcuucucacugauucuggauuuccucuucuguccccuguuggguaucagaugacaucuuugggacuggcaccuaguauuaagaguaacaggugcaagggaacuuagucaggcccugucugacacaaagcacguugggcaugcucgucuuccgcgccagcaaaggacaccggaggucacagaggacauggugcuuuguagcucuuugcauaggccuccuacagacuaauugcuaguguuggccccuaagaugaagaagggugauagaguguugcugcugcuuagagagauaacaaagggguucgugaauaagaacacaauaauuucugagacugaaaauguaccuuguuuuauuacauggccagaucucaaaucuaaagugaaguuccaugucuuuguucagcugcuagccaccaucucuacauucuuugguagagugucaccauguuuugucacagaugccuagacauagggcaugugagucccaggcuguaugaauccugguggccaucuucuccccaacagugaaugucuuccucuucuuagccuugugaguggcccaggaaggacuaggugcugagauuuaguuggcagagccugaguuuggcccuaaaaauagcacugaugaucaccuaugcuugucccugucccuggggcuuagagcuaguguguggucaggcucauucuccccaggacacucaggaacacugcccgagcugaguggugcccucaggcuccuguucauccacucagcaaacaccgugucgcacucucaucagccugcauaccuagcucaguauuugagaaagcacaggcaggcuuggguuuagcaccuggcuuugauacuucuaggugaacucaugaaaauacccuggcccuugcuucaggacucguaucugcaaaugggguuggaacuggggaggggaguggcauauuuucaccugugacauuuucgugcuguggaaauuaaaagagacuacgacagagcauuucaagucauccagcacagagccugacagcugcuauguuagcuauaggcccagauaaaugccagcuguuccuuaguaagacugccuaagugggucagagaugguucugggguuuggaauaugcggagccagauaaguuauacugcagcgucucauaugaugaaggaggcuugauccuucauuguuuuaacucguuuuuuuuccccccucugugaaauaccuuguccuuucuuuuuccuucuugaaaaccuagugaaaccuaaucauaguucccuccuguccacgcuuccagaaaagagguuuauuacuuuaugaaggaagcuaggggagaggaccaaggggguuggggggagagaggaacucccuugggaacaucccuguugagaggccaggagggagaccuacaacuccuuacacuaagaucgcugugacccagggugagagagguugccaaggucucuuguaguuggaacaguuuagaauuccaaccugucccucccacuggccugaggaaggagucaggggccccagagcucuagagguaguaauugccucaauuuggaggcugggcuguugggagccugcuuccuucacagccacagucuucaaucaggaguccugucagugugcccuauaauugaugugggucuccagccccagacucguaacccccagcuccuccaccccaaaguuugaccccuguugucucuuuguuucuuccuuuuaaguuggugccaguguugugauguuucugggaacugcagaaaguugaccguaacccagagcagccgucaagaagagcugauucuuuuagcuucccggcggucuauuuucuguugugucuuuuugauuuagcaagaagcaaacaucccaggugccucugggcaucucuuccgcccaucggagcagacuucauucuuucagugcacguaggcauucccaucugugucccgcagaugaguggauggccugucagcuauuucuaacgccugcacccccaccauucaggugagagugaggagggaggggcgcugcgugcaccccagcuggagaaagccuggcugggacuugaagcaagcccugacuuggccuaugggagcucccccucaccucuguacagagggaaggauccaagcaucgagccaagccaggaaacaaaagacuaggagcaaaccuuccaucuggcugcgaggaggcagcgacacaaaggugcugcugcacaauuuaucacuggagauuuucugcagccagggagcuccagacccucacccucaccgccccccaaccccacccuaccccccccccccccccggguguaaggccaggcagguauagacuaggguauuaggagagacaccuaauuagcacguggaggaaagcugcuucugaggucgucagugucuccuaggaucacagcccagcagcuccacuuccugucaggccugcaaggggugaggguggggggccacugcgggggugcuacguucccuucucauggucuauggagugcaacugaucuugugggcaugggugaggacaagagaaauuuuauguuggccgacugcaacaucuuaggaauuaaugaagaagcuggguuuaggcaagcaaaggggagagagucgcuuuuccuuucauuuuccccacaccagguagcugaagcaagaaguuucuacuaaagagacugagugagacaguaaaagucaaaggcuuuaaaucagcgguucucaaccucccuaaugcgguaacccuuuaguauaauuccucauguuguggugaccccaccaccauaaaauuaucucauugcuacaaaauaucaguguuucccaauggucuuaggcgaccccugugaaaggguccuuaaggcacucaaagggaucaugacccaccaguucaaaaccacuacuuuaaaugguccuucuccaaacagagguucuacuugucccuccugacuguuucuguacuacaaaauggggcaugugggcuaagacauacaaauguacucgagagaguuuugcugccuugcugauccggugauaagcaguaaucagugggaaacugagacuuagagcaauuugcugugacauggccacugaguagcugcaucaggauucgaacccagagucuaagaugagaacccuauaccucaacacaugcugccucucagaacagaguuuggaguuucuguaaauaaucuauguaugggucuauggcccacaugagugcagaugccugaggaggugagaacuggagcuauggagguugguaacuuacaugcacauucggagaauacagcacugguccucggaaagagcagccaaugcucuucguggcugaaccaucucuccaacccccagaacagaauauuuuaagucucaguugucccagaagaucuagguuggaaaaguuuacaauuggauugaccucuuugggauuuaguuacuucuuuuguuuuuuguuuuuacauuuguguguugugcauggcauggaaggauguugguucauuccuuccaccguaugugucccagggaucgaacucacucugcccucuuagcacauacaagcacacaauacuguagcugacucuuacuguaacugcuauggauccaaacucacgcuuugguagcaagcgcuaacccaccgacucaucuccccaucccacuuaguuauaauuuuaagggcuagaucucacuuuaucgcccagccuggcuccagcauccuagacuuaaggggucuugcugccucuguuuccuuaguagcugugguuacaagugcaugacacugcaccugccuuauuuuauuauuuauuuguaugagaacuggggguuaaacccaggcccuugaaugugcuaagcacucucucugccauuguccuacauagcucagcccccagaucuaucauuuauggauacuuagcaugcagcagagccagugugugguaucaccuguaauccuaacauuuggaaagcugagccagagggaucacaaguucaagacccugucuuaaagacaaaaauaaaaaagauacauaacaugcagaaggcauuaugccaaguagcucucagaaauuacauauaucucaaaacagauguguuaugaguuuuguuccauuuuuccugaugaaaacuaaaauauauuuagaugaacugcuugggaaccagaaggaacaggauuuauacucugagaaguauuguucccauggucuuuuuuuuuucuuuaaagauugauuuuuuuuauuuuauguaugugaguacacugugacuaucuucagacacacaccagaagagaugguugugagccacuaugugguuacuaggaauugaacucgggaccucuggaagaguagucagugcucuuaacugcagagccaucucuccacccuguuuacauggucucaauguuauauauuucugccuaauaacuuugggugcugaacauuaauuuuuuuaagauuuauuuauuauuauacauaaguacacuguagcugucuucagaugcaccagaagagggugucagaucucauuacagauguuugugagccacuaugugauuacugggauuugaacucaggaccuuuggaagagcagucagugcucuuaccugcugagccaucucaccaguccugaauauuaaaauuuuauuuuauggggauggagacauggcucagagauuaagagcauuuacuguucuugcagacaacccggguucgauucccagcacucaaaacucuugguaacucuaguuccauccagaagaaccaaugccaaugccuuccuuuggccuccucagugcaugcuugugugugugugugugugugugugugugugugugugugcacaugugcgcgagugcauacacacauacuaaauaaauaaauagauaaaugugauuuuauuucuuucaggguuucucucuguagcccuggcuguccuggaacucacucuguagaccaggcuggccuggaacucagaaaucugccugccucugccucccaagugcugggauuaaaggcaugcaccaccacugccuggcguauuuuuuguuuuuuguuuuuguuuuuguuuuuuuaaagugauggugguagggcggaaauuccugaacucugaccuguaaucauguaucuagugugucccuauugaguggguugccaaggaaucagauaggcaaggcucaccauuggacagaaauaagccugucaagacaugucagcucccagccugagacagagugaggaagggaguccagagggaccaaacuucaccugaguagaaccaggaagugccuggggaaggagaggagcaaaggucuccugaguccugguuguguaggaauuggcuauuuuuaugucuaccguucugagccucucuccugcuuugacccccagcucucacaagagucaagcaugcauuacccauccuuuuaacaaacuuguccuguucaucugguacacucagcacggggcucgcacugugaauaugaacauaagaacugucaggcacacaauuuuaauauccaagaagcuuaggccuagugagugagcaauacaaagggacaaagggcagggacuuccagcucagcuugggucaaauauguccagguagggcaguguuaacaaaggcuccauuuccugaucuucuguugccaacugccuacuacuuagcucugugguccaggugguggugguggugcugauggugauggugaugaugaugauuccugcuacuacuauuaaugucugcuaggcaagugaauacagaucuauagaggucucuccagacucuggguauauggggcuuauuggguccauguccauguggcuuuuuguugccauuccuuucaacuuaguuuuguuugccacaugauuguccccuggaaugugcuguuacuguguuuguuaccucgagagucagugggauugccccucucucuggacgaagguauagacuccuaaauaucucauucucauuaaauaagguuuguagccucaucauuccugccaguggacaggaaaagacggcuuugccaucuuacaaagagaacaggccuaagggugugucucagcaguagaguguauauuuagcauguuggaagccuuggguucauucccugucacuccaaaagcaaaaggaaaaggaagggaggagaggcuggagaugcaguccaguugguaaacugcuuguuagcaaguuugaagcccuggguuccaucccagcaccuccuacagcaacaggggcagacaccuguaaucucaacacucgagagucagaggcaagagggacaucuccagacucuuggauacagaauugcuuucaucuccauuuuauggaugcgcuuacagaaacuuuugguuaauuucucaaaaaauguggaaucucugcucucuacaguguuagagggucugaucacacuggugaaggucucacugguaccacacgggucaguguuugcuuucuccccuuccaaagaaagcacugggaaacugcuaagguagccggccugagggagcggagguguaaauggugagaucucgguuaaccucucagaaagauucaauaaagccagauguggaggcacacacguuuaauggaaugccagcacuuguggaccgcgcucugugaguuugaggccagccuggucuacacagcaagcaccaagucaaucggggagggcuacauaguaagaccugucuuuaaaaaagaagguucuacgagccucuuaacaugaaucccaagaauaaaggcuuuaugagagagcacaaacaccuggggcucagaccuguuccuuguugaaaugccuaaggcccuggcagcccugagagcugccugcagcguagcuggcaaacagccuucaaggauuccgauucaaugcuuacauggaaggcugcguccgcaugcguuuccuuucuuuucuuuuaugcaaaaaggguuaaaagcugcccuuuaugaucgcugccaggacuggagugaacagacagaauuccccucucuggggacccugaaggggaagcgguuguccagaagucugccuuuugggauauaaugugucugcuuccuguaugaaugcccaagucaagaguguguccggcugguggcugccuggacuucaccacagcucugauuucagccauuucucugacaugcaggaaguugugugucuuuagccaccugcaacuugauggccagcugauggaauacuucggcccugcagucagccccaggaaauuagaacugggugucucacucagccaaucacggggauaggagcggguaaaggauuaauagcuccucuuugcucucuguacuguuuaaaaaaaaaaaaguauuugggggcuggaaagauggcucagugguuuagagcucugacugcucuuccagagguccugaguucaauucccagcaaccacaugguggcucacaaccaucuggaguaggaucugaugcccucuucuggugugucugaagagagcgacagugcacucauauacuuaaaauaaauaagucuuuagccgggcagugguggcacacaccuuuaaucccagcacuugggaggcagaggcaggcagauuucugaguuugaggccagccuggucuacagagugaguuccaggacagccagggcuauacagagaaacucaaaaaaaucaaaauaaauaaauaaguaaaugguuuguuuuuauuuuauguguaugaagaguuugccugcagguguguacacccuauguacagugcccaagaguaucagaaggaggugucgaucccccuggaacuggagccacauaugacugugagcaaugugggugcuagaaaccaaacccaggacccuagaagagcagcuggugcuuuuagcugagccaucucuucagcucccuguacuuguuuccccugcauagcucccaggauacugcucaucuugcuuucccauuccucguauccaacaacuccuaagucaaggccuuuuggggaaauguggucacugugccacauuggagaaucuccccguagcuacuuaaugauaauuuccagugugccacagcauaaaaucuguuuauuccauguuuauuuguggcuuuuauuuuauuuuauuuuuuauuuucuguaacauauuaagaaacucaguuaagccugcccaugcagcuguugaucccagcuacuugggaggccaaaguagaagacuuucaaguuuaagaccugccugcccuacagaguaaguuccaggccagcaacuuuauaaaacccugaaccuuguauuaaaauaaaaaguaaaaugaggucugagaugugguuuaguggguuuaacccccagugcuacuuuucccuuaaggaaaaaaaaaagaaagaaagaaagcgaauugcacaaagucaugugccugcuugauggaacccaaggucugcuugucugcuccaggucaggcauuuacccuuuugcacucuuccauuuuaucccuucuuccuaucugucuuucuuucuggaugucccuccaggucuaccucuguucugauuguaugguacuauccauauuucuccaccuuugcugacuuaugggucaguuuacagggacaaggagcaucccgugcacugcugggguacuuagcugcaucccuggcuucuagaagcucaggcauccuggagcacugaaggaugguccccuaaaggacaaagcuguuccucuucuccugcugaaacuuacuaacuaagccuuaaguucucucugcagcuucuccacgaaggagaguugugugccagaagcauccuugcauggaauuguccacgcugcugaaucuggcccaggguuccguaaagaugugcguguacuucacugagccaguguuccucaggcucugcugucucaggucuuagugagagauguccuuauuccucagucuaggaacugagaagagcaggcaacugggcaguugcccugggcaacgggaccuucugaguuucucuggggaagaacccuccagucuuuuguagaaagacagacauugggcuugaagugagggcuuccuaugaggaaggcaaagcuguugucccuccuaaaaggacucugcuugccuucagaaggaaauucugcaucuuuccugggauaacuuuaucucuuacguguagacaauugagagaaggcuagaaauauacauuugggcauagcuugagaggcuggcucacagaugucaaaggcugauuggccauccaucuauucagccauccauugcagguuaggaagcuuugccuuaaccucacaccuuugggagagaaguaggaagacuggggaggcguagagaccaauaguaaaggaacaggaguggcaauguacagcugacccuucccaguuccagcccaggcugaaggcagggcccagcuaaugggaggaagagaggaaagcuagggacgagaugagcaacaaggcaggcccccuccuuccacagcugcagcagcucagcggguuagaugaauaaucugaggggggagagugacccuagaagaacccuuuguuccagcugaggcuggagcaggggcaccgagccauucacacgccaucccagggcauccugcuggguacucuggggagggggcacugcagccagucaugggacuuggccaggcagauagcuugaugcucaauggggaagccagcugcaugcugcugaggcugggggaggggcugcguccaccggccuuccugcaggccuuggucugucucacagacuggaaggcacugacuggagcacuggcugguccugguuagucuguccugagguggcuugaucuugucaccccuugccccgaaaaguaaaaucugaugauaggacucgcaagcuccuucgugccuccccaccuggauuccuugacaucgagaggcaccgugaucugguuucaccguucuagcuugcgucagugcuugaggcugcaagguggaggaagguuuacuugugucucaguuuucuaauuuuggaagaaagcauauagaggugucuugguagguggcggcugucccccacucuuguucugagcacaacaucccuugguggcuuuauuugucuccuggccuucagagaugcuguguaaagaugccauagacggggccacgaggcucucugugaacccaaaguccgaagcugucuuugggaucauaucugcccuggcagaggaaggaaaucugagugacaauucccuuggguuuuucuccuccccaacccuguuggcuuuggguggacaggcaucaaugcccucuuuuuccuauucuuucugcccaggaauagccagcagucuggagugugcauguggucggagccacuucacaugugcggugagcgcgcuuggcgaauguaccuguauccccgcccaguggcagugugauggagacaaugacuguggagaccacagcgaugaggauggcuguaguaaguagcaucccuggguuagcaggaggagauaaaggaugaaccaaggaguguuuuaugcuugccugccuuguguccaacuuagaguugggcucuugcaagggugaccggauguggagagagacaucgcuucuucacauguacacauuuaaaaacuuguauuucuauuggguagaucaugccucuaaccccaauaagcacacacuuugaagcguugcaaaagggcccgcaugguggcucacaccuuuaauccuagcacuugggaggcagagacgggcagaucucuugaguucgcacccagucuggucuauaaugugaguuccaagauggcuggagcuagagaaaccccuguccaaaaaaaaaaaaaaaagugagaaagagagaaaagaaaaagaaagaaaaaagaaaagaaaaagaaaacaagaaaaagaaagaaaggaaaagcaaacuuggaaaaggcauaaaagaaaauacccuuaaagacauaaauagacauuauuaaacagcucuccuuguauuugugaauucugugugcaugauacaugcauacuuuuaaauuuuuucugugcuauacauaggugcagauuguuuucauuauauuuuaauacucuguauagucaaaaauauuaaauaagauaagcuuuguaagaaaucuuauguuuggguggcuggugggguugcuuagcagguaaggauacaugccaccaaguccaaugacuguuugauccccaggacccacgugcugggcagaaccaacccuaggaaguuguucucugaccucuccauggacacuguggcuuuuguguucucucuccugcaaaaguaauaaacuuuaaaaacaggguucaaagcuauugaagaagacacccgaccaagauugacacacauguauguauccgacuaaggcuauguagcucagggcugcuugccuuguaugugugagguucuagguucaacccccuccccauacugagaggaaaaaaaaaaaaccaccuuguguucuauuuaagcuugccuuuccuccagcauagucacagacagacaaugggccaggacguccugucuuggauauauauaaaucucacuguuaagccaauugucuggauuuaaggguacaugucuggcccgcagcaucuaugucugaugguaacuaauuagucuaaugggaacgaagcuacaaccuggaccucauuaacccuaaccagcucagcuaauuaugauaauaauaaaugcuucccuuucauguagcacuuucauaugcauuaucucaaaagaccucuugugaguugagugcaauuauccccuuguguaguccaaggaacuacugcucagggagggcagaugacaucauaguaaugacuucuagaagugaaacccagaugugucaaucauccuuuaauaaaaggauaggagggaauugugucccuccuaggaucucuugaggcaggucucauacaguucuggcuggccucaagcuuaauauguggcugaagaugaccuugaacuuuccaucuuccugccccuaccucccaagugccagagugacauguguuugccuccacaccuaguuuuaugaggugcuggugaucaaacccagggccugauacguguuaggcaauguucuaccaacugaguuacaaccauagucccucuauucucuccugcccaaguuuuucuuacugcuuccucgggugucuuagacuugggggguucuugcugccccccaauucccuucagccgaucccucuucccagcugcaguuucuugggugcucuaucuaccaggggaccaaggaugggaaugaggacaauaggauuuggagcaaggaucucuggcccaguguagccugccugccugaccuuucccuucucuuggacccagcgcugccuaccugcuccccucuggacuuccacugugacaacggcaagugcauccgacgcuccugggugugugacggggacaaugacugugaagaugacucugaugagcaggacugucgugaguguugggaagggccaggcaaauuccacgggcucugucggguaaggguuuucagucagaaaaugaugccccugggucuauuugagcucucgggucuucagcucuuuucuguccuuuaccccucaucucuugaugagcuaagcccacaagaggugagcaccuccccaggagugcuggggucagcauugggacuguugacugcccuagaaggcuuuauugaggggcuuggaggcaaugugcucuucggagcagcacugugccugacucaucugugaccacagccccccgggagugugaggaggacgaauuccccugccagaacggcuacugcauucggagucuguggcacugugauggggacaacgacuguggugacaacagugacgagcaaugcggugagugggagcagaaagaggucaagaagggggucuaggguaggagcgccugugggaggagacaggagcaaagggcugugcuaccugaccugaaacugcuccagggauguggugcagcugagagaaggcaggugggcagaguagucuauccugucaggagcguggaccucccccuacccuggaaaguaaggaggauggugagauccuaugggacuccugucucauugcaccccuagacaugcgcaagugcucagacaaggaauuccgcugcagcgacggcagcugcauugcugagcauugguacugcgauggugacacagacugcaaagauggcucugaugaggaaagcugccgugagugucccuaccccugaggcgcugggcuggcacggugaccaagggcuccgguuccuagcuaaggauugacugagaggguccugugcaggcaagggagugggcguuccaaaggagcaugucggggacguaacucauacagaugcuugcuuagcagccuugguuucuauccacuucugguccacuagcguguagaagucuguagugccaucacaaaggaaagccgguuuguagcauucuggaggaagacaccuugccccugucaagaaucaggccccugucccuagucacuaaggucugaggagggcugcuuucccuuccagcuucagcaguacccucuccuccuugcaaccuggaagaguuccagugcgccuauggccgcugcauccucgacaucuaccacugugacggagaugacgacuguggagacuggucagacgagucugacugcugugagugcucuggcuagcugggaggaggggcagccagacaggaggagcuuccuccagugucagggcacaggugccagcuggggcggaaacagugucugaaauccacggucccucuggggaggagcuggaguguugggaggggcgggagaugggacuugggacuuucugcucuuccacgaggugcugugugcacggucuggcuagagacagaagaccuuuguuuccccagccucccaccagcccugccgcucuggggaauucaugugugacaguggccugugcaucaacucgggcuggcgcugugauggugaugcagacugugaugaccagucugaugaacgcaacugcagugaguuggggguagcaucaaaggcuuggggggccaaggagaaggguuugggugcagauagagcaugaagacauagugaacagcuauacaguugugugguuguaugcugcacagaggcacuauaucuaaaggauaccugucgccuaguaguccacagacuuguagacacaccauggcaguuaaaauaguaggcggaaguaagggacucugaggaaaggucaccugguucauaaagagauaccuucugcaacaccaccaucaagaagaguagccuguguacuuugggaggcagagaguuucaggcuggggugggaggaccagccuuucuuccauuaauuaggucuuugcucuguccagccaccuccaugugcacagccgaacaguuucgcugucggucaggccguugcguccgucuguccuggcgcugugauggggaggaugacugugcggacaacagcgaugaagaaaacugugagaacacagguggaguccccagcgguauccccgcccugcccuaauguugggagugggaggcagagaagcaaagggaacauugccauugcuuucaauggccuggacuugcccugcccuucccagugaguagggucagauccagcuguuggagcaggggagauagcacuugcuaugcaagcacaaggacccaaguucaaaucccuagcacccaaguuaaaaagcuagguauggcugugagugccuguaacaccaccgcuggggggggaagagaaagucagaccccugaagcucauuaaccaaccagccucaccaaauggccagcuccugauucaaugagaaaccuugucucaaggcaauaagacagagaaugaacgauaaaguuaucagauauuguccuuggccucugcacacacagguaugggcacacauacccauauucauagucacaugcguguaccacacauccacacaacauaucacauacguacacacacaugcacaugcacaauccagaugcgcugaggaacuguguacaguucuugaacacagagucaaggcugugagucuuugcagcugcucaaauucucacuuccaaucuggccuugggaggaagggcuguuguccagccaguagcccagugucuacuuccacucugcaggaaggacuggcagucucugcgucugcuccccgcccaccccaccagucccugcuaaaccugguucugacuacaagacuacacuccgacucuguucccaucacucauccaucguggaaucccagggagaaaacaaacucagacacucaaccagccuugucugagcuguuuccugccucggaccccaucccucccaccuugacgcucagcuggcuccacuuuacccuagaaaaugacaggcuccugucccuuguggacucaagcccugcccuccugugaccugacucucccccuccucccucucuuucuaggaagcccccagugcgccucugaccaguuccuguguuggaacgggcgcuguauugggcagaggaagcugugcaacgggaucaacgacugcggugacagcagugacgaaaguccacagcagaacugucgugagugucucuagcgggugggcccugcccgugguuuguggcugagccccaccccuaggguucaaagggaggccucccuugggacucucacaguuuuugggagcuguucuucgugguccagguggaaugccaaguuggcuggacggggguggauucugggcucggcucccaacucuggcuuggcugucacagggccccggacgggugaggagaacugcaauguuaacaacgguggcugugcccagaagugucagauggugcgaggggcagugcaguguaccugccacacaggcuaccggcucacagaggaugggagaacgugccagggugagcuggggccuguuggggguggggggaaggaggggagggaagcugggugacauaucagaugggugugaccuugacucaucguuacacugacccugggaaguagggaucauuucucucauuuugcagauagggaaacagaagugcagagaguauagguaauuuacccaaagccacacagauaguaagcagccgaguuggaguuugaaaucugagacuccaugaccucaaagcccgaaccacugguuacacaguuucccuccuggcuguggcaguggauggggauauggagcugugaccagggagacaaugggguggcuuaggagugugugggaagaugguuguaggcaggcuuccucacccugccugguauccacagauguaaacgaaugugcugaggagggguacugcagccagggcugcacaaacacugaaggggcuuuccagugcuggugugaagcaggguaugagcuacggcccgaucggcgcagcugcaaagcucuggguaaggaggguuggcacuugccugggugggcggaacagacaaaagccagguguuagagcugagggauuugcuaagauguagacugauuuuuuugcaaauugcaaucugggcgccaagugaaaggcgauuggguuugggguuagaaaggauucuaguguucuaguccaaauuucagcagcuugggacaugcucuagugggcaaagggccccagcuaugagcugaggcccugagggugcaugcugauggguaucuguggcucugaggcccaguggguccuauuucuaugcuguguccagggccagaaccugugcuacuguuugccaaucguaucgacauccggcaggugcucccgcaccgcuccgaguacacgcugcuacugaacaaccuggagaacgccauugcccucgacuuucaucaccggcgggagcuggucuucuggucggaugucacccuggaccgcauccuccgugccaaccuuaauggcagcaauguagaggagguggugucuacugggcuagagagcccagguaggaaaacaaggcccugaguggagagccuggaaugccaugugcaaaaaaacacagcggaaagggggggccgggccaguguuuccaaagugcacaaagcagaaggccucuuccagugaaaucuugggugaaacucucagauaggaaccaacugaggaguugaaaaugcugcucaauugguagagugcuugcuuagcaugaacacaaagcucuaagcuugauuccccaagcacugcauaaaccagacaugaugaugccugccugucaucugaagagguagaagcaaaaggaucagaaaaguucaaggucauucaguuuaaagccgggcugagauacacgagacccccaucuccacauacaaaaagcaauagcuaaucugguggccucaggcuuauccuacaagcagguuaagugacuaagaagucagcagcauccagggcuggaguugcaacucaguaggacagcaccugccuacuuaugaaaggcacugauuuccauccacacacagcaccagggcguccagaguucaaggccauccccagcucuguguggaugaagugcgugaccccggucaacugcuugacuucccuucccacucugggaagcucagugccaagcucacagagacgaugugugucagaguuacaacaagguccuagccucagaagcaacgucuuguaagagucugcucuuguuuccaggacgcagagcuaccuagggugaauggcugacacucuucccuugccuccucucaccagggggccuagcgguggauuggguccaugacaagcucuacuggaccgacucugggacgucgaggauugagguggcuaaucuggauggggcccaccggaaggugcugcuauggcagagccuagagaagcccagagccauugcccuacaccccauggaggggugaguaggugucucaaauuuccaggucccuccugcagcaggcagggauuguucucaggccucugggccaggcacugugggucuuccucagagcaguguuggcaauauggacucuguacccagaugcccuugcguccugggucuguaguguguggcugaacauccuuggcuuacucaaccucuccguguuccuucauuuuucucuuucauucuuuuguuucuuuucuuuucuuuugaauauauauaaguaaacccuucaaacacaccagaagagggcaucuggucccauuacagaugguugcgagccaccauaugguugcugggauuugaacucaggaccucuggaagagcagucagugcuuuuaauugcugagccaucucuccaacucccucccucuucauuuauuucuugguuggcaaauuaaaaacaaacacauauaaagcaaacauaaaauaggcauauucgggaggugaccgcagaaggauugggacuucagcuacagaguuggugaccaaccuaagcuauugagacccugaucuaaauaaagauacaacugcuccuacaaauaucuaagguuaaaauaaugaagcauuuugaauggaauaaaauauacuaauuagguaaguuugaacugccuaguguuuuuuuauuagcccauagagugaagcuaauuaaaaauuauuauuaauuuaaagcagccaguaguugagguaauuaauaucauuaauuugaaauaauuuuaaaaauuaauagacaagucuccugcauugaagucucuugaaaugaaaauuccuagccucuggccuguauacauuccaugccaccucuugaggggaugacucgcaagauccugcaauuagaugucaacuguuugagaaguauggugugagggagagggggcauagaacaggccaggcagcagaagagacugagaaagaagagccuguguguccuaacauauacacugcacucucucgucgucuucacgggcucagggauugcuguccacugcuccguuucuagcgccgguugcaccccuuccauagcaggcacuuuuaaaaaucugaugaacaaaugcucugucuccaggcaauucaaucgagauacuuaaaacaucauucuucagaacuggugauacagcucugugauaaaacaguugccucgcguuagguucuggguuuaacucguuggguucagucuucaaacacgggggggagggaggaagcauuuuaaauaaguaaauuuuuuuuuugaaaaaagcauacuucaaagccgggcaugguagcauaugccuuuaaucccaguacucagugaagcagauggagcucugaguuugaggccagccugaucuacacagugaguuccaggccagccuggucuacauagugagugccaggucagccaaggcuauauagugagacccugccucaaagauagaugauagauagauagauagauagauagauugauagauagauagauagauaauaaacuaacaaacagacacaaacaaaugaauaaacaaacgagaugguuuccaggcaaacgggugaaacccaacguguaaagccgucuccuguuccgucaccguggcugucauucaucaguccuccgccauccaucucuugacuuccuuucuuccuagaaccauuuauuggacagacuggggcaacaccccccgcauugaggccuccagcauggacggcucugggcgucgcaucauugcugacacucaucuuuucuggcccaacggccucaccaucgacuacgcuggucgccgcauguacuggguggaugcuaagcaccacgucaucgagagggccaaucuagaugggagucaccgcaaggcugucauuagccagggugaggucuuuggugugcugucuuucaucucucugcuccuuccccaauccugcccccaggagccuuggcagagggugagauguguguggcugccaggucuggcugggcucaggggccauggcaggccaugucuggacuaaggucuuuuuggacugucuccaggccucccacaucccuuugccaucacaguguuugaagacagcuuguauuggacagacuggcacaccaagagcaucaauagugccaacaaguuuacggggaagaaccaggaaaucauucgcaacaagcuccacuuuccuauggacauucauaccuugcacccccagcgccagcccgcagguaaaaaaaaaaaaaaaaaaaaaaaaaaaaaaaaaagucacaucaagugagcuagauuugucaccagugauguggcugcuggugccucuugagaauccgccuugcacuuguuacagauacagugaauuccagucagggaaguccagagcuggcauuaacaugggcuacuugcucucucugcuggacauuuaggguaguacaacaucaggacucaucuggcuuuuuccauaaaaugcaaacauuuacagguacucguauucacaucuggaaaagauaucgaaauuaaucccacagaguugguuuuuucuuuuuuuaauagacuaauuuguuuucauuucaaauguuaucccuuuuccugguuuccacucugcaaaccccuuaucccauccccccuuacaacacuucuaugagggugcucccccacccauccacuccuaccucaucauccuagcauuccuccacacuggggcauggagccuucacaagaccaagugccuccccuuccacugaugccagagauggccccuucaguuccuucaguccuuccccuaacuccuccauuggggucccugggcucaguccaaugguuggcugcaaacauccacaucuguauuggucaggaacugacagagccucucaggagacagcuguaucaggcuccugucagcaagcacuucuuggcaucaacacuaauguuuagguuuggugucugcaccccacagaguucuuuuuuuggagggggguucaagacaggguuucucuguauagcccuggcuguccuggagcucacuuuuguagaccaggcuggccucgaacucagaaaucugccugccuuugccucccaagugcuggcugggauuaaaggcgugugccaccaccacccugccagaguucuugaagaaaacccuccaacccuuuguccugguggggucuaccuuuguaagcguuucauuuuuccugaucaucuugcucugggcucuuugagcagggaaaaaccgcuguggggacaacaauggagguugcacucaccugugucuacccaguggccagaacuacaccugugccugccccaccggcuuccgcaagaucaacagccacgccugugcccagaguaaguggguuugggacaccagccucagaggaggugccuuuuggggacaguuagaaggagcagugagaggaguuggagggaaggcuugucaggcagggagggccagauuccucaaggaauccaugacugacuguagagaccgagggcuuccaagucaaagcugaggaccuagaacccagugguagcuggaggcaucauucaguguacaaacaccuagcucucaccucaacaggcagaaugccuucugucugcgcagaaagaagguccaguuccucuaaaaagcagggcagugguuuccaacuucugucccuuuagccugauccauagaagaguuuguguuguuagaauagagagcaacugggaucccagaugaugaucugugaccaccaaguaaaagaugauaggauucccuggucucuuccauaaucucugcuuugguuccuuagagcuccuacaagacaauuuuaccuugcaaagucagcccuagaaaucucggcacaaaggugaccuuaucuaaggcuaguccagggaguuguugaucaggcauagggcaugaccagcaagagggcaggauuaauucauuauguauccgucacaacgaauucaacauguauguauucaugcuguauaauccacugacucucuuaaaucuaauuaaaaucgaaauugggagacuagggugugguggugucuaucuaaccccagagcugggugcauagggaggcaggcagaucccugaagcucacaagccagccagucuagccaaucagugggguuugaauucacugagagaacuugucucaaaaugaguaauaaggugaagauguaggagaagcugcacaacuuccacauguacacauguuuacacauacucauauacaauuucacaaacauacagacauacacagaggcaagaaucagauucucugggcccuguccaaacagugacuggggaaaauauuuugagguuucauucagauacauacugagaacuaguuucauacuguauguuuuuuccugggccuuuuuuuuuuuuuuuuuuuuuugagucaggguuucucuguauagcccuggcaguccuggaacucacucuguagaccaggcuggccucacacucaagagcuccgccugccucugccuccugagugcugggauaaaggcgugaccaccacugccugccuucuugugcccaucugcuucugcugucuuagaugcaaaaugcuuccagggacauucucccaaugauuuaucaaggcuuggaagagggauuuggaaguuaggcagaagcuccuuucugaguaucgauauacauagguuuucauauuuguggguuucuugucugugcauuuaaucaacuguggauggaaauuuuaaaacugugucuguacugaagauguaguacccuuuaaaaagaugcacuacauagauguguguguguguguguguguguguguguguguguguguguaugagaucagaggacaaccuaucagaguuuucuccuuuuauccuguggguucuaaagcuggaacucagaucgauagguggaguggcacgugagccaucuugcuggccuguaugggcucuuuugguuauuauuaucucaagaacacauuagagucacuggggagauggcucagcugcucuuucagagaauccagauucaguuucuguuucccacacaguagcucacagccgccugucacucugguuccagggccucugaugacguucucuggucuuucaagggcccaaggcacacguauggcacacaugugugcaugcaggcaagacacucuuugugucuuagagacaggguuucucuguaacuugugaacacuauagccuugucugucuuggaacuugcucuguagaucaggcugguuuugaauuuagagauccgccugccucugccucccaagugcugggauuaaagacuuacauacauauuucuggaaaagagaaggauagaauauaagccaucuaaauaggaauuauauuccacauugaauccucagugucaagcaaacaaauacauuauguuagauauguagauauagauuacaaguaauccagagauuacuuagauuaugugggauaugcacagguuauaugaaacaaauacauuauguuagauauguagauauagauuacaaguaauccagagauuacuuagauuaugugggauaugcacagguuauaugaaaaugcuacccuguuuuauauaagggcccagaguaucuaugaguugaguaucugcgggcgucuuagaaacaauucccugcacauagcaaaggcuaacuguacugggaaaaauauuuagacaagccagaggaggccuagaggaugggaaagcugcuguggaaagcagugcccaaauuucccuuuggagcaggccugagccccaguucugggacacaacacugagcccugagcaugcucccugaucucuguuagccucaugugcucuucugaaaacgggagcaagaauaacauguacuacaaagcacugguaugggauguugcccuuguuuuuucuuugucuccuuccuuccuugucugucugucugucucuuuuuuuuuuuaaagauuuuauuuauuuauuuaauauauguaaugaguacauuguaacugucugaagacacuccagaagagagcaucggaucucauuacagaugguugugagccaccauaugguugcugggaauugaacucaggaccuuuggaagagcagucagugcucuuaaccucugagccaucucuccaguccccugucugucucuuuuuagcauacaaaauauaggguuuauuauggcauuugcaaacucuuuuuucccuguuucuccgucuucucacccauuccccugcacaagccccgcccccauacccuuguacuucucuuggucuccuuucugcugaggucacaugcccuuugacuucccccuuuucugaacagcauuucccccucaugauccucuaucuaauuucguagccucugcccucauucauagccacucacacaugccucuaacccuugucaguuaggauucacauaugagagagaacguuuuucucuuguuuucacuuuuugaaucugggucaccucacuuacugacaacacauuucaaauccauucauuauauugugagggucauaauuuuauuuaucuuuaugaccgaguagaacaacacugcaugucuauaccgagcauugagccuuucaaggaaggaacuuagugagcagucauuauuggcuaaucugugaagagaacagcagauggaaugaucauucuagaugacagaguagaaacagaaacuuuagcccgguagcaugucuguaauuccagcacuuaggaggcugagguaggaggauggaguuugagaagagucuguagaaagacccugucucagagaagcaaaagaccagaagaccugaaauaggacaaaggucucagaaguaaccugggaguuggcaguggcccagccacgccacuggaaacagccaagggaagucaggggagagaacaguucgaaugaagcugauagacgccuaagcaguggaguaaacucugcucccacuggacucuaacguguaauccccgaggagaagcugagcugggcugcagggcaccugcagugugaagaguagggggcaaagggcagcaggucccaggaagugugauugaaccaggugucacacaggugagcaucugugucugucaccauuacuggauuuagagcauuaaaaggagaccccucucggccuuugaucaggucuugacaaguuccugcuuuuugcccgaaggauggacauccgucggaucagcuucgacacagaggaccuguccgacgaugucaucccacuggcugacgugcgcagugcuguggcccuugacugggacucccgggaugaccacguguauuggacagaugucagcacugauaccaucagcagggccaagugggauggaacaggacaggagguagggcugcgcggaucuagucccuccaggaggggaaguguuucccguuccuugugguugguggaguuugggcuccagagcuggaauaggagugcagacagugauaaacuuugcuuccugcucaggugguaguggauaccaguuuggagagcccugcuggccuggcaauugauugggucaccaacaagcucuacuggacagaugcagguauguacagggacccuggcugucuugagucuucugagucuuuaguucuuaucuaaauugcaacuuuuaugugcuauacuuggugcuuguaaauauuuuguggcaucuugaacaaugaacuuaugaccuguuuuguuuuguuuuuuguuccaugaauguccagacaaaauaggcauuuuuuucuaugagucuuagugggguagagacuugggagauaaaaagaauaucucuaaacuagcauucuucaaagugugguuucuggaacaacaucagcauguccugagaaguugugagaaauuuagauccuggacuuacucaaaaucuugaggaauugauuggaaaaaucuuuacagauccauucauguguaugugugugccugaguguguguauguagaccagauauguauguacaggugcccauggaagccagacuagggugucacaucccuuggaacuuaguuacaagcagucuugaaccacccaauguggguguugggaacugaaccugugucauuugcaagagcagcaagcacucuuaaccccugagccaucaauccagccacaggaaucuguauuguaacaagcucuccucauuuuugugugcacugagaucggggaauugucuccucgaaucauaggauggagugggcuuccuaagguuuagaaacuugugcuguuccaaggagugaaacuaaccacagccuugaauuuucucucauaguuucagucaguaaauauccauugaguauucacuacaaaauccuugccaagcauuuacugcauacagagcucugugcuaggcaggaguggggccagaaggaaaaagcaagccuggaauuaaauuuuuuuuucccugaucccuugguaggcacggacaggaucgaaguggccaacacagauggcagcaugaggacagugcucaucugggagaaccuugaccguccucgggacauagugguagagcccaugggcggguacgugcugucccuucugagccccagcucccgcaagaacuggguacaagaugggaaucuggagauuagggagaggggccagaucuguggaugugcuaagggcagagggagcgcgagaaaucacugucuccucucuggcaagagaaccuuuuaaauuuuaaauuuucuuuaaaaagauuuuuuauuguuguuugcuuauaaaaucaauuuuauuauuaaagaauauuaaauuuguaggggcuggagauuuagcucagagguuaagagcacugucugcucuuccagagguccugaguucaauucccaacaaccacauggugacucacaaccaucuguaaugagaucuggugcccucuucuggccugcagacauaaugcaggcagaaagcuuuauacauaauaaauaauuaaaucuuuuuuuuuuuuuuuuuuuuuuuuugguuuuucgagacaggguuucucuguauagcccuggcuguccuggaacucacguuguagaccagguuggccucgaacucagaaauccaccugccucugccucccaagugcugggauuaaaggugugcgccaccacgcccggccaauaaaugaaucuuuaaaaaauuauuaaauuuguagaaaacaaaauucuuaccuucagcauaaucauuguuagcacuuuaaagcauauuuuucugaaauauauuuuucucuaaaugcccacaaauauugauggugguggugguggugauggcagccacacuuuggguuuuauaaaagugacaucguuugggaaccagauaaaccagacagaccaaacaaaacccccaaacugccccccccugcacaaaagcuauacuucaguuuggcuauauauccuucauagcuuccucaccagauuauauaguccugccuugcucuucuucauaguuacaaaaaauuuugugaacuuacguguccuaauuacuuaaugcguguagucaagagaauauguuuucuggacacagcaguacacgcggaguucacucucccucuucuuucuucacaccuaaggaggucucuucugcuacauacuuuaagauguggccgcucaucuauaagacucugagguaucuuuugauagugaaggaagauauaagccuucagggacacggcucugaguccaggcuuaggguaacucuuggagcagaaccccuaaaagccuuugaggacccugcacccucaucgguauuucuuccgugcuguggauugacccuccaccucacucacauaagcuuggaagucuaaaagccccuuugcuuuuauccagguacauguauuggacugacuggggugcaagucccaagauugaacgggcuggcauggacgccuccagccgacaagucaucaucucuucgaaccugaccuggccuaauggauuggcuauugacuacggcucucagcggcuguacugggcggaugccggcaugaagacuauugaauuugcugggcuggauggcagcaagaggaagguaaaggugccacuagaacaucuugcccugcucuggaagccuccagggaagcauccucuggcugguggcugacaggagcuagggggacccagaaguuauggggccagcaugggacagaugcuguuugucuaagacuguagcuccaggggacauggggcugcugguugacgauucaagcuuauuaggaauuaggguggacagugggcuggacacacacacacagaggcuuucuuaaucuccauagcaacugaugguaaucaaucaccuacuuuguaccuggccaaugacugggcugccucucuuuugccguuguuuauuuuguuauccuuuccaacuuucaggaaaauugcaagagcauaagaggaauaauauuuugccacauuucccguaccauucucuuuguucuuuucccccuuccuccuucccuccuccccuccucucucuccacacacauacaaacauacacaaauaugaacaugcacacacacaauuauuuuucugaaucaucugagauuaaauuggaaacauucugccacaguugcaauauuuucccagcgcguauuucuuaagaaccuuauaugguaaaacugagccuggagaaagcacaguagguaaaaaucacuggccacagaagcacgaggaccugaguucgaauucccguguccguccacauaaacucuguacagaguagcacgaauaucuguuauccuaggacucccaagggaagucgggaggcagagacacgagaaucccagaagcucagaagccugcuaucuuggcauacacagcagaaaaacaacagagacugguggaaggugaagacacguacaugaguuuauccucugacuuucacacaggcacaucgauuguacccacacagauaucacacacacugaaaaacaaacaaaagaacaaugaaauuaauguuaacaugauauuacugugcaacucacagucuguguuuaaauucauuuccaauuucuucaauaaugccuuuuaauaauuuuaauuuuuuucucuuuuacuccaauaucuaauccagaaucacucauugcauuuacugacccugccccccaccccagccucccuggggccuugcuauaugacagggccuugcuauauagcccaagcuggccucaaaccugggcaauccuccugucugguccugcucaguucugggacaauaggccuguaccaacaugcccagcucauaaucaugucucuuuaacuucuaaucuuguuucuuccucagacuuuccuaaccuuucuguuuaaaacaaaaccauuuauuuaguuugugugcacuacagugcaugcauggaggucagaagacaguuuguaggaauugguuuucuccuucuaccacauggaguccagagauugaacucagaucgccauauuugguggcaagccucuuuacucccugagacaccuugcuggccagucuuuccauuuucaaaaaggaaaaaucccuuucuuaugguaucuauuuugauugcuuggucaagguggcauccucuauaaagcugugugugugucuacacuggagauaugcaagugccauuuuccaguagccacacagcacuuaaauagguguuaacacacgcuggcagacacgagcugagagacaagcucuaggucacaggaacuugcuuccuagcacuuugcuaagcuccugccucaucccuguacuguuucgugaugcaaguguuggggccuuccagguacuaauuggaagccagcucccccacccuuuugggcugacucuauauggacagcgcaucuauuggacugacuggcagaccaagaguauacaaagugcugaccggcugacugggcuagaccgggagacucugcaggagaaccuggagaaccucauggacauucaugucuuccaccgccagaggccuccagguaagcagccagcagcagcugcuggcuucucccucaaccuuuccauucccuagcugcccccauugaaagcucccucucccucuauagugacgacgcugugugccguggagaauggcggcugcagccauuugugucucagguccccaaauccgagcggcuucagcugcaccugccccacagguaucaaccugcuacgagauggcaagacaugcucaccaggugagucaaagcauggucuguguggguggaaaggggcugccccuccucugcaggaauccucugauauggucagagaaucuguggaagagugagggcuuuuaggagaaggagcagguagacaggauggagaucagguuccgucguuucuuguggucuucuuggauagcagcgagacuguccugucucaacacucucgccuguugcaaaguuacaauacaauaauuuguuuagaacaggacacuccuuuggagaaacuuggugaaauaaauguaagaaauguguccuaucuacaaugguuugguacccucucuuucuuagaugugccacuuuugugagcauagaccugugugucauucuuaugggaggaccccagaaguaaggccuagcugcucagauguuagggguccagguuucuccuagggcuacugugugggaggcuuggacucuaaccucauaaagaaucugaaugccucucagcuggugaaugaagcuuucugggacccuauucuccacuucuuaagcuuuaugauaaaaggguccuuccaagagugcugcugcuaugauacugcuuucuguuccacuccuguuuuuuaauuguguuuguguguguguguguguguguguguggugugugucucugucugucugucugucagaggauaacauaagguagucuguuuucuccuucuaucaaauggguccuggagacugaauucaggucaucaggcuaauugcaagcaucuucacccacugagucaucuugccacaccucuuuccauagaauaaaugaagaggugagccgggcagggugauauacaccuaugaucccagcccuugggagaauuaggaguugaggacccuccucauccacacagugaugucaaggccagucuaggccauaugaggccccuuuucaagcucuccuaacacccaaaaaggaaguaccauuuauacauacgugcaaagccuagugcucaguacuuuauguauuuauacaauuucuuuucuuucuuauaguuauccuguuauuaaccccauuauauagaccaggcuuaaauaacuucaguaauuugccuaggcucauaccaccagaccaauauaguauuggacuucaguuagccugccuccaauuccucuuagugucucugcuagagugacuguccucccuccuucucucuccaccugggcaggcaugaacaguuuccucaucuucgccaggaggauugauguucgcauggucuccuuggauaucccuuauuuugcugauguggugguacccaucaacaugaccaugaagaacaccaucgccauuggaguggauccgcuggaaggugugugugugugugacucuuguucucaucuauauuucugugccugaucaaaagccaucaguguccuuucuuccuccaccuuugccuucuguuccugcugucacugccaagagcggcccugcugugacaucuccccacuuggauccauuuccccucuuugccugucccagugucucaggcucugagucaguugugggugccucugugggcaggcaggaccuggguugagucaagccuucccucucaggaaaaguguacuggucugacagcacgcugcacaggaucagccgugccagccuggauggcucacagcaugaggacaucaucacuacaggugagccuuccucccaacccgagggccaccugucuggcuaaagagcugggaaauaucccaucugucuuaaggcaggagucagugugcucuuccgacauccugcaggucugcagaccacagacgggcuugcaguggaugccaucggccggaaaguguacuggacagacacaggaacgaaucggauugaaguuggcaaccuggaugggucuaugcggaaaguguugguguggcagaaccuugacaguccccgggccauuguauuauaccaugaaauggggugagagcuggcuuuaucacucugaguggaccaagcuuagccgagacuauggauaggugaaggugugcacagcggaaaugaccaugaagcauaggagcacugugaacccuguaggucacgaaggcugaccccugaccccggacuguuccacucccuggcagcuucuuucauugugucaauguaguguacagcguuaaagcaugagccuugccaucaguagacaggaugcaagagccggggaaauccaucacuuaguaaagugcuugccacacaagcaugaagacccaaguuuggaaucucaguacccaaauagaaagcuagguacagugauaagugccuaugauccuaauacuggagaggcagaaauaggaggagcccggagauugcuggccagcuaggcuugcuggaccaaugggccccagguucagcaaaagauccuauguuaaaauaauaauaauaauaagguagaggguuggagagauggcucagcaguuaaagagcacugacugcucuuccagagguccugaguucaauucccagcaaccacauggugguucacagccgucuauaaugggagcugaugcccucuucuggugugugucugaagacagcuauaguguacucauacauuaaaugaauaauaaaucuaaaguagaaagugaauggggaccauccaucucuggccucaagccucacgugcacucgcauggcaugcaccugcaugcacacacacaccauguaccugcaugcacgaggacacacacagagaccaaaauuccaauucucccauguguauuagcuucuucacuuuggaugcaauguuuaaaaucucugauccuuaucagcuucuuccccugucaagcaagagacaguaaaauguacacuuugucacccacccuugcgagggugagcuaauaaugugugugaaguguuuggcgcaccauaggaacgccacaguauguucgacgcacugcagguauuugcagacuaugggagcuauuagaauaaccagcuguuccacuuccuccaucagguucauguacuggacagacuggggggagaacgccaaauuagagcguuccggaauggauggcucagaccguacugugcucaucaacaacaaccuaggguggcccaauggacugacuguggacaagaccaguucccaacugcugugggcugaugcccauacugaggugagagcccugccccugcuucccagaagccugggaagauggaagagagcuguucaggaucuuuagugaaggccccugguggacuaagagccaccuccgcucaaucuccuccacagagaauugagguggcagaccugaauggcgcuaaucggcauacacuggugucaccaguccagcacccauauggccucacucugcuugacuccuauaucuacuggacugacuggcagacccgcagcauccaccgggccgacaagaguacuggcagcaaugucauccuugugagguccaaccugccaggccucauggacauccaagcuguugaccgggcacagccacugggugagaagauccuaggauucuugacucagagccaccggauuucuggggcuaucacgacagcagaauauagccagagcacagaguuacuuucagacagagagacuuccuaagcuccacuucugggauaagucuuuugucccucuagguaugguugguacuccacaggucuucggugcugcuaccuacaaagagcucucagagacauuugcucuaccucauuucugccaaacacugacucuugucacuaagagcaguaaguuacccauagagacuagguccuuuaugagcgauugcuagccuccacaggcuggguaugaaagcucuagucucccaggcugggugugaacacucuagccucccaagcugggugugaaagcucuagccaccuagggugggugugaaugcucuagucccccaggcugggugugaacacucuagccucucagguugggugugaacacucuagccuccuaggcugguugugaaugcuugaugcuccucuuucaccagguuuuaauaaauguggcucaagaaauggcggcuguucccaccucuguuuaccucggccuucugguuucuccugugccugucccacuggcauucagcugaagggagacaggaagaccugugaccccucuccagaaaccuaccugcucuucucuagccgaggcucuauucgccguaucucacuggacaccgaugaccacacagacgugcacguuccuguuccugggcucaacaaugucaucucccuagacuaugacagugugcauggaaaggucuauuacacagauguguuccuggauguuaucagguaugaguggcacuggaacaggugggggacacagaccugauccugagcagucaugugugagguuacauucucuauugacgaauaagcggacuggauggcuuggccguuugacauggaguuagauuucugaccacuucacagugguccacacuuacauugcuuguuugcuguuuuggugacuguaaagcuacucaggggccugagauuggaagaucgauaguuagaggccucauaggcaagguccagucucaaaagaguaagagcagaguugcuuaccaugguuccccaccuacaaucucagcccuuaggaggccgaggcaggauggcuuggguugacgaucagccuggacaauguagcaaccuucugucucaaaaacaauaaacaggaugcagcucagagugcucgggaagugcacucugaaagugaaagcacuggggggugggggggugggggucucagcagagccggaagugaucgcuugagguagaaagaucacaaguucaaguucaaggccaucuuuggcuauauaaugagcuagcucgaggccugggcugcgcugugugagacaucucaaaaacguguguguauguauguguaugugugugugucugugugucugugucuguaugugugucugucucugugugucugucucugugugucugucugugucugugugugugucugucugugucugugaguaugugugugucucugugugugugugugugugucugucugugucugugugugugucugucugugucugugaguaugugugugucucugugugugucuguguauguaucacagaaaccugguauguuaaacaaacaaacaugaugccaaguugggaaccuggagcuuccacacuagugucaggcccugaggggacucuaagagcccucuaaggcaggugaaaaguuagaagcuauauuguggcauagggaccuuagcccaacauuaaguuuuauauugcuuuaccuggauauuuugagugacuuuuuuuuugcuauuauuuuuauuauucuuuuuuuuuaaagauuuauuuauuuauuauauguaaguacacuguagcugucuucagacacaccagaagagggcaucagaucucuguuacaggugguugugagccaccaugugguugcugggauuugaacuucugaccuuuggaagagcagucgggugcucuuacccccugagccaucucaccagccccuuuuauuauucuuuauauuucuuauuucaacacaacucaagaauaugauaucaugucaauacuagagacuuaccauggcagaaauucuuacaugggauauagaaaucuuugccuuuguucuccugagggugcauucagauuucauguggugugugcaguuuagagaaaucccccaggugacuacgacguaauccuugucccuggugcauuaguuucuguuuaaaagcacagaucgguuuuagcaaaccuuuccuuucugucucugcuuugcuuugcuuugcuuugcucucgagacugaacccagggccagaguucuaccacugaccuacacucucagccccaaucuaccugucuaauaaucaccccagguagcaauucuuguguccucacaggauauauuaggaaugacuuaauuuguccuacggcaaacccuauacauccaaacccucuugaaggaaacagucuuaagauaaucugccuguauugagcacccaccauugcuggguacugaggaacaugcuguaucugucucuauagaguuuauagugaauuucaggguacgauuucugguuagucugguuacucgagcagcccugcauugucccuaaggcgagcagaccugaauggcagcaacauggagacuguuauuggacacgggcuuaagaccacugacgggcuggcaguggacuggguugccagaaaccuguacuggacagauaccggccgaaauaccaucgaagcaucucggcuagauggauccugucgcaaagugcuaaucaacaacagucuagacgagccccgggccauugcuguuuuccccagaaagggguaaguucaugucuagcgggaaagaguuccagucuagaagggacugguagaaaagcagcucccagaauguguuuacagauuaaugggugggugguagccacuauauucugccaaucucuuugugacaauggcgcuauuguaucuuagguaccucuucuggacagacuggggccacauugccaagauugaacgggcaaaccuggauggcucugagaggaagguccucaucaacacagaccuaggcuggcccaacggccucaccuuggacuaugauacccgcaggugaggacccugguccagacagcugccugggaauagagggcgggccaaggagagcacagagguuggcaugggggugggggggggagaaaauauggaaaaucccuggacagaugaggaagaggaaacagggaaagggguaagacaaugcagucaggccgggcgugguggcgcacgccuuuaaucccagcacucgggaggcagaggcaggcggauuucugaguucaaggccaaccuggucuacagagugaguuccaggacagccagggcuacacagagaaacccugucucgaaaaaccaaaauaaauuaaaaaaaaaaaaaaaaaaagacaaugcagucagcaccaggcuugcugaauccagcccugagccuucaguggcuuuggucuccuugguuugcaaguucugaggauuaucaguagacagacuguguccuauuuuacauauccauuuagggucuuagauuuguggcuuaccugcagaagcaauaggcucugggauugguaauuucuccucuagauuagggugaaaaaaagggaagggcagaggagggugacuuccccuuccugcccccggaggaaaagaauuaaggucaggucaccuggagaguugguagggugaccucuucuuuuaaccuugguuagguagggccacauggccugaacccuuucugaagaccauuuauaaaacugugggcuuagauuuccggcuaggacccaaagggugaucaaguugccaaggaaaggcugcgggugguccuaaauucucuguguccccacagcuucagguucccugcuuaugaguuacauucuguucuuuagcuguggggcucauggugaccucucgucaggaguguuuccugacugcgccugccaguucagcuuggggaggaacaggaagcaccuuauggggaagaaccaucugccccacccccuucucuuucucuucucaggaucuacuggguagaugcacaucuggaucggaucgagagugcugaccucaaugggaagcugaggcaggucuuggucagccaugugucccaccccuuugcccucacacagguacuggcucaggagagagguaacuagaccucccugacuaggguguuuccuggggauccuaagccacuuagagaguacucugcuauccuggcccagcacuuccguguucugucauuugaaggccuggcucucaaaaagaggugcaacuugugccggggcccuggcuauagagaaguugcuuugugaugacugagcccaggaacauggcauuuugauaaguuccccuggugaaucuacugcugugcuuuuagcucacuuaaguuaaaguuuguuagaauggcuaaaagugagagauuugauguggccagcuauuugguguuugcaugccuucacaaugagccugaagccuacuuggauaaauaacaggacacgggaccucuguaggcuguaguuaccuauaaaacaaguugguuuaacagugacaugcacuugaaguaugcacuagugucaacauaggacguagcccucugcgaacacgagacauacuguauuaauugcuuacugacaacagcaaauuaaggaagggaagguuuauucuggcucacaguucaaagguucaguccaucauaacagagaagacaugacggcaggagcaggaggcagcuggucacaguguaaugcagucaggaggcagacauuggugcaugcugugccuggcuaccucuccuuuuuagucccauccaggaccacagccugcucacauuuaaagugaaucuucucaccuuaauuaacuuacucuagcaaccgcucuggcaugccuugaaguuuuuuccaugaugaucucuaaaucccaucaacuugacauucacaauuaaccaccaagucggugagguggcuuauaggucucugaguucaaggcuggacuggucugugcuggcaggauccuuaguaagacucugucucaaguuaaaacagagaucugccaucacauguaacuaguucaauuacuccuaaccuuaucugggauaguucaacacaacagguaaccugaaggaacuauguggcagugaugguuguaaucccagcaacuuggaggugaggcaggaggauucaagguuauccccaacuacauagcuaguuugaugcuagguugggcuauaugagaccaugucuaaaaaaaaaaaaaagaaaagaaaagaaaggaaggaaggaaggaaggaaagaauaagaaagaaaagaagagaaaaaagagaaggaaagaauuugggauaagauaaugaacacugagucuaaaagagauucucagacacugagaaguucucccugcuuggcgagcaucacccuuuuuuuuuuuuucuauuuuuaaguguuggagauugaaccuguagcacucugccacagaacuacacccucaacccuguacuguguauuugauguuuacccaccacaaaggguuuaucugaauuuaccuggcaauaggcuaacgcagaauauauuuucucaaucuacaaaugucuuccagaauuucuaacauucuaccacugaggaggaagacaauaauacuuucauuuccccucucacccuuggcugagaaugucacuuccagggcauugucaggaagcuguccauguaaauaagcggacuauggaaaucaggguuuugaacaaaaagacccauauggcaaaggaugaaaugaaccucuggauuccuguuuguuggguaaugagcuagucucucauuugacugagaacugagugugggugcugcagacucggagaugaaucaagcgcauucuuuuuuuuuuuuaauuuaaauuuuuaaaaacuuuuuauugguucucugugaguuucacaccaugcaccccagucccacucaucuccugucccuucguacuugcccuccaccuuugcaaccucuuccacaaaagagaaaaaaaaucaguagugugucacagccgcucacaaucacauucuugaugcaggaacuugggcuggaggcauauggcuguaacucuagcacuugagaggaagaggcaauagguuauugagugugaagccuaccugagcuacacagugaguuccaggcuaacuugugcuacauagcaagauugucucaaaaaaaaaaaaaaaaaaaagguuaggcauugugaggucugucuauaauucuaacacgugggagguagagacaggaggguuacaacuucagagccaucaucaacuauauaguaaauuugagaccaaucuaggcuacgugagagcucaauaaacaaaaacaaagaauauaaacaaccaaacaaaacaacgacgacgacaaguacccgaguagggcagaacuuagacacccaguagugaccaagucacuacugggugucuaaguugugugugagcagcugcuuggugcagaacaacauagaggcguucaguaaugugcuccaugggccuggagcgauuuccugagugauaucugggggugcacagcauucauucaggaaaucagucgcagaaggcacuucagcagucggauagcucacauggaggcacagagguggcacuggggucugacugcugaauacuucuucuuuuggguucccuaucgaguagcaggacagguggaucuacuggacggacuggcagaccaaaucgauccaacgugucgacaaguacucgggccgcaacaaggagacaguacuggccaacguggagggacuuauggauauuauugugguguccccucagcggcagacaggugggccgcuaggaacugagucccuuuccuuacaguugaugggccuggcucuggucaucccaagggcuguuaguggccaacagggcuuguguuucaugguuuuuagaccugugcauccuuugugauuauccccuuccuacccuguuguccugggggugagauaaccccggauuuccucccuuucgagaagugugagaccgggagacccuauucucucuuagaccagacacgucugcuuugucuccagggaccaaugccugcggugugaauaaugguggcuguacucaccucugcuuugcccgagccucugacuuugugugcgcguguccugaugagccugacggucaucccugcucccuugguggguuggauagacuaacuucuuggaaccacagagcccuuggaaagggaggggacggcaaccucagcaguauccuuuuagggagcaucgugguggcauaauguaaaugagcaguauucuugggcuuugugaugaugcucaagccuggcuuugucuggccccuggcauuuccuagaacagaagucuagacucccgaugucuugcugaggaucaccagauccucauuucuauuccuaauauuugugagccaccauuuuauccuagaaucacuaauaguaaauccaaaucccuuuuaaauuuauagcaauaaaugagggugccagagguuagggcaucugaaagauucuauuaagacgucuacucuugaacuauauauagguuucuagcagcccauuucaacccacuuuucucuccaguaccuggccucguaccuccugcucccagagcuaccagcaugaaugagaagagcccagugcuacccaacacgcugcccaccaccuuacauucuucuaccaccaagacccgcaccucucuggagggggcaggaggaagguaaguagggucgauacaggguugagugucuggauucagaucaccaugcccuacugguaggaaagcauugucccagcuucauaaucuggcagaugggagaugcaucaucacaucauuaaccaccagucgcuauuauggggaacacagguguguuuuaaauguagauugcugcaaaugaaucucucuuacuuuuuucucacacacagcuuagacacccaguagugacuuggucguauuuaaauguagauugcugcaaaugaaucucucuuacuuuuuucucacacacagcuuagacacccaguagugacuuggucguaucucuaucuguuccgcccuacucggguacuugccguuguuguuuuguuugguuguuuauauucuuuguuuuuguuuauugagcuuucacguagccuagaaaaaaaagaacgcucauguguucuugagagcacacacacauagccacauauagaagacagaggaggauaacaguauccucuacuucuauucccuuagacagggucucucccugaaccuggagcucacuguauuuugggcuaagcuggcggccagugauucuccugucugugccccccauugguagggucauaggcaugugcagccaugccuaguuuuuuacaugggugcuggagauccacacuugggucuucauccuugcacaucaagugcucucauucacagaaccaucuccuggacccugcugcucuuuuuaucucugagagcaagaggcuuaaaagcagcuuucuacagaaagcaguagggaggaggcuccuuccugcauuccgucuguccaucagccuuugcucucacgucaccgguguaguauuaggguuuuguccuaguagaaaccccugacugagauuaaauauuuaaugaaacacuaaaguaguaucugcauuauaacuuuauaacuuaagugugauagccuuagcuugcgaucccagggcucaaauaaaauacacauaugugcaugugcauacaauacacacaaacacauacauguaccauuaucaaauaagcaaauauaaccauauacagucuucaaagcaagcauaaaauauauuccauuaacuuugaugcacuggcaacuauaguugagcugaaaagcagaaacaaugacuccaaaauaaguacuuuaagcucagugucuccaaagugccaagauuugcacauggucacaugcggcauuuuauaaauuguaaagaaaacaaacaucuaagugugaauauguaccuuucugaauaacuuugaaauguuaaccaucaucuuuauuauuuuuuuaagauuuuauuuauuuauuuuauguauaugguacacuauagcugucuucagacacaccagaugagagcauuggaucucguuacagaugguugccagccaucaugugguugcugggaauugaccucaggaccucuggaagagcagucagugcucuuaacugcugagccaucucuccagcccaaccaucaucuuuauuuucaucuuaaauuuucuuuagaacguuaguuguuuucaccgugcugaagugugaacuccgcacacgcuaggcaagcaaucuacugcugagcugugcuccuagucccuaguuugauuugggaaacaucuggacccuccucagacauuucuuccuggguguguauauacacauuccucugugcguguggaggccagagcucgguauggagugucuuccucaguugcuucccaugggugguuuuuuuuuuuguuuuuuuuuuuguuuguuuuuuugguuuuuugguuuugguuuuguguuuuuuuuuuuguuuuuguuuuuguuuuauucuguuuuguuuuguuuuguuuuguuuuguugagacaggguuucucuguguagcucuggcuguccuggaacucacucuguagaccaggcuggccucaaacucagaaauucgccugccucugccucccaagugcugggauuaaaggcaugcaccacuacgcccggcuccauguuauuuuuugagacacggucucucccuaacccuagagcguaccacuugucuaaguugacuagccagcaagcagguguuugcaaccagcuuuucaugugggugcugggacuccgaaccuagauccucauguuuuccuggcaagaacucaguaaaucaucuccuugggcccucuguuuuuuaaaugcacauagaaaccagcccccuguuaguucuuuauugccugugguaauacauguuuugguuacuuaaguauguuagcuggaauauaauuuaaaaaacaaucccgcaugacuaagcagaacauaggugcuauguuagaacauaggugcuaagaauagguccccuggggggggcauauaggguacuuuugggauagcauuugaaauguaaaugaagaaaauaucuaauaaaaaaaaagaauagcucuccuaaauucuuucuccuaguuaauaugacauuucuuguacuuguguccuacaccuaaagaaacaaaaguaauaaucauaauuagcauuucuuucauuuuuuacuuauucucugacaaauccauaacauauacauagauccuauccaccccaccucucagaauuccaccuggauuuuuuuuuccaaauagggacacuauguagcuuaggguguccucacucagggcccuccaagugcugggauaacagcuguuaccaugcccacuuuccucagaccuuucccaauggaguucuaguuccaauuccugguaucuugguuucagggacucuucugcugucuauauggcuuuucuccagacgguugggaggugucuccaauugcucgccauaauaugccagagugaccuucugaguguugcaagugcaccagcugugcacucccucuggguguuuugcuuagucccuugucaaagaaugaagggaggaaaaacaacuuuuuuaaccuugugauaaccaaucagacuugugugcucugcagcugcuuccuaucaauucuuguaguagaaagaagauuugaguuggcauccuuagaacucugucuagcucacucuaaaacugcuacuucuaaagguauauaacugagaacauauuuaaacaugacauagcagcuggaaacauuccuucucuccauucauucucucucuccucucuccccccaagccccugcuccucaguuuuuuuaaaacagggucucacgauccuggaacucauuccauaggccagacuggccuugaacucacagagauccgucuauuucugccucccaagugccgggauuaaagaccugcacaacuaugccugguuuaauccaugaucuuuuucauuucauuucuuggaggcacauaucccagcacacauagaggucagaggacgagauguaggaguugguucucuucuucuacccuauggguuccagggaucaaacucaggucaucagacuuggcagaggacgccuuuaccuacugagccaucccccugagcccuagucccaguccuuuccuccuuccgggaagaggguaaagacgucuugaguccaagaaggcuucauaucucuuucucaugccccacagaugcucugaaagggaugcccagcugggccucugugcacauuccaaugaagccgucccugcugcuccagguagguccuaagaauagaaguguuguagaacaaagauucuucuguuuaucuguuuuugaaacaggcuauuuauuagcauguagaucacacuggccucaaauucuccaauuuccugucccuugucucccaaguacugagaguaagauauggauacaccauuauuuuauauggguuuaagucuccacuuacuucuuuccuaguuuuugugaggagucuuauagugugggcaaacucuuuucauugacuaaguccacagaaauaauaauucuaagagucaccacuuagguggcagcuagaagguggucuuuaguccuugccuggcguucuucccuucuccuaggugaaggacugcacgucagcuaugccaucgguggacuccucaguauccugcugauuuuguuggugaucgcggcuuugaugcuauacagguaaccucagcucugcugcaggggugacauggucucugguugcuguuagccugucuggguucucucgaagcuucacagugugcugaauacacuuguacgcagccuagagucaccugugcuacccucagcagucucccuacuggaugacugacuuuucccauaccucucucucccucaauccacuggaaugggaaauggucuuccagucacaccaacacaaccuuuuaccccagcguggcugacacagcauugcucccuggaaaucacuuugaaaagacacagugugucauuucaauuuaggaucuuuuuacuugccuuuuucuucccaguaccuuaaacacugcaaacaacaacaacaaaucugaaaauaaauuaauaauaauaacaauaauaauaauaccacuugucuuuuaaugggaaaguauaaaugcccuaaccugguaucuuagaguuucuugcuguaauaaaacaccaugaccaaaaacuuggugagaaagggguuuauuuuugauucuacauuacuguuaucaucaagggaagucagggcaggaaccugagagcaagaacuaaugcagaggccauggaggggagcugcuuacugccuugcucuucauggcaugcuaagucuuuuuguuuguuuuuuauuuuucugagacaggguuucucuauagcccuggcuguccuagaacuuucucuguagagcaggcuggccucaaacucagggauccaccugucucugccuccugaaugcugggguuaaagauauacgccaccacacccagcauucuauaaaaacccagagcaccauuuuaggggaguccccacccacagugggcugggcccuccuacaucaaucacuaauuaaaacaauaccuuacaggcuugccuacuuacagaucaauccuauagaccagucugguucucagccuuucuaaugcugcgacccuuuaaugcaguuucucauguuguggagaccucaaccauaaaauuauauuguugcuaguucauaacugcaauuuugcuauuacaucuguuaugaaucuuuuuuaaagaauuacuuauuauauauauauauauauauauauauauauauauauauauauauauaaaagugcacuguagcugucuucagacacaacagaagacggcaucagauuucauuacagaugauuguuagcgaccaugugguugcugggaauugaacucaggcccucuggaagagcagucagugcucuuaacugcugagccaucaauucagcccacuucagcccuguuaugaaucuuaaguaaauaucugauaugccagauaucugacauaugacaccccccccccaugaguugugaccuauagguugaaaaccacugcuauagaugcauuuucucaauuaagguucccuccccuccaaugaccauagcuuguuuauaaacauagccagcacaccuguaaccuaguaaccggguccgagcuucagcagcauuagauuauaucuaucaauauugcagcuaguaaaccauaggggugggauuagaacaaagguccaucuccugcauaacaaguaaccuaaaagguagugagugcuuguagaucagaaaucuggauauagcuucccugugugugcucagcuucgaggucucuugcaugcuguaaucugggugacagccaguguuaugaccucaucucaaggguagacuggaagaaaggaagaaagaaaggaagaaagaaagaaagaaggaaggaaggaaggaaggaaggaaggaaggaaggaaggaagcaagcaagccuuccaagccgggcggugguggcacacgccuuuaaucccagcacuuggaaggcagaggcaggcagauuucugaguucgaggccagccuggucuacagagugaguuccaggacagccagggcuacacagagaaacccugucucgaaaaacaaaacaaaacaaaaaaaggaaagaaauccuuccaaauguacuggaauaauuauuguuggcagauuuucauucuuuacuggcuguuggucucucucaucuguugcuugccuguggaccuuccuauaagucaacuuccaacaugucaguuugcuccuuguaaagagagggagggaaggagggagggaggaugcaccacucaagagggaagcugaucgcggcuuccauaauuuugcauaauggguucacuagaagugagucaccagcuccggcccacacucaagggccgggauuuagaaaagugugggugccaggacgaggggugugugugccaggacgcagggucacggggaccugcagagaggcugcuucccacaccuagguuccaucugucccccagcaucauaccuauaaaguucucaacugauuucagcccgauuuuuccucuugaagacacagaaaauccaaguucacggauccuggaaugggaaaccugaccuauagcaaccccuccuaccgaacuuccacucaggaagugaaacuugaagcagcucccaagccagccguguauaaucagcugugcuauaagaaagagguaacaauggaaaguucuauuuagguuugucugggguuuggagagaggguggaggaaguaggaccgaauugccugagugggugagaaagggccguguggugucccuucuaccauuuuggagacaacagugaacagaaaacugaguaucguuuggguuucugcagagaucuagagucuuggggggacccugguaaaagcaaggcuagaagacucaggucugaaagcaggaacugucuguuucccuggagauuuuccagguuuauggaugcuuuccuucuagggguugucauuccucuaugcuguaccccucugaagcaagggggcucuuugagacaacacccgcaaacccaagagcaccugaacucuuucuuucucuagucucugaauuagcaaaguaguaccuguuguugggaauggcuaguuuuucuuuaucuuuguuguuaaggguuuaaaagauuuuucuagaaaccugaauauuuauguguuuuuaauuuuaaaaaacauuuuguuaagucaaugcaaaauaauuuccugaauauucaggugugaaaaauagucaucuuuccacagggguaucuagggucugagaugucagaauuuccuaaucugguagaaccugguuucuucuaaaacccuguaaccuucauagaguuuucccuaaagagacucagccugcucugauuguuagcagucaaccaagcaggacccuugcucuccacaguaauccuauacuugcuggauugagggauuccuggauuuuaaaaagcugccacuauaauucagacccccuacaguccugggaaugggaaaacucucuauuucugagaaggacucuugaggauucuugaguuccuagaauguggguugucccagaaaagaaucacaaugaaggcuguccguuagaaccaaaaacuaggucugaagaccugacucagcaguucagugcaugugcagccugugccaagcccuggauccauccccauugcagccaaaagaaaaagagaaaacguuugaccucuuucuuuuguuuucugcuucuuccucagcagcucuuccaucccucugauagccuuucacccuuucucuucugauugccucuugaguucagguacccguugcucuguguguguagagaaagugguguuucccgaacuaccucugccauguacccugcuucucccuaacuuacccagugcaucugugaugaggacucucgaggggccugcauguuaucucaaacucacuucagcucagaggguugcugggugaaugagagccuguguguuugcaaacuaccucuaucucucugugugauuaagggacuccuacaaggcagacaacccaucaucaagaaccuagcauagcaucuguuuaaaguagggccuuaauaacugucuguggaauggaacuguuacuaacagaaagcaauggcuggagacuaggagugaggaaacuaccccggugacagaucccaagcuacaauggcccuuuugcuccuagugguggcaggauaauccugggaauaccccacaagucaggaaugaggcugcccuugaagaguacauaaaggaggacacuuaagccaaaguuaaagcuaucuuuagagugaugcagaucacucagggauggucuucauggaagcaauuccacaguauccucccucaaagaguuacagguuacaggcucauuaagaacacagauacacacacagccauccauuggacugagugcagggucuccaaugaaggagauagagaaagaacccaaggagcuaaagggguuugcagcuccauaggaggaacaacaauaggaaccaaccaguacccccagaacucccagggacuaaaccaccagccaaagaguacauauggagggaccccauggcuccaguggcauauguagcagaguuuggccuugugggacaucaggagaggcccuuggucuugggaagggccccaguguaggggaaugccaggacagggaagcaggaguggguggguuagugagcagggggaggggagaugggauguggguuuucagaggggaaaugaggaaaggggauaacauuugaaauguaaauaaagaaauauauaauaauaauaauaaaagaacacaaauacaaugauuucccaagucccacuccccaaaucuuaccucccaaauuuucuuaucacaauuaaaaagaucauucaaagcaaaccaauacauaaagauuuugaaugcaggcacacugaauugcuucugccaguuguuuuugauugcuuauaucugcaugacgucccauuaauaaacuacagggaugcuguaacagacgacucaugauguaaaugcauucugguugcuuuggauuucuuauaucggcacgaugucccauuaguaacccauggugacacuauaacaaaagcuggcauguuuuagcguguccuguguccagugcucuaauggucgcaucccauggauugccucacuuaacccuuacaauaacugggguaacuuguagaugcugcucuucuacacugcagaugggaagacuggguuuuagaaguguuaaguaauuugcucaagauaaccuagcuaguaaauggcugguguagaaccaaacgccaugguuuucccccugcuucugugaugauguaauuaucuaauggcaguugcccuuaggugggaccucauauuugcuuuggccacauugaucuagcagucugugaggguuuuguccacccuagccacuuggguucaguucugcuuccauuuucagcucaccaugaggaccuuuauagaaugccaaccgaccaugugucuccauucucuaccucaggguggaccugaccacagcuacaccaaggagaagaucaagauuguagagggaauccgccuccuggcuggggaugacgcugaauggggugaccucaagcaacugcgcagcuccagggggggccuucuacgggaucacguaugcaugaagacagacacaguguccauccaggccagcucuggcucccuagaugacacggagacagagcagcugcuucaggaagagcagucugaguguagcaguguucacacugcagccacuccggagagacggggcucucugccagacacaggcuggaaacacgaacgcaagcucuccucagaaagccaggucuaagugcugcccacauucucuucccugccugccuguucauucuccucuguggacuucugauccuugugcucacauaacaacgcgggcccuuucccaugcacgcaucuuccuccucccaccccaaagugcucccgagcccccauagaaccuguuacucaucugaguccaaaacuaccuggggacaagaagugagggcacaucucaagaauuuagaccuggauuuuaccaugaacuucaccucuugcacucuauccugggcccccugaagcugggcucagugugauuccuugucagcacagagcuccgucucccuuugcccuggcauccuaugugccugccccacagcaccgaugcaauucaugauauaagacucuggucuuccccaucacagcuggcaugauggccucccugugaacuggccuaccaggggcugggacuggaggucacagguuaaaagguaauggacagagguugagagaaggaagaagcagcccagcuggucugggugcuugggaaaccuccagccucaaguguugguaauuaugaaaaaccuuggggggcggggauucgagcccuggaaucauguccauugcuggcaguggacauucuccucauccagaagucacugcuuugucaguugugauacaggugaagugugggaauggcuuaggcucuucuuccuccugcuggaaugucuggggccauuucuaccuuggauaacuggauagcuccugccauggcaacucacuaauaggaauucccuccuggugcugugaugggccguacuuuucuuaagccuuuagcuaugcugugagcuugagugaacauugggugggccuuggagagcagacuuguagaacguuuaagaagcucugcaaagaaagcauagcauccuacccgagcuucaccuauucuacucuucucucuuccauucugugggauucuaagggaaacaauucugucacagccuuucaaagacuggcucaacauuuuccuaaauggucagaaagagcaacuagagagacacaagacacccaggggcucaggaggagaauugugagguugaaccucuugaguucauucucaagugcucagggauccaaguucauggacacagccuguggcucucgggugguaaaggucaugugccaacucuucucagccccuguccacacuaaagugccagcauuagcuucaugcuccuuuaggccaagggcuucucucaggggagcugagauuuuuuuuuuuuuuuuuuuuuuuuuuuuuuugugcugcccuagaaucucaucccaguuuuucuacuucugagagaggggagucuagccuugcuuucucuaaccgguccugugucaccucaaucgcuaauguccaaugaugaggagggucagugaagauguaaagugguaagcaaggaguggagagguggugagaaccaguccagagcaaguucaggcacuucuccauagaaaccgaagcacaggagagauuggcaggugcugagaauggaggagaggacuuuuaggggaaguuuccugacauaaaacaucuuucaugguuuauugcuauucagagaucagcagccaggcaucgcaugaacaaacaagaucaaaucuuuucuggucaguuauuacgaguaagagacagaugucaaaccauuagucuuguugucauuagcuaggcccagauauaugucugcacacagagccagagcaggccaauggccuuuuccaguaaaccaauugagaaaaguacagugccacuucuaagaggaaagauggacauuucacacagaaugaggcagcacuugagccuuuaaauccauaguuggggaggagggggggggggggaaacagaagcgugguguccuccugaguggaaaggggcaaggaucuuuuugcacuugggcuguucagaauguagaaaggacgaauuugaggaaauaucuauuugagcacugauuuacucuguaaaaagggcaaaaaucucucuguccuaaacuaauggaagcgauuuucccaugcucauguguaaugauuuuaacauuacucacuggagagauuggacuuucuggaguuauuuaaccacuauguucaguauuuuagggcuuuaugauaauuuaauauaaauuuagcuuucuuaauuau

SEQ ID NO: 917 - RNA, 93935 nt, Mus musculus
cgguucuccgaggaccaaugaacaacgaggacacugcggggugugcggcggcccaagcgguuuuaaacggcuuagagcaggccccucgguucugacccggcagaggugagugggcagugggucucaccugccggccuggacccuggggacccggcgucgcgcgcgcuagaggacccacggccgcgggcggggcccccgcggacgcgcgccuccgcguucucgcgaacccggcaggucugaggcggcggagcggggcggaggccugggagcccgcggcuggcagggcggggggcgugggcgcucgcuuguguuggugacccgggcuggggguucaggugagcagagcacgcggcgggggagcugcugcagcuucggagguucgcuggcggccccgggccgcgccugaaggcugagcuguccgaggccggggcgggggcccugccggcaggcccuugguggaggagugcgccucgcggaauuguuaaaugaaugaacaagagcacgggagggcuguggugggugugaagggccuaguugucuccuccgagccgggaccagagccuggugccugggccugccuccaucccugcguccacuaccugugaugauuuuguaaggaugcuguucauucgccgccccgcccuugguuuucucccucagaaagugucagcagaguucagggauuuugcagcucugaagguuuccggcaccaguacaauagccagcaggguaggugagccaggccuugccgcuaggugaaugagauucucacuuuuuagcgcuuagcaaauccuuguugagagagcugcccaaagucgugguaauugcuaugcaagauugaaugcaucccauuuuguuucuugcggagggcaggaugaaagagauguugccagagaggcugcuguguguaaaagaauauauucuuguugaugaaucuuaacaaugaguuucugauucagcaccaguagagguuuuugcagaacuugucccaaauuuaugcaugacucuuaauucuccuaggaaccaaggcauuaaaucuuggcccagauaggaugcuuguauuacauuaugcauaauuauagaacuggaaacucauuuuuagaaaggugaaauauuuuuucuccauuuucaucacccugaaaacaucuucugugaccuaaagagcgagaauauaaaucaaguuaauggucauuugagacuuuucuaaagugacuggucaaguacgauuuaauaaagagaaaaucaaaaucaacuuuuuuuuuuccaauauaaguuaaaucacuguaguaagccuguaaugaaaaaauuguacacaaaacuuuuacuuuuuuuuuuuaccuggggcuggagagaggacucaguauuuagggggcaaugguugcuuuucaaaggaguugggucuagucccagcagccacaaccguuuguaacuucaggaccauggggacugaugcccacuucuggcauccaugggugcugcauauacgugauacacacacacacacacacacacacacacacauacacacuggcaaaacaccuauacauauacauauuuuuaaggaccuuuuguuuauuuuugugagugggugcauaugcuuggugucaggcaaauugccugacgucuaucgugugggucuggggaccaaaccuuaguugucaggcuuggcagaaaacacccuuaccauuuaacccuccucucuggucccaacauuuuuacauacguuuuuaaugcuguucacauaaggagguggcaagcaaagguauuccauuacaauaugccauauacuuuccucucuuuuaaaguuuggauuaucaauuuugaguuaugugggcuggugugugguaauucagcagcagcaguucaguuuggaaagagcaauuaaaaauaauuaacuucuuuaacaauagcuuuggauaguguuaaaauauuuuuucccaagauuuaugaguauucguucuguauauguauguguagcauggaugugcuuguccccacagacuuccuucagaagaaggcauuggauucccuggaacuggagucacagaugcuuauaagcagacaugugggugcugggaaccaaacuuggguccucugcaagagcaacaaguguacuuaagucugagcuguuucuccaguucccagugguuaaaaaucuugaugaagaugaaaacuugcaaggcaugaugguucacaccucuaauuuuaauaugugggagacugaagcaggaagauggcugugagcaugagacuagccugggcuacauaguuaguuccuggccaaaauagauugcagagugagacugucucaaaaaacagcacaaaccuaacaagagcaaaugaaaacuuuauaauuuaguaaagccaggcugucuagugccugggagauugauggcuguuggauauuaaacauuauacuagauucaaggaacacauuugugagccuggggaaaaaagcgccugagggaguuuaacauauuuaucuuuugaacaauuuacaauaguacauuacaguuucuauaaucucucuagcuuagccuggggccuugaacaaaguaagauucuuaaauauguuuacuaccaguagcuaauuaugaugguuuguauaugcuuggcccagggaaugacacuauuaggagguguggccuugguggaguagguguuuuacuggagacaugggcuuuaagacccucauccuagcugccuggaagccagucuuuuccuaguggccuucagaugaagauguagaacucucagcuccuccugcaccuugcuugccuggacgcugccauguucccaccuugaugauaauugacugagccucugagccuguaagcuagcaccaauuaaauguuggccuuauaagaguugccuuggucaugguaucuauuuacagcaguaaaacccuaagacagaaguugguuccagggacugggguaaugcugugauaggcuugaccagacuuuuguuugggaaaauguagauuuuaggacuuaagauuuggaaagcaauagaauccuuuaauuggggcuuaaugggcuuauucuaguaggaauauggaagacuuuguuguugagaaugauuugaacugugcagaucaggcccaagagguuucaggagaaggauuucaguauguggaguagagacuguuuuugugguauuuuggugaagaauauggcugcuuuuuaccauugucugaagagucugccugaggcccacgugaagagauuuagauugcuuugaagaaggaagucuaaaaaacggccugguauaaauucuauugugugguuaaaacauaugguucaagggcuagagagauggcucagcgguuaagagcacugacugcucuuccagagguccugaguucaauucccagcaaccacaugguggcucacaaccaucuguaaugggaucugaugcccucuucugguguguuugaagauggcuaaaguguacucauuauauauauaaaauaaauaagaucuggggggcagggagaaaaaaaaacauaugguucaaguauuaaaggggcuccaggaagugaaauggagcugaauccuauguucuaggagagaacagauuaaggaagugggauuuuggggaaagauaggugcaggcaugguaguacacaccuuuaauucuaggagacaaagccaagcaguucaaggccagccuggaacagagcaaguacuaggugaaggaaagcuugaguccacagguggggugauacuuguuuuuaaucccagcguucaagaaauggagccauacagaucucugaguucaaggucaaucuacagagcaaguuucaggacagccacgcuuaagcagugagguacuuagaaaauagaaagcuaguaauagaauaagggaggccacguuccagccccagcaaacagcagaacucggcagcuugaguucugagacagauuaugcagcuugcucagagucauaugacuuacagaaccugaauuuaaaugccagggucuaugcucuuagggucaucauauauaaaguaauggcuguuuuaaaaaaauucaagaacagauuuagaacagagcacacuccucuuccuugauguaucuaccagagauaagaaauauggauaacaggcaugguauuauuuuagggagccaguugaaaauacagcaguguuuacuuuaugggcagcugugagugugguaagacagggagaaccuuaaaauuggcaguuguguauagcuuugagauagaggaaucuugcuguauagcccuaguuggccuagaauccccuacguagauuagguuggccuugaacuugggguccuccugccuuugacaucucuaugcugggcauuacaaauguguaccaccuugccagcuuuaaaauugagauguuaaucuaauugugauuguuucuugaugguuaguguuagagagguaugaaguuuugaaugauucucaugcucuuacaucuugaguucaaagauguugcuuagguuuuggucuuuuuaaaaaauuuuuauauuuauuuuauauuguguuggccugcauauauguauguguaccacauggugucuggugucacagaaguuaucuagaugauaguguuggguccccuggaacuggacuugcaggugguuguaagcuaccacgugggugcugugaacagaaccaggguccuaugcaagagcagcaaguucucucaacugaaccaucucuccagcccuacuuagguuguuagcagugcacuuauccugacuacuuaauaaacuuuuaaaacauuaaguuucuuccuuuuggccuucacuuuuccuguuuucugccuagaaugucccaacccacuuugccuuuauuucaaaccuauguuaacaggcuuacuacaacauuuacuucauuguuuucuauggucccaauuagaauagcuaucuuggugccuuuuaccucauuucucucuguuucacguauuugauuguuuuuuuuuuuugugugugugugucagaauuccucauggaaaugaaagcagaguguacauguuuuuucucugugagguuauauuaguauguuacacaaugccuggaacaaaguagguuggucagugcgcaugauagagcucaccugccaguacuuagauguuagaggcaggaagaacaggagcucaagguuauuuuuggcuguuaggaaguuugaagauagccugaacuguaugcccacuaaggaccugaguucucucuccuggacccacaugguggaagaagaaccaacgccuauugaaggagaaucaaucuccacauggaugcugaagugguacacacuuguacacacacacacacacacacacacguacacguacacuacauaguugacuuuuuuugguuuguguguuuguuuuuuguuuuuguuuuuuuucuuuuguuuuuuaagcaacuaaaguaaaugguagaaaagucuugaacaaaaguagucuaaacugacauagucuucuguaugugaugaagcuaaacaaagacaauguguaacuaugugucaguguuuguugucuuuggaugaaaaauaccucaacagauaagcucagaagucuuccacuaagaaaacuagaaaauucuuagguuuauguuuguguugcuugugugaagugccuaggcccucauaaaggccuucacuuaugugagaacaguaggacugguucaacccuggacugcugucuucaugggccuguguucucuugugcugugauacguagacacuugaguccggauuaaaaacaaaaagaguaguuuuacugccuuaaaauuucuccgcauuucacuuauuuuuuucuuuuuucauacucugacaaccauucaucuuuuuacuguccuuguaguuuuccucuuccagaaugccauacguaaccagagucauucuacacuauguacugugcucagacugacuucuuucaugucacugaaagauuagguucaugagaguuuuuguucauuuuuuugaaacaaagucugauguaaucuaggcuggcacugaauuuacuauguaucugaaacugaccuucaacucuugaugcuccugccucuaccuccgaagugcuaagaguacagguguucaacaucauacugggccaugagaacuuuauauggaccuaguuuuuacuucauuuguguaaauacuucauuuguguaaauaaauuuguuggaucauaugguuaaacuauguuuaggguuuuuuuuucuuuuugguuuuucgaaacaggguuucucuguauagcacuggcuauccuggaacucacuuuguagaccaggcuggccucgaacucagaaauucgccugccucugucucccaagugcuggaauuaaaggagugugccaccacacccagcuuauguuuaguuuuuguaggaaacugucaaacugucuuccaaagugacuguacugcuuugcagucucaucagcaaugaaugagguuuccuguugcuucauucucgacugcacuuaguuuuagcaaguuucuuuauuuuuuuaauuuucgaaccauucuaguagugcuauagugcuccuaucuuuaaaaauguuuuaucaugacauugacauuuugagagugauaguuuuauuguguguguguguguguguguguguguguguuguguguguguguguuguguguuguguguuguguguguguguguguguguguguguuguguguuguguguugugugugugugugugugugugugugugugugugugugagagagagagagagagagagagagagagagagagaauucuugagcaggcgagcacaagcacauacauauugccauuguacauguguggagggccagaggacaacuuauuagaauugggucucuccugcaacaugugaguuccagggauugaacuugaaccaucauacuugguggcagcugauuuuacauauugagcugucucauuggcccuguuaaugugauuuuuguuuuguuuugaagacaggguuuuucuauguagccuuggcugcccuggaauuuguucuguagaccaggcuggccucgaacacagaucagccugccucugucucccaagugcugguauuaaaggcguguauuaucaagccuagcauuaaugugacuuuuuaaacagugcuuuaagaauacuuuacacuuucucaaaucccuagagaguuagauugccccugguuugucuucagcaucacuagcaguauuagccagauuaaaggauaaaauuacuguuucuccuuuucuuuuagaagugaguugcuagcugccagauguauccagcuuuuuguggugguauuguaaucuauuaaguucauagugaagacucaaaaucaaguaacgcacacaugaaauaacaccugcuuggauaauuuuuuuucucaaaaauaauuuuauagggcuggugagauggcucagcgguuaagagcacuggcugcucuuccaaaggucccgaguucaaaucccagcaaccacaugguggcucauaaccaucuguaaugggaucugaggcccucuucuggugugucugaagacaacuacaguguacuuacauauaauaaauaauuuaaaaaauaauuuuaugguguuuuaaguaaguuuuaagcugcaugaaguccuuuggucauggguuagacaugucuucaaaucuagaccauccugaaaguaggugaaggguuuaggugcguuuccuggaggaauaaguauccguauauuauuuuauuuggaauucuguaaggaaaauuuauuacucuuguuucauuuauuauuuuccugaggcacugggaauuauuccuaggcuuuacaaauauuagacaagugcuaugccacugagcaguaucucacaguuuucuuuaaaaaaacaaaacaaacaaacaaaaaccuugguggcacaugccuuuaaucccagcacucaggaggcagaggcaggcuuggucuacaaagugaguuccaggacagccagggcuacacagagaaacccugucuugaaaaaccaaaaaaaaaaaaaaaaaaagaaaagaaaagaaaaaaccaaaaaacaaaacaaaaaaccccucgaauuugugauucucuagccucuguuucacuaggagcuggguuuauaagucugugccaucaguccccccccccuuuuuuuuucuuuuuuuuuuuuuaaauucuuugugguguguguauaucacauggagguuagaggacaaauuuugguaguccuuaccuucuacuuuggugguggggggggguuguugugguuuuuuuguuuuuguuuugguuugguuuuuggcagagucucuguuucuacuucauugccaugguacugcaggcuagcuggcacagcuaaugagcuucuagacaguucuaucuccaccucccaucucauuguaggaaaacugagauuacaggugcaugcuaccacauugagcuuuuuaugugagucccuaggacccuaauucaggucaucaggaauauguaacaauugcuuuuacccacugaaccuucuccauugaucuaucuauuuuuugagucagucugucuugcugaaccuaacuuuugcccuuuuggcuaaacugaccagugaaccccagaaucuacucuguccugucuugcuuuuauauagauguuggggauugggcuaagguccucaugcuugcuuagcaagcacauucgcugagccgucucuuagcccauuguuuguuuguuuuuuguuuuguuuuguuuguuuuguuuuaagcgcugacuuauuuucuggcacuacaagauguacugggcuccuccuuuauguuucccuaauucagcuccagaauuagaauuagacuguucuuucuugagcucuaguccuuuuaguggguacuuagaaaucaagaugcagauacacaguauacuuuccacuaugggguaugcccuguauugguauacccucucaacugaaagaauuagguaguauaugcuaguguccuccauggcauauauaauugucuuuguaucuuuccaucuauguuuccauuaagauagacaugcaguuuauacagauaaaaagacauuccuuuugacauucagaggaaacuuagauguccucuuuguaauuugcuuuucacugagauuggucccaccccccacccccucccuauccuguuagccucacuguuguccagucccugauaauaccuuuuaauugccagaaaacauuguuuuucuaauuuggcaacaguauuuguucuuguuauaggccuuggucuagaggugcauucaaaacauugcaguuuuguuauagauaugauugcaaaugaaccauaauaaccuguaucuuuauguuuuguuuuggucagaguuuuuuuguauagcucuggcugucuugaaacuugcuuuguagagcaggcugccuggcacucagagaucugccugccucugccuccugacuacugggucuaaagguaugugccaccacuuccuggcaccuuuuuaucuuguuaaacaugaucuuuauuauguuaugaaagaguauagaaccuugacaucuugauuauauuuauuccuaguuguuuguuacuaauuaaaauaacuuuucuuaauuuaauuauguggugguggaaacacuugaccauaaggccagaagagucagaugccucuaaaguuggaguuucagcaagcuuuuggauaauuacuauuucuguaauacuaaaauaagacaaaccacuauuccuucauaaugauuuaauccagggguagaaaauaggacuauaauauuugucaaugcuacaguuauuuuauuacugagaaauuugacauugaaaacaccuugauuauuggguaacuggagaaguaccauuucauaauacuuuagaugugggaaacuugucaauauaaacuuauauauaguucuguacaugagaauacuaaagucccaaagaugagaugacuucugaaguguuaaagguaguuaaugucaggaagaaguugugaaauauuuuuucccuuccucccucucuuucucccacuguaccauugggauuaaagacgugcgccaccaugcccggcuuacacacaaguaauuuuuaaaaaagaaagaaaagcaguuuuaguauucuuggguauagaacccagggagucagacuugaugaacaaguuggagagacagaauucagugaaaaaaaugauacucagugauaaucuuuaaagcucucagagaccauauauuugcuccuugaguuuuuggguuuuguuuuguuuuguuuuuaauuuuaauuguauggaggucagagaacuuuguagaguucucuccuugcaucucuguguggauucuagagauugaauuaagguugcuaggcuuguucuguaaauacccuuaccugaugaugaccaagaaaaaauacuguuuauucccugagauauuaaugcaguuuccuuacaaaaauuucaagaacuuccuuuuaaauuacauaguuguauauaccaauuguauuuguaugcaauaucccuuugcuuacauagacuuguaaauuauuggugaauuuuugaaaggucaucuuuuauucacaagaggguuuuuuuuuucccuuccuguuaccauccuaccuaucugauauuaccuuucuuuugcugugaaggaagucugugaaaagacaaggggaagcauugaaagcugcuagaauuucugugucuuuauguugcaguuugaaaauugcuacuucuaagagaaguuaauggaaaaaaagcagcuuccauaauuuacucugaugguuugacuauuaucugcaguaacuuuuuuacaaccuucgaaaaccuuagaauugugguauuggaaacuagucaucuuuacuuuugugauauuaccuuuauuacuaucaaaccagagauucacuuccaaguuguuccauuauuuaccuccuacuuugaaaaaccuuugagcuagaggcagcacauccugggccugcagaccucuggguaaagguugcuguggccccuuuaagcguucugugugcgugcagaagagcauugaggguggggcgggcacucuugacaguggugcuccuguccccgcccccguaggaggcgguucccagcagcugacuugccaaugccgccgccucccgccugcuaccggguauuccugcugauccugcacggacauuagggcggaccucguccugcuaggguagcguaagugucagacuacaaaaagggggcaagcaucccauucugguccggaaguccuagaggacaguacaugggacuuaaccggccuuucagaguauaaguccaggaaggagugaaaacaaugcccucugcagugugcuaaagccggggcaucagcucuaauuguggguggugacagggcccuaggguguuuggauguguuguguuugagugguucugcagccuaguucaugcuugaggugaagagaggauugauuuuaccagaguuuaaccaggugggacaggauagggaugcaagcugaauucuuaguuugggauuuagagaccuggcuagccuccggcaugaguaagcucuagauuuucagucaccuugguaguguugaacaguaacucccaaaguugaccuaauucacagcggguuuagcuuuccaucuccccagagaccuguguugguauacaguacccauuuuggagacauugacaaugaucaucuauuagagagaguucagcuaaccuucuuuccugcugauaaaaauggcacaauguaaaugauacaucacuuuaucugucuuaguuucugagggaauguuugggaggucaugaucccagaacaaggaaagcaaccaaaguuuggugagauaaauugcuagagaagccuuucaaauuacucccuccaauaaugcagaauacuuaagcaagaugauuaacuuuuguucuuauucucauuagugggaauaucuggaggcagugaagguauuuguuagaaugaacguguuaaucguuugugcuuucuccacauagagaugagauuauuuuugaccuuggacaaguaauaguaaucuuaaauauuuuaugacaguuacaucauuuuuuauccuuuuuuaguccaugugcccuuccuagauguguuuuaaguaaggaucucuaagcacauagguucauuuuuuuuguuuuaugauuuuuuuuuuucaaaugagcaucauugcaugucagcagucauuuaaaagguuuaaacuuuuagaacauuuauuuauuugggguuguagucaugaugagcaugucccagccuguauguagaugccagaggacaacuuaaaggaguugucucucucuugcugcaucauguggaucccagggauugggcucaggucgucaggcuugacagcaagugcuucuacaaacugagccaucuuacuggucugcuuuauuguauuuuguuuguuuguuuguuuguuugucuguuugugauauuggugauaaugauauguuacccaggcuggcucucaaaccuuuagaauugagucauccucuugucuuaaccuuccagauagcugaaauaaaaguuagagauugugcucugaguggacaaaaucuuuccucacgcuucucaggcucauacuaugauucugcaguagcguuuucuuagccaaagugagaguccaggaaugguaauccaauucagagcucuuguauugugauagugaagagcuuuguaggucaagaacuugggaauuugccauagaagaguugaacugccaaugauucuuuucaaguaaaaggcaaaacuaaacugcuuauuagcucucugguuauuguagacuaucagaauauagaaauuuaaaauaaaagcauaccacacuuauuaagcauuuggauaguuggggaagagucgugaauguaaaguaggagaaaauuucuaagcuuaguucuaacauuauuuaucaaauagucucucugugccuuauuuuuuaggugguugaagaguuaagaauacuagauuacuaggguuugcauuuuaugauaggauuuuaugcucgaacauguagauauuuaagcccuugguguuuacuauuuacuaaucuuucuuucuaaaaaaccugcuuuggacauuuuauaaaaguggaaucauaccauauagagcccuuugacuuagcauaauauugucaagguucaacugugauacaagguuuauucauauuuuauuucuuuguauuccuauuauuuuacuguauuaguuuaccacauuuugguuauucauuuauguugauacacauuuaguuuuuuuauuuguucuagcuaugaauguuuaugugguuuuaauuugugcuauuuauuggaaaauauuucauuuuucuaaggagagauuauucaagccuccuuaaacuuugaccuuuugugaaacugagguuuuguucuacauguauuccaucuuauuguguuucuucacuacuuccaaaaugaauuauacacaucagaauguggucuuucuuuaugauaauuguuaauuaauauuugcacaggaugacaaaaauagggcuuuccaguagucacuuuaauacacaaguaacagagcuaaguguggugacauaccuguuaucccagugaaugggaagcugagucaggaaaauuaugaauuuggaggcucaccugagcugccuagugaaacuaucuaaaaaggggagguaagacugguuucaguucuguacuuggucaguguaccaauaagauuaaaagaaaaugauuaugagauuauuaaggggucugugugauguguguaguauacuuuauuuucuggauguuugguuugauuuauucaauauaucauucuaaaguaucacaaacaaaauuuuuagaaacuaaauuuauuuugaauguuugaguucuauaaaauuaugaauuuaugucaaauaaaauuaagagugaaauagaugcuuucuguuugcugucaggugauaacuagcuuuuugagcacuuggaucccuuaguagauucugaguaucuaccuccaaggauuuuaucuaaacuaacucauacaauccacccaauaaugguagaauauuauuauuccuacuuuucuacauauguugcuaacuaacuuaucccuggccuuucucuaagucuguaguggcuuugaaaaaaacauuguuuaaacaauguagaguccaagauaaaauagcaaaucauaaaaauuuucucaggaaauaaaacuaaaauuucauguauuacuacuuuuaggaugaguauauuuuuuuucuuucccuagcuaguguuuauuggcagguugugugugugcuaggcaggcacuguguauggugaacuguagcuuuuuguuguuguuggaacuagagaguuacucuuuuugcuuguuaggauaugguauuacagccucaacuuacuccccugcuucucccuucugaguccuggaaguauaagcauauaauacuacccaagcucucugccuguuuuuguuuguuuguuuguuuguuuuuuaauaagaucucacuaaccgaugguugugagccaccaugugguugcugggauuugaacucaagaccuucggaaaagcagucagugcucuuaaccgcugagccaucuuuccagcucaucucugccuguucuauuacaugcuaacuucaucuaaagucuguccuuggucuucucacugugcacuacucuccuucagugcuguuaucuauucuuuugucaaugugguuauugacauaucauaugucucuuugaugcuccagacuugaguucccaacugcugccuacaucaacacuugucuaauauacaucuuaacucagcuugucuagaauccuucuucuaucuuuuaacaugaacuuaguaaaggaauauuugagcacuuagaaucugacuuuucucuuaggcaucaucuuuaauuuaaauucuucaugaccuucugauugcuuuucuguuuuucaaaucauucugugcauggauuuacauacguguuauaugguuuuugauuacuuuuguuuuugagucaggaguucauucauccuaggcugaccugcaacuguguguguaccugaugaugaccugaucuuucugccucuaccuucugaaucacagguuuaccaucugggauuguacagugcagggacagacuccaagacuuuguguguacuaugcaagcuuucuacccaccaagucccaucucagacccucuuggaaaauacaaguuuggggggcuggugagauggcucaccgacugcucuucugaagguccugaguucaaauccaagcaaccgcaugguugcucgcaaccauccauaacgagaucugacacccucuucuggagugucugaagacagcuacaguguacuuacagauauuaaauaaauaaauuugaaaaagaaaaauacaaguuugacugggacuggagcuuaguaaagcacugacguagaggcccugaguuuaaucuuuagcauugcaaucagucaucagucuggucaucaguaaauaaguugaaaaacaaaccacuagcugagaaaaagaaacauauaaauuugauagcaaauguaauuuccuaacaauccuucaaagucuccuguuacuuuugaacugauaccuaaauugcuuaacauuugcuaagaaggccauucaaaaucugaccuugauuacuucagccucauuauauaucuuguugaauuuauacuuaaaccuuguuaaguaaaauuacuacaauaaaagaaguuauaauugaugcuacacaaguuucuaaauguuuauuuacaugucuguuuauuucugagaguucaguuuguagacaagcacaugacucagaacuauacugugaaaaacacagggcccacacaggcuagacaaucacuccaauacugagcuauaccccuaaccuuugauucacaauuuaacuaacauauauaaauuuuacaaaauggugacugaaauagcaacucauaguaaaacuacacucaaugugauaaccuuuauucagaugaccauagaauaugauugagccagggcauagugguauaugccuuuaaugccagcacuugggaaauaggaaugaggaucucugugaguucaaggccugccuguucuauauccaaguuccaggcuagacagagauacaugauuuaugagaccaucucucaaaagaagaaaauucugaugaugacauagauuuaagcugggcauggugguucaugccuuuaguacucucuacagagugaguuucaggacagagagauccugucucaaacagacagauuuaagcauuguuuaaggaauuuguuuugugggcaaaagaaaaggguggaaaugccaauaguauugcaauuuguugguugcaugguagguucacaucagauuuuuuguguuugcuuacuuuuuugagggucuugacauagagcuaagguuaacucacuaguugggcucaaaucggcaugucuugccucagcuucccaaaugcuggaauacagaaguauaccacugugccuagcuaacauaccagguuuguugucgucguuguuguuagguauuauuuuaccuaugugagcuugugcaucauaaagugucagauccccuggaacauaguuguaaacuaccaugugggugcugggaauaaaacucuucuuggaggagcaacaaguacauuucaguugcugaaucaucucuccagcauacaauuugucaguuucguuaauuuuacugugaugcuucauaacuuauacacacaaugcguguguauuuuuguuguaugaguuagaaauucuagaacuugaaucuuaaucagugacucaugccuguaaugaacacacauaggaggcuaaagcagaagaaaucaugaguucaaacucuucuugggcaauuaacauagcaagucccugucucagagagaaaaagacagacagacagacagaaacaggcagacagaaggaaagggaaaaaaaaaaacaguaagaacugguaagcugacacaguggguaaaacucuuggcacccaccacaugcccaacaaccuggaguuugagucuaaagguaucaggaaagaacugacucugcaaacauaaaaaaaaaaaguuaaaauuauugaaaaaaaugaguggcauuccccuuuacuguccgucuucuguagcagcuaugaaagaagacaaacacgaagagcacacauauaaagaaguguuugugcucauuauuuuuguaccugguuuauuaugaaacaggccuuuuuuuuuuuaaauacaagaaagcagcaauaauuuuuaaaaguccagacuauaaaguaacaugaauaguuuuauagaggccuuggguagccuuuuucuucuuguuucucuuuuguuguuguuguuuuuuuguuuuuuguuuuuucaagacagguuucuuuguauagcccuggcuguccuggaacucacuuuguagaccaggcuggccucgaacccagaaauccgccugccucugccucccaagugcugggaucaaagguaugcgccaccaugcccagccgccuucuuguuucuuaagggagaguaggaguaagaggaauaaaagaacaaggagugaacucaagaagauaaugaaauuauuuacuuuguccuagagaauauuuucaagacuuuuauugaguaguuuuugaaaaacagucuagucugcuaaggcuuucuguuucguucagauaaagucagauaaacucuccuaaagaauagaugacaucugugcauaguauggagcgcuagccugaucuaugagaaaauccaguguccugguuuagggcagagaagaggaccugugaagaaauacaaagucuucuauuugcuaauguagacuucuauugugggugaagauuucuuuuauaaaaagauagcuuuuuagagcuauugaugauaucugaagcuuuguuuuguuuucuaguaaccaaauagaaaugugccaaagcuguugauauggcagggggagguugauacuuugguuuccaauauuuucuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcauguccaaugggccucucuuuccagugauggccgacuaggccaucuuuugauacauauguagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucacacaagagacagcuacaucuggguccuuucgauaaaaucuugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuccaauauuuucuuaagggccaaguagcucauuucuuuguuuuauucuuuguuauguaucauauuucucuuuaaaaaaaaaauguucuuuuugagacagugucuuauguaacccaggcugcccucaaacucacuaaauguaggugagacugauguugaaguauugauccuucugccuccaccucccauuuuuucuaauuaaguuauccuauuaccuaguuguggcacacaccuuuaauuuuaccacauaggaagccaagacaggcaaaucugugaauuugaggacagccagaaccauagugagacccugucucaaaacaaacaaacaaacggaauggaauuaaguaguaggcauuugaucaaagaauggaccuuuuugguuuuuuggugucuuuguuuguuuguuuguuuuugagacaggguuucucuguguagcccuggcuguccuggaacucacucuguaggucaggcuggccuugaacucugaaauccaccugccucugccucccaagugcugggauuaaaggugugcaccaccacugccuggcaagaauggacuuuuuaacucuuauuuauacaugcaugaugaaauaacuaaagaaaagucauuuuugucauaagagacaauuugguuacuaguguuaaugaguaucuauuaccuacuuuuaucugacuaggaacuacuuuuaacuccaagagaaaacuagaagcacaaugggagaugacagugagugguugaaauuaccaguugaucagaaaugugaacacaagguaagaacuuaaauauuauugucauuaacuuguuuuaucagcaguuauaauauuuauaauauacuuuacuuauacuauuuauacuuauguuuaauguauauuugauauauuuaauauuauauacuuauuauuuauacuuauucuguuuacuuauacuauaguauaucuuacuuagaaugugaaaaacauuggcaguuuaaaaaacacugaugucuugcuaagaacauuauuuuacguuauuagaaauaggugucuuuuuuuguuguuguucaagacaggguuucucuguauagcucuggcuguccuggagaccaggcuguccucgaacucagaaauccgucugcuucugccucccaaguccugggauuaaagguaugugcuacuacugccuggcuagaaauagguguuuucuaucuaaguguggcagugcacuccuguaaugccaguacuagggaugaggaggcaagagaaucaggaauucaaggccagcuucaguuacauagcaauucuaggccagccuggccuaagugacccugucaaaaaaaccccaaaacaaaacaaaaacaaaaacaaacccccaggagauaauuuaguaagaaaaaacacuuguacuccagccuaaugaccuaaguucuaaacccaaaucuaugcaaaaggcucaguucaguggcuuggcucucauuuguaaucccagcauccucugguuagaugagagauggagacagguaaaucucccagaagcucucaggccagcuagccuggaguuugcaaugcgaaaaugagggaaacgcugcuucaaaaaagggcagaaggugacuuccacacauacauacacucuggcacaguuacacagacaucccacaaacacaaaauagguaucuuuagcuugauuaaaaaauuuuucccucuaauccuagcacacaagagggaggguagaagcaggguugaucuuugaguuugggccagcuuugucuacagagugaguuuuaggacagccaacuacacaaagaaacuuucucaaaaacgaaaaaacaaaacuacacacacacacacacacacacacacacacacacacacaaauucuggaaacaauuuaaagacagaaaaguguauuugugaagaagaaaaguguaucuuuaaaaugacaaguugggaagcuuuuucauuagcaaauucauuacuuuauggaaagugcuuuuugcauuugcacuuauauucugguuuggcucuugauguccagcaguuuuuagauucuuagauuuauaugauauauauuccaguaucuauccucuuagacuagccaucuauuaauuauggauaauuuuaagcuauuaguuaauuucugauucauaccauuauuuacugguuaucuuuuucaauugguuucauuuucccuaacuauaucucugggguuuuuuauucuuauuuaaauuuauuuauuuaauuuaaagacagagucuggcuauauagcuaagacaaucuuccugccucgguuuccugagugcuggaauuacagguauaauuuaacaugcauauccauuuuuaaagcaaaugccuaccagguaguugaauugauaauuccauuuccuuucuuacaaaugucuacuuaaaauccacagguuagcuauuuucccauuuuuguuuggguuuuuuuuuuuuuucuuuuguuuugagauagaauuucucucucuauagaagucaggacaaguuuuaaaagguucugugagaugaaugcaggagucaaaccaaggucaugaggcuuacucagcaagcucccuugcccacugagcugccucuguggcccugcugugaauuuuucuuugaaagauuuauuuauuauauauguaaguacacuguagcugucuuucagacacaccagaagagggcgucgggucucauuacggaugguugugagcuaacauaugguuguugggauuugaacucaguaccuucggaagagcagucagugcucuuaaccacugagccaucucuccaguccucugcuaugaauuuuuaaguagcuuugguaaaacauucuuuuguuuauuaaagcggugcauggguggcaccggccuuugaucccagcacaagguaggaaugugggacucugaguucgagaacagguugaucuacauagugaguuccaggacagagauugucccuguuucaaaacaacaaaauaaauuguucauugacuacuuauuuuuugaaaauugucagaauuucuuaaacuuuuuucuuuuuucauguuaugggguauuuuguucaaauuuucugauauaggauauucuuuuauuucuacagauuauuacugaauaauaucauuaaccuuguuucaaaauacuaauuuuguuuuagcuauggaaagcaagauuaaguggguaugaagaagccuugaagaucuuccagaaaauaaaggaugaaaagaguccagaaugguccaaauacuuaggauuaaucaaaaaauuugucacugauuccaaugcagugguucaauugaaaggacuagaagcugcacuugucuauguugaaaaugcucauguugcaggaaagugaguaguuucuuuccuagaauucuguaaacaucucuguguaaugguacaagauaaguuuauguguacuuauagagccucuguuacaguuuuagaacauacuaauagucuuccauugucuuuaguuagucugacugguacaugagaucucuaaaguggaauaauuaucuguuucuauguguuuggguacaugugaaagucagaacaacucgugggaauuaguucuuuuuuuccacucuaagucccauagguugaacuuauguccucuggcuuggcaacaagcaucuuuacaugcugaggcuucuagcuggcccuuuucccuuuugaguauuuuagaugcgaauuacucaaaacuuaaaggaaucuuaguguccuaguuagagucuucauugcuacaaagagacaccaugaccaaggcaacucauauaaagguaaacauuuaauuggggguggcuuacaguuucagagguucaguccauuaucuucauggugagaagcauggcaucaggcaggcagccaggcauggugcuggagaagcugagaguucuacaucuugcucugaagacagaaguagucugucucucauuccauacugguuggagacugaacauaggaucucaaagcccaccuuuauggugacacacuuccuucaacaggccacaccuucuaauagugccacuuaccaugggccaagcauauuuaaaccacuaugcuuguagaaguaguuacuguaaggaagcguaagcgccucacagaaaacaaauggacauuaugaaaaacuucucuuaaaagauauaaucaccauuuaacuuccaaggucucuugggguagugaauucuaacauguuuucuagccuauuugacuccaacuauacaugauagaaguuuccagucacucacuuuccuauacuuuauuaacuuagucuuuaugucauugaugaggaagaacuuccacacacaaaaagcugagacuguuaauuauacaagaaagauguuuuacucaaagaucaugcaagugaacaucuucaguuugacaguuugguuauaaccaauauuaaugaaaggauuuuuaaaauuucauuuuucuuugcauaucagaauuuuugacauauuuugauuaaaaagaaagaauuuugacaaauuccucucauauuagaagcuuuuuuuuuggcaaauacgaccuguagcucuaacccauuugauuccucuagcucccauaauuaggaguuuuauuuaauuuacaaggcaaaguucuuacuacaagguucugcuaagaaguugagucuuuccuuauuaaaaauaugcaccuccccauuguaugaauaaauuuucuuauccuaaaaaugucuaaaauaacuuauuucaaaaaguauccauucuacaauccuuuauagaguguauguuugcauucccacauguaagacagguacacaugcacacacccuauagaaggucugcaaagaauguucaaggacaauucccuauuugaauuuucuacacuuauaaacugaaacuauagugaagugugucuaggguuuauaucuuuuuacuuacauauccauuugugugugugugguguuuacagaacaacgggagagguuguaucagguguuguaaguaaagucuucaaccaaccuaaagccaaagccaaggaacugggcauagagauuugccucauguauguugagauugaaaaaggagagucuguacaagaagagcuucugaagggccuggauaacaagaaccccaagaucauaguggccuguauagaaacacugaggaaagccuuaaggugagacuuuuuguaguucucuuaaguaugcugacugaauuuggguucuauguuuaaacagaaauggggacuguuaaacuuauaaugucauccuucaagcuuguuguuugguuauuuucucuaaauuccuuucuacugaaugugagcagggaacauuucuguucuauaugagaauagcucuuuuuuguaaaauuauauguguguguaauauauaaugugugugugugugugugugugugugugugugcgcgcgcgcgcgugcguaugcuauuuucucuuccuagcuaaagacacaguaucuuagcuaaagcaaacuuuuguuuagggucuuauugguaaacaucaaaaacaacuugcucuauacuugguaugguauaaaaaauaugauaauuuguauauguuuuaucuuuaguccuagaauucuuaacugaacacugcaguuuuuuauauaugcacuguccuugagggaugaauugcuaagguuugguggagagcucugaccuuguuaaaucaguaguucuaauuaaguagacucuagguccuccuuccaguuggagggcaagcauucuacuacuuagcuacaucccaaaucuaggcaauucuuaaaucccaucuccuuucuauaguuguccauuguuagcuaccuuagaaagcaggcacuaaugagggcuugugagauggcucugugguuaagaauacuggcugcucuuccagagguccugaguucaauucucagcaacaugacuaucuccuaaaaagggaucugaugcccucuucuagcauagguguauguucagguagagcauuccuacauauuaaacaaauacagaaaggugaaaagaaagaagcacuaaugaaaucuuagauggggaccauuccuuugguuuauggcucacaucuuggaaacagugucuuaacauauuuuaugugaaaguaucaucauucuuuuuguuguuauuuuguuuguuuguuucgagacaggguuucucuguauagcccuggcuguccuggaacucacuuuguagaccaggcuggccuugaccaggcuggccucgaacucagaaauccgccugccucugccucccgagugauauuuucuucauuuacauuucaaaugcuaucccgaaagucuucuauauccuccugauuuuuguucuacuuuuucugauuucuuuuauaaaguuugacuuuuaucuagauuuuugugugauuaaaaguuuccuuguuuaauuguuuuauuacugcacguguaucugaugcauaagugggagugugguacaagagcgccagagcacaccuguagagagagcucaauccucaggucaggcaagugcuucaaucccacugagccagcuugcugucccaaucaaaguuucuuuauuucuaaucuuuuaugauauaauaaguacauagaguuuuuuccuuuagcuuugcuuuguuuuugagaagggucucucccugucgcccagacucaugucucagauucauggcauuccuucuaccucuugucucuagauaggacaggcaugugccaccauaccuggcagcaugugucuuuauaguaaaaaauugucucauuuuugccacuuagaaauuuaucagauuagaccacaagcacuaaucuagauauugcuagccuauccuccacaguaugcucaauaaaauauucuuuuaaauaaauaaauagauagauagauagaaaaggaaguuuaauaaauuuacagacucugcuuguaucaguagauauauuuuguucuaauauuuuauguguuuugccugcauguauuuguacuaugugcaugccuagugccuacaaaggucagaagaggggggucagauacuccaaaacuggaguuauuggugguugugagccacuaugugguuacugagaauuuaacauaggaacccaggucuucuucaagauagcaaagggcucuuaauugcugagccauagcuuaauaaaauaaaauauguaucauacugaaauuuuucugcucuuaaauuaagaauuucuacuucagacuguuauauacuguagaaaucuuacuuuuaaacugacuaggaaaauaggauaggaaaagaauaaguuacauuuaucuuuuuuauacagucauuaucugugguguuuauauagucauuauuuauuuucagucccuaggaaaaauccaggccuuuaaugugcuaggaaagcauucuaccauggacuaucuccaccuccagccuuguccugauucauaaugaucuguaguuuaccuugcugauuuuucuuuccuaaagcauuucauaauguaaaguagcucuuuaggacuuagaggcuaaacugugcaauuuuaggugccauagccuccugaaguuacuauuggugacagcuuuaagaggcaaaaaacauucugucauuccaaaauagaauucuagaaacuaucuugcuuuuaaauuucucauucauuuguucauuaauucauccauuuuuaguguuuugaucaaggacucagguaacuucugucuugaaacuugcuauguagcugagggugaccaugaacugcugguccuccuccucucaaguucuaaaauuacaaguguguggugcuaaguaagauaccuaacuuuucuaucauguuuacuaucaaacuuggaauugguuuuguuuaauguaucuuuuuuccauguggucuugcuucaucucuuuuauagcucuuguugagcaauuuuguuacauuugugcaagugaaauaacuuuacacacaugaguuaauaguauauuuuaacugguuguaguaaguacuaucaccugaaauccuagcacuugggauacugagacaggagaaucaccaaaagcucccuaggcuucagaaugagaccauuucuuaaaaacuaaaagaacuaaaggccccaaauauauuuauguccuacugauucugaaauucaguacuuuauagcugaauccuuacuguccuagaauuugcuguucagaaucguuaauaagaccagaaaguuaauacuaaaacuagcauguuggaagcugagauuggaagagcaugaaauugaggcuagccuguaguauauagcaacacuguaucucaacacuaauauuggucaauuaggaaccauauaaacugacaguuuauauaguuaaauauccuauuuuacaaaauaauaagucagaaugcagagguuuucucuuuggaaaaaaccucuaaaucaaaaagagcuaaauugauaagggguugucugaguuacuuuccuaucguugugaagagacaccaugaccaaggcaacuuauaaaggaagcauugggcuggagagauggcucagcuguuaaaaucacugacugcucuucugaagguccugaguucaaaucucagcaaccacaugguggcucacaaccauccguaaugagaucugaugcccucuucugguguguuugaagacagcuacaguguacuuauguauaauaaauaaaucuuugggccagaacaagcaggguugaccagagcgagcaggucaacuggagcgagcagagguccuaaauucaauucccagcaaccacacgaaggcuuacaaccaucuguacagcuacaguauauucauagacauaaaauaaauaaaucuuuaaaaaagaaaaaggaaauuaaaaaaaaagaaagcauuaaaugggacuugcuuauaauuuuaaauggcaaacucaugaucaucguggugaggagcaaggcaguagguaggcauggagagagacugggggaaagagaccuugugucagcuuuuuaaaucucaaagccuacccuuagugacacaccuucuguauagccauucuuauucaaaccaccacagagauaugauaguugaaaaaucaagaaugaaauacauauugccauaauucaaucugucagauugaguaauuuuuguuugguuauuagaaaguuccauuuuuaaauguuaacauuauuuugggcucuagacaaauacuuagcucucuaagaaugacagagaauuuuuuuuuuuuaagauuuguuuauuuauuauaugugaguauacuauagcuguuuucagacacaccagaagagggcaucaaaucucacuacagaugguugugagccaccaugugguugcugggauuugaacucaggaccuuuggaagagcagucagugcucuuaaccucugagccaucucuccagcccgacagcuaauuauuaaauauauguauguacauguggauauggauggauagguauauaaguagaugguuuugaacucuauuuguuaccuuaagaaauauuuagcauguucauauaugauuuguuuguuuguuuguuuugagacaguaccucuuuacauagcucuggcuguccuggaauugucuauguauaccaggcuggccuugaacucagagugauuuuccuuucucugccuuuuaagugcugggaguaaaggugugcaccaccauaccaugugcaguacaugauuuggcacuauauauauugacaguuucccccaaaucuuucacauacagugaauuugguuccaaaaucaucucacuuaagccaauuauuaaaguguugccaaaacuauuugaaucucgagacaaggcuguucgggaugaagccaaauuauuugcuauagagauuuaucgauggaaucgagaugcugugaaacacacacuacaaaauauaaauucuguccagguaagacacagacuuccuugcucguuuuuauauaagguuaauauaaguguauuuccuacuuguaauuguuaauaucuauccuuauacauaauuauuuuuuauuuugaggauuuaaauggguugaauuucugagcauagacuuuuugcuauuacugucugucacucuuuuucugcccuaucuccacccccaaguaaggagcaaguucuguaucuuguacauguuagacaaaacuagguuuuuuuuguucaggugucuauagaacaucucuuuuuuguaccccagcccugguaguauuaaaucuaucaauaaaacgucccuuucugauuguguggaguaggaggacaugcuuggaugaagcaguucuaucacauaguuauuuuuggagcuuuuuugauaauauagcauauuugaauucauaaacuagugauacugucuuaaaauaaugaacuuggaaaacuagagagaugucucacagguuaagggcauuugcagcucuugcagagccaaccuucacauagccucugcauacaugaaguauauacuucauacaugaaggcaaacacucauacacauaaaagaaaauaaaucuuccuaaacgaaagaauuuuguucuuagacauaaaccuuaagugugguaaaguaauaaguugauuugacuuaugcgacaaaauacaauuuaaauuugucuuuaguggauuucccuauuaguaccaucuaaacagaaagugagucccaacuaaucaguacccccagagcucgugucucuagcugcauauguagcagaagauggccuagucggccaucauugggucuagcaaacuuuauaugccccaguacaggggaacaccaggaccaagaagugggauugaguggguaggggagcagggcaggagaggguauaggggacuuuugggauagcauuugaaauguaaaugaagaaaauaucuaauaauaaauauguggaaaaaaaaaagaaagucccaaaauaccaauaaguacaaguuuuauguuuucuaauagugggguauacguuuuaaaaauauuuuauuaauacuugcaguugaaagaauuagaagaagagugggucaagcugccaacaggugcuccuaagcccagucgguuucugcguucccaacaagaacuagaagcuaaacuggaacagcaacagucugcugguggagaugcagaaggggguaaggcaguguuuaaacaauaguuucaaugaaaaaauuagugaauuucaguggguauauuuuugaacuucuuuuaauaaaaccugagucauaugugcuacuaaaugacucugaucucuuuucuauuaaaaucuuacccugggaguuggagaagugguucggccagugguuaagagccuuuacugcucuucuaggacccaaguuugguucccagcacccccauggugacucagaaccaucuguaaucccaguuucagggaauccaacccucucuuguccuccucagguaccacuugcccauaguacauagacauacauucagacaaaacacccauacacauaaaauaaacuuuuaaaaacuauaagggguaugaaaagauauauaacugauagguaaaacuaucauuuugguggguguuuguguaagauggguagguacacauagcucacaauacauguauagagguagaggacagccuucagguguugguccucaccuuuccauuuuuuaaaauguuuuauuauuuuuuaaaguuaauuuuuuuuaguuuaaguuuaguguguguuagucucugaaaguguaugccacaugugugcugguaccagaaauacacaucagagcccaugaaacuggacuuaaaagucaauuaugaucuacccauuguggcuuugggggguugaaagagcugcuaagucaucugaccagcacucuaccugguuuuaguuagggcccaggcuuuucaacuaggaauccucgcucacaagcuuuuccugugucagccucccaucuccuguaggugcugagauugcagaugcgugcaguacugagucuggcuuuuuccuggguugagcaccuaaaaucaggguauuuuuuuuuuuaaaaaaaagauuuuaagauuugugggguuuauuuguucuguuuuguuuugcuuuccuucaaagguggugaugauggugaugagguaccacagguagaugcuuaugagcuucuggaugcgguagagauccuuuccaaacuucccaaagacuuuuaugacaaaauuguaaguaaugguuaagcuucuuuaauuuacuuuaaauaauaacuuagguugaagucagagaaugugcugcugaacccuugcuugguguaccuccccacuccccccauagcuuccuaguaaaguggguugcuucuuucucuuucuuccuuuacuauauuuagccauauuccagcauugaaaaaauagagcaaaacauaacgucuuaccaaaaaucagaacauuuucaacucuuuccucauuuauccuauuguuuaucuuuuaaauaucucuuacauucgucucuuuuuggaauggcaggaugggucagcacaugaagguacuugauuucauucaaguuugguaaccugaguggagagagagaaguucaccuuugcuaagauuuguugacuuuucuguuuguuuguucuggauaacugucuuuguguccuggacaccguaggauguucagaagcguauguggcuuuuacccacuagacaucauuagagucagcaauacaugacaggcauguuuccaaacauugcuauuucccaauagagaaaaaaguauccuugaaacuucaacuuaucuuccgucuacaucucuaacaguuggcacuuucuguuucagacaugcuguauuucucuagguagcaaauaggccacugguuuauuauuuuuaacucugagcuuuaaccuguguuauucuuucuuucuuuaauauuauucucucaaaauuuaucuaauaauacauuuucaacuuuuagaucucaacuuuagcauaauuuguuuguuuguuuguuuguuuagauugguuuuauguaugugugugcacucucucucucuuuggcacuggcucucuuuacagauauauggauauauaugaauaaaaauucugugaacaaggugggcaggagcggugcacauacaucccuucuccuagcacuuagaaggcagaggcaggcagaugucugaguucaaggcagccugaucuacaaagagaguuccaggauggcaagggcugcacagagaaacaacaaaacaaaaacauuuuaugaacaaaauagcccucauuaacuaugguuuugccauuugguuuuuuaaaucucacuuuaaaaaauuuuucuggccaggcagugguggcgcaugccuuuaaucccagcacuugggaggcagagucaggcggauuucugaguuugaggccagccuggucuacagagugaguuccaggacagccaaggcuacacagagaaacccugucucaaaaaaccaaggcaaaaaaaaaaaauguucugaaacaaacaacaguaaaacucccugguuuuuaaauugguugaguauaugaaauggaauuuauucuacucuauguucuccagugacuuauauucuguuugcaggaggcaaagaaauggcaagagagaaaagaagcucuggaggcuguagaaguacuagugaaaaaccccaagcuggaagcaggcgauuacgcagauuuagugaaagcauuaaaaaagguaaugggcggagcuucagcauugguguccucaugggacacugagaaucucuccaucuguaauuuagugauuuaaaaaaaaaacaacccacaaauauauugacauuuaaggagcacuguaauaauauuucaaucggagacuucuguaauuuucaaaauuuagaguuuaaaaaacuuacuguccuauguuagagauugguuuuaucuuaacauuuucaauuuaauaagucauugauagcuuacggucuugaugaucuacagccaaguguuuuaguucuauuuguuuguuguggguuuguuuuugguuuuuuucuuuucuuuuugagacauguuuugggauaaaaggcauccaccaccacugccuggccugugauucuaucucuuacaaagaaaauggaguugccauaugauacugguuuagagguagagugauagucaguaaugcuauaucaggcuaugaaguuuauauagucauagauuggaaucccuacuuuugcuagcuggugaccugaagcaaauuaaucucuuucauuuuuuaaaauuuuccuaaauugagguaauaauaccuacuuuaugcaauuugggugaaauuacauuuaaaaagcauuacaaagcaucuccaaaauuguggcaucuaauuuguuuuuaagaaauauuaacauauuuuaauguuuuauuccuuagggaagauaauugcugacucuuaguaugauauguauauuagagguuguuuagcucagagacuaaagaguuuagcauucuguuuauggaacuaaggacuauguaaaaucagagcaauugcuucuacuggaaaagagaaugaaaaaaaaaaacccaaagauuugugguacuuuaauaagacaacauuuuaacacuaacugagacaggcauuuuacuauagcaaacuguuaccagagagaaacccagucauuauugcguugcucaauugaugcauaucuaugaauuuagauaaguguugggcuuugggauucaagaaaggcuguagaguuuuugcuaaaggagacucuucuaugggggaaugaaaggaaaacucagucaccuguguaacuaaauggcuuauauaggaauggucacagugagguuugcgauaaccacagcaguuuguauuaaugcuuguaugguguaaauuuacagcagagcuguugcccuguguccuuuggaaauauguuuguuugguuuuucuguuccaaaguaacgacaauagaccuccagcuucucuguacauugugcaguacaggcagccaugugucccuagggagggucaaggauuuguuauguugguuuuuccuuuuguguuucuugaugcuagguuuuauuccagagccucaguaugugcuggguaagcacuuuaccacugagcugcauccccacucaguaugcccuucucacucuuuuuuguuucuuucuuuuccuucucucccuucaacaacaacagcagcaagaguaccacauaguggaggcuuauaaauucauaauuauuaagauuuucuucuuuuguaagaaauaaaacugguuaccuauugguauaauauuuuuugaagaguuauuuugaagauauauuuucauuucuaguaccccuuucucuaccggguuaugacuuuucuuuuguuuuucaccuuuacagguuguuggaaaggacaccaaugucauguugguagcuuuggcagcaaaaugucuuacuggcuuagcuguugggcucagaaagaaauuuggacaauaugcaggacauguaaguaauauucuauuuagauguaagucugaaaaauuaucagaaaugguaggcuaguuuguuuuauauuuuaaaacagcucuuggcauagaucuuuguguuggccaggcggggguggcgcaugccauuaaucccagcacaugggaggcagagacagguggauuucugaguucgaggccagccuggucuacagagugaguucuaggacagccagggcuacacagagaaacccugucuugaaaaaacaaaaccaaaaaucuuuguguuggacgaaguaaacaccucacugguuucauauauauuuucagucuagcucuucccaagacuuguguaaaaauuagacacuuggccugaaguacuuaguugacuuguuugcuuauuauuuacuuaguauauccuucuuugcuuuuauaaauaugaaauacauguaguugaaauaaaauuguaaaaccugugggguuuugcauuauugcucuaguggaaacaucuacuuagcaugcauaaaguccuggguugucuuuccaaccacuuugacccuagggggaaaauguuuauaguaaaccauaaauuagguaucaaucaaguuuaguaauagaguuuaauaaauugagauguuuucuuuaacuaugacagguauugguagccucugaauuaccuaaaaugaguuaucauucugaaauuuuagcaguugucgguuuuauuguuaauauguagccuuacuggagacugcuaauucauguauuaaagauaguuucugagaacuaaaacuaaaguagauacuaacaaauaaaaaugacuugugcugccuauuauuauggaaauaaaauaaaguccuagcuguuugugguggugcacaucuuuaaucccaguuugaaauucugaggcagaucucugaauuucaagcuaaccugaucuucagaguaaguuucagggcagccagggcuacacagagaauccugucuuaaaaaacaaaaagaaccaagcaaaugaaaaaaacuauuucuggggaggcaagggugggaugaagucucuguaucccuggcucccgacugaaaacuacuuuuaaaauugacauuaauuugcuaagcaaugguugagugauugauugccuucccuucuagccugaguuuuuacugguucuguuuaacuuacugucuagcuaagaugguucuaucugcuuaauuugggauuuuuuuuccuuuuuaaaaauuauauguaagccggguguggugccgcaugccuuuaaucccagcacucgggaggcagaggcaggcggauuucugaguucgaggccagccuggucuacaaagugagcuccaggacagccagggcuauacagagaaacccugucucgaaaaaacaaaaaaacaaaaaaauuauauguaauaaauugucagacaaauggcagggcaguuaagagcacuuccuacuccuguggggaauauuccauauaaauggacuauuagaauguguggucauccgugacuggcuugcuuucacuuagcuuaauuuugaaaauuuugaaucagcuauacuauaguguauauuaggacuucauucuugcuuuuuaauauuacuuauauguguaugaguguuuugacugcguguaugucuguguaccacacgaguaccuggugccuguggaggucagagagagcauuauaacuccuggaacuguaguuaaggauagcugugagcuaugaugugggugcugggaaccaaacggguccuguucaugagcagcauguguucuuaaacugcuaagcuaucuugucucgcuguccccuacaguacuucguguauacuuguuagaguauuaguguagcuguucaucuuuuacagguugugccaacaauuuuggaaaaauucaaagaaaagaagccucaagugguacaagcccugcaggaggcaauugaugcaaucuuccucacuguaaguugauggcauggaacuuucgguuuugucuuaauacauguugucacuguaauaauuugacaauuuaaaguugaaaaagcucauugccauuuucuucuaaagaccacacuacagaacaucagugaggaugucuuagcaguaauggauaauaaaaaucccaccaucaagcagcagacaucacuuuuuauugcaagaagcuuucgucacugcacuuccucuacauugccgaagagucuacuaaaacccuuuugugcugcucuacuuaagguaauuggggguaguuuauuuauauauuuuuuguuguuguuguuguuguuguuguuguuguuuuuucgagacaggguuucucuguguagcccuggcuguccuggagcucacuuuguagaccaggcuggccucgaacucagaaauccgccugccucugccucccgagugcugggauuaaaggcgugcgccaccacgcccggcuauauauuuuuucuacuaguuauauauaaugacuuuaaugcuauagauugugaucuuuaaaugaacaaacacucugaacccaagauauguagcugucauguucuaccuuugaaggauaacagguucgccaagaauaagcaucaaacuagagugugugaaggucauugggaauagggcauuuuagauaaaagguaaaaggaaaagaaaacauggugaguuggcaagauggcucagagggugaagacuggccacauaguaaccuaaguuaauuccccagaucuccuuuaaaggugaaggaagagacauucauauaugcauaaauguacacauagcguguguguauauauguaaacaauguuuaaagcacuuacagaggauggagaaauagcucagcaguuaagagcugcucuuguaaagaauccaggcaugguuccuggcaccuccauggugguucacaaucaucugugacuuuaguucucagggcuccagcucccucuucugagaccucuguggggaccaggcaugcacaugguacacaugcauacaugcauacaaaacauucuuauacaucaaagaaaguaauuuacauuuaaaaaaugacauuuacagugccaggcgugguggcguaugccuuuagucccagcacuugggaggcagagaaagguggauuucugaauucgaggccagccuggucuacagagugaguuccaggacagccagggcuauacagagaaacccugucucgaaaaacaaaaacaaaaaauugacauuuacuuggugaauaacuaaauuauuauuugaguuaguuaacuagguaaauuaacuaaagauuucugaaauccagaaaaaaauguggaagauuaacuguuaauuggcaaaagaaaagcuugcaguaaaccucaguaaauuauaacgggaaaauucucacccagcaacuauaguucugaauaaaagucguaguaacuauagaguucauuguauuaaacaucauuuacuucuguguagcacaucaaugauucugcuccugaagucagagaugcugcauuugaagcacuggguacagcuuugaaggugguuggugagaaaucaguaaacccauuuuuagcugauguugacaaacucaaacuugauaggguaaguuaguaaugguugucucuuugcauugcauuuugcaaaccuaccuuaucccucucuguugaacuguuguauaaugauagauucugaagaggugacagacacugaauucaguugcccucagugaugagccaccauguucuaguggacaguuucaugacccugguuaaauucaguaugucacagaacaguacagaaaggcaugaauguugaaaagggugcauguauggaagagggugaguaauacggaugagagaaaguuaagaguagauaaguaugccaguaauuacaauauacuguaugugugugaguguguguauuuauauaugaauccaucaaaaaguaaaagauaauaaaauuucagaguaguacuuaacaugauuuugugaauuuuuguuuauuuauugcuaguuucuuuuuuuguuguuauuguggguuuuuuguuuguuaaacaauuucaagacuggguuucucaaguagcucugccuguucuagaauucgcucuguauaccaggcuagccucgaacucagagaucuguauaccccugccucccucccaagugcuagaaguaaaggcauguaccaccaagcuugguucaugcuugccuguuucuguagggaaaaaaaaauuucugucccaaacaugugcauguauuugaaauuaguucuggagggugcucccugggcauuuuuuguuacuaauuuuguccuuucuguauuacuaaaaaaacaaaaacaaaacaaaacaaaaaccacugauaauugacaucaguucuucaguuuauucucuaaugacauuucagaacaaauuuguugacauuuuaaucuuaguuacagugauacaauaguaaaaauaucuuuccaauuauaaccuaaccaacacugaauaacuaaucuauagagaauguaauacagaaaugucuuucuuuaguguaaauaucuuucaucaaaaucauggcuguuuagguacuuuuguaauuuuacuuuaugaaaaaauaaaacacauauaugcacugccaagaaaauuacagauaagaauuacaaaaaaaaccaacaauauuuucugauuuuuuuuuuugguaugguuguggcuuaaugacuucuaaguaauaauguaaugguuauguuuuaaaguuauuggaauauaaugauauucauauugcuuucucuagaucaaagaauguucagaaaaaguagaacugguucaugguaaaaaaucuggacuugcaacugaaaagaaggaauccaagccucuaccuggaagggcugcagcaucaggggcugcaggggacaaagacacaaaagauguuucaggacccaaaccaggaccguuaaaaaaaacaccuacugcuaagguuaauauuugugacaaggucuuacuucguaauccaugcuggucugaagcuugcuauguagccuaggaugcuuugaaaucagucauccuuguacuucaaucucccaagugcuggaguugcugaugugugcuaccacacuuggcuuaaaagauggcuuaaaaauuagaauuuaguaagauaagagacuagguuucauauucaugguauucuuccaauaugucuuaauuugagaaauggauuccuuggcuacauggcaaaucuuaauaaagacauaguauuauaacuacacuuuuucuuuauaaccugccuauaagguggcaaguugacuuaguggauaaaagagcuugcuccaagucugauaaccagaauucaaucucucauauucacacgauggaaggagaaaaaaauuaaugaacaaggauacacccacacucuacguuaauaauguaauuuuuuuucuuuaaaacuaugacuaagagcaagguagugaugguacaugccauuaaucccagcccuugggagccaaccuggucuauggggugaguuccagaacagccaaggcuccacagaaaugugucucaaaaauaccuaaacugccaggcagugguggcgcacaccuuugaucccagcacuugggaggcaaaagcagguggguuucuuaguucgaggccagccuggucuauaaagugaguucuaggacaggcagggcuacacagagaaacccugucucgaaaaaaacagaaaaacaaaaaacaccuaaacaaaacaagaagaguaaauaucugacuaggaauaaaaauaguaguaacaugccuuauuuuuuuuaaaaaaacgguaaacauuuuaaucacuucuuuuuuuaaguuuacagcuuagacuauagagauagcucauuuacauagccaagguugaugaccugaucaccaggacauaugugaugaaaauaaagacuuccucuccaaggaaggaaaacuugauucuucaagucuucaucugaccuucaaauagugugucugucugcuccaucccaugauccuucagcccccagaauaaaagaucagagauguuugccaucaguauuggugaccugaggucagugcuuagaucccauggugaaagaagagaaucaggcccucaaagcuuguugccugacuuccacacaugagcucuggaguggguguacacccauacgaacaauagcgauaaauauaaagauuuaaaaauagugcuauuagaggcaaugaagacccaacuuuuaaucucaaauuaaucuguaaauauaguauaauuccagaugguuuuuuuuuuguuguugucauuguuugagacagggucucuuuauauagcccugaauguccuggaacuauguagacuaggcugaccuacaacuuagagauccaacugagucucccucugccucauccugaaugcuggaauuaaagcauguauuucugugccugaccccuccagauuuuuguuuuucaagacagggcuucuuugucuaguagucuugguugucuugaaacucuguacaccaugcuguccucuaauucagagauccugccuuugccucaugagugcuaggauuaaaggaaugugucaccacugcuaggcuccaguuuauuuuuuauaaagacuuuauguaugcaugugagguggugguugucuauggaggccagaaugguguucagaaguuugagacaauuauccuucugauaugguuguuuggaacugagaaacaguccucuuuaagaggagcaaaugcuuuuaagcacuaagccaucucuccagcuagaccccaguucaucauuuuuauuucauuuguuuuauuauuuuuuauguauuuuauauauacacaaaugcucuaucuucguguauaucugcauuccugaaaaggggaucagaugucauuauagaugguuacugggaauugcacucaggaucuuguuguuguuguuguuugguuugugggggaugagguuucucuggguagcccuagcuguccugaaacucuuuuggguagaccaggcugaccuuaaacucacagacccucugucucuaccucucugccucucugccucucugccuaguaccugcucagcuacauguuuucgauuguuuuauuaacaaaaauuuuaauaugcagccugcaaauuagccaaauauuccauggauggucaauguugugguaauucuguggacaauaaacuuuuguuuacuuuuaaggugauaucauuuuaauaagaucuuuaagagucaaaauauguaaaaacaaaacaaaaauugcuuuuauaaaauuguaaguaguuugugguuuuaaauuuuucuuuuaggcugguggaccaucuaagaaagguaaaacaacugcaccagguggcucagcaagugccgggacaaagaauaagaaaggauuggagaccaaagaaauaguggagccagaacucucaguaaguauuacacaggaaagagauaaaggccccaaggggauuggaggucuuccugaguucuuuaacauaacaguaaauuugcagggcagugaugacucaugccuuuaaucccagcaugcuuuuaauugggaggcagagccaggcagauuucuguguucaaggccagccuggucuacagaguuaguuccaggacagccaggacuacagagaaacccugucuucgaaaaccaaaauacaaacaaaaaaaccauacaauauauucauaucuuuuagcuacugcagacucaaaugcuguaguuacuguaaggcuauuuuaguuuuagcuggguuucuuuuauguuguuuuuuaaaaacgucucuaauucugauggugcuauaucaugcagauugaaguaugugaagagaaagcuucagcuguucuucccccaaccuguauucagcuucuagacagcagcaacuggaaggaaaggcuggccuguauggaagaauuccaaaagguacaaaacaaggaugaaacagaguguaaaauuagauuauguagacacaacacuaacauuugucuucauugcuaaguuuuauaauuaguaaauguuucauaauauaaacuuacgaugagguugagcuuucuguuuauguuuuguagcuguuuagugcuuaucuuuuaacauccucauucugacuucucuaaguaugaaaguuaguaacuuuucaagaaaaugacuuacuuacaaauucuuauugugaauuauaaggccuaggagauuuuuaaguuuuuaaaauuguuaauaaauguaauaagcaaauagaucuugccauggaaaauagaugaucuuugucuauuucuguacuuuaucaucaugauuuaucuguggaaaacacauuauauauugguaugagaaacuguccaaacuuuugaaauuuuauuggucaggguucuucagaggaacagaaaugauagaauuuuuguggagacacacacaggggauuuaguagagucacuuaccaguugugguccaacaauggcuaucaguucuuuaguccacaaggcuggauguuucagcuggucuucacuauaugguagaaucacaaagugggcuuuaaggugagugaaggaaugaacuuggcaaugaaagugaguguaagcaggccaaaagcaaaagcagucagcagaagauauggcccagggguuggagagauggcucagcaguuaagagcacugacugcucuuccagagguccugaguucaaaucccagcaaccacaugguggcucacaaccaucuguaaacggggaucugaugcccucuucuggugugucuguagacagugacaauguacuuacauacaugagauaaauaaauaaauguuuuuuaaaaaaaggagauguggcccagauugaagguagaucuucccacucaacagauaaagacuaauggggcucuucccacuuaagaaaacccucauuuuacauagugagagccuaucuuuaaaaaaagaaaaacuaacccaauuuuuguuuaaggcaagguuaggaaaucggagaacagguaaaagaacucuuuauguuugaugccagccugaucuacaauguaaguuccaagauagccauggguauguagagagacuuugucucaaaacaaaaacaaaaaaaaacucucagagauguaggcagcugauugggguuuauuuuaguucauucuagauguugucaauaauagccaucacaggaaugaugcauuauagcucaaucuaacauauacugugauuaugauacuaugagagcuguagaaaagggaauaauucuccuagcucgaguucucguccaucuuggcuuggcuuagcuugacuuuaggaucuaccuucacuuggaacuacuuuaacuuuuuuuuuacuuuuaacccuuuaacuuucuugucuuauuuuauuuauaggcuguugaacuaauggagcgaacugagaugccgugccaggcauuggugaagaugcuagcaaaaaaaccuggauggaaagaaacuaauuuucagguauuuuuaaguuguacauuuaauguuuuuuauuuuuaaaaaaugaguguagagaaaacauucagagaauugauacaggccaggcauaguggcacacuccuuuaauccuagcacuugguggcugaggcaggcugauuuuugugacuuggagaccaucuuacugaguuccgggacagccagggcuacauagugacacccuaucuugaaaaaaucauggaggaaaaaaacaagaaagaaaaaugauacuaaggcuagcaagauggaccaguggguaaaagaacuugccauuacccgaugaccuaaauuugauccuuuggaacauuugguagaagaagauaacugauuccuaaaagagguuuccuagcuccacacauacuccaugacaugcauauacuauacuuagauacaucauaaaguaaaaaaauuuaaagugauacagaauuuaucacuagcuguacauagaauguuuuauuuuuacaucuugugagucccaguuuugcuacucuacacccucauuuuuuucuguguuccauaguuccaacccuuucuuuuaucaccuugguaucuucacaaaagcugaauauucugaaagcuuuugauccuuuauaucucaacucaugcuaccuuuuguuguuugucauguuuaacacauuuuuauacagacucuagauaggugaaaguacaccugauuuuagccaauauucuucuguauuagaucuagagugugugugugugcguguguguguguguguguguguguguguguguauuggcacacaucuuccauuccuuggcacuauaacuucaccuuagcuauuacuuuuugucuacacaggguguaaagguaugauagaaguaagagacuaucucaugucuuugcuagguauauacauagccuucaauauuauuauguucauagccuucuggauucuugggaauauuuaguuauguuuuaaaguuucuugagagccagcuauggugguuugcaccugcaggucuuagaacuaaggagguugaaacagaaauauuaccaugugucuuaguuaggguuuuauugcuaugaagagacacuaugaccagggcaacucuuauaauggaaaauacuuaauuggggcuaucuuacaauuuagugguuuuaguccuuggcaggaagcauggcaguaugcagacagacauauugcuggaagauccaagaguuccacaucuugaucugcaggcaacacaagaagacuuguuugccacacuagacauaguuugagcaugcauuaugauaucacaucccaccuccacagugaugcacuuccuccaacaaggccacaccuccuaauaaugccaguccuuauggccaagcauuaaaacacaugagucuaugggggcuaugccuauucaaaccgccacaccaugaacuagaggcuagccuugguuauaggaugagacccuaucuuaaaguauuaacuaauaauuuuugcaaguucuuuguuauguaaauaagucuggagaaguucuagguuuuauguaggcagcuguaauauuauaguaauuuugguggcuuuaugcagucaguaagauuuacucagauguauuaaggauuacauauauugagaucaaugcaaaaaaugaugaaaacauaaaaauuaaaaucuugugugccaaugagauggcuuagcagauaaaaauacuuaugaucuauccucacaaccuuaaugaaucucucugaccugugugauaaaggagaaaagcagcuccuucaagcucgcaucugaccugcaccuccuccugucucaugacuucccacauacauacauacauauauacauauacauauacacauauacacacaaucaaugaaauaugcuuuaaaauuuuuuuuuaguucauaaguuaaacauugagugguacauguuuuucuuguauucauugucaucuauuuuaauagauaaaaauaaaaauuacuuugguuguucaaaauuuugauuuuuaucuaauuauccuuauagauacugcaucuuaagguuccguguaagugacugaugucauuggcuccucaugcuguucugauguuuauucuuguucaggugaugcagaugaagcuucacauuguugcuuugauugcccagaagggaaauuuuucuaaaacgucugcucagauuguauuagauggccuuguagacaagauuggagaugugaaaugugggaacaaugcaaaagaagccaugacagcaauagcugaagcgugcaugcugcccuggacagcugagcaggugaguuccagagcugucucccuguguugucccagguuguccccaauguuaacugaggccuaccaaucacaguuaauucuugaguauaguuuuuuauaacuguggggucuuuguguauguauaugcccuggcugaccugcaacuuacuauagcaaauaacauuaauuuucuuuuaagacacuguaauucaaauggaucagucaaugaaaguuucaaacaagaauguuuuaaaacucugcaccucauuucuuuuuaggauaaauuaagucuuuuguuaauagauccuuauacuuaacaccuagaaacucauauuuaauaagugacuuuaauaugccucauauuuaauauaugaauuuaaauuaaagucauaacuuauuucuaugagaaauauaagaaaaguagagaucugaugcuauguuuucugaugcuauuguuucaggugaugucaauggccuucucacaaaagaauccuaagaaucaaucagaaacucuaaauuggcuaucaaaugcaauaaaagaauuuggauuuucugaguaagucuaaaaaugaaauauaauugaauauuuugccaagucucuggucuugauuuguuuuuacugucuaugucugcuucugcagaacugggauuggguugucuaacuuacauaaaagagacacacauguucuggaaggucuguguugacuuguauauguacaaguauauacacauacauacacacacacacacacacacacacacacacacaacacauuuaaaaauuauuuagggugguaugaguguguaugugugucauuggucuugcaggagauguaggcggcaggugccuauaccugcuaugcccuuuagcuguccucuguccccugccuuucuggaggugcugagguuugcacccaugauguuguacuaaguuauuuuuuuuuccucaaguguuuagugccugaaaggacucuucuuuggauuaaaugcugucagaauuccuacaagaaaauuuuuuuaucauuuacacacucuuugccaaauugauuuuuguaugaacauaguuguuaauuauuuuuauauuacauuuaggccuaccaacuugcagaaauuggucuuuccuuccuucauguggcuaccauguauucaugucacccaccuuuacccucugaaccaccucacugggcucuuagauuuugggucucuguguguguguguguguguguguguguguguguguguguguugcugugucuguucucagauucuucgaauuauuuaagcccuccugcugcaacuuccuguuaguauauaguauuuagucaggcccuuuuuagagaauauuucauguugucucugucuuuuuuuuuuuuuaagauuuauuuauuauaucuaaguacacuguagcugucuuaagaugcaccagaagaggccaucagaucucauuacagaucguuguaagccacugugugguuucugggauuugaacucaggaccuuuggaagagcagucagugcucuuaaccauggagccgucucuccagcuccgucucugcucuuauagaugaagaaauuaagucucagaaaacuuaacaucaucgcuaggaaagugccaauagcaaagcuggaauucaggcauucuuguuuuaggaagaggguauaauugccguauuguauuucuuucucugugccuuguuuuauguguggguuuguuuucuuucuuucuuucuuucuuucuuucuuucuuucuuucuuucuuucuuucuuucuuuucauauaacuaccacuuauuaacucugauaaaggccagggauaguggcaucuuuaauauccgcuucacaagugacagaagcaaagguaggcagaucacuaugaguucaagaccaaccagggcuauauuuauugcgacccugugucaaaaaauagauaaaaauagugacuaguauaugcuuucagaguauagcugaaguaaaaugugauuagagagugauaagaaauaagacuggaauaaaaaugagaacaagucaucuaaugccucuaaugcauuuaacagcuuuaauuaaucgagauaacagaagcauuuuaagcagggcuauaccauaauuuugggguacaacaguuauguaguauaugugagguucuggguucauguccgagaauugcaaaaauuuggauguagcuuuggcacaaaaguaucugaccaaagucagauaauaagacauaaggagaauaauuaauauauuauucaaauaaauguugucaggaaguaguuguucauaagccuguugauuguaguacacaccuuuaaucccaguacucaggaggcagaggaaggcagaucucuugaguucuaggacagccaagucuauaaaucaaguuccaggacagccaaggguacccaaagaaacccugucuuugggaaagaaaaaacagaaaacaaaaaaacaauagauaugugcauguaacuuauggaugugcacuacuuaggauauaguuugaaaguagaacuguauaugauauugagcuagaaugauucuugagucaaggauggccuaaagaacugggagaauaaauguggaucugaaaugaguuccagaagacuggaagccacaaguuugggaguuguuuuauauguaggacacauacacagacguagaaaugugacaaaggcacguguauacaugaugcuacuaguacaagcuagguuagcagguaaauccuaguggcuugaguucaguccuuugaacccaccaaaggauaaaaugaaaaacuccacaguuguccucuggcuugcagagaugacucagcaguuaaagaccauucaguguucaucuuugggaccugaauuaaauuccaguuccaggggauccaacuaaguuguuaucugaccucucuacaagugcccugugucuccaaugcaugcauaugcacuagcaauaagucuuuuuuuuuuuuaaguuuuaagagcagauuuuggauuuuuuuuuaagauuuauucauuauuauauauaaguacacuguagcucucuucagacucaccagagggugucagaucucauuacagaugguugugagcuaccaugugguugcugggauuugaacucagaaccuucggaagagcagucagugcucuuaccugcggagccaucucaccagcccagauuuuggaaucuuaauuaagcauaauaugauuaaucaguguaaagauagaauuuaaagcucauguuaaguuaaggaaagaggauaccugagcacuccuucaguggaagacuagccuaaagucuaauuuuauaagcucuugaauguuuugaagauuuuaaugguggcccacgccuuuaaucccagcacuugggaggcagaggcagguggauuucugaguuccaggccagccuggucuucagagugaguuccaggauagccaaggcuacacagagaaacccuaucucgauaacaaaaaaaaaaacaaaacaaaaaucaauuaauucuaaacucuguuuuuuucuagguugaaugucaaagcuuucauuagcaacgugaagacugcucuugcugcaacaaauccugugagugugcuucagccuguguguaaacauuguauccacuuuuguguuucugcucuaguuuggaaaggucucacuguuuucucuggcaggcugugaggacuucugccaucacccugcuuggcgugauguaucuauauguugguccuucuuugagaaugaucuuugaggaugagaagccugcccuccuaucccagauagaugcagaauuucaaaagguaaagguucuaaaaaugauccaaucugugggugguuuugagaauuucacaucaguuaagaauaaauuuuuaaccaaguuuaaugguauacauucaaauguaauuccagcacuccaaucauggaagaccaugagucagccuaggcuacaauagagaucaagguuagcuugggauucaaagugagacucucuaaaaaacuaacaacaaaaauagccugaagagauaauuacgaguuaagugcuuuuccagaagacccaaauucauuucuuagcaccaguccuguggaauggccugcaacuccucuagcuucaggaaaucuaaugccaccuucuggccucugcagauacuugcacucaugugcacauaccacauacaauuguguaugugugcauacacauauaauuaaagguaaaucuuuuuuuuucuuaaaguaaaggcaaaauaacuaaauuuuuuaacucuugggauaaagaacauauauguuugguuuuauguacauaaaguguuccuagaagaauuccuaagaaauuuaaaacugacuuuauaaagaaaaaaacugagcgauuauggcguagaccaagagaucuauuuucuugguuuuuuguuuuuguuuuuguuuuuuuuacauuuguaauguuagacaauauggaucugcuaucuauucaaaaauuacacuaaacugaaaaaacaauuaaaaaaaaaauugggcaacuuagcugguccugaaauugccauauagacaggccucaaguuugaagcagguccccugccuccugccucuugaaugcugggauuagacugguauacuaucacacuugccugaaauguaacuuuacugguuuuuuguuguuguuguuugcuuuuuaauuaugacuaaaaacaaaaaggguaggucuucuugaauagcucugacugaauaugcuaaguguucacaucuugcuuucuuuuguuuuggaaauauaagucaaaagacaauuuugugacugggaagucaaauucuaaucaucuucauaaaaaauaacuugcgcuuuugucucaauuaggaucuagcuagcaacuaaaguauauauuacaauauugucuaaauauuuuaugaguuugaaugaaauucagugguugaacacuugguagcaugcauaagauccuguguucuauucccaggacagccaaaacaaacaaauauuaugaaaaaauaagaaccuuuuacauaggcgccuucucuagacucuuugcugccguucuucagcuucauuaguuucauucuuguguguguagaugcagggacaaaguccucccgcuccaacgaggggaauugcuaagcacagcacaagugcuacagaugaaggagaagauggagaggaaccaggugaagggggcaaugauguuguugaucuuuugccgaggauugagaucagguagguuuuauccugagaaauuacuuuauucuuuauguuauuuggauauuuggguuuagguguuuguuugagacagucugccucagagugaugggauuaaaggcaugugccacuauggccagcuguuuuguuugagacuaggguuuuuacuauauaguauaggcuggccuugaacccacugucuuccugucuuagcuuccugauugccaaguagacaauugugcaguaucauauucuuaaaaucuugaccuuuuauuaauucaguaaagggaguuuggguaccauuaucuuuuaggaauauagaauuagaauuaugccuucuguuuuucagugacaaaauuacuucagaguuggugucuaagauuggugacaagaauuggaagaucaggaaagaaggccuagaugaaguggcagguauuaucaaugaagcaaaauuuauccaaccaaauauaggugaacuuccaacugccuugaagggucgacugaaugauucaaacaaaaucuugguauguggaccaugugccuuuucuuucucuuuccuuucccugcugcuauagaagguucauuuucauugugacuuucacuagcaaaaaugaguguucauguuaauuuguuuucaauuacagaaagauuccuuauguuucuuauaugugucucaagauacaagauuuauaaaugucagggcuuugagggguggugaggggguucaagacgagguuucucugcauagcauuggugguccuggaacuugcucuuguagaccaggcuggccucaaacucaucgagauccaccugucucuaccucccaggcacuagaaucaaaggugugcuccaccaugaauagcuuaagaguuuauuucuuguaggggucccuuacuaaauauauuuauguagaacuauuuuauauguauauaugccugauuuccauuuucaauuuuuucauuuaauuuuaagauagagauccauuguguagugaaggcuggccuugaacucaauaauguuguacucucaagcuacucuuucaucguccuccccaaugcugggauuauagacaugcucuauuuuuaauuuuuaguuuuuuaagaaagcauaaguuuauuuguucauuuauaugagagaaagagggugaauauagaagucagagaacauuuuguuaggccaguucucuccuuccaccauacaaagguucugggauuaaacuccgauugucagccuugaucacaaguaccuuugcccaccacaagcaccuuuacccacaaugccaucuugcuggcucuaacuuuuauauuuuauuuuuaugucaauauuuuuaaaccauaaaguaaaauucuaguacuguaguuuuuugaaagauuuuuauuuuuuugucagucaugguagagcaugccuuuagucccagcacuuaggagacagagacaggugggucucugugaguuccaggccauccuggccagccaggguugcauaguaagacccuaucucaaaaagaaagaaaagaagaaagaauuuuguauguguauauguguuuugaguguggguauguacacacaagugcaauacccaauaagaggcuaacuuauuuauaguuccguguuaaaauacuaucauaguaucuuuuaaguaguucagaagucuguaauauugaccacauaauagcaauuguaaaacuuugugcaaguuuaauuacaguuugaaccuguguuggauguuuguacucaggugcagcagacacugaauauccuucagcaacuggcaguagccaugggugcaaacaucaggcagcauguaaagaaccugggcaucccugucauuacuguucucggagauagcaagguaaagaagccucuuuccaacauaguccauucuacacuaaggcagccgcauucuugggguaacuaacucuguuuuagaguucacauaauugcuuaaaauauuauaaagauagauacuguuaccuuccuggcagaauugauaugaugacuagauguaccauuauuuaguuugugauccuuaaauaguuacauacucuagguuuaguaucuuuaugaaauuucuuucuuaaagaauugaaacauauuuuaaaaaaagauuuauuuagcugggcgugguggcacacgccuuuaaucccagcaccugggaggcagaagcaggcggauuucugaguucgaggccagccugguuuacaaagugaguuccaggacagccagggcuacacagagaaacccuguuucgaaaaaccaaaacaaacaaacaaagagauuuauuuauuuuauguauaugagcacacuguagcugucuucaaacacacaggaagaggguauuggaucccauuacagaugguugugaacuaccaugugguugcugggaauugaacucaggaccucuggaagaacagucagugcucuuaacugcugaaccaucucuccagcccgaaauacuuuuuaauaaucaacauauugauuauuuaguugaaacaaucauuuuuauuaagauacaucuuaauguaccuguuucauauaauauacauucaauaaaugauugcuauuuaggauuauaaugucauuaagguuuuguuuuuaguauuucuuugguugguuugguuugguuugagaagagguuucuuauuuaaaguugccuguccuggaaaucuguguguagaccacacuuagcucaagagauucaccugcuucucucucccaggcacuggcauuaaaggcgugugccaccacaacuggcuuaaaguuuugacauaaugaauaaauacaucauuaaauauaaaguuuagaucuugaaauaauauucuacaucgucccacccugaacuacuacaacaugcuuuucuaguacuucaguuaggugcuaauaauuggaucaucucagaagucauugaaguaucauugaaggcugcaacuuuuuauuuaaauauuugccauaggguaaauauuuuaauguuucuuuacuuuuguguuauugaguuauugacuuaauuugaaaaauugagucuuuucauaaaucuuuauacucugugaauggaagucaauauuuaaacauauucaaguuguuugcuuaauucuuaacaauuugagccucuaacauagaauuucauucuuuagcuuauaacaucauaaaaguucccauggauucauaaagcaaaaucuauuuauuauccuuauacuauuuaccuagauuauuauuuuaccuaauugaguauaagauuuuuuuuucuaauuuaguguuuuauauuuccaccuucuuuugaagucuuuagaagaaccauagcaccaguuucuguuucagagaagaugguuuaauuauguccauggggccuuaacaagggaagccucuguucacacucacccucccuccaacuguacuuguuauuuuugccaauucucuucucaauucagaacaauguucgagcugcugcccuagcaacugugaaugcuugggcagaacaaacuggcaugaaagaauggcuggagggagaagaucuuucugaagaacuuaaaaaggaaaaucccuuccugaggcaagagguuaguaccauaaagaaucauauguuuuacugauaccuuuuacuuccuuagauggccucuauaauaacuauguaugcaugggaaggggggaguaguugagauagcgccucucuauauaauuuagcccuggcuguccugguacucacuguguagaccaggcugaccucgaaccuuaagaguuuugucuaccucugcucugcugagauuaaagguguguucuaccaugcccagcuuaacaaauuugguggguuacaucuauaauccuguuucuuugaaggcuaaggcaaggaggaucagcaaagguuugaagccagcuuguuuuacauaaugaauugcagacuagcaugaaaacaguuucccaaaagaaaaaaaacugaaacauaaauuuauaacaauaaguaaaaugauaccaaauuccuagagcuuucuauuuuuguguuuuuguuuuguuuuucauuaauuuuccuugugaguacaugagcauaugaaggccagcagucacugucccauuuuaauaucgccuccacaccacccugagggcugggauuaagaccacagagaacuuuuuugccucugugccuugaaugcuaggguuaaaaaaaugcaccacaacuggccuuccuucuuguuuuuuuuuagauggguccuuucugaucuguagcucacagauucagccagacuagcgauuucagagauccuccuguccgcccccagcucuguuauaaauauggaccacaguacauaacuuuuagauggcggcuagggaucuaaucucaggucuuaauguuugugggauaagcucuuuucuggcugacugagcccucucuccacccugcuuuuuguuacuuuuuuuuucuuucaggaauggggugcaguaggagaguugagauagggucucaaauuguccauugugacgucuaacuugaaucuggcugaggcuggucuugaacucgugguugccugccuccgccucucaaauucaguccaacuuguuucauuaauaguaacacuuuuggcuggaacaaaacguaguuguuagugucugucuaaauaaagccuaaaguggaacccaguacuuuguaaaacugagcauguuucuaagcuuggcauuugagaaguagaagcugccuugaucucagauaucuauauccugggauuccuagaagaucuuuggaugugaucucuuaccagagcagucauguuauaaauuaaaauuccucuacauauguguaaacaaaugagcaugcacacccacgcacacauacaugugugucugucugugucugugugccuaugucuguguauguaacaauaauuaauggaaaaggugaaggagaggagcauaagaggacuuggagggaggaaagagaagagaaaucaugaaauuauaauaucacaaaauaaauaauuuaaaauuuuaaguagccacuaaacuagagacacaaaauuuugaguaacagugcagagaagcccuuaaucuuuaaaaccugcuuuguuuaagaaagugaauaaugauaaauuauaagacaugcauaaauauuaauacaauauguaaucugcucuugaauuuaauauuagcacaaaagacaugaauaagauuuucccucgcuggacgaaggguuucucuguguagcucaggcuguccuggaacuuacuguguagaccaggggcuggcuucaaacacuacuaccugccugugcuucccaagugacaggauuaaaggagugccuaauuuaagaaugauauggucaguaaagguuaagugcuauuuaaguuugaaauuaugaaauaaaguguucuugagguaaggauuugguuagagaaauaagauuuuucuuuacucccauuagauauguuuuuauauuuuuuucuaugaguagauucucagcucuuuccugaaagcuaguuuuuucucucaucccuaacguaggguaaguugugaacuaauuauaauuaugaagguuuuuuuugucugacuccugauuaccaggcaaaaacaaaauuggcuucuucaaaggauccagaaucacccuaguagccaagccucugggcacguguauggggcacuguuaucuacauuaguuaaacauggggcaguuuggccaguugccuuccaauagguuggaauccuggacugaauaagaguuagaaagggagcuaaacacuuuauggcucucuguuuucuuccuuaggauaaaaugugaucauuugucucaaguuucugcugccagaaugucuccacuauaauugacuguugucuuacaccaugaaacaaaaugauuauuucccuuuuaagaaaauagaaaaacaaaaaaaaccuacuuuucucucucucuucuuuucuuuucuuuuuuucuuuuuuuuuuuuuuuuuuuuuuuuuugguauuucgagacaggguuucucuguguagcccuggauguccuggaacuuauucuguagaccaggcuggcuucaaacucagaaauccuccugccucagccucccaagugcugggauuaaaggcgugcgcuaccacugcccugcucuuuuuuuucuuuuuguuaaacaaaaaacuucuuaaaggauucccuuuuuuguguguuugcauaguauauaguuuucuguuuggguuuuuuuuuuuuuuuuuuuuuuugagcccuuaaauggcaaaucagauuuuaaucagauuauaaaaauagaguucagcauucagaaaucaauguauuccuuugugccaacagacuauagaagaaacuucaugugauuguaucaacugauuuuuaaauagucauuuguuaaaauauaauacucauggugaaaauucucagcuuguuaguaauuaaaaauuagcuacaugaggcuggaugugguggcacacauccuuuaaaacucugaguccccagccagccugcagagugaauuccaggacagugagggauacaaagagaaacucagucuccaaaaaagaaaaauaguaauaccaucccauaugcuguaugcagauaacauaacucuuuagucguaaaaccaagaaaucuacaaauaauuuccuauuuaaucagugaguucacuaaguuugaaagauacaaagucaacauauuugccuauacugcagaaaauguuuguaaauaaccuuacucugcaaaagacacucaaagagcggucauaagauugggaaaaauauuugcaaacuccaguaaagaauaucuaggauaaagaccuuaaaacuaaauagcaaacugaguguggcuauacauuucuguaauuccaacauucaagaggcugaggcagagaaauuaugaguuaagaggucagccuagguuacuuauggaacuccuaagaguagcagauucugaacaguaaaggaaaccuaauuugaaaaugacaaaacacauuacagacauuuuuuuaagcaaauaaguucuugagaauaauacuauuacuugucauaaaaauguuauguuaaaauggaccuaaaauuagcugggcaugguggcacaugccuuuaaucccagcacucgggaggcagaggcaggcagauuucugaguucgaggccagccuggucuacagagugaguuccaggacagccagggcuacacagagaaacccugucucgaaaaaacaaaaaccaaacaaacaaaaaaauugaccugagauugagcauggugguauauacagaccaggauucaggaagagugcuaucagcuuaagggaacaugggcuauuaacaaaaaaagggaaaaaaaaaaaaaaaaaaaaaagaaaaacuacaguaggguaucauuacacaagaaucagaauugguuaaguaaaaacuagucaacugauggugcgugucuuuaaucccagcacucgggagggagaaccuucuacagaggaaguuuaggacagccauggcuacaaagagaaaucaugccuuuuuuuaaaaguucaagguacagugguacacaucuauagucccauugcaagugaggcagaggcagggcuaucagagguuucaggacagggaagacuggagauacugucucacaauuuaaaaauaauaauuaaaaaugaaaugcaaggucaucuuuggcuacuuaggaguuagaagcuaaccuggggcuccaucucaaagaaacaaaacuaaaaaccagaaccagaagauggcucagugaauagaauacuuacucucaaacuuugaugacuggaguuugaucccugguuuucauaacuugaaggaaugaagggaccccacagaucaucugcuaaccacauagacacacccaucuccaaauaauaauuguaaaaaaaaaaucuaaucuaaggguagaaguauagcccaggauggaaugugugcauuguaugcacaggcucugggcuccaguccucaugcugaaggaaaaacaguguuugagacuaguaaacaaucaguaagucugacaucaauaauaguaauuacccacuuaaaauacuugacuagucuuuuuuuuuuuuuuuuuuuuuuuuuuccuuuuggcagcuucugggauggcuggcagagaaacuaccuacacuccguuccacuccuacagaucuuauccuuuguguuccucaucuguauuccugucuaaaagaucgaaauggagauguacggaagaaggcccaagaugcuuugccauucuuuaugaugcauuuaggauaugaaaaaauggcuaaggcuacugggaaacuaaagguacuaguucuucuugauaaguaguguuaaaagguauuaggaaaauacuagacauuaauuuauuguaggcaaaaaaugccaccuaccauguuuuagcaguauagucuggugacauacaguagugcaaauuauuaccuucuagaauggugguuacucaaaugugacuucauaauguauguuacuucuuuugugcuuugugcugccuccuuuacuucauuggugaaucaaaaguaggagcgcaagcauuuuaguagcagacuuguaguaaucucaguaugaauguauuguuuaugucaacuuugauuugcuuuguccuuauagccaacuucuaaagaucaaguacuggccaugcuagaaaaggccaaagcuaacaugccauccaagccugcugcaccugcuaaggccauguccaaaccaaugggagggucggcuccagccaaaacccagccuauaccagguaacaacuuugacaaugaccugaaggaacucacaguacagccagccugauaaccuuuucauuucauuuccucaucuuuuccugcaaacauuugccaaguacucaugucagaguauguacuaaaggugugauaauuauuuauuuuuuuaugccacaaagauguuguaauucaaauacugcuuucaagaauuauuccaugcuguuuuuaagguuuccacagcuacuuucuaucauugaacauucuaguuagaagaggaguugguaacaucuagcuuaaucuacuuuaacaacauaaaaccagggagguuagugauuuuuuuuuuuuuacaagguaaaauagccaguacuugaaccugccugagauucugcuuaguaacgugacugcauaacacugauaacacuuagggcucaugcugagcucuuaacccaccacugaccuauaucugaaccccuacauuuuuuuuaaaauaaaaaaacuaccugauaauccugauauuaaaagucaguaauagcuuggcagugguugugcauucagcacuugagaggcaaagacagguggaucucugaguguaaggccagccuggucuacagagugaauuccaguacugccagggcuacauagugagacccugccuuuggguuuggggugggcaauaauauauaaucuauagccacuugaauucuagacuucuugcuuuaucaaagcaauuuucuucugguuaaugguauagaacuugcuaugaaguuagaaauuuuacauuaucuaacacuuguauccagguguauacucagauuuaauauuuauuggaaucuuauuuagaaguuaauuucagugacagccccuaccuuuagagaaguauuaaugugacaaaaaguacuguuaccuguuuaaauauuguuaaacaagagguagacucuuuaugaacuaauuuuguaacauuguguuuaaaaagaauuuuuguuucaaaaagagauuugcuuaccucugcuuccugaaugcugggauuaaaggcauacaccaccacugcccagcuuuuaaauuccuuugaaucuauauauaacccuugacuguucugaaacucaguauguagaucagacugaccuagaccucagagagaucugccuaccucucugcuccucagugcugggccugaaggugugugccaccacacccagcaaaaugucuuuuucugauaugaaaagucaauggccaauaauauacaauucaacgcuuuauuugugccaggaugauaaauuaggauauauuucaugaaaaaaaucgaaaguaggagauauacauuagaauacaagaaaauauugcuaguuaaacuagaguaauauauuccuuagagauagaaaggacaaagcuaagugcuagaucaaggaaaugguuuaaaagacacacagacacguuucguagagaauguuuacucaauauuugagaucuuauuuacuuccaauuuuauuuuauguauaugagugcucugucugcauauuuaugccugaaugccagaagaggacaucagaucacauuaaaaaugguugugagucaccuuguacuuguugggaauugaacucaggaccucaagaagagcagcuaaugcccuuaacuacugaacaggaagcuuccagcucacuucagcuugaugucuuuauauuuuuugcaucugaguaguaugggguuuucagccauaaggucuugccaucugccuguuguggguaaccaagaauaaugccaguuaccuguuuguuuuauuuuuagguuaauauccuuggcuucuagaauaacuuuacucaccagugcagaguacucagucuugcauuauuugcuugcuuuuuuuuuuaguuuaauuuucuuacaaaguagcaaguuucuuuauauuuucccauauaucauuuguugucauccccuauuccuucuguuuguagaucauaucuacaugugccacucuacccagacuuuaaagagaaaauaagacuaggaaaaaaaaagucuuuaaauuccuuauauauagccgggcgugguggcccacgccuuuaaucccaacacucagaggcaggcggauuucugaguucgaggccagccuggucuacaaagugaguuccaggacagccaggacuacacagagaaacccugucucgaaaaaccaaaaaaacaacaacaaaaaaauuccuuauauauugaaaaauuuaagacuacagaagguuuuuuuuuaaaucaucauuauauguuuaauguaucuaggauaaaugauauuaauuuaacauaguguaugcuuuuucccucccucaaagcaccuguugaagauucuguuuccaguaccauagaagcuaagccugaucugaaaaaggcuaaagcuccaggcguuucuuccaaagcaaagguguguuaauacucauauuuauguaguucuuuugucuuaauuuucuauacugagucacucaguuagagaaggccauagauguaugagagaauaucacugcuucugauaauaucaauuuaaguauucauucagcuuucuguggcuuuaguuuguuuguuugguuucuucuucuucuuuuuuuuuuuuccuacacaagaugugcugagacacaaaacuuguuuucagaucccaaaauagucauucuguuuccacaagauguugucguggagaucuugaguauuuucccucaugaaaagaaaaggugucuaacaugguggcaaacgcauuuaauccacuggguaugcagagguagacagaucuuugcaaguuugaggcuagccuggucuuacauggugagauccugucucaaaaauaaaggaaaaaaagcauuugcaccgucaguucugggaaaaucaacacuuuagaauggucuguauuugacgauaaucaccuuccuucacauggcucaauuaggucaucaggcauuaagguacucccaagugguuggauuuuuuguaguuuuuauagaauuggaucauuggauuaacaguucagagcacuugucacucaugcaaagaaccugaccucaauuuccagcacucuuauguuggcugguaaccaccuguagcuccuguccuaggguuccagugcccucugcugaugucugcugguaccagauguaugggacgcacaugcacaugaagacaugcaagcaaaaauaauaaaaauaauaaaaauaauaaaaauugaaucuuaaaaauugacuuauuuuguguauggguguuuugcuugcauguguauuuguguacugcaugcauacauugcuggucaaguucugaagaggguguuuccugaaaugggaaccacagaaaucugugagccaccauguggguguugggagcuaaccaggauccucuggaggaucagucaaugaucuuaauugcugagccauagucuagccccacucugauuagucuaaacagcaauaccuuuugucucuacacuaguggggcuugaaccaccagccauuucaauauccaugugcaguugcauggcuuaaauguauccacaugucccauuuuaauacucucuaggcaauaguuucauuuaauuauauguuggaaucauaacaaaaauacaaucaguuucugcaucaaugcacagaacuagucucuguauuuagacugcuuauuguuuaguacuuacaaagaaaaauuaaggaacuauaguaaaucugacaacaaacaagcaauucucauagcaaaucuaaaugaaaacaacccguguuaguagcugaguguaagugaucaggaauuugauuguucaacauguuuauuauuguacacucaucauagaguugguguuuucuaggcguucuucuaaauacuauuaucauugacuggacauaguggcucaugccuguacucucaauacuccaaacacgccugaaaacuaucaguuaguuuuucaaaaccuuccugggcuaccuacuggguuuucaaccaacuugagcuacaaaauauacaaaaugagaucgugugugucugugugugugugagggaaagaaggaaggagauuauaauuacccuuuuuucuuccuuaugaguauguccuuaaaucugugaguuaauugaugggguaauuaucuuuuaaaacuaucuagugagguuguucuuuucauguccucuucuuguccugaacccaacaucagcaaauguuuguuuuuaguuuuuugauuaacagugcuuugaaguuuuuuuuuauucuauuguuaauuccauauuuuuuaaaaguuugcaaagcacuuuuuaaaaaaagauuuauuuauuuuauuuauaugaguucuauuguaguugucuucagauacaccagauccuacuacagaugguugggagccaccaugagauuguugggacuugaaugaacucaggaccucuagaagagcacucaaagcucuuaacugcggagccaucucuccagcccccaugcaaagcacuuucauauaaaugagcucauaccuauuuugauugaaugauauugguauuuagagagaaauucuggacaacuagaaaauuuaguuuuugcuacaugacuucaauaauaagauucauauuuuaccuuaagcauauuuacuacucuucauuuuuuuuccaucugauaaaaauauuuuagccauuauuuuuaaaacuaaguauuuaaaauguuuauagcaacucucuuuagaaacauuuaauaccuuauuuacacuaugguagagauauaauaaagauacauagaaaaaauagagcuuuuaacuaagugauaugaacuauaugagugcuauuuauucagauggcauugauaugaaauauauaaauaguauugaaaagccuggcagugguggugcacaccuuuaaucucagcacucagaaggcagaggcaggcagaucucuugaguuggaggccaaccuggucuacagagcuaguuccugacagccaggcuacacaaagaaucccuaucuuggggaaaaaaaaaacaaaaaacauaauuuuuuuuccuaaggaagaaauaaaaacugucugugacuuagacuacuuggaguuaauaccaacucguguguguguguguguguguguguguguguguguguguguguguaugccuuucuugcucagugacuaauaaaaagucaugggauauaauuuuaaaacauuuauaguacacauuuguaaucaaagucaaaagaggcuaagguggucacauugaaucuggucuucauagaagguuucugaacaaugauuucucugauuaauguucuuuugcuaagcagcagcauauauuuaucagaaguggccuaacuaaucaauauucucuuaacucugguuguagaguguacaagggaagaaagugccaagcaaaaccaccuuaaaggaagacgacgacaaaucugguccuauuuuuauuguuguuccaaauggaaaggagcaaaggaugagagaugagaaaggauuaaagguaaggaagugaugagaaucuuugggaguuuuugcucguuuuuguuaaucagaaacguuuuucagacuaggaguacuggcauaaguccagccgaggcaggcaaaugucuguuaauuugagugcaggucucuugaguuugaagccagccugaucuacauagcaguccauccaagaaaauauagugagaugcugucuuuuuaaaaaaugcuaaaaaguuguuaauauguuauugguacuuuuuuguuuguuuuuuguuucuucaauauggucuuuguuagcacaugucuguaaucccaacccugaagaauaugaagcagcaaaauucuacauuuuaagacaaucuuaaaguuacuuagcaagacccuuucucaaaagaaaaaauguuuaguuugaaacuuaaguuguaguugauaauuaauuaagucucuucauuuauaaauuaucuuauucuuucucugggauuauuuuaaaagaaguguaauucuuuuuuuuguuguaguucuaguuuguggugguguuuguuuguuuguuucuuucuucuuuccuuuccuuuucucaucccaaggucucgauagcccuggcuaggagauccuccugccucugccuccugagugcugagauuacagggguguacuggcauguugggcaaggaaaaguaauucuuacaugucuucuaaauaggaagaugauuuaacaguccuuuacuauuuuuuaaacauaaaaacauaguauucaaugguuaucaucagcuggacauauuagugggcuacuauuuuuuaauccuuauaauaaacaaaauacaaccauauauguagcuaauauaguuguuuugggguauucaaagcauuuggcaaguauguacuuuggccuggguuucauccugagcacaguauuuuugauuuugagaugagauucuucuuauguagcccuagcuggccugcaacuaccuaaguauaucaggcuacaucuauuuaucugucuucuaccaccacacccagccaccauggcagaaauuuguuuuuuaaaucacuuuguuuguuuguuugagacagggucuuucuguguagcucuggcuuauucugcaacucacuauguagaucggguuggccuagaacucacagagauauuccugccucugccuccugagugcugauauuaaagguauguaugcacugcuauguaacuuguaggagucaguucuuucuuuucaucauaugagccccaguaauugaacuaaaggcaaguaccacugaguuaucuugguggucuaaacagaguuuucuuacaauuguuuguuuguuuuuauuggcccuuugaauuuuuuucaugcaguguauuuugaucuuguucacucccucuuuuaaucccaucaggcagaucuuucaguucuaugccagccuagucuacagagugaguuccuagaccaccaggucuacauaaaaaacaaaauaaauuacuuauuugugggaauaugcauguguuugcaaauacacacuugcacacuacauauacauauuuugauuacuucuaaucaaaucacaguauuacagucauagaaucacaaauugugcggucgccgggcggugguggcacacgccuuuaaucccagcacuugggaggcagaggcaggcggauuucugaguucgaagccagccuggucuacagagugaguuuuaggacagccagggcuauacagagaaacccugucuugaaaaaaaaaaaaaaccaacaacaacaacagaaaacaaauugugcugucacaaacauguuucacagucugaagagauagcuuaguagauuaagagcacauacuacucuugcacaggaccuaaauuugauuuccagcaacaugucacguggaucacaaacucauguaauucuagguccauggauacacacacacacacacagacagauauauuuacauauaaauuuuaaaaaaucaagucaggcuuuuuaaaaguacauuuaaauauaggucuuuaugcacguaaguaauucuaaauuccuagaaugguauuauguuuuucauuuaguacguuuauuguguuuaccaugucacacaauuauagcauuuauaugcccuuuuuugguuuuauucuuuuuacuauauugcccugacugcuuccauggugcuaggauuaaaauaauaaauuaaugggcaucaacuuuuuuuauauuaauauuugcccaaaauuguuuucuuguaggauuucagaaguguaacaccuugagcuauauuuuguguucauaauuaauuacuagugaaucuuauuuuacuaaaaaguacuuagagccaagcaggaugcuacaugcuuauagccccagcaauugagacacuuaacuagcaggagcucaacuuugaguccacccuauucuauagagcaauaugucucaaaaaguauaugcaacaaggagcuagaaagguagcucagcaauuaagagcacuaguuguucauacagagcacuaggauuggauuccuagcaucuacaugguggcucacaguuguggcuguuacuccagcuucaaggaauccaguaccuuuuucuagccuucaaaggcaccaggcaugaauuuaauacacaaacauauaugugcagucagaacacccauacacaaaaaugaagaguaaaagaaaagagaacuuaaaaaaaaaaaagaacugagcaggcuaagacaggaagauuacugugaauucaaggccagucugcucuccacauucaggccagugaguacuaaauagcguaacaaaauagugucucaaaacaaagaaaaccaggagcacggagauaacacauuaaguugggucuuucaccugcaccaugugacucucaccuuugcuucaguuuaacugccugcauucagugccuuuucugcuuucgccccucaggugcuaaaguggaauuuuacuaccccacgggaugaguacauugaacagcugaagacucagaugucuaccuguguggcuaaaugguuacaggaugaaauguuucacucagauuuccagcaucacaauaaagcccuagcugucaugguugauguaagucuucaaauagauaaauaucugucucaggaauaugaaaauagggaaugcagagaguuggucacaccuuuaaauacuuugaagaagaaauugaauacaccguguccucuauaaagcuguuucacuugauagaauaaaaugaugguguauuuuggagauccuggugaagguuuaaaaaucuuacauuuucuuugagcaccauuacaacuuaagaaauauauaugccuaguagaaauuuaaauuuauaaugggacuggagagauggcucagcgguuaagagcacugacugcucuucugaagguccugaguucaaaucccagcaaccacauggugguucacaacuauccauaaugagaucuggcgcccucuucuggagugucuggaggacagcuacaguguacuuauauauaauaaauaaaucuuuuuuuuaaaauuauauacagucuuaccuaugggguuuuucuuuuauuuuaagcacuuggaaagugaaaaagacggugucaucaguugcuuagaucuuaucuuaaaauggcuuacccuccgguuuuucgacaccaauacaagcguucuaaugaaagcacuggaauauuuaaaauugcuuuucacccugcugagugaggaagaguaucaucuuacugagaaugaagcaucguccuuuauccccuaucucauccucaagguaauggguucucauccuggguggccacuugaguucugagcuagccuugguucuuacacuuuauggcaugauggcaucuccuuucauucauucucaagauccuuucaagauacaguaaugcgugaaauaaccauugcacucagaaaaggucucugucauuccuccuugaccagguuggagaaccaaaggaugucauucguaaagauguccgugcuauccugaaccggaugugccuugucuacccagccagcaaaauguuccccuucauuauggaaggaaccaaguccaaaaacucuaagcagagagcagguauagcaaaacauauauauauguguccaucuaucuuucuagaguugcugagagcugagcucagagucccauacgugcuaggcaaguucucuacacugagcuauauuucucaacccacccccuuucccccaaaauugaaguuaaggugcaagucuuugcauaagugagucucaagaagucauuuauaaaugagcagugaaauuucuucagugucuguguaguugauuccaauuuucuucuucaaacugugagagugaugaguugcacacugguggagccauaguaucaggugauacaggcaccacucaguacuacccuggugacaaaaucaagugcacaggggccaucugacucacaggcauaccuugucaugaacacuuauaacaccauugucucauauaugacaguguaaaugacagaaaaaucuaaaaagacccagaauaagauuugucacuuccugugugccaaagaaaaguuguagaagcuucuauaccauauuuuuuugaguuucauuaaucuauucuuucuuccccaauagagugccuggaagagcuagguugcuuaauugaguccuaugguaugaauguuugucagccaaccccaggaaaagccuuaaaggagauagcuauucacauaggagaccgagacaaugcuguacggaaugcugcccucaacaccauuguaacaguguacaacgugcauggagaucagguguucaaacugauuggaaauguaagugacacuucucuguacgccuugucaguauguugcaaaaagaauuccaagauuucuugguuguuggguuuccugccaucucacucuacuggaguuucauugauuauuaagcuuaaccaucaagauguccuagauccagguauguauuucaggugcuuucauuguuguuggaccucuuuacuguguuugaauagauuuuuuuuuuuuuugguuuuuuccagacaggguuucucuguauaguccugacuguccuggaacucacucuguagaccaggcuagccucugccucccgggugcugggauuaaaggugugcgccaccacaacccugcuaguucugccucuuaauuccuugcuucuuucugagccagacauuauugugccuugaccuccguucuuuacucugauagaguuauaauagcaccauuuuaaugcacuguacuuaaauaauuguauuuccaucaucuaauaagauacuaucaccaguguagaagaacauaaaacaaauagaaguuguuuuaucauaugacgaaaagugaauaauugugcucauagacacaauuuguuuuuagcaacaaaacaaagaaacuucauuaauuuuuaccuucuuuuuuucuuccuuuuuucaaaaagaaauuuaauuuugauacaugucagacuaggcucaaacucacuauguagccaacgaaugucuugaacuucuuuuauuuuuuguuuguuuguuuauucuuucuuucaguuguguauuuauuuaauuugaggcagggucucucuauauuguaguccaugagcuagcaauuuugaccaggcuggccuagaacucacagaaauccuccucuucaaccacccucaauuccuuaguacuaggguuaaaguugugagccaccaugccuagccuaagacuuugaacauucccgauucuaccccuacauccugggugcuagaauuacuaguaugugcaacucuauccaguuuuauggaugcugugucaaaccaaggcuuuguacauauuaggcaagcauacugccaacugaacagucaucagauucuauuuuuagcuuuuugauuauaguuauuaacauuaguuauuacuuuuauauccuuuucuuucauuuguuguuauuauagcuguguagauauaugguuguugacuuaauaauauagugauaugaaggauaacaagauaauucaauggauaaaguuguuuuacaaccaagccugaauaccugaguuucaucccuggaaccacaugauuuuaaaaaaaaaaaaaagaaucaacucccacaaguucuccuauaacuuuuauauuaguguuguggugcuugugugaacacauacauacaacauucguguguguguguguguguguguguguguguguguguguguaccagauaaauaaaugcaaagaagcacuuuuuagaaauaauguaauagauugacuuuguuuguuuuuaagauuauauuuauuuuuuaugugaaugaauguuuuggcugcauguacauauguguauuuguaucccacaagugugccuuuugucuccagaggcuagaauuaggcauggaaccucuagaacuaaaguuauagcuggaccccgugguauacucaggaggcagaggcagaaagaccuuugaguuccaggacacucagggcuauuacacagagaagccaugucuuaaaagaaaaaaauugggcaguggugacauacaugcuuuuaaucccaggacucggagcaaaaggggaucucugauuuccaggacagccaaagcuacagagaaacccugucuugaauaacaaaaaaauaaacaaaaacugggguuacaugauuuuggggcaccaugugggugcugguaacugaaccuaaguccuucgcaagaguaacacauacuuuuuguuuguuuguuuguuuguuuguuuguuuguuuguuuguuuuucgagacaggguuucucuguguagcccuggcuguccuggaacucacuuuguagaccaggcuggccuugaacucagagauccaccugccucccgagugcugggauuaaaggcgugcgccaccacgcccggccacauacuuuuuaauauagagccaucuacccagcccccuaguguuagaaauuuuaaaguaaauuugaucuaucauaaaagugucuuuuuuuuucuacgugaaaauaaagaguguguguguguguguguguguguguguguguguguguguguguguguuaguguguguuauuuuguuaguaaaagucugaauuugucuguagcccuggcuauccuggaacucacucuguaguccaugcuagccuugaacucagagauccaccugccucugccucccaagaaccaggaucaagggcaugugcuaucacugccuggcuucuuuuaagcugggauggguaauuuuuugcaauaggguuucucuguauaacaucccuggcugucuuagaacucaauuuguaguccagacuguuuuguugaccagcuguccuugaacucagagaaaccugucugccuuugccucccaauacugggauuaaaaguaugcaccaccacaccaggcuugcaguggauaauucuggauuauuauucuccaaguaggauuuauauuuuaguaaauggguguacuaauagcuugaauuuuuacagcuuucugagaaagacaugagcaugcuugaggagaggauaaagcggucagcaaagagacccucugcugcaccugugaaacaggccgaagagaaaccucagcgcacacagaauauaaacucuaaugccaacaugcuacgcaagggaccagcugaggauauguccuccaaacuuaaguaugugaauacagacaguuaucugcuagcauaucuguggauuuagcuuugugugcucagagcuugucuguaacauaaucuugaguuuuugucauuaucaugcaugacagaugucuaggcuaaugucuuaugaccaaauguuuaaucuuucauucuucauugucuuugucucaaaaccacuucuaaauggucuugugccuucuuucacugcuuuuccguggacagaauuauguaucgcacauauaggauguaaguacugccugcuaauuucucauuagcagggcucuuauaucuuucuaacuucugacaugguuucauccccucuggagagugaucagccuuuacaauaggacagcagaugguggccauaaauaccaggccucccaugaaagccuucuuuauauucacuuguauucacauuccuguuuuuguuuuugguuuguuuuuuuguuguugucauuauuuuggguuuuuuugaaacagggucucauaguccaagcugucuuggagcucuccauguagaccaggcuacccuugaauuccuaaaguuucagcugucucugcuucccaaaguccugguauuaaagaggugcaucaccacagcagacccaguuuccuguuccuaagauaaggcuacugagaugcaugcauuccacaacuggccuaugggcucaaaauacugccuuccaaacaagacaacacuguuuggggcuguguguaauucaaguauaauuuuaaugaauuugaauuuguaaauuuugcauaacuauauaauauuggccugguucuaucuauaucuacuuuuugacuucuucaaaaaguaaugacuaucuuucaaaguauaaaauguacugaaaaacuauauaagaugccuaugaugagaacuuucacagagagagaagggaacaucagucuacaccauuauuacuacuucggcucauaguaauggauuuucaaucuauauaaguauuuucugcuccaagugaacuagaaguucaagauuguggacaaggcuuuugcacaucagagauaauacacuuaaccuauaauguaaacacaaauuaaaguugccugcucucucuuagaauaauccugaagcagugcuguuacuucaggcacuuuccuaucaauuuaaauccuucagaggggcuggaaccagaaguugaacaucugucuugaagcuuugaggcagcuagcagugcuaauauuauccuugugaagaaaucccucuuaguucaggagccucuuuuugcuuccuuuagucaagcucgaagccugagugggcauccugaagcagcccagaugguucgccgagaauuccagcuggauuuagaugagauugaaaaugauaaugguacaguccgcugugaaaugccagagcuuguccagcacaaacuugaugacauuuuugaaccuguccuuauuccugaaccuaaguaaguucagcuuucucaaauacaaacagcuugugaucauuagagucuauaccuggaaguaugcuguugaaaauuccuagaguugauuacuaccuaguagugaccucuuuacuaaaaccuggaucuaguaaagaauugcauaauucccacucauauucauauugaauuuuuccuuuugauguguugucuaggauccgggcuguuucuccacauuuugaugacaugcacaguaauacagcauccacaaucaauuucauuaucucccaaguagccaguggugacaucaacacaagcauccaagcucugacacagguaaugggaaugcuucccacaguagugacuucacugaccucuguagagacuuguaagaauaauggauuauauacuaguauaauaacaguauugaagcacacagguaguguccaguauuauccugauuuuuuaaaaaaggacacagggaccacuugguuaccauuuguauaaaguccccuggaaccagaguuacagacaauugugagcuaccaaaugggugccaggaaucaaacccagguccuccggaagaguugccaguguucuuauguaugagccauuuguucaguccccagaagauaguuguuuguagccauuuucugcuuccuucccuaacaguucaguuuaaguguauauaaacagggaagagcuagcuagguuuguguuugcuguggugacaaugauuguuaguggggaaccacguuagcucagagccaggagauaaaaguccaguggauuacaaggaaaguguucauaaaagaacauugacauguaguuguguaucaguucucaaguaaaggaugucuauggggggggcaggcacccugucaucguguuaaggccccaagcaaagcgaguagcaugcagaguggcucagaaugagggaucauccaaacaagaaugggggcaucaaaauggagaagggcuggaggcagaaauagaagauuggucauauagagacugguuaacuaaaaaaaaaaaaaaaaaaaaaaaaaaaagccaauuacugcaaaaauggaguccuauuucuuauauuuuugguugugagccuagccuuuaacggcugagccaucucuccagcccauggaguccuauuucuuacauuuagagaggggagcuacaaauauauagcaaagcaaaaugaacugccugauuccaucauguguacuccaaaugacagccugacuccacucuguuuuaggcuaaauuuccauagucauaaggaaacuucaaauuaaggcaagucauccauauuggggauacuaaacagucacuagcuaggucauuucauuuguagcauucuuucaaauaaaaaaaaguuaauuuuuauuuauuugacauaacaucauuauauaacaucauuaacagugauguuaguaaaauaaauauaacaauauauauucaagacauuuacauaaaaaacaaugaacuguuagugaaugacauuuaaaauacacuauuugcuggguagugguggcucacaccuuuaaucucagcacuagugaggcagaggcaggcagaucucuuugaguuugaggccagacugguuuacagugugaguuccaggacauccaggaggacacacacaaagaaacacugucucaaagaaagagagagagagaaccguguguguguguguguguguguguguguguguguaaaauguuuauaugauucagaauuagaugucaguuaccuaguauauaaauuaagcguauuuccuaccacaagagggcaucaggucccaguauagaugauugagagccacagugucauuauugagaguugcugcaaauuaaacuuagaacuccuagaaggacagugcucuuaaccacugaaccaucucgccaguccuguuuguuuguuuguuuggcaacaaacaaauuaagugcaaauuaaguguauuuccaugcaaaauuacaacagucuaaaauuugagacgcugagggaauuacagcacauguacagaagugagagaacaaauugugagaguuaguuauucugucaaguggguccuaugauaauccuuacuuuguaauaaaaaugcuggaugcucagaguaacagaagagagacauguuuauuuucuguuccuuguaagcugaccauggugauucaugccuguaaucccagcacucagggauuacucaggcaggaggaucagaacuucagaguuauucuuugcuacaugucaaguuugcagccagcuuaggcuacaugagaccuguuuaaucauaaagaagaaaauaacaauaacaacaacaacaagaaaaauaggcauaguggugacauauaccuuuaauaccagcauucaggaagcaggugaaucucugugaguucuaugauagccugguccacagugugaguucuagggcuguuacacagagaaaucaggggagugaggagauugagacaugaguuguuacugcaucuuuguuucuugaaacaaggucugugucugaacuagaaugccauguagaccaggcuggcauugaacucagccaucugaaugccucugcuuccugaguacugguauuuaaggcaugugucaccaugccaaucacauuagugcauuuuaaaaguucugugaagacuagaaguauggcucauccguauagaaugcuuagaaugugcacggccuaaggucagucuccaccgacagaaaacaaaccguaugcauccucuuaagaaaggagaacguggagcuggaaagauggacugacugcucuucugaagguccugaguucaauucccagcaaccacguaguggcucacaaccaucuguaauggagucugaugcacucuucuggagugucugaagauggcuaaaguguacuuacauauaauaaauaaauaaaucuuaaaaaagaaaaaaggagaauguucucucagacaaaaaugcaagcauauaaggauauauauguacacacacacauauacauauauacauauacacacacacauguauauacucacucaaagauuuuguuuauuguaauguacuaaacuacaaacacuggaaaaucucaguaaagaaaugauugaaaauuuugauaaagaauuugguaagccagccgggcagugguggcacacgccuuuaaucccagcacucggaaggcagaggcaggcggauuucugaguuugaggacagccagggcuacacagagaaacccugucucgaaaaaaaaaugaaaaaaaaaaaaaaagaauuuaguaagucauuauguuguuuguuuguuugaagucagugguucucaaccuguggucugucccuguauaucagacauuguacguaucagauauuuacauugcgauucauaacagcaaaauuacaguuauaaaguagcaacaaaauaauuuuaugguugggguucacaacaacaugaagaacuguauuaaaggaucauagcauugggaagguugagaaaccgguauuauaaguguuugguuuuguaugaguauuuugcaugcauuuaugcacagcauaugcguauaccugguugaucccuacaaaauccagaagagaaaauuagauuccuuggaacuggaguuaaagacaauugugagguuuccuugauaaggcugggaaccaaauucuaguccauugcaagaacagcaaaugcucucuuaauagcagagccagauaucucuccagcaucuugugcugcuuucacaaauagaguuguucuuuugacuuuagagauuuucaaaaauuuccacugaauuaaaaagcuagaugccaacaaaguauggagguuuaugccuuuaaucccaacacucagagguacaggcagaucugucugaguucaaggucuacauaguaaguuccaggacagccagggcuacauagugaggcccugacucaaaaacaaagaaagaaagcuagauguagaaaaguacaucuaaucuuuguaaacuaauugcaucccuaaagccuugagaguaaguguacuauaauuauuuuaauaauaauaauaauuagaagacuauaauaauauaaauaugaaagaauguaugucuacugauuaauauaauuuagaaaaggaaggaaaauaauccucucugaaaaugcaguguuuuuuaugaugugcauauggaaacauuaaacuuacccacuacauacuguguuuaugaaguaggcauacaugaagaggagauaaugaaaguaaggccuacaccaggagacacuguucacauguaaacgguggcccaguggagucauacagcuuagcaguccugcuaaaaaugaccuuuacagaauaccaacauauuaguguauaagagauaaauauuuuccuguagaacauuuuaccaucacuacaggaaaagcacuggacaugagaaaauugaguuuuuaguuuagacagaguaaauacucugagcuuuccaagccucaucugaugaauggagaucuuuugcuuguuacuuuuuguuguugaguugucuuuuuaaauuuuggcaguacugugaaugaaacccaggaccuuaaacuaaguaggacaugcccuaccacugagcucuuuauucauauauauauauauauauaugaaugaaugaaacagacuauauacauauagauaagauuguuuguuugggguuuuguugcugcugcuguuguuuuuguuuguuugaaggcugguucucacuuuguagcccaggauauccuggaacuuggcuguguagccuaagcugaacucaaacuuaaaauccuccugcucccucagccuucaacgugcugaucauagguauguuccacuacucuuguuuuuuuuaauugaagguuuaguaguaacacagucuaaaagagaaguauucuuuuuuuuuguuuguuuguuuguuuuuguuuuguuuuguuuuguuuuguuuuucgagacaggguuucucuguauagcucuggcuguccuggaauucacuuuguagaccaggcuggccucgaacucagaaauccgccugccucugccucccaagugcugggacuaaaggugugugccaccacgcccggcuagaaguauucuuuuuaaugaauugaacauucaaguguagaaauuauucucugaaguacacaguaagguucuuagaauagaaucucuagcuaauucauugaauacuaucuugcucaguaauaaauguguguguguguguguauauguauauguguguguguguauauauauauauauauaaauauauauauauauauauauauauaaauauauaaauauauauauauauauauauaaaaugauugaauuucuaaauuuaauuaauaauuuguaaaguuaauuuuuuuuuuagguaaaauaaguacuuugcuaaugaauucucuuauagaaauaugucuuauagucucuuucugccacuuauaaagcuugggaacuacagcuugggauuuuuguuaccagauugaugagguccugaggcaggaagacaaagcugaagcuaugucuggccacauugaucaguuucugauagcaacauucaugcagcuaagacucaucuacagcacacacauggcagaugagaaguuggacaaggaugaaaucaucaaguuguauagcuguaucauuggcaacaugauuucgguaagacauuucuggagaguuucucuuagaucuauuaucccacccagguccucaagccagagucagucugauguuccagugagaccuguguccacuugguagaauuauccaugagucauggagccaguuguugacuuuuugcauugaauguuaccuguuagguggcucaucuaacacagcuggaauagagaaggaauggagaguagacagaacuagaaccacagagaaccugggaucgugugcucugaacuuugagauggggagaucucagcaccccagaaacucaacauauuuauauagaauugaacagagaggcuggguuguugcauauagauaaacaaggaggugaguuauguuaugugacuggauaaagaacauagguuuaacuaaucucuguaggagcaaucucugaaaagaguagcuuucaggccagugaacauaguuguuggagcacugaggacacuucuguagauagauaccacgcaccccgaggaaggcuuugcuccuuuccucugugucucacacagagaaggcuuugccauucccuuagggcugaggcuagaguccuugauacagaccauguuagcagcacacauuuauucaagaauuuguucacuuggggcuucuuccacuccccauaguuaggauauaaaauacaaugcuuaguucuuccuaguguacugcuuccuaccaguuucuucuacaggcaaagcagguccuauuuggcuuuucauggauaaucggggaucaaaaauagaguagaaaggaauuaggguuagggaaauuaauuaggguuguuuuuuguuuuuuguuuuaacauucugagguuuuaaaaauguguugguacaaacaugcaaucccagcacuuagaaguuuaaaguacuggccagcugggccacagaguaaaucuuugucaauauauauauagcugaauauugacuagaauauaccaacuauguuuuucuucuuugucucauauauugaguuuuaaccuuccuaacacaguuagaacuggauagcuauuucagauagagagcuuggcccgggaggccuccacuggaguacugaaagaccugaugcauggacugaucaccuuaaugcuggauucucggauugaagaucuggaggaaggacaacaggugauucguucugugaaccucuugguggugaagguuuuggagaaaucagaccagaccaauauccucagguauauuuauacccucgucaguaaaacuugggauagucucuuauuugucuacagauagaaaucagguagucagaguugugaguggcucagucaguagagugcuugccuaccauucagaguccugagucugccccccacccccaccccaccugaccucuaaacccccuggggccuccagucucuugaggguuagcugcuucaucucugaaugaacacagacccagcaguccucuacuguguguguguugggggccuuauaucagcugguguaugcugucuguuugaugguccaguguuugagagaucucucggguccagauuaauugagacugcugguccuccuacaggaucgcccuucuccugagcuucuuucagccuucccuaauucaacaacaggggucagcugcuucuguccucugguuggaugcaaauaucugcaucugacucuuucagcugcuuguugggucuuucagagggcagucaugauaggucuuuuuugugagcgcuccauagcucaguaauagugucaggccuugggaccuccccuugagcuggaucccacuuugggccugucacuggaccuucuuuuccucaggcuucucuccauuuccaucccuguaauucuuucagacagaaacgauuauaggucagaggcgugacugugggauggcaaccccaucccucauuugaugcccugucuuccugcuggaggugagcucuauaagauccgucucccuacugucaagcauuucaucuaaggucccucccuuugauuccugagagucucuuaccucccaggucucugaugcauucuggaggguccccccaaccucuucuauuuccugagguugccuguuuccauucuuucuauuaacccucaggacuucagucguuuucccucaccccgauuagaucagguuccccucacuccccacuucccacuuacccuccccauccacuuucccuccccauccacuuucccucccaggucccucucucccuccccacuugugauugcuuucuucucucucccaaguggaacugagguguccucacuugggcccuucagcuuauugaccuuuuugaguucuguggacuguaucuguauucuguacuuuugugggggauaacauccacuuauuaguaaguacauaccaugcauguccuuuugagucugaguuaucucacucaugauauuuucuaguucuauccauuugccugcaaaacucaggaugaccucauucuuaauagcaaguaguauuccacuguguaagugaaucacauuuucuguguccauuguucugucaugggacaucuagguuguuuccagcuucuggcuaucacaaauaaggcugcuaugaacauaguggaacacgugccucuguggcaugguggggcaucuuuuagguauauucccaagaguggcauuccugggucuucagauagaucuauuuccaauuuucugagacaucuccagauugauuuccagauugguuguaccaguuugcaaucccaccagcagugguggaguguuccucuuucuccauauucucuccaacauguguugucaccugagguuuugaucuuagccauucugacugguguaagguggaauuucaggguuguuuugauaugcauuucucugacuuugaacauuauuuuaggugcuuuucagccauuugagauucuucacuugugcguuuuugguuuaguucuauaccccauguuuugauuggguuguuugguuuuuuuuggugauuaacuucuugaguucuuuauauauuuuggauauuagcccucuaucagaugugggauuagugaaaaaaaaaaaaagaaaacaauagcaaaguuuaccaauuuucaaauaacaaagucuuuuuuuuaagguuuauuuauuuuauguauaugaguacacuguugcuguucucagacauaccagaagagggcauaauaucuuauuacagaugguucugagccaccauguaguugcugggaauuaaacucaggaccucuguaaaagccaucagugagugcucuuaacugcugagccaucucuccagcccaaauagcaaaaucuuuuuuuauuauuuuuuauuuuuuacuuuuuuauuagauauuuucuucauuuacauuucaaaugcuauccugaaaguccccuauaccccccccccccgcacugccccccaacccacucacuccugcuuccuggcccuggcauuccccuguacuggggcauauaaucuuagcaagaccaagggccucuccucccauugauguccuacuaggccauccucugcuacauaugcaacuagagauacaagcucuggggguuacugguuaguucauauuguuguuccuccuauaggguugcagaccccuuuagcuccuuggauacuuuuucuggccccuucauugggggcccuguguucauccaauagaugacugugagcauccacuucuguauuugcuagacacuggcauagccucacaagagauagcuauaccaggguccugucagcaaaaucuugcuggcauaugcaauagugucuggguuuggugguuguuuaugggaugguuccccagaugggacagucucuggaugguccuuucuuaugucucagcuccgaacuuugucucuguaacuccuuccauggguauuuuauucuccauuuuaagaagaagcgaaguauccacacuuuagucuuugcaaugugugcuuugagcuuuacuauaguuucuuuaaugaauguggaugaccuugcauuuggagcauagauauucagaauugugaguucaucuuggaagauuuuacuuuugaugaguaugaaguaucccucucugucuuuuuugauaacuuugguuuggaaguugauuuuauucgauauuagaauggcuauuccagcuuguuucuucggaccauuugcuuggaaaauuguuuuacagccuuuuacucugagguagugucugucuuuguccaugaggugaguuuccaaaauguuggguccuguuuaugcagccagucuguuagucuaugacuuuuuauuggggaauugaguccauugauauucagagauauuaaggaaaauuguugcuuccuguuauuuuuguuguuagaguugggauucuguucuuauggcggucuucuuuaagguuuguugaaggauuacuuucuugcuuucuuucuagggcauaauuucccuccuuguguuggaguuuucacuuuauuauccuuugaaggguuagauucguggaaagauacuguaugaauuuggcuuugucauggaauacuuugguuucuccaucuaugguaauugagaguuuggcuggguauaguagucugggcuggaauuuguguucucuuagugucuguauaacaucuguccaggaucuucuggcuuucauagucucuggugagaagucugguguaauucugauaggucugccuuuuauguuacuugaccuuuuucccuuacugcuuuuaauauucuaucuuuauuuagugcauuugcuguucugauuauuaugugucgggaggaauuucuuuucuggucaaucuauuuguaguucuguaggcuucuuguauguucaugggcaucucuuuagguuagggaaguuuucuucuauaauuuuguugaagauauuuacuggcccuuuaaguugcaaaucuucauucucaucuacuccuauuauccuuagguuuggucuucucauuguguccuggauuuccugaauguuuugaguuaggaucuuuuugcauuuugcauuuucuuugauuguugugucuauguucccuauggaaucuuccauaccugagauucucucuuccauuucuuguauucuguugcugaugcuugcaucuaugguuccugauuucuuuccuaggguuucuaucuccagaguugucuccuuuagauguucuagcugucucuggguuuucuuuauuguuucuacuuccauuuuuagaucuuggaugguuuuguucaauuccaucaccuguuugguuguguuuuccuguaauucuuuaagggauuucuaugcuucaucuuuaaguacuucuuccuguuuagcaguguucuccuuuauuucuuuuuuuuucuuguuuuguuuuguuuuguuuuguuuuucgagacaggguuucucuguguagcccuggcuguccuggaacucacucuguagaccaggcuggccucgaacucagaaauccgccugccucugccucugccucccgagugcugggauuaaaggcgugcgccaccaugcccggcuucuccuuuauuucuuuaagugaguuauuaaugcccuucuuaaaaucuucuaccagccucaugagauaugauuuuaaaucugaaucuuguuuuucggguguguuggcguauccaggacaagcugugguagacguacuggguucugaugaugccaaguggucuugauuucuguuaguuaagauucuuauguuugccuuucaccaucugguaaucacugguguuagauguucuagcugucucuggcuagagcuuguuccuccugugauucuguuagccucugucagcauuccugggaguccaacucucuccugagucccaggggucagagcacugucugcaggcaagcucucuucuggcagggaaggugcacagcuccgccuucuggcuuaagaugaagaccugaagggacccuguccaagaagcucuguugcuucuguggccugcacacucuccugcagggacuggucuuugagagaccugggauacaagauggccuuuuuuuuuuuuuaaagauuuauuuauuuauuuaauguauguguguauaccauuguucucuucagacacaccagaagagggcaucagaucccauuacagguguuugugagccaccauguaguugcugggaguugaacucgggaucucuggaagagcagucaguucucuuaaccacugagccaucucuccagccacuaaauaauaaaaaauauuaaugauugaucucauuuuuaguaauuaugaugaucugugaauuacuuauuagguggauagagaauauucacacuucaguuacugauuuuuaagaaugaagguuuaaaauuuauuaaugcuuuuuguuuuuccagugcccugcuuguuuuacuucaggacagccugcuagcaacagcuaguucucccaaauucucagagcuuguuaugaagguaaaguugaaaugauuucaucucuuuucuuucaaagauauaaucacuuuuuuuucugaggaggugggggugugguucaagauaggguuucucuguguggucuuggcuauccuggaacucaaucuauagaccauguagccucaaguucagagagccaugugccucugccuccagagugcugggauuaaaggugugugccaccaccacccagcuguaaucacuuuuuaaaaauguagacgaaaagaaauuugaauuaugauauugaucaaaucaaccaaguauagacaaaaaauacaguugguaagccaggcaugguaacaguuguaauuccagaaaacaagagguuaaggaaggcugggcagugguggcgcacgccuuuaaucccagcacuugggaaacagaggcaaguggauuucugaguucgaggccggccugguccucagagugaguuccaagacagccaggggaacacagagaaacccugucucaaacagacaaaaaaaagaggcuaaggaaggaggauaggagucaaaaccagccuaagauaccuaauuuaguguuacugaaacagugaggcugucucaaaaauauguauauauaacuggacuuuuauuuuccuuuauuucaacuuaucacuaaauucaagucuaacauuuuuuauaucagucuucaugcugugauguaucucuucauccuaauaucuaggaggcagagacuugguuggccuugaacucagagauccaccugccucugcuuccuagugcuggaauuaaagaugcacaccacuaagccuggauucuccuaaaaaucuuugcaaacaugaaaagcaagcuaccacaguggcuuauuaauuauaccuguaaccccagcacuugugaaacaaaagaagcagccucuuguacauaguccaguuagaucauggccagccaaaccagaaggcaagaagucugauaagggauuuucaauaugagcacgagguauauacaggcuuauaauguuuagucuuucguagaacucuccaaaugaacauaaguacaacauuauaguacuggugcuauagugguauaggauacuuggcauccuuagguuagauuugguuaaacaaucuagacuauucuauacucagguccuaaggaaacuaagacagaauuugaacguguuuugguuugguuuuuuuuuuuuuuuuuuccuccaauauuuaaaacguccuugucucagggguugggagugaaaacuggagaguugagauggauggucacaggguugauuugucacacuucagggagggacauaguugaagagauucauaucuuuaagguuuagcagccaaacuugaaggaugugaccaacauuuauaucuuacauaccuguaaucacagcauuuagaaggcugagucaggagaguuaagguugaggucagucuccauaacauagucuugaggccuagggaaauggcuuagucuguaaagugcuuguuauguaagccaggugagaaggucuguguuucuaaucccagcacuggggaggcaaauauaguagaggagaauccugugacuuaccaaccagucuagcugaagcaacaagauccagguuaaagagagacugucucauaauggaaaguaauggaggaaaauacccuauguccaucucugaucuccacauacaugugcacacacauaauaaaucaguauuauacacauagagaacauauacucaccuaaaauuagagccuugaauuuggaaaauugaugauaaauuaucuuuauuuuuuagucacuccuucuguuucuuauuuuuuaaugguuuguuuauuuuuaugugcauugguauuuugucuucuuguaugccuaugugaaauauuggauccccuggaacuggaguuacacacugggucuucuggaagagcagccagugcuuuuuguaugguuuguuuuuuggguuuuguuuguuuguuuguuuuuugagacaggguuucucuauuguaucccuggcuguccugaaacucacucuguagaucagacuggucugaacucagaaauccgcuuacuucugccucccaaguacugggaauaaaggcaagugcugcggucacccagcugcagccagugcucuuaacugcugagccaucuuuuacccucugguuucuuauuuuaauagugucuauggagaaugguucgacuauuaccugacaccaucaacagcauuaaccuagacagaauucuucuggacauccacauuuucaugaaggucuuucccaaagagaaauugaagcaaugcaaaagugaauuuccuauaaggacucuaaagacccuucuacauacuuuaugcaaauuaaaaggaccuaaagugaguaagaacaacaauugaucucuugaguacauuacauggaagucauuacuagcauuugaaugugcugucuccuucagauccuagaccaccuuacaaugauugauaauaagaaugagucagaauuggaggcccaccugugucggaugaugaagcauaguauggaccagacugggagcaagucugauaaggaaacagaaaagggagcuucucgaauagugaguagccugaauucccagggguggggguggagucuuaggaaucagaguaagcggucucuugauuugcuguuaucgccauuucugccuaauauuuuuaaaacacuugaguagugaacacacgauuuuugaucuccaaaaaagaguucugugucugugcccaaagcaugguuagaucauuagguaaguccacugugagcucuacuuaacuggagaggaauggaccagcaugucuguagacuagaggcucuccuaaccagaacacuaguacugcuccucuaagcuuuccagcucugguggccuguaccagcagaaccacaccuguaaggccucuauucugaaauauuuucuguuagcauucauccuuucauuuguucaacucuaaucauuccuuuguguuuuucaauuuauuaggaugaaaaaucaucaaaggccaaaguaaaugauuucuuagcugagauuuuuaagaagauuggcuccaaagagaacacuaaggaggugagaaugaaagcccaaggcuggggugguagcacagcacuuacggcacuuggaaagcugagguagauaauugcaaguaugagacuagacugaacuauauacauagugagacugucucaaaaaagcaaauauaacaaaaaggcagguguagugguccacaguuguaaucuuagcagucaggugguugaggcagaugauuguucuaaguuugaggccuaucugauguacauaggaagccugggccagucagaguucuauaagacuuucucugcaaaaaacaacugaaggagggguggagggaggaaggcuagaaggaacgagggggagugggaggggcuaaaucaaauagugugauuuucucuauggaaaauguaauaccuauccccaccucuuucuuuuuuucuuucuuucuuuuuuaaccagggccuagcagaguuauaugaauauaagaagaaauauucagauacugacauugaaccauuucugaaaaauuccucgcaguucuuucagaguuauguugagagaggccuucgggugauugagauggagagagaaagcaaaggccggauuccuacuucaacaggugugguuuccuguuacaguuccagaaauaguuagcuaaaauaguugcaggccacccaccccauuggcauucuuguugauaccagcuuuauauaguuuggugagaacuaaagcuuccggucuucucuucugccaggaagcccuuugacccucccaaccugcaaaccaugugcaggguccacucacaccucucccuaccuuacuuuggcaccuugguggaagcaguguucucucuuagcugaacuacaccaaagugcccuccuguuuguucucccuacucucaucuucacuguuuuguguacauuuccacacagagcauuagaaggcguuuccaacuauuuucuagaaggcaaaaaccuuuugaguauccuguguugucugauccucugcuacuucugggaccccaucuacugcuccccagccccaccaacccccacacuauuucugaaucacaaacacauaggccuugggccuuugugcuaacuuugucauucuguuguucuuuauguagggauugaaaccagggcuuugugcaugcucuggauacacucugcuacuaauacauuuguaacaccuacauuggccauuuuauuuacacacacacacacacacacacacacacacacacacacacacacacacacacacacucugcuucugcuucuaagagagccuauuggccaauucccuagccuuguucagaucuuguucacaaagauccgcuugccucugcuccuggguucugaguuuaaaagggauaugccacuacacccagcacauucccacuucuaacaucuaugguaauagcaucuguuauuuguugugucugucauucucagcugaaauucaaaauccacaugggagguacugaauuacuggagcucaguuuggagagugcuuguuuagaauguacaaagaauuggguucaaucccuagcacccauuaacuggacaugguaauacaugcaugccuauaauccuaggaggaccagaguucaugguuauccuuggcuacauagagaccauccugagucacaugagacccuguuagaaagaagagaaggaaagaaaagaucugcuggaaaaggguuuuaucuguucaguugccuagaacaaaauuggcacucugcaguuauuuuagggaugguuagaaugaaugcauagccaaaguccaggcggaaauauuacuguccccacaacaaaaaggcuacuacgaaaaucgcuguucacagagacaaagaaagucaaaggagguuucagauuuaaaaaaaaauauugaaaccaaaggcagcccuagcuguaaaaguucuuguccucagggcagagcagagcagagcaguccgaaugugcccucucaggugcuugaugccugucagaaguuugcaccuuguguaguuuagguucucucucugcaucugucugucucaucuaaagcuuugcucucccaguuaguugaguuuugacaccauaaaugacuacucuccaacccacugaaggcucugcaagggugguaaacagaacaccaaguaacaguaggccagugauuugccuggccacaagaagccuccuuucccuuuccagaguucuguguuguaguguucuuucuuaauuuauuuuuauuucauguguguguguuuugucuacuguguaucuguguaccauaucugugcaguacccucagcggccagaagagaaugagcaucagagcuccuggaacuggaguuacaguugugagcuaccauauggauacugggauuuaaaccuggguccucuagaagagcagucaguagucuuaacugcugagccauuuugccagcccuuagacaaacacucuugucucuagcacuaagccauauccuugccccaaguuugguuuguuuguguuuuucucuuaauuugcacauguaugcgggcauguauauaucuauaugggcauaugugcagcugcaggagcuuguggaagcccagaaaugauauugaauguugucuuccauugcucguuguuuuccauuuuauaaauugaggcagggucucuugcucaaaccuagagcucacugguucagcgauuuuuuuuuuuuuuuuaaccuggagccaccuugcuccaugaaucuccuaguucugucuccugcaugcugagauuuuugggucagcuguuaugcugugccuaccuagcguuuauuugaauucuagcaauucagacuccuguuuacacuuuauccauugagccaucuuuucagcccuguaaguuagaucuuuuaaauguuauacuuuaugacuguucccuguuagaaauuuaggaauugagaugaguugguguuguucuucuccaagaauauugauggagccgggcgugguggugcacgccuuuaaucccagcacuugggagacagaggcaggcgaauuucugaguucaaggccagccuggucuacaaagugaguuccaggacagccagggcuauacagagaaaccuugucucgaaaaaccaaaaaaaaaaaaagaaagaaaauugauggauaguuccuaucccuuguuauuuccuauagauuugaaaaacuugugucuguuaugucauccagcccaaacauaacugauucagccaaauauccucauuuucuaaauugggcauuaaucauauacuuagaaguagcuuagggacuuuggauugccugugucagccgugugauuguugguauauaagccuucauauaaccaagguguaaguaggcagcccuuuugugucaauucuuuuuuuucuuucuuucuuuuuuuugugguuuuucgagacaggguuucucuguguagcccuggcuaucuuggaacucagucuguagaccaggcuggccucgaacucagaaauccaccugcuucugccucccaagugcugagauuaaaggcgugcgccaccacgcccgacuuugugucaauucuugaaguucugaguguagguuguauauuucagaccagccugcaucacuaaguccagguagauccuuguggggguuuuuuuguuguuguuggguuuuuuuuuuuuuuuuucaguuuucaaguacaguggagacauucagacauuuaaauuuugucguugcuaggagauugugugugauaaacauaugcugugccacugaguccuagggauuauugguugucuuugguaauaaauugacuauugcauucuggaaguugggauauguggaucucugcaugggcuuccuucauuuuccucuguaggcauuuccccucagauggaggucacaugugugcccacccccacaagcacaguguccucccuagguaacacaaauggagaagaaguggggccaucugucuacuuggaaaggcuaaaaauucugcggcagcgguguggucuugacaacacaaagguauuguuccuuucugugugggguggagaggagcgacagagucaccucaguagaguggccugcccuugguauacacugcugaagaguuacaucuugacugcucccugaacuuagcccaugucucccuguccucucucaacagcaagaugaccggccuccacugaccucuuugcucuccaaaccagcaauuccuccaguugccuccuccacagacaugcuccauagcaagcucucacagcuccgggagucccgggaacagcaccagcacucagaccuggauuccaaccagacccacucugcaggaaccaugaccuccuccuccuccacaacuaacauugaugacuugaaaaagagacuggagagaauaaagagcagucgcaaaugaagcugcccacccucggcacucugcagcuuuaguuacugaucuagaagcccuguagugugaagcggccgcugcaggccauuguacacaaacugguuguauguaucagacugcagaugggaggagcaguggugccucaagucugcacaugcucugcuucuagaagacugacuguggauuagcuuaguguacagacuuuaaacagcugcucccucagcucagaguagguuccauauccuuuuuuuuuguuuuguuuuaauggcucauuuguaaaauuguccuaauuuuuccuagcuuucagccauuagaaacucuuuuaauaguuccuuuugaguugugagcucuucuucuguagcccugaagggacacuguauucuguaugaaugcauggcaugagacaacuaauuuaagagacuuuuauaaauaaaguuugcauuaacuauacccauuucccaaaau

SEQ ID NO: 918 - RNA, 11142 nt, Mus musculus
cgguucaauauuaacccagagagagucaggacaaucccucagaucccaggagcugacacacuaugucgcacguccgcggccugggccucccuggcugcuuggcucuggcugcccugguuagccugguacacagccagcaugguaaggggcacuuggaggccucgggcaggauagaggaugugggaaaggccugagggaugggguuuccugccuaagaacacagaauacagggacaguccccaggugguccucagaccagaguguccagcuuugagaaggagucauguguguggugcagguaggagggcaucaguucugucuucuagaacgggggagugggcuagggcaaccaaugaaaggcagaugacucaaacuauguucaguggcuuucugggugcuuuccccauccccuauguucccccuuggaagcuagcagggcagccagcuuccuaccccuaaugguuaagcuagccaggcuuccugaggcgacuucccaugccccugcccccugcugcaguguuccuggcgccucagcaagcacuaucgcugcuccagcggguccgcagagccaacaguggcuuccuggaggagcuccgaaagggcaaccuagagcgugagugcguggaagagcagugcagcuaugaggaggccuuugaggcccuggagucuccccaagacacagugaguccugcaacacucaaugcuaggagacagggcagguaggcaaggaacaggccuggguucccucugcaggggaucgcuggaccaagcaggaaacauccgggcucuuccccuuuucagacuuucacuucuauucggacucuugucuccuugagcugcaagaugggcacccaaaaucugucuuggggacuuguaggcccgggcugucacagugaggcucgcgacaugaggggagcuccucagcuucagcagccagcuauacugcggcucgggguuaucugguguuuugcuuaagccuuuccgccauuuuuguguucccuguuguguaccacuggcccuggggcucuguugcagcccauucccuuccgggggaccgagagggaugcacuuuugucuccuccagucaagggugcggggcucucuccccccacccccauauuuucucccuuuggaagccaaaguaggagacucaaacugggcucaggugguaagggaaggauaaggugguaagggaaggauaaugcuacuaaccgaguagaacuccauccugccguagucucacccccagcccuugcuuuguaggacguguucugggccaaguacacaggugaguggccagaaagguuugcccaaggaaggguggcugggggcgcuccacuagagaauguccucucccucagaccuuguugcuguugcauaaagcacuccuggcacccgcucugcccugcccccaucccaucuguuacccugccuuuaucuuuaucuugucaccuguucccaccccguccccacagcgauaccaaacguauuucugcuuucuguuuuuagugugugauucagugaggaaaccucgagagacuuucauggacugucuggaagguggggcacagacucuguguggguggguggguggguggugcggaagccugcaagaaaggaaucacagaguggucagcagccauggcucaagugguaucuccagugccugauggucccucuuuguccuuggucaaggaugucuuugcauguggccuuguggcuggcacuuagacuguuggaggaaugaauggauaguuaaucucagggucuggcucucagggcccaauggcacuucuguucagagcucucugucuuauuaauucauucuccaaaauguuuuuguuuuguuuucaagacaaggacuccuacagccuaggauggcuuugaacuugcuaggugcugaggaggaaucugaacuccugauccucccauuuccaccuucccagggcugggaguccaggcacgugccuccauggcagcugucauccuccaaaccuucuuuuuuguuuuguuuuuuguuuuuuucgagacaggguuucucuguguagcccuggcuguccuggaacucacuuuguagaccaggcuggccucgaacucagaaauccgccagccucugccucccaagugcugggauuaaaggcaugcgccacuacugccuggccagacuggguuuuucuguucagccuugguugucuuguagcuugcuguauagaccaggcuagccuggaacucccagagcucaaccugucucugccuccugaaugcugggacuaaaggcgcacaucaccacgccuauacuugucuuuuuauuguaauaggaguggguguuugccugcauguacaucuuauaccacuuaugugucuagaacuacaguggccagaaaagggcauuagauuccauggcacugaacuuagagacauugugagcugccaugugggugcugggaaucaaacucugguucucuggaaaagcagccagugcucguaacugcugagccaucucuccugccuucauacuuuaauuacuuacucaaaagauauuacacuaagccuuccgugugugccaggcacuguguuggugucgggggcuggggauuucuuuuuguagacaggguccaagugaggaugagcuggccuugaacucuccuuaaaccucuguuugcugagagccugaguuacaggaggugacgauaccaaacaggugcugggggaauugagagcauggaaaaguuguggguuuuaaagaacucacaacuuuuggguaacagaaacaccacagggauuccuggaaaggccaggcgagagcagaaagagcagcuggcuugucggcagaaucagagauggcuucccagaaguucuguuuaccuggccuugugggaugagcuagugaacaaaucugagagaauuccaagcguggaaacugugugcaaaggcccuaagauaacaagggcgggagaucagguuggauuacaauugugccugucaccgaguugucacguggcuguuguggaguggacggaacagcugcaaaggagugaaaggugucccgguuauggaugguggacuacagagagccuggggccagugggaagacaaaauguuaauagaagauugggggacaucucuggggucugauguagacucaggugugugucucuguaggucgcugugcuauggaucugggugugaacuaccuugggacugugaaugucacccauaccgguauccagugccagcuguggcggagccgcuacccccacaagccugagugagugcuuugcaggccaggaugggaagcaaggacacacucgggaggcacagguccccgagcauccuucucuuacagaaucaacuccaccacccauccuggggcagaccugaaggagaacuucugccgcaauccagacagcaguaccacgggacccuggugcuacaccacagauccuacugugcgcagagaggaaugcagugucccugucuguggugagcuggggccaggaagcaggucauggccauggccaaggggucuucagaaggcuugauaauauugagugggcaucacaaugcuggccaccuucagagcaagaggaaggaguuacaaacugaaggggcaguuggccaggacauuugggaggccuggguagacugccugucaccuccuuuucucccucccagucuugggucccucaugcuucaggcuguggcucguuucaaacaacuuuuguguguguguccugccaaggugcucuccuccaggacauucuccuagaucacuucagccacaugucuuucccaaacaccacagaguuaagcaucuaaggcuguguucugguugacuguugugaucaauucccaugguuaccuccuuguagccacaguaaugcugcaaaacaaacauccauaccugaagggcaugccacagcaaggguuucuuucuuacaccacugaggcguggcucgaggaugcucucagcugcacuccccagcgugcgugugugugugugugugugugugugugugugugugugugugugucugggauggggagacaguggcccagccaggauugcugggccugcauggguggcugugcgaugaaggguggaugcagcugaaccuggugauugcuuguucugcuuguaucacgcuggggcugagcaguucccugagggagucccuccauuccuccaugacagcagaggaauguagaacagaagugcucuuugaaggccugugcucagagcugacagucaguguugcuugugcuccauugguagaacgagccaucugaccaaggccaaagucaagaagugaaauauugucugcuacaaaaccacaaguaaaggauaugaauauaagcgaugaauucauaccaggggcuggagaugucguuuagugguagagaguuuggcuacaaugcacaggguccuagguucaacuccccccgaccccacauacccuccacaagcaggcccauucgguaugaugccaacucauggagaugcugaggcaggaagagcaaaaguucaaggccuggguugaagacuuggcucagcaguugagaguaucugcuucccuugcagaggcaauaacucaggucuuagcauccaugucagguggcucacagcuccuuauaacuucaacuccaggggaucuaauggucuuuugacaagcaucuacacacacaccacaaauacacauaucuguagcauaagagacaugaauaaaaaugaaaacaaaauuuuuguuuuaaaguucaaggccagccucggcagcuuacugagaacgugucucaaaauaaacagaaaaaagaggcccaggggcuguaaguuaaugguagagaaugccuggucccuagcugcagguucagagccgguucuuugucagcuaugcuccaccugagacagcccuuaaagcaaaucaccagugaucuguaaaacaaagcaaacaagcaaacaaacaacacccccccacacacaccagcugcuuagcuagacugccucuguccguguuugugggacgcugaaacugaccugcaagcuugcacccugguccacacagaccuuccuagcagacccgacagccuuucuacuguguccaauuaaaacuugagauccgagccaggugguggcggugcacaccuucaaucucagcaccugccaagcugaggcagguggagcucagggagucccaggacagccugaucuacagagugaguucuggcacagccaaugcuacagagaaaccuugucucgaaaccaaccaaacaaaaagcgcccccccccccaaaaaaaacaacuuuaaaaaaacaaaacccuaaaaagcaacaaaguuuuacacaaauugacuccaggcagacccuaccaacagacugaagauagucuaagcgcccaagggguccugcugcuugacucacucugcaccagauauuucugcuguguauauuucauucuuccaucaacuauuagguaagacuggcacgcgcacucuguuugaagggagguugcugaggcuaggagugcuuaggcugccugaagucacacgggagugauccaccaggacagggauucaaaucucccucgggucuacguguaguuccccccaacuuugccuucuguauccuucuucaccaggccaggagggccguaccacuguggugaugacuccucgcucuggagguuccaaggacaaucugucaccuccacugggacagugccucacugagcguggccgacuauaccaggggaauuuggcugugacaacacuugggucccccugccugcccuggaacagcuuaccagccaagacccugagcaaguaccaagacuucgaccccgaggugaaacucguggaaaacuucugccgcaacccagacugggaugaggagggcgcauggugcuauguugcggggcagccuggcgacuuugaauacugcaaccucaacuacugcggugagcggagcucauagagcagggcaggggcaaggauugaaaacaaguggguucauuacagccuuacagaaaccuggcuagggguagguccuauucuuguuucauagaugaguagacggaggcccugagaaauuguuggcuggcaggugugccuagacucuuaaccucggagucaaacgcccuccaaugccccuggggucuugggaaggucugaggucccagccacugccgggucucuacagaggaggcggugggagaggagaacuaugauguggacgaguccaucgcgggacgcaccaccgaugcggaguuccacaccuucuucaaugagaagaccuucggccuuggggaggcaggugagacacucgcgucucagugggacacgaggcuggaggccaggaugggccccucaccgucugucuugcucugcagacuguggccugcggccuuuguucgagaagaagucguugaaagacacaaccgaaaaggagcuucuugacucuuacauagacgggcgcaucguggagggcugggacgcugagaaggguaucgcccccuggugcguccuggacugaucuacaggccugccccacccacggccgcugcaggaccuggcuccacagaugacgcuagcacccacucucuaauuucccccagagcuaccucagccagcuuugccaugucugccgaguaauugucagagaugaggccaagcgagcuuacgugacucauccucaggcacgcugcauagucaggacuguauccaauucugaucuagagcugugcuaaacuauacggucuacccugauagagcucuggucuucuacggcagccaaaucaauccgagauuugagcccuggaggcaacccugucccacuaucugucuuucuuccuuuucuuccuuccuuccuuccuuucuuccuuccuuccuuccuuccuuucuuucuuucuuucuuucuuucuuucuuucuuucuuucuuucuuucaucuuuacuuuuggggcgaggggaggucuuauauagcagaggcuuacuucgaacuucugaugcuccugcuuccacaucccaagugcaaggauuacaggcuugcgacaccauccuagcccaguacucuucaucuaagagccuuucccauuuccaaggcuguuaggggcugggcuccagcuccuaaugcacucugcuucccguuaggcaggugaugcuuuuucggaagaguccccaagagcugcuguguggggccagccuuaucagugaccgauggguccucacugcugcccacugcauucuguacccacccugggacaagaacuucacugagaaugaccuccuggugcgcauuggcaagcauucccgaaccagguaugaagcaaaugccugcuggugauuggcuggguucugagugcucaucgggggcucuggaggcucugggguacaugggacccacaaguaugagcuuucagcauccucacugggcaagcccguauggccaggcccuggcccacuccagacaggagaacaugguccagguggaagucucuuuaaauugugacuauuggagcaguacauguagcaugugccuaucucugugggcccacaugacucagaagacugugugugaccgugcucaguuagcugaggaucucaugagugguucuucucuguuggggucugcacagauaugagcggaauguugaaaagaucuccaugcuggaaaagaucuacguccaccccagauauaacuggcgggagaaccuagaccgcgauaucgcucugcucaagcuaaagaaaccuguacccuucagugacuauauucaccccguguguuugccagacaagcagacaguaaccaggucagcacuagggucucaguugugauuuggccugggcucugaaccuuggggccugacaaucauuugcaggguucaguuccaugguauaaaugcaaaagucauuuucuagaaggcugucagggacaauucucaucagguccuucucucucccuaaagcuugcuccgggcugguuauaaagggcgggugacaggcuggggcaaccuucgggagacauggacaaccaacaucaaugagauacagcccagcguccugcagguggugaaccugcccauuguagagcggccagugugcaaggccuccacccggauucgaauuacugacaacauguucugugcugguaaggcuuucugucuugggcuagggaaacagcugggauggggguuagcaggcaugugguacaggcacaagcccgggcacuuacaagucagaagaccccagguaaguggcugaagcuuuucugaagguaaaaagaacauaaaaguuuucaugguguugagaucugaggugugugugugugugugugugugugugugugugugagagagagagagagagagagagagagagagagagagagagagagagagagagcaagugagagagcaagugagagagagagagagagagaguuuugccagugaucauuaauaucugcucaacgaaucuagcccagcagaaguccuggguacagaaagaacauucauuuagccacuuagcauacauuucuugaaugccuauuguguccuagacagcacuuggagggguacucagcaggaacucaaauaggugguccugagaaagcugccuuccuagaggggggcuaugccaauaaacauaucuagaaugcauguccuugauaacagcucugaggagagagcagagugagggagacuguaagggacgagucaacuaaagccaguggucagaggggcuggcaucggccuuuucucaagcagguuaggcagagaugggaggaagaggaugaggaaucagacacagagggagggucgaaacccggcuuugggaacagauguaggugcagggaugcugaggugggcaaacacuugguugaccugaggaacagcagggaggccugugggcuugaagagcaguaaacucagugaucccacggggaaugaggugagagaagagggccagguguagugguaacaucuguaacaucagcacacagggaguggaggcaggagcaucauguggaacuagaggcucaucuggguuaccguagaucucuccgaaggcagaggcaagggggacucucuuaagcuacagggcagucagaacucaaggaccuuuggaagaacagucagugcucuuaaccacugagccaucucaccagcccaaaucccaacuuuauuauuacugugguguugcagauuaaauagagggccuugaacuaggcaacugcucuaacacuaaacuauaucucaaucccaacuaagucuuaagauuuuggauuucagggucccuuuguaguuuaguauguuaauaauuaauugugaugaagacugugauuguauggaguuuauuuuuaguaacucauuauuuuguaauuauuguuucauuugucaucuuauuuucccuguguuauguuuguuuuuaaaaguuauguauuuaggagagugugcaucuugcucuaguguuuaucuuuccuuugggcuuaugcuacucaagaugccaauccuuccuuccuacuucccucccucccuuucuuccucccucccucccucccucuuucccuguauuguguggauuuuuuuuuaaagacauggucucguguaaccuaggcuugaaucuacuaugucguugauagccuuuuugguuuuuucgaggcaggguuucucuguguagcccuggcuggccuugaacucagaaauccgccugucucugccucccaagugcugggauuaaaggcgugcgccaccacugcccggcuuguagcugauaaccuugaacuuaugaugcuucugccuuucccaaucaauccucauccagggcugggauuacaggcacgugccaucaugcccaguuuaugcaguuugugagguacuggggauccgaauggcuucaugcacgcuaggcaagcacucuaccaauguacaguacaggcuggucuuggaauguuaacagugucaccucagccuccugguuacaggugccccgcacacccauacugaaccuuuaacuccuuagaccuuucacuuucucccacuuccuggucauuuaauuuagaucuuuugggacaaucuuauggaccccaggcuagccucaagcucaccaugugacuggggaugaucuuaaaugaauccuccugacuccaaccuuuaaauugucgauuuuuacaagcacauaccaugacauccaauuuuuaaaauuuacuuuucauuuuuggauuugggagucaagcuuuuuucugaauguaccaguugcuugaagauauuucagauaguuuuguaguugauugaaggugucuuacuaaggucuuuuuuucuuguuucuuccuauugucugguuaguuuccaugugucuggguaggaguguuucuacugauuugccuuguucuguugaaagauauguuucugacuucauucuauauguauuuuagauuauauguacauuuuaguucacuaaauugagguuuggguguuccuggagucuauuuauuugaaggugugguuugggguacaagagaaggcugugacuuggccagaguggaaagggcaagaaggggcuggaguuggggcaucuugacagguaaaggugacaagcuugcuaaaggacuagauacauaaggugaggaaaugaggucaugugacuggcuguagcuccuuaaacgaagugacuucugaacuccuguucuuucucaaggcuucaaggugaaugacaccaagcgaggagaugcuugugaaggugacaguggaggaccuuuugucaugaagguaugcuucuuuaaaggccagggguugguggauaaucuuccaaagucagagaagguugggggccaggaauuuguuuucagaaacagcacuuggaccugacuauuggaaaccccacuuuucuuccucagagccccuuuaacaaccgcugguaucaaauggguauugucucauggggugaaggaugugaccggaaggggaaauacggcuucuacacgcauguguuccgucugaaaagguggauacagaaagucauugaucaauuuggauagguguguggguggguaaaggaccuacacuauggaauccucauugcaaaaucacagaaaccaaucaaauuacuuuugugguuuguuucuguucucaauaaaagugauugucaguagau

SEQ ID NO: 919 - RNA, 188718 nt, Mus musculus
cuuccuuugaugucugggcguucguguguucgaugaucuuuugcggcgucuucuugguugaugucuccggagcggcggcggcugugccagguccuggacugaguuaucccggaggccccgggcucuggccgcuuucuuccgcuggucggucgagcggaccccucgcuuucuucggccucuccccgccuuccguccguggcuccgugcgcucgcuggcuuucgggccgagcucucacucuccucgcagguaggcccgggaggagccugggaggcccggucccgcauccuuccgcccaaggcaggaggagaccuuagcgccggccggugggcgagcgcgcggcccgccggggugcgcguugugaaggggguugcgcccgggggcgcggccggagggcggcccggaacugagcgagaagccggaaggagggagagaugcugaagcugccggccggguuccguagagaggggaugucggguccuggacgcgugucgucaccccuagauuguaggaacuuggcuuucuuagacccuauucccuuucuccuuuccuacaacuccgguuccggaugucaugcucaguugcacuggggaccccuacugaguucagccucggagugcccuuuugaguagguggaggcuauugaaacuaggcccuccagcuccuaggaacgaaauaucacuuauagucuuuugggguagggaaaccgaggcugagguaggggacgugacuuuucccugugaccucgacagaucauuaaaugugcuguaagguucuuuuuuuuuuuuuuuuuuuuuuuuuuuugucuuuaacaguucacaauucucccauuuuacuggucacuuuuuacuuaacagucucucauuugacuuuuuggaacucuucuuucuuagaaacauauauuguguuacuggaggcuucagacauuaagggagcaagugauguuuuugacuggguuugcuuuuucgaaguuuguaucguuuuagcaaaaguaguaaggauaguuuaguuuuguuuacucauaaauaauuuguuuacuuccacuuuacuucugauuaauacugauuccacucuucagcuuguucugaaacuuucugcuaugguguuaaguacuuagugcaagauggaagaugcuuaagaugguuaagacuuugaauucagguucuugucuuguggaggucuuuucuaggagggaauccaaggaaucucuuuugaaacuuuuuuuuauuugguuagugauuuagucauuuuauucaagaguucaaaagucuguguagaaauuauucaaacauaauugaagaugaaucauuugugaacuuuacuguuucucucuuuuuuuuuuaaagauuuauuuauuauauguaaguauacuguagcugucuucaggcacaccagaagagggugucagaucucauuacuggugguugugagccaccaugugguugcugggauuugaacucaggaccuuuguaagagcagucagugcucuuacccgcugacccaucucgccagcccucucuuuucuuuuucaaggccuuaaggucuaaguguuuuuguuaauuucauuuaaucaaaugucuugauccuaaaaaaaagucuuggagguuguuugauguuggguaaguuuccacacuauauagaagucauaggagaguugauuuuaaggguguauagauugugaaaaucaguuucugcacaguuuuaagaugcuucaggccgggcgugguggcgcacgccuguaaucccagcacuugggaggcagaggcaggcggauuucugaguucaaggccagccuggucuacaaagugaguuccaggacagccagggauauacagagaaacccugucucgaaaaaaaaaagaaaaaaagaaaaaagaugcuucaggaacuuuagaaagaugauagaauuuuacauuguuucucuaauuuuuccuuuaauguauguguaaggucagugagguuuauuauuauuucucgccuuuagaagugcugggaauuuugaacccaaggucacacgcacgugcucuuccacagagcuacaucccuaccccugagaucaguaauacuuaaaugaaggugauugauggaaugauugauugugugucugugugucugucugcacaugggcaugccaugcaugcauauggaugucagaggacaauuuccaggagucauuucucucuggcacacgguucccaagugaauucaggucaucuggcuugauaguaaucugagccauuuuguuuuuuuuuuuuuguuugguuuuuguuuuuuuuuagacaggguuucucugaguagcccuggcuguccuggaacucacucuguagaccaggcuggccucgaacucagaaauccaccugccucugccucccaagugcugggauuaaagguguaagccaccacugccuggcuacuugauucauuuuuguaugcuuuuuuuuguuuguguguugcuguuuuugaggcaggaucccuuauauuccaggcuagcuucauugacugugcagcugaggacggccugagcucuuugauccuccugccuccaccucaguuacuggauuaccagugugaaccacugcuugacaauuacugaagucaauuugggcuguuuccugggauuucagaaauguucacauuaugacugaguuauucuguauuuucauaagaugguucuuguggauaauuaagagauauaagcugccugguguuggugguucacaccuuuaauuccugcacuugggaggcagaggcaggcggauuucugaguucgaggcugagaaacccucucagaaaaaaaaaaagaaagaaagaaagaaagaaagaaagaaagaaaaaaagagauauaagcuucaaauagcuguggcaguacauacuuuaaauuccaacacuccagagagacugaggcaggaagauuguaaguucuaggucagccugaguuaacauccugagacuuccucaagaaacaacaacagaaaccaacaacagagacaagaaagacgaaagcuucugaauguguucuggaauguggccuggaccagaguuacugaaauaaacugcuuucuuuuuuuuaacuaaaagagaaaaugcuuuuucuuuuuuaauguuuuuuuuuuuuuaaagacuuuucauuuauuauuauaguaaguacacuguagcuauccucagacacaccagaagagggagucagagcccgcuacagaugguugugagccaccauguggucgcugggacccgaacucuggaccuuuggaagagcagucgggugcucccacccacugagccaucucaccagccccccuuuuuuaauguuuauuuauuuuaugugcauugguguuuuaccugcauuuaugacugugucaguguuagauucccugaaacuggaguugcagacaguugugagaauugaacaaccagguccucuggaagagcagcuaguacucuuaaccacucagccauuucuccagcccugaaaaccuuaugugguuuuuuuuuuuuuuuuuuuuuuugguuuuucgagacaguuucucuguguagcccuggcuguccuggaacucacucuguagaucuguagaccaggcuggccccaaacucagaaauucaccugccucugccucccaagugcugggauuaaaggcaugcgucaccaugccuggcaaccuuuuuuuuuuuuuuuuuuuuuuuuuuuuuuuuaaagauuuauuuauuuauuuaugugaguacuccaucgcuguuuucaggcacaccagaagacggcaucggaucccauuacagaugguugugagccaccaugugguugcugggaauugaacucaggaccucuggaagagcagucucagugcucuuaaccacugagccaucucuccagcccccaaccuuauguuuuuauacuguauaauuuguaauauauuuucagugugugugagggaaauuauaggccuuuuauucuuuuggugauccuuuuuaucuugcuuuauugaugcugaaucuaaauuuuuauggacuucauucaguaucauuaugaauggauaguuuaacucaauuuauuuccuccucaucuaucuuacuuuuaaauaaauuaggaaaaaagccuugcuguugagugcugaugguguaggccguuaaucucagcauuugggaggcagaggcuggcagaucugaguuugagaccagucuagucuaaagagugaguuccaggacagcuaaggcuacacacagaaacccuugcuccaaaaaccaaaacaaaguuaaagugguguuaacauaucaacauaucaaggucuuucaaaaaagauaggucucagucuuuuuuuuuuuuuuuuuuaaagauuuuauuuauugauuauauguaaguacacuguagcugucuucagacacuccagaagagggagucagaucuuguuacggaugguugugagccaccaugugguugcugggauuugaacuccugaccuuuggaagagcagucgggugcucugacccacugagccaucucaccagcccaggucucagucuugaaagaguuauuuuggagugggcuauaaauauuuuguccuguggaguagcauacaaaaacaaggaaaccugcucaaaaguacaacaaacugaagugccuuuagucaugguaauccuuguuucuuucuccauuccucauaagcucauggcugugcguuucuuguuauggucacugcuuguccaggagugugcccuacaacagccugccccuaugcguuggguaacuuacaguuuuccuguuuuguuguuuuguuuauuuugggguuguaauuuacauauauuuuuucuuuuuuaggcuuucgaucacagguugagcuucauuuuuuuccuuuuccuuuuugugauugagcuagcccaggaugugauugagcuagcccuggaugugauugagcuagcccaggaugagcuucccacaguacacagaguagugguggcucaguggaggacuucuugcuuuuccaguguggcuggagaaaugcacauuugaacuggauguugccuccguccuugguuuaggcauuacuccuucauggagucccugucucaaucuguaccagugaacaaauguaaaccaugaauuugucuuucuuuaaaaaauaaaauaaaaauuuaaaaaaaguguucagguguuacuucugugcuauccuagagcagugaucuuagauguccuucagguuaguagucugucuuucuuucaaggcagccuuguggaagucacugaggauaggauagagaugagcaaacacaggcucaggacgagcuacugcguguagagcauuggugauucagugcugaauuucucgccuucccagagugcauauaggaaggcguauguauuuggaacugcuggugaaagguuuggaggcugcucacuuggggaccuucccuccccuuguaguuagucuuguguuuauacguaaggguuaacugcucccuuacuuguccucugucucuuuugcucuuagaacugaucagcuauuucucuagguaaacuuuuguuuuugcauuugagucuacacuauccuugaauuccugauucucuuaucucugccuuccuaguacuggaauuauaagcaugaacgaacacaccuggccucuguaaugcugaucagggcuuugugcuugcuaggcaagaucucuguacgcugagcuacaucccagcccacaucaagcuauuuuuugguugugacuuuucuuucagccaccuuuaagacuuuucuauuuuccacaaguauaaagcucauuagauauauuaggucaaugauacagaagcugauaggaguguuccuacccuugugaaguuuauuccaguggaaaguauaguuggaaaggaaucuggcaagggugggaauuuaggccgaaacaguacucuguggaaaacagaucaauaaagaggagugagguagguaggugugucccuuucauggcaucugucucacuaaacaacugcaguaaugacauaauucuguaaguucuuuucuugccaucacaaugaaaaaaaguguccggucuuacuguuuuccaaguugaacugauccuaucucagccucucaagugcuaggauuauaagcugccccaccaugccugguguacuggcugguugugugugucaacuugacacaaguuggaguuaucacagagaaaggcaccucucuugagaaaaugcuuccaugagauccagcuguaaggcauuuucucaauuagugauaaaagggugggagggcucagaccguuguggguggugccaucccugugcugguagucuugguucaauaagagagcaggcugagcaagccaggggagcaagccaguaaguaauaucccuccguggccacugcucagcuccugccucuugaccugcuugaguuccaguccugacuuccuuuggugaugaacagcagugaggaaguguaagcugaauaaacccuuuccucuccaacuugcuucuuggucaugauguuugugcaggaauagaaacccucacuaagauaccuggcuacaauagaaacuuucaguuaagauugauauauauacuauuugucugauacacuggguuugacauugggaugcuugacugacuuuagcuuuuuuacuuauagugucuugaauuuaauuuguuuucauuaguuuucuuuucuaauuacauauucuuuuuuuuuuuuuuuaagauuuauuuauuauauguaaguacacuguagcugucuucagacacuccagaagagggugucagaucucguuaaggaugguugugagccaccaugugguugcugggauuugaacucaggaccuuuguaagagcagucagugcucuuacccacugagccaucucuccagcucacaaaguauuuuuuucccccaaaacaggguuucucuguauagcccuggcuguccuggaacucacuuuguagaccaggcuggcccgaacucagaaaucugccugccucugccucccaagugcugggguuaaaggcgugcgccaccaagccuggccuaauuacguauucuuuagagguugaauuuacugaauuugagugcagaauacuugccuguaagugcauuuguaccaaagaauaaguugaaccauguagucagucuuaaguuagauuuaguagacuuaggacaaugagagaaggagaacuuaggcuauuguugaauguguauaaaauaauaccaugaucuuguuugaguucuuucugccaaaaaauuagaaacauuugcaaagauuguuuuuacuguugcuuauugaaauugguuucucuuuucaagacacaaaagucacuuuuugugacuuguuuauucugccuugcuggauaaagugugugugcucccuggcugcagggcacauggauguuugagaagcagacuggagauuuucagucuaauugaccagggaaaagucacuugccaguagcagauauagugguucaugacuaugaucccagcacuuagacaguggaggcaggaggaucagaaguucaagguuguccuuggcuucauaagcaaguucuaggcuggccuaggcaacaugagguucuuucuguucuaucaaaagaaagcauaucucuuccaaacuuuuuccccuucccugagucauggucugcuguguagcccagacaaacuuugaacaugugaucuuccagcuuagacucccauguaccaccacaucuagcccaaacuuuuaguagcugauacugcuucaguaacuagguagccugguuauaaauccuagaaccagugcuuacuagcucucaaggcaaguuacuuaacaaacuuccaguuucuucaucuguuaaaauacagaguugugagaaauuacuuauucuguagaauacuuccaauaauuugauaugugcuagugguuaucauuauuaguacaaucaauuaaaguuuauauguguucuucaaaagaagaacaaauaggcuagacaugguggugaaugcauuuaauccugugccuaaaaggcagaggugggucccugugaguuuaguucagccaggguugaacuccauacugaaguucagguuagccagggcugcauaauaagauacuaucagaagaagaggaacaagagcagcagcagcagcagcagcagcagcaggaggaggaggagaaggaaauacuagugaugcuuaguuugaagucuuggagcuuuugaggaaacuuccaacagggaacagggagguacaacugaaucugcugcuacuuucccccaguccccuucaauuaaccaaagggugagccuuuacuggaugagggaagccuagaaaguaacaguaucagaaacacaguucuaaaauaagaaagaugucaauuuuuugugagacauuguagcaaaacaggccagggcuauuuuagaauagaacauccagguagaaaacauuuaagcaagcauuugaauuuugcuauuugaacuaauucaagcugaagaauuuagaagaaggugauuaaaugagugaaaaaauaauauuuaggggauguuaccuaugaaaucaacacagauaaacuggaauaaugaauggauuuguuauauaaugguaagaacuaagaauccuguuaguacaguuaguuuucuauuaauuuugccucuuacgacgcuguuguaaauuguugguuacuuaagucauuuuuaguuuaagucuguuuaauaaucccacucuuagucauuaaaaaaacucuaagauuacgacaguauuauuuauuuuuuguguuuuuuugagacaggguuucucuguguagcccaggcuauccugaaacucucucugaccagguuagccuugaacucauagaggccugccuuugacuuccaagugcuaguauuaaaggcaugugccuggauuuuuuuccauuuuuuaaauuuauguauuauauauaaauggacauuugucugcauguaugucuucacaccaccaccaaccaaaaacggugugagaucucauaggacuauaguaauagaugguuguaagcugucauugggaauugaccucaggcccucuggaagagcagcagugcugcuacgccaucucuccagccccaacauaggccuggcuuuuguuugauuuguuuuggagacaggguuucucuguguagcacuggcugaccuggaguucacuuuguagaucaugcugaccuugaauucagauuagccugccucugccuccuuguugcuggauuaaaaaagcauguguuaccacuccuagcuuugcuuuuuuuuuuuuuuuuucuggauacauggggucuggccguaucuugucuagguuugaccaaacuccuagacucaagugguuuuuuuggcuuuggcuucagaccacagguguacacugccaagaccugcuuuugagugaaugccauaaccuaauaauaauauaauacaugcuuuuaaaaacauuaugccagcuuccaugugaggugugguuuggaaagaaagaaaugaaggaagcauaguugggaagcaaguuaguagccuaggcaaaagcuaaugauaguuuaaauuaggcuguaggcaguagagauggagggaaguagacagauucagaacauauuuuagaaucaggacaaacaagaccuaauguuggacugaauguaauguguaggaggagggaggugucaaguaugagccuagguuuccccugugagcaucuggguagaugaaggugcuacauuucagaugggaacagggggaagaguugguuuugaugaauugaggaguagaaugaaggcuuuguuucugucacaccaagcaugagaugcuggugaagcgcacauggaaacauugagaaaccaauccucaggcugaggcagaaagcugcuggagguaaaucuggauggacuugcuguguaaaggauauuuauaaccuaggaaauggaugggcucaccuagagaaaagagaggggaacucaggauugaguccuaaggaaucuaaagaaaccuaagagucuguaauuguggacacaaagcaaaccaugucaagaaagacagacucagccauguucuguugaauuucacagcaguucauugauggguagcaggaacaaugguggaggacugcagggucaggagccagauggaaauggguuaaaggaauggggagagagcaaguggagaugguuuucauuuuuugauuguagucaguuuucccauaaaaaagcaaugcugauuucauuuuucuguucuuuuuguuuguuuguuuguuuguuuuuugauacaggguuucucuguauagcccuggcuguccuggaacucacucuguagacuaggcuggccucgaacucagaaauccgccugccucugccucccaagugcugggauuaaaaguaugugccaccacugcccggcguuuuuuuuuuuuuuuuuuaagauuuauuuauuuuauuuuaugcaugaauauacuaccauugcugucuucagacacaccagaagagggcaccagaccccauugcauaggguugugagccaucaugugguugcugggaguugaacucaggaccucuugaagagcaguuagugcucuuaaucgcugagccaucucuccagccccugcuuuuguuuuuccuucuuuguuucuccuuuucucucucugucucucucugcuuugccauugugccauugugccuggcuuuuaguucuccuaacacuuucuuuuuaacuuauugacuuaauuuuugcuuguuuguuugucuguguuccugguacccaugggugccagaagaagauugugagcugucaugugggugcugggaauugaauccaggccuuuuggaagagcauagauagcacucuaucugcuaaaccaucuuuccagcccccaaauuuuuauuuuuaaaucagagaucaaaacuaacaccuguagcuuccguagagcauguguaguuugagaguuggguaugccuaaauugagacuucaaaucaaugucuguaagauuuuuuaaagacguuauagacagucuaauguagcucagguuagccuuggauucucuguauaggaugaccuugaauuuuccugccacuacucccaucuuaacuggaaucuuccccccgccccuucuucuucuuuuuuuuuccgagacaggguuucucuguguagcucuggcuguccuggaacucacuuuguagaccaggcuggccuugaacucagaaauccgccugccucugccuccugagugcugggauuaaaggcaugugccaccacgcccagcaccggcuggaaucuuuugauaauauugcuuuuugaggaaauagguucuucuagcauucugguuuuaauuauuuugcauuuuacugaugggauaauuagaguacaacaucugugugguuuuaacuucccaucauccuuacagucagucagugauagaguuaagaauuuaagacucuuaaucauguucuuugucuaaggugaccuauauaaagccauauugcauuuacaagaagcuguacgaaauggaguuccuauauuaucucugaaaggauaucauucaagugguguuaagcagauguucuccuuccacagagaacaggacaagagggaauauaucuuaauuggugacagaagggauauggauugcuuguuagaacuuccugacaacaagaugcuggacaguuaccaagggugauugugaaauaucuucccuaaagauuuaauaacuaccuuuuugggaugauguagguacagacuuguuuugaaauaaaggagaugaugaagauggcauucucagaucucuaguaaccucacaacagagcuguuugauaauuaacuagaacaauaucuuugccauuuuaauaaguauauuuuaauuguucucgaaaagaaauaaucaauagugugugaacuaggggcuaugcggauggcucuguuggugagguaauugcagugcaugcaugaggaccugaguucagauucucagugcucaaguaaaagcuagaugugcuggcuugugccugucaucucaguuuugggguggguuggggaguggggagacuggaggauuccuggagcaugcuggcuagccaaugaagccaaauugggacacucuagguuuugugagagaccuuaucucaaaaacuaaaaagaggguguuagagcaauggcucagugcuuaagaguacuuagugcucuugcagaggaccugaguuuugcucucagaaccuacauguagcucacagccacuuguaacuccaguuccaggguaucugaugcccuucuguggccuccuuagccacugggcacauacauacagguaaaacacucauaaaaaccaagucuuuaaaaagccagaaugaagaguuauuaggaagacaccugacauuggccuucacaugggcaugcaccuugagcaaccccacagaagagaguaggugagugggccaggggugguuggacauguauaugauacaaacauguggggcauggaggcuggaggaucagauacuaaaggccaguccugccuaagugguauguuggaggcuagccuggguuauaugagacccugucuuaagaaaaagaaaggaaaagaguacauagaaucaauuugucaagccugguaaaauauaguauugauguucugaauauuucuccuauaucuuugaugaaccaugaacacucauccuugccuugaaauuuuucuuuuuauacuuauuaauuggggugaaguaugcacgaaugcuaugguaaacuuguggaggucagaggacuacuuucagaagucaguuauucuaucauguagacucugggcuuggaacucaggugcucagguuugguggcagaugcauuuacugauugagccaccuugcuugcuccuguguuccuuaucaaaggaggguuucugcuauguaugaaucaucauucuuccuaaacaucagagaucaaagccaccaccugcagcgucuauaaaguaugugauuugaguuuucucugucaaguguugugccaaucuuuuuuuuuuuuuuuuuuuuuuuuuugguuuuucaagacaggguuucucuguauagcccuggcuguccuggaacucacuuuguagaccaggcuggccucgaacucagaaauccgccugccucugccucccaagugcugggauuaaaggcgugcgccaccacgcccggcucguguugugccaaucuuguuuuacaggcuuaccugagauagacacucugguaaaauugauuaagagguuggugagauggcucagucaguaaagugucugcugagcaagcaugaggcccucuuucauauaaaagccaggugaagcuguguguaucugcaacccagggcuggagggacagagauccauggaugcuugaagcuuauuggccagccaguaagcucaguugaacaguucuguguucagugagacacugucucaaaaaaaaaaaaaaaaaauguagagaucaauggaggaagaagauaccuagaguuuaccucuggcacacccuugaacaguccccuccucucaauguauccacacacauauuaguuuagggcuugggaauguagaaugauagagugauucuuuagcuugcaugcaguccuagguuugaucccuaagcauuguauaaaccagacagauggcacaugccuauaaucauagcacucuagagauggaggcagggugaucaggaauucaaggccaaccugggcuauaugagacugucuggaaaaaaagaauagcacuugggaggcagaggcagguggaucacugaguuugaggccaggacagcagggcuacaccauugccagacguacagaaugacaacgugguuuuggagaaugagcuuccuucuuacgugagacuucagccuuguccgucugauugaggauggcaagugcagcauuucauauggcacuuugggaaucaagaaaggaaauguguagcuuuacggcauugaaacuucauauagaauuguaaccaggacaguuagaaagaagcugaugugagagauugucuuuuugcucuggugagaguagcaggaaucuucaaacuacaacacuuaguacuuccuuaagggaaguugcuauuguucaguauggcagcuaaaaguuuugguguacauaguugugaucccuucccuagacugaaaagccuuuguuuucaguucucuguucccugucaccugcaguaguguuuucuauguaaugugcagucuuccaaaauuaggauaaauggaaguaaguucagugaaagucagcauauaucuugucugucucuauaagacuauguauauagagaggcaugugccaaacaauauuuauuaaaaaucccuuuguugacaugugaucaaauagaaagaaggaucugagaaaggaagaaaacugauuuugcagcuuuaaacuucagcuucaacauuuguuggcuauuaaaacaaucucuaaccauauuuccuuuccugguccuggcuuuuggaaugaccacucugagaauaauuaguucuuauuaaaugccuaggccauaagcuuuggcucauucccugauuagcucuuauuuaaccauguaaaucuuuucuuuuuauuuuaaaauuuuuucauauuuccauuuauuuaaaaaacuauucuauaucuaccacuuggccaguuaccucucucucucuucaguuccagcccucuuccuucaucuaccuggcccgucuccuugguccaguucggcucuuccuugaaaucccccuuuuguccucucacuauuacccagaauucucucucuccugcccgugucccaccuccuauuuccugccugagcucauuggccaucccccuuuuauugacaggugaugcuucuaagagucucucuccaauuagcuguuugaccauaggcaaguaacuucacacugagacagucuguaaauuaggauugguuugggagcggacuuacagagaugucauaauauaaagcaccaacccuucuuuuuuuuuaaaguuauaaaacagggcuggccuggaacucaaaaaagauuccaaccgcuucugucucaugacugcugggaaucaaaagugcuaggauuaaaggcauguaccacagugcucaacacauuuuauuuauuuguuuauuuauuguuuguugagguaagguuucccuauguagucuuggcugaccugcaacucccuauguagaccaugcugaccuugaacucauaagagguucaccugccucugccuucugaggguugggauuaaaaauguccauaugccuaauauuguguuuagugggguuuuuauuuuuuuauuuuuuuaauuuuuuuuuguuuguuuuuuuuuguuuguuuuuuuuuuuuuuuuuuuuuuuuuuuuuccgagacaggguuucucuguguagcccuggcuguccuggaacucacucuguagaccaggcuggccucgaacucagaaaucugccugccucugccucacaagugcugggauuaaaagcaugagucacuuaguuuuuuaguugauuaauuaauuaauuaauuaauuuuauauagaugagugcuuugucuucauauguaccagaagaaggagucagaucucuuuauaaauggucacuagacaucaugugacugcugggacuugaacucaggaccucuggaggagcagccaguguucccaaccacugagccauuuuuuaaacccucaccuuaguuuuugagauauggacucucacugaaccuggagcucacugauucagguagacuggcuggccagcaagccugaaagguccuuuuguguucaaguuuuugugugaauauaauuuaauuuuuuugcaauaaauguccaguaauacaauuuuuggguuauaugauaucaggguuuuuuuuuguuuguuuguuuguuuguuuguuuuuugccucugccuccuccuccuuccucuuucuuguuguuguucacaggguuucucuauguagaccaagcuagccuugaacucagagaugugccggccuuugccucucaaaugcuaccaccacuaggcuaugguuuauauuuuuuaauuuaauaaaauuaaagcaaaagaaauauaguuucguuuuauauccuuucuugauauguauaacuuaaauuuuuuugagacaauguuuuuuugguagcucacguuggacucuauguagcuggggauaacuuugaaaacccaggccucuugucuccaccucuggagugcuggauuacgaguaugugccuccaucccuggcauucauaacuuacagggauuucugaugguuuguacagcaucacauugucacuggugaaauugcuguugccuagacuuugucuugcugaucugaugaucaguguauauauuacagauguuaauuaacuuccauacccauggguaaugguuaacuucuccaagauaaauuucuuuauauauaggugggggagguaugggugucaaguaauuugcuuaaaguuauauaguagaucacuauguacuaagauaaguucagacauguucuuccucccuguuucuaucuccuaggucagcucuuugauguuuugagacagggucucauacaguccaagauggccuuaagcuugguugagucaggaaguauggccuucagguuuugauccaucuguguucuccuuccaaaauuacagaaauaaauuccuauauuggguuuuaugagguacuggcaagacauuuuuccaacuagucccaggcuauuuugauuuuuguuuugagacauguugaaguccaggcugacuccacacucacagcaauccuccugcuucaaccucaguguugggauuagagaugagagcuaccagaucuuguuuuguuaacuucucugagucccauucuauacuucuauacuuucuuuuuuuucuugcuuucuuucaaacucucuuucccucccuccgucccuccgucccucccuccuccucccccuccucuuccuucuccuccucuuccucuuccuccuccuccuccuccucuucccccuccuccuccucuucuuccuccuccucuucuuccuccucuuccucuuccuccuccuccuccuccuccuccuccuccuccuccucuuccuccuccuccuucuucuucuucuucuucucucucucucucucucccucucucucucucucucucucucucucucucucaaucuucucuuguagucccggcugaccuuguauuucuaggcuaucuucuuguuucuaccuuucugggugcuuggauuagaggugugugccaucaugucuggcuaagguucaguuuucuuauuugacaaauggaaauaauaauaguaacuaucuuaauaguauuguugugggcuggagagauagcucaguggcuaagagcacuggcuguccuuccaaagguccuuaguucaguuuucagcaaccaccuggugguucacaaccaucuauagugggauuuaaugcacucuucuggugugucugaagacagagacagugucucacauaaaguauaauaaaugauucuuuagggcuggugagauggcucaguggguaagagcacccgacugcucuuccgaagguccagaguucaaaucccagcaaccacaugguggcucacaaccaucugcaacaagaucugacucccucuucuggagugucugaggacagcuacaguguacuuacauauauuaauaaaauaaaucuuuaaaaaaaaaaaauaaaugauucuuuaaaaaacuaguauuguugugaagaauaaaugucuuugaaaagcacugaguauuauuaguauggcaaauauuaagucaauauuauaguggaguaauguuuuaaauguuauauucuauaucaauuuucagauauuuagauacuagaauuuaucuucuaauauacauagaaagcuuucauauuacuccuauuuuguaugaauguauguguauaugcauguauacagguaggcauauccauguaggagcuggaagucuacuuuagguacuguuccaaccaacauguuuuuuucaagacagggucuuucacuggcuugggcuuacugauuaagcuaggcaggcugcucaucaucuccuaggauccaucuucuccuuuucagcacugggauuacaaccaugagccuacaugcccugcccuuuuggaugcauucugaggauagaccuuugauucaugccuuaauggcuugggucugaacuagcuucccagauaaauauuaguccuauuuuuuauguaaggauacuuuaguuguuguuuuaaaaugguuuuuauccuaaagucuuuccuccucucuucuucuuccuccuccuccuccuccuccuccucuacucuucuccccccuccucucccuccuccucuaucuuccucuuccuccuccuucacucugugagacaagauuucucuguguaacaagccuugguugugcugaacucaauuuguaaaccaggcuggccucaaacucacagagaugccugccucugccuccugagugcuggaaucaaaggcgugcgccacaaccaccugacugacucuaggaucuacucuuuuuuuuuuuuuuuuuuuuuuuuuuuaauuuauuuauugauuauaauuaaguacacuguagcugucuucagacaccagaagagggcaucagaucucauuacagaugguugugagccaccaugugguugcugggauuugaacucuggaccuuaggaagagcagucgggugcucuuacccacugagccaucucaccagcccuaggaucuacucuuaauuucuuuuuuuuuucucaugcaccacugcauauagugcauguauaacuucuuuaguuauuuucauuuuguuacuuuuaauuaugugaauauguguaucuguguguggcuaugugcauaugagugcaggugucuguggaagccagagacuacagaccccccugcagcugggguuauagaugagacagaggugcugggaacuacacuugcucaccuguguaguguuugcuuguaacugaugaggcaucucuccuguccuguuuuuuguuuguuugauuguuuuuguuuuguuuuguuuuguuuuugcuuuuuugagauaaccuagacuggucuugaaugccugaucuuucuacugcuaccucuucccaagugcuaggauuacaaguguuugccacugugcuuggcuccuuagcugucucuuuagaacauuuucugaaucucucuauuuauuaugcucauuaucauuguuucuguccuugucccaauuucuuguuauuucuuuggcuaaaauucucuaauauucuaguacucaccugucuuuccguugucaguugugcuuuaaucacaugauugcuggcuucuuacauguguccagguuuccuaucucuuuauacuuuuacuuaaguauguucaucuaaauucaccugucaucucggaagucuuuucuagcuacucgauaacgaaaggcugggagugaccacucccccauuuccccauacauuuuguuccuagaauguacuugaaaguguuaauaccuaucgguugucacauaauaagcuucuucuuguguauguuuuuguuuguuuguuuguuuguuuguuuuucgagacaggguuucucuguguagcccuggcuguccuggaacucacuuuguagaccaggcuggccucgaacucagaaaucugccugccccugccucccaagugcugggauuaaaggcgugcgccaccacugcccagcuugaguauucuucuauuacauuuauuuauuuauuuuggguucaguguguauguaugugagcagaagucagacagcuucugggaguuggcccucuucugccacgugguucugagagucagauucaggucaucagucuugacagcaagugcauucaccagauugcuugccccaaguguucucaacuugaaauguugggcaggaagaauucugcuucuagucagagcuaaaaaugacuagguuuuaaaugcagagccuuauuuugccuggcugagaaacugauuggcaaaguagaggagcauuugguucuuuuagccuaagaacucuguauuuugacuucuuuuccugaagccuuaagggauuuuuuuuuucucucccuaaucuguacagccaagaaccugaccugggcugacucuuaagauugaacagugaacucaguauccacugagccaagacuuggacgccugccucugacacugucugaaggcuaagccugaauucaaaucuugcucuggcuacuggcuuauuuggugaacuuugauaaauuucuuaguucuuccaggcuuuguuuuguuauuugucuguucugcaucucacagaguccuggguuaauguugucaaggcuuuugacaauacuauugcuuuagcuccagggguuucuaagaauuggagguuguguggugccccaagcaguuggacucuuucccauggguuagcagaagauggaaagaugggaucucucaugauguguggugggccauacuucauccugugauaaguguugauggauggaagguauguuguugcugaugacauuaggccugucagaggcagccguuuuuaggcuguuuuuguguuuaauauuucuccaccagaagcuacuuuucucucuuuguuugcaaauagaaaaauccccugucauuuuuguguauuuagggauagacuuccugguuucauugauuuaucccugugcgcaccccccccccccccgcccccagcuuccggucuccagaaaaugaauacuuucacauaaaauuccugucugucugucuuccuuucucucucucucucucuucuuuccuuucuuuugauuuauguguuuuauguaugucaguacacugucacucucuuuagucaccccagaagaggccauuggaucucaugacagaugguugugagccaccaugugguugcugggaauugagcucaggacuucuggaauagcagucagugcucuuaacugaugaaccaucucuccagccccuucuuucuuuauuuuucugaaguaaguggguguaaggaaauaaauuuggaccuuauggcauucgauuucuaguuuuaagcacaagcuuuccuuuccugugguucacaauuaggagccguccuugugaguuagagccugaggcagauuacaguguaguuugagucuuuagagagugguuaccacacuuguaauguaguucagacugaauauauguaaaacacugggugacugcugguuaggaacaaaagagauugcuacaucuuuugggugcuccucuuuccccuuucuucuuuccuuccucaccauguucacuuuuuuccccugcuacccucuccccuuacugucuucucuuccucccucuccccuucuaccuuuccuuccuuuccuuccuugcuuccuuccuuuccuggggaccuaauccuugggcaugauagauaagcacacugccauugagcuauauuuccagcuuuuuacccuacccacccuuuuugaggugacuguagcuuuauaguuuaagcuagccuuuaauuuagaauucuaaugccucagacuccugagugcuggauuauagguguggccaccauucuugguuugugccaaguccauucuucccaacuuccugggauagaacucugggcugcacaauaucaggcaacugcacugcuucagcccaacugccagguuuuuuguuuggagucaugaucucacuuuauagcccuagagcucccuauguugacaagaguagucuucaauucauagagauuacccaccugacucugcuuuucaaguguuggauuuaaaaaugugcucacgacaccuggccaaaacaagaagauagguucuuuuuguuuuguuuuguuuuucaagacaggguuucccugugugacccuggcuguccuggaauuuacucuguaagcuaggcuggcuuugaaaucaaagauguguaugccucugccuucuaauucuaggauuaaaggugugugcuacuugccuagugcuggguucuugauucaguauuacuuccuacuuuguuuagaugcagaccaacugaauuagauugguguaauucaguauaaauguugcugugugcaguaaagauuccggcucuagcagcaguuuaugucugugacuuuggcuuuuuguuuguuuuguugauuuucuuuaguuuuuuuuuuuuuuguuuguuuuuguuuuuuguuuuuuuucgagacaggguuucucuguauagcuuuggccguccuugaacucacuguguagaccaggccucgaacucagaaauccgccagccucugccucccgagugcugggauuaagggcgugcgccaucacgcccggcaacuuuuuuuuuuuuuuuuuuaaagauuuuauuuauuuauuguauguaaguacauuguagcuguuuucagacacuccagaagagggagucagaucucguuacagaugguugugagccaucaugugguugcugggauuugaacucuggaccuucggaagagcagucgggugccuuuacccacugagccaucucaccagccccaacuuuuuuuuuuuuaagagcagguuuauugguggugccuuuaauuuuuguucuugguaggaaggcagagguaggugccucucuguaaauuuuaguucuacauauugaguuccagagccagaaguacacaaugagagcuggucccaagaaauguuuaagaaauguuuuuuuauguuuguuuauggagggaugggcauguaccucggggacacauguggaugucagaggcuaacuuucaggaguugguugucuccuaccauuuguccugagggggccagguuuggcagcaagcaccuuccccugcugacccaucuuguuaauucucaguuuucuuuuuuaaaguuuuuucccucccuaaauuguguguguguguguguuaguuacauaaguggaagugcccuuggaggccagaggaguccaauuagcuagggcuggaauuagagaugguugugguuucccuuccugugggugcugggaacuaguuugggucuucugcaagaacagugcaugcucuucacugcuaagacaucucucuagccuuuuuuaaugcuaaggucucauuauauagccuauguuggcuucaaacuagguaaccaaacuagguuuccucaguuuccugagaggauuacaagugugugucaucacaacuuggcuaaagcuuuuucuucuuugaucucagccuggccuugaacucuauuccagauuacuuuuccuuuuugugugcugagauuacagacuccauaauuggcgggcauagaacagcucaguggcagauucugggauuuuuaaauaaucauaggaugagauagggacaguaagggacuguuggugucuaucauugaagagaaccuuucacaggcagaaaaaaugagguuaguuguagagaauuuuuugaauccagguggugcugaggggccaucagacacgugucuuaucauauugaugacagggaugcagggaugggauaaagauuuacauuguugucuuagauguauuuaugccauuugugcuugacgaaaagauccauacuguagugauuugacaguugcuuaaucauagucugauaaauauacacccacacacccacacccacacacccacacacgagguuuauuucucucaaaaacuauguacugaguuucuggaaaggaauaagagaaagauuuucauuuuucuuuagcaucguuuauucuguuuugcauuuugaaaugaggccuugcuuuguucauaaauauagcucacaggcuggccuuguuaugaugacaagugugagcuggguagcaccauucuuuaauuugucugcuuuucucuuguugcuguuuucuuuguguguguauguguguagugcauauacuuguucacauggguuuuguuuguacauggagagcaaagguaacuuguuggguuucuccuuucaucacguucuugugacaagguuucuuauuaaaccuaaagacaucaguugguuuagaugaacuaaccagugagcuccugguauccuccagucugccccauuucucuucaguccccacagugcugggaauaccaguguauauugccaggcucuuuuaaaaauggaugcuggacagcccuaacucaggcuccauggcaggcccuuugccaaauugagccacuuacuaugcacccuuuuuucaugaccucugaggaaaugaacacuaaaaauauaaagcacacagauuuguaguugauaaaguguaaaguagguggaacaugguuaauguaacauauaugaggcuagcacacgaauaugggaauguuguagggacucugccugugguaauuagguguguagacucuggguucagauugucuggguucaguuucuuuuucuuucuuuuuuuuuuuuuucuuuuuuuauuaaaagacaguuaacucaucacccuuuuuggguucaaaguaugaaucuuccauucugggacugauucuuucuuugcaucucauguuuggguuggggcuaaugaggauuauaagaauuuccuuugacaugucuguaauuguagcaucugagacaugagccaagacauaaccugaaggacaaccugaacuauauacugugaggcuucacuuccaaaaaauguuaugcagaauguuaugaucagagccuggcacuauaaaaauguuagcuguuauuuuaacuauuaccucauagcuuaaauuugucaaaaagaaaaaaaaaaaaaaaaaaaaaacgaugacagugagcaguaaaggguuucauugaaaaugauguugagagugcugcaguggauccuuauuuauuuauuuauuuauuuauuuauuuauuuaguagaauuuuguuuauuugaugcuggaagacuauuuuaaaaaauauuuuauguguaugaggagguuugccugucucuauggcuggugccuguggagguguaguggcuauuccugguuguauauuuggaaugauuuacaaucuagaaauggaggguucaccugugauccagaucuugaagcuggaagacacaaguuucugaccuggaucuuagcauggagaucuugaggcacaguggcugugaaaaguuuaggcccagacaagguaguacaagccuuuaaucucaggagacuaaggcaaggagaucucugaguucaaggucagccugagagaaaacaaguuccagacccuggggugguggcucacaccuuuaaccucggccacaccuucugcuggagaccuacguaagaccauuagaagaaggaagauuccgccuucuucgacugcuugcauuuacuuccagcacaucugugggaaucuacuucuacagaagaccagcugaaacaaccgaacucaugggacugagcaacuacuagauccuuggacuucccauucacaucugaccauuguugggguaguuggacuauaggcugaaagucaucacagcaaauucccuuaauauauagagacauuccuuugacucuagagaacccugacuaauacaggaggccagaagaaacuguugagucccuuguaguuggaguuacggaagguugugagcugccaugugcgugcugggagccaaaccugaguccuuuggaagaauagucagggcucuuaaccacugggccaucucuccagucccucaaggacuguuuuauuaguuugauuccuccagccaggaacuuuguguaaacuaccaggcugguuucagauucacagaagucuguucaccugcuuugcaggugauugcugagguuagaugugugccaccauacccaacauaaguuuuacguuucuccacugggugaauucaggaaccuaauugcuagaccauaugggacacauuucauuaauaggagaggccaauuuuaaauauccacagcuuucaagagagaaauagagaagaagaaagucauuuuuuugaguuaggguccaggaaagaugggcaguagaggucuuuaagaagcuguaaugggggaaaggccuuuagagaaagguugggcaagccugcuaacaauguugucugcaaucgugcauuuauguacacacaccccauacacaaacaaccauaaaaaacuuuuaaaaauuagaacucagaagccuguuuuguuuuggauuuuuugaaauagggccucacucuuguaggucugauuguccugaaacuuacagagaucuaccuaccucugccccucaaaugcugaauaaaaggcauaugccacuacaucuugcuguugugggauauuuuguuuguuuuguuuugaagcagagucucauuuuauagcccaugcuggccuggaacuugcuguuauguauagucccucuaaaguuaauuugcuuuacagggccuugugaucuaaaaauauuuuguuauauuugucauuacagaguggguagacaauagaaauauauagcagugaacagauuuuacaugguauaucuucaaccuggugauaacucucuagugaauacugcugcugacaguacagucuccuggaugaggcaggagcugagguacaggaaggcuaaguaauuuuucugagaaaugaggaaacuuuuguaugccgagaaaaugauggaauagggugugaugguguacauucacacucguacacuggugaaacuaaggcuggagaauuucgaaucagacugacuggccugggcuauaucaggagaugaacgguggagaaauggaguugagcuaguuuuacugagacaggaacaacaucagugauuucaacuuuauugcuguagcugaggggguccaucaacccucgauucuucugauccugcuucccaaguacccuagaauuacaagacuguaccagcuuccccauccucuccuuuuuuucagugcugaguauggaacacagaacuaccuugacuucaugaagaacaagaaaguuuaauaagauugagcuacccacacccccagugcugaaacuggaauuuaaucacaguauaggauauacauggauauccuauacugucucuagcuuagaaauuauggccaaaaaaaaccaaaccaaaaucaaaacaaacccaaacaguacuucuccaucagauucaaucagugccacuacuuugucacauccuaaaauaucuuuucguaaucuacacagaacacaugaacacagucaugauaauaguuuuucuucuucugggugaguuugccuucauaauuuuuacuuguuuaauuaucugauuugugugguauguugcccaaaauuccgucuucccccuaaguuuaguauaaaagacuggcaagaccuguuuggagaaaggugcgguuacuagagguguggugcuagcuuuuuagauuuggugucauuugaauguaguguuccccguaguaagguucuauugaugaaaacaaagcuuccaauuauagaaagccuuguguguagaaacuguacccgcaugccauuucuauaaaaugcugggccacuuuuaggccucuaauuaaaggcuugacauuuuguaguuaauuuuccaguuguugggagaacuuuaguuauacaagugaucuuugguuuauuuaaaggauuaaaaaaaauuuauccuuugcuuuuuauggugcuggguaucaacccauggcuucaugaaugucuacucauuuacuguaccacugagcuauaaaacuaacucaagauuuugaaaaaaaaaaagaggauuauuauuuuguuguuauuuguaugcaucuguguauguacuguguguuuguguguguacuaguggaggccagccagcaucuagagcaguguuucucaacuuguggacaaagacucuuuugugaggauauggaaugacccuuucacagggucgccuaagaccauuagaaaauacaaaguaauuuuaugauugggggucgccauagcaugaggaacaguaaaggauugcaacauuaggaaaguugagaaccacugcccuagagcuugaguuauaggcaguucugagaaacccuauguggaugcuaggaacugaacauggauuuucuggaagagcagcaggugcucuuaacugcaacggaguucucucucuacccuuuucucagucuucauugguuuauuuauuuauuuguuuuuguuuuuguuuuugguuuuuuuuugagauaggguuuuagggcuggagucauggcucagugguuaagaguaccggcugcucuuccgaagguccugaguucaaauuccagcaaccacaugguggcucacaaccauccguaaugagaucugaugcccucuucugggguguuugaagacagcuacaguguacuuacauauaaaaaauaaauaaaucuuaaaaaaaaagagugagagagagauaggguuucucaguauagcccuggcuguccuagauagaacucacucuuguucuaggcuagccuggaacucugagauccacuugccucucugacucccagaguguuggcauuaaagguguacaccauaaccaccacuuagcuuguauuugcucuucuuuccuucuuuccuaaucuccuccuccucuuccuccuccuccuccuccuccuccuccuccuucuuuuaaauacccuccuccuuuccuucuuucuaggucuuguuuaaucucaaggauuuuaguccaucagucucugccucuagaguucuggaaauauagguguguaccaucaugcuuggucuagggguuuuaaaacuuaaauuauauguguaugaguauuuugccuuagugaaugucugugcaucuuguggguacuuuguaccugaggccagaaaaaggacauuggguccccuggaacuggaguugcagacaguugugagcucucauguaggugcuaguaauuaagccugaguucucuggaagagcagcugguacuuuagacucugaaccaucucuccagccuagauuuauacuuuuuauuauaauuauuuguuaauuuacuuuguguauugugugcacauaaacacaugugacacuuacagcacauuuguagagguuagaggacagcuuuugugaguugguucucuccuacuaugugggucuuagggauuggacuuagguuguuagacuucacagcagugccauuaaaugcugagccaugccaccagccccaggaggaugauuucuuuucccaaagaguuaaauccuugaauuaaaacccauauauuacugaauaugugucaguauuucauggcugauuuuauucacauuuugucuucauggacacauucaggugcagacauguaacaguuaaaugaggaaacugagcucuauuaauagcuaagcaggggcucaguuguuagagugguugccuaacaugcauuaagccaauacuagguuugacuccuaacauugaaaacuagguguaccgguguucugggaagguggaagcaggaggauccuaugcucaaggucauuguuggcuacauagggagcuggcaagggcagagguguuugcaaacaacuaaaaucuuacguuucugaaucauauuccccaaguguuauaagaacagcuggucaaaugcucagcaguuaagggaagauauuaccuuuguauauggccugaucucaguucugagcaucuaugugggaugaaugagccaucaccuuaacucugccuccagaggauuccaugucuuguucuggaguccacuggcaacugcacuugugugcacgcuccagcacacguacaaagccauacuuuaaaauaaaauaaaucuuuuuauuuauuuuuuuuaaaagacagugucucuuuugagaugguguagcucuggcuggccuggaacugccugccucugccucacaaguucuggaauuaaagggauguaugaccauaucugguuaauaaauccuuccucccuuuuuuuccauguguguguguaucaauucuguuugccucauuuuauugauguggggauagccccaguugcauuuaguuauuuuuuuuugccuacacaaucauuuuauuuguccugaguauguuuuacuuuguugugugguaacugccuuugaaauguuuuuuagaaaucugccacuuugaagaacugugcaucuguggguuuagugaggggagucauagugcacucaggaagauucacugauaauguaacagcagugcauucuaacacuuccacugcucguuacucauuggagccuuauaauaaucuuaaguagagaaggaggauccgagucacaaagugacuuacccaaagucuguccuucuuucccuucccuucccuucccuucccuucccuucccuucccuucccuucccuucccuucccuucccuucccuucccuucccuucccuucccuucccuucccuuccccacaaaucuuaacuagaaugugggauaaaucguuagcauagaugaucaaauugcaagaugaaccuauaauucuuaguuucuagugaauagugacauacuuuagauguuuuuuacauagaguaguuaaauauaauuacauauuaaauagaaaaaccuguaaagguugauuuuaucuuuuuggagugauuaauuuuauauguuuagguaaauaggaaucuugguauuagauguguguguguauucauaucuccuugucaugacuuaucuuagucuccuauuugcuuauaucuuuuugugauuaagcacugauuuggaggacuucauaacagcaucagaaauucuucugggcuuucugugucuccguuuuacuuuacauauugggaaacuuuuuucuucuugcuuuuuuuuuuuuuuuuugcuuuuuaaaaaggggaaugaaugagggcuggagagauggcuuagugguuaagagcacugacugaggggcuggugagaugacucaguggguaagagcacccgacugcucuuccgaagguccggaguucaaaucccagcaaccacaugguggcucacaaccaucuguaacaagaucugaugccuucuucuggagugucugaagacagcuacaguguacuuacauauaauaaauaaauaaaucuuuaaaaaaaaaaaaguuauuuaaaaaaaaaaaaaaaaaagcacugauugacuguucuuccagaaguccugaguucaauucccagcaacuacaugguggcucacaaccaucuguaauaggauccuauacccuccucuggugugucugaagacagcuacaguguacucacauacauaaaauaaauaaaaucuuuaaaaaaauguauagugguuuaaaguguauuuugguuuaaaaucucucuuucucuuacacacacacacacacacacacacacacacacacacacacacacacacacaccccgcaaaaacaaaacaaaaaagaggaaugaaaagcaccugacugacacuuucuccuuagccaggauccccaagaccaaguucucagcaaaaaggagauuuauuugccccagagggacaaaggacagagaauaagagacaggagauagaggaugagggagaagcuguagcugucuuagagggggacaaaggacugccucuagauuggagacugaugaaacacauaggaacaugguggucuauaaagguaaaauggggaaacccuguguuaggaugauguguaauuguaauugggcaugucaauuaggugauuacuggacuuuaaaucuuugauaacuguacuuugguagucagccuuaggaggaggaacuggccaaauaagggaacagaccuugguggcuagguuuacaaguauacucuaauuuagauuauuagcaagucagagaaaauuggagagaagggcaaggccugcuaagccauguuugcaaugccagggcuggcuagagucccuucaacaggcuuauccgcuuuugguucaaucuggcuucuuuagguuauuugggaaugcagcaaagucuccucucauauggugauggggcuagccuuuaauacaagcacuugggagacagagaagcaggcagaucucagugaguucaaagccaggcuggucugcaaagugaguucuaggauaucagggcuacacagagaaacugugcuucgaaaaacagaaacaaaacaaauuaccaaaaagcauguaugucuaucaauuuccagggaccuaaacucaagaguucaaaucauuaacacugguuugauccacuguuuuguuuuguuuuagauuuauuuauuauuuauuuauuuuuuuaauguaaguacuuuguagcugucuucagacacaccaggaaagggugucagaugucauuaaggaugguuauaagccaccaugugguugcugggauuugaacucaggaccuucggaagagcugucagugcucuuaacugcugagccaucucuccagcccccuugauccacuguuaaacaguguuaagucagagauccacuagcuugugccaucacugccuggccuuuuugguaguuuugauuucuuuucuuuucuuuuccuuucuuuucuuuucuuuucuuuucuuuucuuuucuuuucuuuucuuuucuuuucagguuaucuuugaugaugauauuuguagaaacucuccuuucuuccuuccuuccuuccuuccuuccacucauuuuaauuccuguaggaacugaagguuauaucauaguuuuuugaaucauauaauauuuguaaccuguacuuuguuuuuccuuuugaguuacagggggacagaaaggaaauuuuaauuuaauuuaauuuuuuuaaaaggggcccuggaccagugagguugcucaagggguaaaggugcuugcugcccaaugaccuaaguuuaauccuggaacccauaugauggaaagagagaauugacuccugcagguuauucugugacuuguugcauacuggaacaaacacauccagauuauacacaaagaaaugggacugcuauuguuguuccuacaguucguugugagauuauaaaaaauuucaauguacuuuaugucguauuguuaggucaaaggaguuucaaaguacuucuuuugaaggucucuauacuaguuuuaguacagcauuaaggggaacuacuaguaacuuuuucuuguaccuucuugguuagaaguaaaagguaagaaauauuuuagcuauuaguuugaauaaagggaaacguggagcagguucacuaaagagauugauugccuucuguuauucaacucuagccuauucuggagguuggcuugcaacucuuguugacauuuuuauuguguacauauuuuguugguuaauaguuggugaugagaggcugggugugugucauggugguacaguacuugacaagcaaacucaggguucaauucccggccccuagacacagcaaagcaaacaaagcaugguaagaguuauaccguaagaguaaagcaagggcuggagcgauggcucagugguuaagagcaccagcugcucuuccagagguccugaguucaauucccugcaaccacaugguggcucacaaccaucuguaaugagaucuuaugcccucuucuagugugucugaagacagugacaguguacucacauauguaaaauaaauaaaucuuaaaaaaaaaaagaguggagcaaagcuuuguguuuagcacuuuguagggaacugaacugacuauugccuaggaauuuaggacuugcuuacugugaaaucuuucugaccuuauccauuuuaaugcuucaggaagaaaacuccuucagcacaagcuauaaauauuuuuccuuauggcuguauuucuaugcaucugguugugugcuuuguagaucgcagccuuuugagaaguagaaggaggcaguuuauuguuugacucucauaauaguccccuuuuguuuuauuuuaauuuaaaagacuucauuauguguauguauugaagccaaagaacaacuucaugugguugguucuucacuucuaccuuuacagugauuauggggaucaaacucaggucucuguggcaaauaccuuuacacgcugagcuaucuugccauauuccacuccuuuuaagacaaagacuugugcugcagcucagaaugucuuggaaugugucauguagucuggacuggcuucaaagcuuuggucaucuuguccucagccccagagagcuguaauuauaacuuugcacaacaaugacccacucugacacuuaacuacuuuugaaauuuaaaaaagcuagaagcagccagggcuagugccuuaugucugaaauagcacuguuagcagguagaaacacuaggaguaggaguuugaggccaguuugggcucuauauagacccuuuccuugaaacugaaguagaaaaccaccuuuuuuuuuuuuuuuuuuuaagauuuauuuauuuauuauauguaaguacacuguagcugucuucagacacuccagaagagggcaucagaucuuguuacagaugguugugagccaccauaugguugcugggauuugaacuccagaccuucggaagagcagucuggugcucuuacccacugagccaucucaccagcccgaaaaccaccucuuaaaauuaucaauucaugggauagauauauuuauacaccuugguugguagaaugcuugccuagcaugaauaaaagccucagguuuacuuuccagcacuacuuaaacuagucaugaugacagauuuguaauccaagcccuagggagguggaggcaggacggucagaaguucaagcuacauaguuugaggguagccugaacuauaugaacuaugucuuuuuuuuuuuuuaaguuaccuuaagcuaccacucagaagcaaccauuguauuuuuuaaucaucuccccuucucuccuucccacuuucucucuuucuguuuuugcagugcuaaggauaaacccuuaggcuuuagagaugcaagcauucuacugcugagccauauaccagccucuaccacagcccuucuguaucauuuuugucuaagcuacugugcccugacuuuccaaaaaguauuacugauacuuuuuggagugcuagaaauugaacagauugauucuagcugcauauguaucaaaagaugaccuacucggccaucaguggaaagagaggcccauugaacacgcaaacuuuauaugccccaguacaggggaacaccagggccaaaaagugggaauggguggguaggagagugggggggagcguaugggggacuuuugggauagcauuggaaauguaauugaggaaaauacguaauuagaaaaaaaaaagaaaaaagaaauugaacagaggcucuggugcauguuaaacaggaaguaggucuaccacugagcugcaucccagcuuagugauuuaugucgguuuauugugaauggugguguguguguguguguguguguguacauggucauguuugccuuaguugcuuuucuauuacuguaaagagacaccaugaccaaggcaacuuacaaaaaagaaaccauucaguuaagggcuugcuuacagauuuagaggguaaguccaugaccaucaugguggggagguugcauggugcuggaacaguagcugagaauuuauauaugaaugacaaacaugaggcagagagagagagagagagagagagagagagagagagagagaacacaccuggaccuagaauuggcuuuugaaaacuaaaugcuuacuaccagugacacaucuuccucaacaagcccacaccaccuaauccuuccuaaaacaguuccacugagcaugaauuaaaugcaugagcuugugggguccauucucauucaaagcaccgcaguguauauguguggaagccagagguagaugcuggguaucuuccucaauugcccuucaccuuauuuuugugacagggcuucucacugaaacuggagcucauugacguuacuaggcuagucagucagugaauuccaggaaucuacuugucuccauuucccagugcuaggauacagguaguauauacuacagugccuggcuuuuuacaugggugcugaacucaugcuuggguggcaagcucuuuacccacugaaccaucucucugucucuccaacuguuuaauuuuuuguugugcuagggauugauugagcccagggccuguaccacuagaccauacccauaacuguacauuuuguuuuuaagagaaaauuuuuuuuuguuauuguuguuuuguuuuucaagucaggguucucuguguagcccuggcgguccuggaacucaacucuguagaccaggcuggccucaaacucagaaauccaccugccucugccucccgagugcugggaucuugccacugcccggcaagagcaaauuuucugcuuuaugaaagaauaagaacugaauauggucaguggucgaaaaugucgaguuuuucauauauaaaguaaaagaacuaugacaagauaaaauauuuuugaaagaaaaauucuagaagauguaccuuuucuaggaaacaauaaauaugaaaagaacacuuucuccuuugaguuagaauuguacuuguaaugggagccucucugguguagaauaggcauuauuugacauuauucuucauuccuuagauuuccaugaggacagcugacaaggaccugaauggccucauuuuagcuauuucuguguguggagcuauugcuugcuccuucaguucugaucccuggugcgacaguggcuccugagcaccaugaaaguugucccagagaagaaugcuguacgaauccucuggggccgagaacggggcacucgugccaugggugcccagcggcuucugcaggagcugguggaggauaagacucgauggaugaaaugggagggcaagguaagcaaaguguucuugaccuaggauuuguggagaugacaguaaauuggcaccuuugaauagauuaaugguagaauagggauauaauuuaucuugucccugagacuugauauagcuaauuugggaaauugguuuauaauguaaaagauaagacuagaaauguucuuccugaacuuagauuuaucuuaauuuauaauuugauuauugucuccagauuuuuaguuugcacugugauacuaaucuagagugguuucuguacuuaaaagucagaguaagcccaacuuuauaaaucaugcuaugcugugugugugucugucugucuguauauauuuacuuauuuguuuguuuucucucagagaguagaacugccugauaguccacgcucgaccuucuuacuggccuucagcccagacagguaccuaauacuuagcuguagcuuaagauuugauguggcuuucuguacucuuggcuuagcuuguucauucagauuaaucccuagagacccuuugaagcacuggaugaaugugugaagguguauaugguguacacacacacacucuauuauuuauaauuauauaauuauauaauuauauaauuauauauauauauauauauauauauauaauuauacuauauauuagaaauggagagaaaguaaacaaacaaugccaaccagaagaauaaaaagaauuguaaagagaauggugaaagucaaggcucagaagauaacauugcuuugcuugaccaguagacaccagcaaugaaggcaauauguguuauuuagcgacagugugggaaaaccagaagccuuuaaaaaugggaauauuucuguuuuguguagagaaacuaccuaguaggcauaccuuaauuuuuuuucauuuguagugaguaguguagggaauaauguugggauuuuuguuuucuaaagcugguaauauuuauucucccccuacaugcuucuuaauuauuccuacauuuugauucucuaggacucucuuggcauccacacaugugaaccauaacaucuauauuacagagguuaagacuggcaaguguguucacucucugaucggacaccgccguacuccauggugugucacuuuucaccccaccaucucaggccuuauugcuucugguugccuagauggggaaguuaggauuugggauuuacauguaaguauuuuuugggcugcuuauuucccuuugguauuccagacacagagacuuguuugccauuggauucuuacuucuggcugagaaacuaaccacuuuguuaggacugguagacauugcuuacuuaaaggauggauauucuaguuuguacuuauccauuaugaaguaaacaaacuuuucuucugccugcucauuuuaagauuguauagcaggaggcucuaacaugaguucaguaucgacuuccuuugucuuggaguacucugcucaugaucaucacacaagacuuguccugaugauagacuaguggguugcuuucacuauguuugcaccaagcuggaauguucacaggugucagaaacaggaacuaaguagaggcuuuguaauugacuugaagacaguaauuguucuauaaauuauuggcacuguuagaugacuguucauauacauuauuuuauaaaagacauguuuaaaguaagcccuauaagaacucauuuuaucucaaauggaaauuuauuuagagacagagccuugauaugcaaaucugacugguuuggaaaugacuauguagaccaggcuacccucaaacucauggagauccacaugccucugccuucugagcgcugggauuaaagccaucuaccacuguacucugauaaagauuguaauugaaaguggaaauacuaggaaucaaacccaggggcuucauccauacgaaaguauaugcuuuaccacugagcuauauaguuccaucuagaccccuccucuuuuucacucccuccaucccuccucuuccccucccuaucccccucuuuuuuuucuuuuauuucuuuuuuuguuugucuugcuuuuugacacuacugucacgauacaguccaggcuggccucaaguuuguggcagucuucuugcuuugcuucccaagugcugggauuauagguguaaguaaucauauuuagcucuucaauguaauucucuucacauggacuccccagucuguuagcaguuuguaaucugagaauaauuuuggauugguucauuugcaggggggcagugaaagcugguucacagacagcaacaaugccauagccuccuuggcuuuccacccuacggcucagcuucuacuaauugccacugcaaaugagauccauuucugggauuggagucgucgggagcccuuugcuguggugaaaacagccagugagauggagcguguccggugagugccacguucugucaacuguaucaggcaccagacaggaaagaccauuuauaacuacuguuauuucaggagacagguuguuaucccuacuuagggcagucaguagucuucuuuaggguauuuguuagcaucaucauggcugauuagcccagaaacaguucauuuuguuuauggccucaucuuguggucucugcaggucagggucauuugguaaaauccuacuuagguucuaggcugccugcacuugggauuaccuuuugagaagccucucaaaaauaaauggguaauuugauagcuugguggcugauuguucauuauuggcuauuuacuuauauuuauuauaucuauauccaauuauaaaaaagacauaaacauguaucugggcuacauaaggagucuaagucuuccuggacuaguuaacaagacucugucuuaaaaaacaaaauaccaagcuagauguaguuguccacacccuaaucucagcauuugguagguagauccagcagagguagguggaucucugugaguuugaggcugucuuggucuacaaagugaguuucaggauaaccagaguuauauagugagacugucuuaacaaaacaaaacaaaacaacccaaaauaucaaaaccacaauauagcuggggauguaguaagauuguucagcucuugccuguuacauauauggccuuguauucaguuuucugcacuacagaaacaagauauacacuaccuaaguuagacuggauaaauuguuuucuuuggcugcuuuugaccauacugugacuggauauagacugguuuucuggcuuccagccauaucacuuuguacugauacuuuguugucacuagaguaaguacuuuuugccaaguguagcagcuuuaugaagggaaaccugaaucuguguggcagcauucugauuuaccauuuaaaugggcucuuagauguugaacagauacuuauuuaguguagcugcuaaaugugaugugagccuggauguuuuucaaaacuggaaccauggccugaggauguagcccagguuaauagaauagcuugucuugcaugaaugaagcuuagaguuggaucccuaguaucacauauggugaguguguuggugcacaccuguaaugccaaugcugagaugguaaaggcagaagagucaaaaguuaaaggucuucuguaaccagcuguugacuuguaagcuagccugagguauauaagacccugcuuaaaaaaaaaaaaaggaaaaaagaaaaaaaaugaaaucuccuuuuuucuuguugacuuguaagcuagccugagguauauaagacccugcuuuaaaaaaaaggaaaaaagaaaaaaagaaaaaaaaagaaaucuccuuuuuucuauuuaauauucauuuauuuuuauuuauauuaauacacuguagcugacuucagacacaagaagaggacaucagauccuauuacugaugguugugagccacaaugugguugcugggaauugaacucaggaccucuggaagagcaguuacugcuuuuaacugcugagccaucucuccagcucugaaaucuguuucuuaacgcauuaggaaacaacauaaagucuuauuuuauugucuuuaaaaguuuuuugaaagacuagguagguguguagcauucaggaaucugaggcagaacauuugugagugugaagaugaccuggauugcauagauaaacugucuuuagaagagagugggagguggagaaaauagagaguuuuaaaaguaugaagggguagucaauuuucauuucucaguuaacaugaucuuugucucuuauucuuuuguauuucagccuggugagauuugauccacuuggacacuacuuacuuacagcuauuguuaacccuucuaaucagcagguaagagucuaacaguccaacucuagcugaauugggagguauuuucuaaacuagcacucuaauuuugauuauuauuauuucuuuauuauuaaauaucuauuauguauuauaauaaugaauuuauuauuacuaaaaugcaauucugauuauauuuuaguucuuaacauuucuguaauucuuuuccaucaagauuuuaauuaauuucugaugauauugaaaguuacagacauaauuuucacaugagucaauuuuuuaaccuuugugaauaaaucaugauaaacaagccuugucagagcugcagaaaugacucagguguuaaaaguuguguacaggaccugaguucaguuuucagucccuucuguugggcuacuuacaccugcucauaacucuagcuccaaggaauccaaugccuuuuucuggccaguucucaguguuuagauguguguggcauauacccacacaaaggcccacacguauccauaaacaaacaaacaaacaaacaaacagacuauaauuuuaaaaaacauaugugggaauuuugccugauugugugucuguguaauguguuuauguagugaccacagaggccagaagauuagauuucuuagaacugguguuacaggcaauuguaaccaccauguggauucugggaaccaaacccagguccucugcaaaagcaacaaguguuuuaaccacugagccaucucucuggcuucuaaaaauaaaucuuaaaaagaaagaaguagccagaggcuggagaaauggcucagcaguuaagagcacuugauguuuuugcagaggaccugguuugaaugccagcacucaauguagcaguucccagccauuugaauuccaguucuagguaucugauugcuucugcugaccuccauagacaccauacauguaugugaugcacauaaauacauacaggcaaaaacacucagacguaaaguacaaauaaaucuaaaauaaaaaggaaauaacuugucuucaucaugcuuaucacucguaugccccuggcugguugcuuuuguuucccuuacugcuucuaugucacagagaugccuuuuuuaaauaauuguuuugccagcuguacccauuuagauauguugccaauuggaaaugaauaauuuaauaccauauggugguuuugaaucugaagccaguuuucauuaccuuauggggagagagguuuuacuuauccauggaggugguucuucuuggaugauuaucagucaacuuuaaguuucucuugauuuguuuggcgguucuaucuguugugcucuacucuguccugcugguccauguugcagggugaugacgaaccagaaaucccuauagauggaacagaguuaucucauuaccgucaacgugcccuccugcaaucacagccaguucgccggacaccucuccuccacaauuuccugcacaugcuguccucccguuccucuggcauccaggugggagagcaaagcacaguacaagauucugcuacccccucacccccaccgccucccccucagcccuccacggagcgucccaggacuuccgcuuacaucagacuccgacagcgggucaguuaccccaccacaguugagugcugccagcacccugggauccugugccuuugcagccgcugugcuggcacucgaguuccuucccucuugccacaccaggacaguguccccccugcuucugccagagcuacuaccccuuccuuuucuuuuguacagaccgagcccuuccaucccccggagcaggcuucaucaacgcagcaggaccagggccuccugaaccggccgucugccuucaguacaguccagagcagcacugcgggcaacacgcuccgcaaccucagucuggguccuacccggcgcucuuuggggggcccuuugucuagccacccuucuagguaucacagagaacuagccccugggcugacagguucugaguggacccggacaguacucacucugaacucucguucugagguagaaucuaugcccccaccgaggaccagugccuccucagugaguuugcuuucuguacugagacagcaggaagguggcucucaggcaucuguguauacuucagccacagaagggagggguuuuccaucaucaggguuggcaacugagucagauggagggaaugguuccagccaaaacaacucaggcagcauucgccaugagcuucaaugugaccugagacgcuucuuuuuggaguaugacaggcugcaggagcuggaucagagccugaguggggaaacuccccagacccaacaggcccaggaaaugcucaacaauaauauugaaucugagagaccagguccuucccaccugccuaccccacacagcagugagaacaacuccaaccugucucggggccaccuuaaucgaugccgugcuugccauaaucuucuaaccuucaacaaugauacccuucguugggaaagaaccacaccuaacuacucaucuggugaggcuagcucuuccuggcacgucuccacuaccuuugagggcaugccaccaaguggcaaccagcuaccaccucuugagcggacugagggccaaaugccuagcuccagcaggcuggaguugagcagcucugcuaguucacaagaggagaggacuguggggguggccuuuaaccaggagacaggccacugggaacgcauuuauacccaguccagcagaucuggaacuguaucacaggaggccuuacaucaagauaugccugaagaaagcucugaggaagacucccucaggagguaagcugcugcuggccugugcucugccuccccgccucuucuccuuaaugcccaucguccuucagucuuagcaggguuguggcuuauauaaagccucugggacccaugcaucugguucugaucuugcauuuuuuggggaaaucuuucuuugauggcagagauagcaucaggccuagugcugugaguuaacuguuguacuaguuuauuuuugucuaagcccaaagcucugguuuuagccuuaaaagggaaauguugauuggguuaaagaagcaugaggagauauaaucauugggguuuuuuuuuuuuugccuugacuuuugacuuugaaauaucauagauauaggacuacuuguugagauaagacuguguuccaaaggacuauuuauagugagaauuuuuaaaaagaccuacaguggggacagauauuuuguucagcauuuugugcuagauauuuuuugaauauauauauuuuuuaacaacucuaguucaauuaauaggugaagaauuccauaggaaaguguuuugcuuuuuuugcuuuuuuuuuuuuuuuuuuuuuuuuuuuuuuaauuuaccaaacuuguguuuuucgauagucucugggcuacucaucuaggguguuuguuuguuuguuuguuuguuggguuugguuuaguuuugauggugguagaaauuaaacucaaagccuguaucacacccaaaauucuuugaauggaucuuccagguuaauauuaucuugggaugggagaaaagaauucauggaagcaaggccucuccgcacaagaauugucaucggagagagcucucaugagggaaacagaguaggauaauaaacuacccaacacguguuccaugaauggcuaugugcacugcuaucuugauuuauuaggggcuucuuucagugauuauguaaaggucaaaucuagcauaaucaccaauucccagaauacuggagccaaacagcauauugcuguacauuauauccucugcugagcaacugaaauuuuucugacauaagcuagggugggaauauagauugugcacaucguguacuuguuauuuuuggaggaugcuuucgucagucauuuagucaauaaacacuaguggaaugguuauaguuuuuccagcacugugcuaggcauugugcccacuggaauauacacuuuuacuauggaggcaagacauauuuacaugaaaucugucauaaguguagacgaucuaguacuacuuuuuuuuuuuuuaaaucacaucugggagcuggagagauggcucagcuguuuagagcacugacugcucuucugaagguucugaguucaaauccuagcaaccacaugguggcucacaaccauccguaaugagaucuagugcccucuucuggugugucuaaagauagcuagaguguaguuacauauaauaauaaauaaaucuuuuuuuaaaaaaucauaucuauauuuauuguguacauugggguggugguguaugugccaugacauuuguauaagaggucagacgguaguuuucagaaauugacuaucuuuuaaugcccuguaaaaauccugggaucaucaggucaucagguaugguggccagcacuuuuaaccugcuuagccuucuuaccaucuccaagcuggugcuucuuuguguacuucugauacuaaaauagagacuaagcaaaaaaccaacaaaaaaauuaguuugauuuuuaauaaaagggagcuauuacccaaaaaaguuauauaauguucaguaaugaaauguugguaagacuuggaaaaggaaagaccuuuuucuuuuaggguaauagcacauucucaaggagaaaauauauaaugcaugcagaauaguggacugaacgucagaaauagacagaguaauuggguuguuucugugccugaaugaaugaagccaguucucgggaacagcucugaauuccuugcuuggaauauuuaccuuugcuuaagggcccacaucaggagccugggacucuguucuucugcauccagcagaguaccuggcauguuguuggcacucagaauuuauuaaaggcagucaagagaaggguuaucuucaacuacuggagcuuaucauuuugcgccuccaaaauaacugagccuuuagucagcacuugcccaucuuuaauaguacuucucaugugguguccuucugaguaaugcccaaauggcuuaaaauaaacccuguauacagagcauuagagauaccaguuaaugagagcucacuguguaaugugucauauucucacuuugaggugauuggaagcaggggauaggacauccugggugacauaauuucugauuuauuuauuuaucuauuuuuuugauuuucuuuuucuuuuuaaagauuuauuuauuuauuuuauguaaguacacuguagcugucuucagacacuccagaagagggagucagaucuuguuacggaugguugugagccaccaugugguugcugggauuugaacuccgaaccuucagaagaacagucaggugcucuuacccacugagccaucucaccagaccuaauuucugauuucuacaacagcucugugcacuauaggcauuacauuucauacccugcaguuaagaaaagugagucccuuagagcagucagaauuucuuuuaaagguacaggaggauaggagcuugggagauggcuccguggcuaagaacacauaagugaguguggggacuugaguacaaauuccaagcgcuacauauggcaccuaugccacugaccgcaucaugauuuuagggggcuugcugaccagccuagcugaaacugagguccuaguccauugagaacccuguuucaaaggacuaagguagaaagcaguagggcagggcuuggaaugugcucaucugccuucuggguguggacacaugcacccacaugaguaugaauguaccuacauuccaaacaaacaaacaaacaaacaagcaaacaaacaaauuuauuuauuuauuucauuuuuaaacguaauuuuuuucuuugguuauugauguuuuggagacagaaucucacuguccugauaaccguaguuuuaauugacauacuucuguuuauuuuuuuauuuaauuuuuuuauuuugaaaagauuuauuuauuuaauauauaugaguaugcuguugcucccuucagacccaccagaagaaggcauugcaucccauuacagauggcugugagcuaggauuugaacucaggcccucuggaagagcagucaguacucucaacagcugagccaucucuccagcccccucauuuaauuuuuuaaucauggaacucuuccaacauaaaaaugaaaagaauaauaaauaaauuccuguauccaucacuuuacauuaaaaaaaucaucagucauuagcuagcugccauuuuguuuuguuuuuugucuucccuucuuuuaucuguauugcuauucacuaccucaacccacauuguguguauuuuugucuguaaauacuucaugguuucuagaaacaaggcuaugcagugaaacuuuguguugauggaaauguucuguaucugugcuugcaaccauaauagcucugaguacacaugaccacugaguaacugaaguguggcuguuaguaucugaggaacuaauuggaauuuuuauuacuuuaaauauaaguagauggauaugacuaguaacuaccauauuguccccauaaaauauuaauuauaauuuuuaaaaauuaaaaugcugcacuuacaugccacgugcaauguguggaggucagaggacaacucuauggaguccauuuucuuucuaccuuccuaugaguuccagcuauugaaaucaggcuacaaaaaaugguuuuacccauugagccaucuugacauuaccauugauaacccucuucaaaaaaaaaauguuuugagacaugggcuugcuuugaaacccaggcuagucuuaaacauagguaugugcuacaaugccuggcuuaauauuuuuauuauacuuauucauuaugguauauauguggagguuguguuguauaugugccauagcacacauauaaaagccagagggcaauuuuugggaguugguucucuccuucuacccucuugguccuggcaaugaacccaggcucucaggauuggaagcacuuuuaccaacugaaauaucuugcugguccuugagcaggcuuuuaaagcccuagaaaucuuaaggguuuaucaggaauuuuuguuuuaauauuuucuuuuuuccuagugauuaaagaguaauuuguauugugauuuaauuaauguuaaacuuuugaaaaugcauguuguagggccaagagugcaguucaguaggaauagaaagccugauagagugcuugaggcucuauccccagcacugggcggcaggaaguaugugcacacacacacucacucgcauacacuguguauagucugucaucuugugauaaauuacauuuuuucuuucaagauacauauauugcauaauucucaucuuaaagugguauugauauuccuuaugaaauuauuauuauuauuauuauuauuauuauuauuauuauuauuauuaauuuuuuucaagccaggguuucucuguguagucuuggcuguccuagaacucacuuuguagaccaugcuggccucgaaacucagaaauccaccugccucugccucccaagugcugggauuaaaggcgugugccaccaugcccggcuacggaauuauuuuauuuuauuuuuuuauuggguauuuauuucuuuuacauuuccaaugcuauccccaaagucccccacacgcucccccacccacucccccacccacccacucccacuucuuggcccuggcauuucccuguacugaggcauauaaugugugcaagaccaaugggccucucuuuccacugauggucgacuaggccaucuucugauucauaugcagcuagagacacgggcuccgggggguacugguuaguucauaauguuguuccacuauagaguugcagaucccuuuagcuccuuggguacuuucucuagcuccuccauugggggcccugugauccauccaauagcugacugugagcauccacuucuguguuugccaggccccggcauagucucacaagagacagccauaucugucugggucuuuucagcaaaaucuugcuaguguaugcaauggugucagcguuuggaagcugauuaugggauggauccccggaaauacaauuugcuaaacgcaugaaacucaagaagaacgaagaccaaaguguggacacuuugccccuucuuagaauugggaacaaaacacccauggaaggaguuacagagagaaaauuuggagcugagacgaaaggaucggccaucuagagacuuccauauacggaauuauuuuuaagugaguuagaauacaguauacuaugagaauugacaacuggcucagaaacguggcauuuugugagauauuuuaaguguacacuauugaaguggggccauuacuuacaaauugaaugucugcguucuguuguaaguuacaaauaaaacguaugcuaacuaaauucucaguuaaacuuaucuaccuuguaaagaugccaugucuaccuagugagcuagcucaugcuccuauuuuccagcagaugucacuguugggcugcuacugcugaguuugguuggcagggaagaaaaaggugugcuuaugguuuguguaggaggaagaaucuuacaacagaagcccauuuuuauaggugacuauuguugcuaagugcauggaauucauaaaaggugauuguauuuaaagguugaggguuuuguucuuugcucuccuaauaagagaugggcuauggaaauguuuugcugucuuggcacuacauggauaauugugucugcaaaugcauuacuaagcacaucuguauuccaguagagcucugugcuacugugugguaguaaucagcuccuagggugucuccuuuuucuugugggcagaggagggcaagcuguuuauguagucugauucuagcucacacccugggugacaagccuuuugucucacucucagaaacaucuuuuuggucuaggagaagaucagggcauugugaggacuuuugacuuuugaaaugucuucuuuuuuuuuuuuuuuuuuuuuuuuuuggauacaggaucuuacuauuuagcucuggcugggccuggaauucacagauauucauauauuucucuuucccaaaugauggaauuagaagcacuugucaucaugacugguugaaauggcauuucaaaacuagaagaacccagaguuauuagucccgccuccccuguuccuuugcuuuccuucaaugcuagagauucauccugggaucucauagguacugagcaaagagcuacuaagauuagaggugaaauuugaacuuccagauccugaagaggacauccauucuuccauuuguuuguuuauagacgggcucucacauagcccaggcuggccuugaacucuuauugugaggaucuugaauuucugauuuuucuguugucugucucucuaaguacuuagauuauaguugugugccaccaaucucagucaauauggugcuggaaucgaacacaggacuuaguaaacgguaguuaaacacucuaccccagagcugcaucccuagccccuucacuuuaagacccugucuuaaaaacaaaagguuggguucugagaacugaugcuuuugaucuugacuuuucuuugaugaugcauaaagaccacagacuguagugauggccuuagcauuaaaauuuaguccaaaacaucaaagguuaaguuggguguccucauuggauuuucaaguuucuuagacuuuuguaagaaguuacuuuggaauuuucagguugaaggcccuuugaaguucuguaagccacucagcuucaguuagucacauugguauuuuccagggagccuucaguccaaacaccauaucuggaaggaaauaaauggauauuugaacuaauuauaaaucuacaagagggugaaagcaaccuagaaauuaggcaaguacaaguuuugccuuauuuaaaaagggggucuaauuguuuguuuguuuguucuuuuuuuuucugugccauugaccuaaccguucuuaucacuguuaacuaagugacugacagaacuuaaaggacggacacuuuguuuuggcaaaucagacccucaugguggggaagacauagcagcaggccauauccuaugguguauuaaguaugcaacagcugguuauuauaugguacccaucaggaagcagacaacuuggaccagaacuagaguagugcuuaacucaucugguccuaggucagccagauuggccccauaagguagggaucaacuauuaaauccaagggccaguugaagacacuuauuucauuuucagacuguaacagacagcuucuuuagaugaagaauauucucaacauguuauccagaaccuaguacaaagcugguaagauauaucagguaaaagccaugcaaaccugguaaccugaugucauuagaaugcacagagaagaaaauaacugacucagaaguuacccucugaccucuaccaugugugcaccguaggacacagcucaacacacacaccacacaaagugguuuuuguuuuuguuuugagguaaggucagccagucuugccugguuuagaacucacuauguagaucaggcuggccucaaacucauagagauuuaccugccucugucuuuaggguacugagaugaaggaacacaccaccuuucugcuuuaguuuuucacacaggaucugaucaaaccagaacucaccaauuggcuauacuggcugggugcgcaggcugcugggaucuguccagugcuagaauuagaggcacacgaugcaggcuuggguuuauuugauuaccuuucugucaugagaccacuguaaguaguaauuauaugugaaugccugcuaccccauggauaguaucugguacucaguaguuacuucguuaauuuuuuuuucuucuuucuuuuuuuuuuuuuuuucuuuuuucuuuuuuuuuuuugacacaggguuuuucuguguaauagccuuggcuguccuggaacuugcauuguauaccaggcuggcuuccaguucacuaaacauuaguccacaugccucugccuacugagugcugggauuaaaggugugugcuacaugccccauacuuuauaauucucaguugaauugaguaaguggaauuaaaauuguguugcuuugugugugugugauugaacuugaguggacuaggcagguacucaacuacugagcuuuauucaucucuagccuuuuuguuaauuguuuuuauguuauuguauguacaugcaugcaugcauguuugauauggaguggcauggggcaguggugagcuuuugaaggucagaggacagauuuguggauucuuuuaucuccuucugcgcuuacauggcguuccaaggcuuacuugggucaauaggcuuguuuagaaaguguguuaguuaaguuuucagauguucuugcuaauuugcuuaagcuguucuuagauucacucuguaacccaugcugaccuucucucuuagccucccuaggagguuugauuuuaugccuuugcccuuccuugcccuuuuuuguaagagagguuaaaggauccauuauaucauauucuuuuuauuguaagaauuuuuuugagacagagucuuagguacccuucuguggucucaaaauagcuuaaggcugguguugaauucaugauccuacuuccacugucuuucaagugcugaggcagauguguacuagaucguucaguucuuaucuuuucaucuuauagagaacccuugguucaauaaauggacaugaaguggcacuuccuuaaguaaagauauacuuuccauaaugcucccaggugaccugaacuuguuccuuuauuucacuaugguuccaaauuauaaacugguuguucugaagccuguaugaagucucuggcaucuagccagaugcccuucacauugauugucuauugaugacugagggcacuguaugaagucucuggcaucuagccagaugcccuucacauugauugucuauugaugacugagggcauucuuuggcauuggcauuuacuauccuggugauacuauuauuucuacuggacaaugcuguuggaauuuuuuucuguuugaagaaauaccugugaacagcuggaacucaguugguagaaugcuugccugguauuugugaagcccuggguuguauccccagcccugauuuauuaauugugguaguauaugccuguaaucccagcccuugggagaaaaaaacaggaagauuauaauucaguguuaucuuugcuggucaucuuggacuacauaaaacucugucucaaaacagacagaugauguuaaauuuggccguaccugcaacugcuuggagcaaccuauuguugggcuauauuuguggucucaauaaaguuauccuugaugaaguucaagugugaauaaucagaauuagauguguaaugguuccguuuccuguugcuauuuuauuuuucuucuaguuuuuguggaaaauacuggauuuucucugacauagauuguucagguuuuggaaaaguguauacuuuuuggcaggaagagguucuaagcaucauuauaauguaauuuuauuuuguuuuauuuauuuuauuuuuugaaguguuggagauagaacccagaaucucuuccuguguucuguaucucuguauacuguguacccauguccaucuuuaaaauaaaauuguuuauuuggaggagacaugcacaugacuggagugcucagcuauaagaggauagccugugggagccauggcugcucugucugcuauaugaguuccagggguugagcucagggauugagcuuugguagcaagugccuucaccaacuaacugagccaucuugauaguccaucaagaugacucuagguuuugguuguaguuauuuucuuuucaggaugcagaauccuuauauaaaaauuuuugcuuaaucucuaagaauacagaagguuagcuaguaccucuaaaaacaaccugugaaauugugguccuuguuacucaaaguacaauaaacuuuugaauuaauauucagaaucuuggcauuugggaacaaagaauagagaauggucaaucaagaaaauuucauuuaugcacaaaugaugacuuguuuuuauuuucuggaaaaaaaugagaacaggaacaggagcaaacccuacgguaaaguuaagcaguguaguuuaugagacacaaagagaagccaagaaaagcuaaacccaggccucagagggauuucuaacaaggccuuccucgccugugaaacuuuggaucuuauaacccagaauaacagguuugcaaaguacuuugugauugaucuauucaguuauccauguauucagcuaacugaugagaccauguguguucaggguuaauauuauuugguuaauagauacuugcuaacaguuccuguauaccaaguauucuuuaaguaucagcagagaguaucucauucuaaggggagaaagacaaaaagaguaucaagagugcuagauggugacaaguucuauggagaaaagggacucacauaaaaagguguagggugugugugguugguugcaguuuacaauagggugauuagaggaaauaggauucgguagcauuugagcaguguccucagggaauuauaggaacaaacugucaacauugggaguaggagcuucauaaggaaauggacaaauucagcauaccugagaacucucucucccuauucaguaggagaugauguuggagaggugacaggguuguuauauagacucuaagccuuuuaaaggcuuuuacucguuuaucugauaugucaucagauuggaaugauuuuauauaucaaagaucugacaucauuguuguuauuuuuggguggugguggauccuaaggcccccuacauauuaaacagauauuuuaucauaguccuaaagauguuguuuaaaaagaugauuuggcugcuagaggagaauagaccaaagagugagauaacacaaauuaugcuagcacacacuuagggauuauuuugugucuuaggcuggugaaagucaauaggccagagccaccagcugucagaauagcacuguuguagagcacuugcccagcaugugaaaagccuugaguuuaauucucaauacuagagugaagagaagaaaagaagaaaaggaaaaagaaaaaaaaaaaagguuuugaauguguguaggaaggguaucugaauggaugaacagagaaucagucaucuucaacagugcucccccacaacccccaaaucaaaagauguauuguuauaaauaugcaaaacggagagcuuggaaaauuuauacagagcaaagcuucauaaguggaaaugccuggguuuuguugcuuacagaacuaacauagauuuacuuguuaaaaaaacugaaacugccgggcagugguggcgcaggccuuuaaucccagcacucgggaggcagaggcagguggauuucugaguucgaggccagccuggucuacagagugaguuccaggacaccuagggcuacacagagaaacccugucucgaaaaacaaaacaaaaccaaaaacaaaacgaaaaaaccugaaacuuuucagaaaugugcuguaguuagagaaagugaaguucucugcaaagccagugcugaaagauaacaacugugaacaauccugugucacccaguuguuuucuauacagacaaacacaguucuuuccuuggucacuuaauucucauacuguauggggcauguuuccacguuugauaguuugacauuggcacaguauucuagcaguaguuauuuguucccugugaugugaccuggauggcuuccauuucuuuauuguacugcugggacaugauuuguauguucauacauauauuuacagaagauaaauuucuggaaguggaauugccagggccaauaauuauaacugauaauggcaaaugauaauuauagaguauuuauuauuacuaguuuaagaugaccuaaaauuucuucuauuuccuguuuuaucuuauugaacauaauuucaaagaucaguauuugaggaauauuccuauugauccuaaauccagguguuacguacuuucuguacucucaugcucacaagagaaaugccuagcaucucugacaucagaccacacaggcuuugucuuaugaaacgacugcgaacauccagacagcuguuugcuaguuauaagacuagacugccuaccuagucucuuauaccagguaggcaacucaaugcucuuugguaauauucuuugguaagaauagguagaggagagguauaauuugauguuauucuuucuuacuuuuucuguuuaccuacuuuaagguuuguuuaguguuuugagaaaaaaaccuaaccagguuguucuccugaguuacucucccaagcuuuagguuuacagguaugggcaaaugcugucaguugaucacacaguccuguuugcuaagcagaugcucuaccauuaaacuaucucagucagucugaauucuaggugugaucauuuuucuucuuucacauuaggguuggcaaacuuucuguacaggacaagauaaacauugacaagguaaauauuuuggguuuuguagguaguaagaauuuuuuguuuuguuuuuuugguguguguucauacgguuuagugugacaggguuggccucucuaucucugucucuuucugugugugugugagagagagaggguggguggaccucaucucuuguaagacuuuucaguggccaagaguaggcauaagagccgaauguguuaagacaagccuucaguaccugaaugucugaauuugaggauagccuggucuacagagugaauuccaggacacccagggcuacacaaacccucuccagaaacagacaaacaaacaauguguauauguaauugaaaauuuccucuucauucuuuuuuuguuguuuuguuuuguuuuguuuuuuuuguuuuuuguuuuuuuguuuuuugagacaggguuacucuguguagcccuggcuguccuagaacucacucuguagaccaggcuggccuccaacucagaaauccacuugccucugccucccaagugcuugggaucaaaagcgugugccaucacugccccacaagaauuuccuguuucuuauauuaucuaccuugaagcagucaucuagcuucacuaaguuuguuuugggagaauuuuaucagugaggcaguuuagaaagguaugagccuccaggucuugggggggggucgggucgguggaggagugugggugugugccugacaaacaacccuucccucacugaaggucaaauuagcaucugguagggcugagcuaaauuaucccucuugcuucucugaggcugaaugguguagagcaggccaugugcuuuguguacacaccaaacugugaaaagauguaaucguucugucagcccaggguauuggaguuccaaggagacuauggugaauuuuguaugugugcuguaaauacacugagagaaacuucucauguauucaucccccuacuuugguccuccuucuuauugucuauucauugaaaucuucuaaaggaaauguugaaguguguuucaagacaccagguauaggggauucuguuugcauaauauauauauauauauauuuuguuuauuguaaugggucucaguccaguagagcuaugcaguaguuuccccuucuggauuacucuuccguuuguguguguguuccaguauaucuuauguuuacuucuuuaaaaaauuuuuucuuugcguguaugccccugugccugugaaguccagagaugccaaauuucuugaaacaggaguuucacaugguuuugagcuaccugauauagggaguggaaacugaauuccaguuuucuguaagagcaguaaugcccuaaccauugggcuaucucucuaguccuuuugcucauuucugauuauguuugugcuucagggagugggccuguuaaauuaaccuggagaugacaaauaaguuuucaaaguagaucuggcccauaagauguuucuaaaauuuucaguuucccaccuaaaucuagauuucuagauuuuuuuggaagggaaaaaaaaccaaaccauaaaauaugacaacacuaauaugcaucagcagcauuugaaaaguuauuccucaagccaagacaaagauuuuuuucuucuguguuuuucgagucaaagucuugcuguagagugaaggcuggcuuugaacuaauuccauguguagacuaggaggcccucaacuugcuccuccuccccacuguguaguguaucccagugcuauuacucaggcagaccugcccuggccuuguaguuuccauacugcugcccuaccuccuccccuaagauuacaggggugcuggggaaaagcauagaccuuucucccccuccccuccguuuuuuuuuuuuuuuuuuuuuugacagguucaaaaaacuuaagcuagccucaaacuucugugacucugaggaugaacuugacuuucuugccuaugccucccggugcuggacuuacauauggggaauacguggcuuggcaugaccuuuuugccuuugucuaccuacacuaggcugacuucaugguucuuaagucaauuuugugugugagaucauugcauuuuauugaugauuagggauagaaauagcauuuucuaugugcuuccccaugccguuuugccagagggaggcacuaaacauuagacccuugcuucuacaagaucuaucccaccuaauugagccauagaggcuucccugcuaguugugggcugacaugcugacagcccucucaccuaagaaacugccuggguuuuuaauagcaacaauuaacaggcucccccucucuuuccagaggggaaagaagagggguuccaagcugauuucccagaugggguucacuugagugagcaguucuccauuuugugaaguuacacagaaugagaacuaccuucauuuggacuaugugaguagacuguauaaacucuuucucuauggacagaccacccuugacagacgggugacgcaugauuugguuguuaccugccaggaaauuaaaaucaagugagaacaagaguggaaaauaguauuaauaaaagacucuaaggcugaaauuaugaccuugucauugauaguuaagcuuguugacaccaugccccuugccuuugcugcaucaaaucuuucugccucuccuuuuucucuucugcaugaccacagcuucugcagcugccuuuucugcuguccuuuuuauucacuuugccugguaaaguagcuuguuaucauuuuuucuuuguucugguggcagguagaacccccuucccauaugugacauggauuacccucaacaaaauuucaaguauauuguacaauauuagcuauaugcacuuucagcacuggcuuuacagagaacuucacuuucucuaacuacagcacuguguguguguguguguguguguguguguguguguauuuuuucuaaauauaacucaguccauaucauguuacuuguacguauguuuucauggcugaccuuuuggcacuggacaaccaauugguguguucuuuuuugggaagaccaccucuccugcuuccagcuuuccuuaguugcuuauagcucuuuguguaguguuguuaggaucccaaauguaggcuaucuccuuaaugacaugacccuuuaaaacaguucuucauguuuuggucaccuccaaccauaaaauugcuuuugcuucugcuucauaacuauaauuuugcuacuauuaugaaucauaguguaacuguguuuuccagccgucuugguugaccuguauaaggguuguuugacccccagaggagucgcgacccacuggacuagggugagggucacugaaccuuuuugcucuucuucccaguguggggauguugaguaaaucuucuuuuccuguuuucuacuguuauuuauuggaaauagauggcugaaccucucucugugugugugugugugugugugugugugugugugugugugugugugugugugugugguguguuggggguugcuguuagagcacgagcuaacaguacucuuuguauauuuuugcuuuuguugcuugugcuuuugaugucauauauaacaaauuaucagcucuucucgugucgagaagcuuuucuuuaggaaucucauaguuucaguuguuggauuuaaucuaccucauuuugaguugcuucucuagguuauguaaugucagggcucaucucugcaguuuucccagcacugugugugugcuccugguggccuuguuagggaucauuuugccuuuuuauaccuaaacauuuauuuuuuuucuccauucuauuuuaauagucuauaugggucuuuacauaaguuuuucccguacugccuugauucugguagguuugcaguuucuuuugaaauugagaaaugugagaccauuuguucuuuguuucuuuucucaguauuuucuugacaauuuaagguacuucagacucuuuuguuucuuuuuuaaaaaagaguggggaguuucgauuucgauaggauugcaccgagucuugguuauuuaggauauuauuuaccagcagcuuugguuugagaggcaccuuugaaugagauccugguucacugucuuagaacuggauuuggagagaaacagguggauaguagcaaaaagaaagacaguuuacuagaaaagaauacacuggggcaggaggaacguuuguagcucaaguaaccaggcuguagaaaagauuagggaguucaugucacauuucucacacaaguuuucuguaugcaucucacaucucacuagcaucuuaaaucuccaccuaacugugugcauuuaguacugaguccugggucacuuucagauacucugaagugccuucucugggccacugucucuagcuagcuuucuucuuuguccacaguuuuuuugugauuauagauauguauuugccaccauauuuguuuguuucaauguauuuuuggagaauccuggaggaucuugagccaacggucaacuugaacuaacuagggaaacuugugucucaggaaaaaaaaacaaaaacaaaaauggcaaaaauuucauaauuaagauuugaaauuuggagagagggguugaaacagugguacucuguguagcccugacuguauugggauucucccuguagaccuucuuggccuugaacucaagagcucuccuugccucugcuucccaaauucucagaugugagauucuucaauccauaaucuaugcaaauauuccuaaaucuucaaaccuccaaaauuaggaacauuucugguccuaagggauacuccaauagcaagaacuugguauuuauaguguauauuaguggcuggauggacuguuauuacaaaacuuuauuuggaugugguaugugugauucuuaugguuuauguuccuauauuuaaccuuuauaguauuaaucuucaaaauauauuucugaccaaaccccuuuuagacauuaugaguugaauaagcaggacauuuuauauuccugauauauauauauauauauuuauaauccaaagaacuaaaaaaauuggcugaauauuggacuacacauucauguuugcuuaguauuguuuguugguugguuuauguuggacauuaaauccagggccuccguucaugcuagacucaaccacacucuauuucugagcuacauuccagccuuacauguguucuuauuucaucauaaaaauuuaugagauggggauuucccaucaaauguggaaacuaagaauaaauucuuagguugcauagccuaagagguggugauacaagauagagcuuaagcugcaaucugccuaauucugaaacuuggaucccagauuucuacccauuuuuguuguuuagaauuucuguugcuuaaacucagaccauuaaaauaugucaaagagguuuagcaacaacagcagucuugccauuuggguuagauaacccuucacugugggaggcugucucagucuuugaaggguguuuaguaguacuccugcuguuacauaaguaacacucccccaaaccaguugcgacuaccaaaaaugucuacagaaaucgucaaguguccccuggggaacccuccuccagaaaacacugauaaaguguuucauggcuuguuguccuuugaucugucugcucucuuacugaggcaucuugaaaggaacuggcaguggcuucaaaguaucuucuuaggguaguuacagaagccagagcucugguggcuucaugccuuucauugcccccacuuugucuuuucucuuuuguuugugauuuucuuaaauaaaaugcagcuggauaaagugguauuuaugaaguuuuuuuuuuuuuuuacacagguauccauucaguagacauucagaucacuucaauuauagccauuagugcuaguaaaaagaaagcaauuuacauguucuaauuauaguggggacuauaaaauuuuuagcaagcuggaaaugaaauggcuuccagacuccucagaguuaaucuucaucaggguuguaugauugacaugguggaggacguuaaugugcaguucuuuuggggaacggaggaggagaguggaaauugcaguuucucuacuaauuguacuuuaggugucucuuaugacaauuucauguugucuagacagagggaaaugguagagaaguuauuccaguggauucucaggugcugaguccggauuuaugugguugcuaaucaagaacaggguggaagggcaaguagaacauccaggaggcagauugccaaagucagcugccaccaagagaagcccucagaaccccagauaccaaaaaaaaaaaaaaaaaaaaaaaaaaaaauggccuguacucccagcucuguguuaggucaaggacuaacuuguuacaugaggaugugagcuggaaaagcugacccugugauggcuaauaaaacccagccuacccugcuuucuuuuacaucucuuguaaggcucuauuugcuuccucuccuugccuuucugguuugggccuaaagauuuuacuucucauuauauaguauuuuaacuaugugaaggucaagucaaagccugcuauuuaaaagauguuuuaucacaguauuuuauguauauggguguuuaccuggcaaguauaacugugcaccaugugcaugccuggaggccuuaagagaguauuggauccccuggaacuacaguuauagauaguugcaaaccaccaugcaggaaugaaacucagguccucuagaagagcaugaagugcucuuaacugcugaacuacuucuccagucuugguuguuacucuuuuuuuuucccccucucauuuauuuuggccuuguucugaauuguuuuguuuuuguuuugucuuguuuuauuaacuuuuaaagacaggguuucuuuguguggcucuggcuguccuggaacucauaauaauccccuugccucugucuccugaguacugggacuaaaggugccacccaguggcuauuacuuuuuaaugacuggccuuagucaagcauuuuuaaaucuuuaguuuaguaauaaagaugugaaaaacuagcuuaggagauaguuacauguuucuugguauugguucuaucgacauguucuuuguagaauuaauggguuuugagguagauuuuuuaggauuuauaugaaucaaguuaacccagcagucauaguuguggaguucuauaaaucauuuuaugacuuuaggggaacaaguuaggaugcacgcaacccccuccccccccccccguauauguugccucauaaguaagguacauuccagcugcagcuugugagaugugcaugugaauauauagaacuacuguauaccaggcuguuuucagaguucugcucuuagguaacaucuagugaaaaagucucugauuuaaauuccugauucuaaaacuggucuggggucugugaacaacccucccaaguuucucagagauauuguauaccucagcuuguaccuuugaguuaaauguagacaaaagugauuuuuucauuauacauuggaaguuucauagcuauauuauaauauguggaggauuuauuacaaagccagcuaucaaagaggagugggucagauguucccaaaggggucuggcuaacuuuaucuagaucaugauugugaguuagguacagauguugugcuagauuacuugugcucugauguuucacugucugcugcucauuacccagagguauugcagaauacaguacugcuugguaaagaugguuuuugugcuuuucugguaaaaggcauuguuuugcauguccugguuuguuuaagcuugguuauaauaaaauaaagcuguuccauaccacagacaucaugagcucucucuguaguaugucugguugccuucccacaucaucccuccccauguuauuacccuuucagcuguggaccuguuuuggucucccucacagcagggacaggauuugucuguccgguucuguuggcaacugcaccauguacucuugagugcaccccuagaacuacggggcccuacagugaucagaugaaugccuaucauuggauaacuuaaaugauaauugcuagugugugaaauagggaggcuuugaugccucugcuuuaaaucagagaugucaacuuggaaaucauaauagaggugucauuucagaacacacaauuauuauuucuuuuuuuuuuuuuuuuacaaagaauaaagacuugucaucucccauucugggcaugcgcugagacagagaucuggggcuuacagagcaagauuaagaaaucuagcaagcaacauuacauccaagauucuuugaccuacugccucuuuauccccuccaaacauugcccuguuucuuuaagaggucucuugagaacuuauagucuaggagcaucaacggucauuuccuaggcaagaagccagcuucugacuuuaugauuuaaugaaccuccaagggaucaggcuuauuauguuuauuaggacaacugugucagcacuuuaaccucagggccuaagugaccaaaaggauaaaggaugauguauaagcaguuuuuaaaaaccuuccuucaugaauuuuuuuagugugcauuuuuugacaucucacauccuuguuugagacucauggggucaguaaagaacaaucagauaugcuuucuuucuuauucuucccagucuaguuagacugccugcugauucauaagcguggauauuuauuugucuccuauuacauguuaauuaggaugugaauuuugauggugauaaaaagaugacuuggaaccaauaccagcuuuuauguagcuuguaagucuaaaagccgacacagacauguuuauaaauaaccgcagggagaaggucugguuuuguuuuguuuuuuuuuguuuuuuuaaaaagagagccuguuuauguagcccuggauagccuggagcuuacgauaugaaccaggcuagucuugacucacagaaaucuaccugucuccacuucucccucucaaguguuggaauaaaaaguguucaccucuaugccccgccccaggagaucucugucucuuaagagaguuaccaaauacuguggaguauuaagagaguggacuuuuggcaggagaagcuagaagugaguuuugaaggauuuuuuuuuuuuuuuuuuuuuuuuuuuuuuugguuuuuccagacaggguuucucuguauagucuuggcuguccuggaacucacuuuguagaucaggcuggccucgaacucagaaauccuccugucucugccucccaagugcugggaucaaaggcgugcaucaccaccgccuggcaaaggauuuuuauaugcagcaguguauaguuuaucuguaacaggaguucucaaaguauagucgggaacuccagaagucuagagccuuuucuuuuuuuuuuuuuuuuuuuuuuauuauuauauguaaguacauuguagcugucuucagacacaccagaagagggagucagaucuuguuacggaugguugugagccaccaugugguugcugggauuugaacucuggaccuucggaagagcaguaagagcagucgggugcucuuacccacugagccaucucaccagcccucuagagccuuuucuaaauguugagauguccuuugucuuuucacuacauucuuucacggagguauugugggguuuccuagaccacauggcauauaauguaauuauauaacugaucacuaauugagaauaugugcucuuaccauuuauaauuugaaauaagguuuuaaguauuaguagaucccauauuuuuaaaaaguuguuggcuccaugguuuugaaggaguucugagauuaaaguaugaaaacaucugaauaaaauauccaaaaggaaagggaaauuucacuggaaacuugcucugccaagguacagcauuuaaauuugaguuuuuaggcauaaggaggcuauugcuuugcauuuggccccugaauuuaaacaguagaugucccauagacaagguaagggaauuaucccuuuaaggcauggggcaccagugaggucuucugccugcagaugcugcacagcucugacacuugauguuugcaccgguuggagaaggccugaacauguuuguugccuuaggauacugucuuucuuuguaaugugacaaccagggucaauuguuuaguaaagagguguugucauuacuagacuacuucagacuuucugcuucccaaauuuugguauuuauuaaauuuaaaauaaaaguuuguuuugguuuauucauuuguuuuuaagaagggguucuuguaguccaggcugguuucaaacuuauacuacgcugaagaugauccucuuccuuccaacugcccagugcuggaauuuuugcacgugccaccagauccaccugaagguucucuuucucuuccggauaaucugucucauaucccuugaccacauuucaccccagaguuuucuuuuauugguuuaguuuuuucuuguuauuaaagauccaugugaaacagagaaccucuugaaaauguuuuuaauacuaaucagagaaaacauucauauaaaauguuaggaauuuuacaauuugacuugugcccucugcagagcuuaauaaucuuuuauuauuucggugaggugcaguuagaaccugaagucaguaagccauauccugcaguccuguucuuucuccuuuacauagucagcuuuacaaggcucccucucucguacagugaguuguauccuccaaucauguucccaccuuagcccccaggaucuuguuauguugcccaggcuggccucuaacuuuugaucauccuguaauaaccaaaggaguagcuagaauuacauugauaggcugucuuucaaagaauuuuauguaaguauguacuuuggauagaaguaggagagcuuuuucuucaaagaguuucuucaaagguaguaaauauuuuaggcauuguuucucucaguaucauucaacucugucuugguuccuaccuccaaaccaggugccgauuauauacauauuacaugcauaugugauaaaguguguguguaugauaaaacuuuauuuuaaaagcucaacucagagccuagaauuuaucaaacaugcuuuagaacaguaggguaaugacauuuuuuaagcuauacauggugauacaugcuuuuaacagcaauuggaaggcagagacggaucucugugaguucccagagagccaggguuauguagauagagguuacauuuuccugccuuaaaaaauaaaauaauaccaacaaaaaucucuuuuagaagccggagagaugacuuagugguuaagagcauuuacuacucugacaaaggacauaaauucuauucccaccagccauauuggauagcuugguuauaagggccuaagccacagccucaggggagucaauguccuuuucuggcuuuuauggguacuuauacucauuuguauauaccuuauaaugacaugcaugcauacacauaauucaaaauagaaauagaggcuggagagauggcuuagcacuuaagagcauggcugcucuuucagaggacccugguuuaaauaccagcagcaccuacaugguggcuaacaacucucuauaacuccacuucccagggaucuggugcuaucuuaacaagcagaaaaaccaaguaaauuuuuaaaaaauaaaaguaaacuuuuaaaaagcuuaaaaugggaacuggcucagcagguaagagcacugacuccucuucugaagauccugaguucaaauccuagcaaccacaugguggcucacaaccauucauaaugagaucugaggcccucuucuggaagacagcuacagucugcuuacauauaauaauaaauaaaucuuugggccagagcaagcagggccgaagcgagcagagguccugaguauaauucccagaaaccacaugauggcucccaaccaucuguacagcuguacuguacucauacacauaaaauaaauaaaaucuuuuuuuuuuaaauuagguauuuuccucguuuacauuuccaaugcuaucccaaaagucccccauacccacccccccaauccccuacccacccacucccccuuuuuggcccuggcauuccccuguacuggggcauauaaaguuugcaaguccaaagggccucucuuuccagugauggcugacgaggccaucuuuugauacauaugcaacuagagacaagagcucccggguacugguuaguucauauuguuguuccaccuauaggguugcaguucccuuuagcaccuuggguacuuucucuagcuccuccauugggggcugugugacccauccaauagcugacugugagcauccacuucuguguuugcuaggccucggcauagucucacaagagacagcuauaucuggguccuuucagcaaaaucuugcuaguguaugcaauggugucagcguuuggauggaucccuggauauggcaaucacuagaugguccauccuuucaucacagcuccaaauuuugucucucuaacuccuuccauggguguuuuguucccauuucuaagaaggggcaaaguguccacacuuuggucuucguucuucuugaguuucauggguuuaccaaauuguaucuuauaucuuguguauccuaaguuucugggcuauuauccacuuaacauugaguacauauugugugaguuccuuugugauuggguuaccucacucaggaugaugcccuccaaguccauccauuugccuaggaauuucauaaauucauucuuuuuaauagcugaguaguacucccuugcguaaauguaccacacuuucuguauccacuccucuguugaggggcaucuggguucuuuccagcuucuggcuauaaauaagguugcuaugaacauaguagagcauguguccuucuuacugguugggacaucuucuggauauaugcccaggagagguauugcgggauccuccgguaguacuauguccaauuuucugaggaaccgccagacugauuuccagagugguuguacaagcuugcaaucccacuaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauuuuuuguucagcucugagccccauuuuuuaaugggguuauuccauuuucuggagucuaccuucuugaguucuuuauauauauuggauauuagucccuuauccgauuugggauagguaaagauccuuucccaaucuguugguggucuuuuugucuuauugacggugucuuuugccuugcagaagcuuugcaauuuuaugaggucccauuuaucgauucucgaucuuacagcacaagccauugcuguucuauucaggaauuuuuccccuguacccauaucuuucccuacuuucuccucuauaaguuucagucucucugguuuuauguggaguuccuuaauccacuuagauuugaccuuaguacaaggagauagaaauggaucaauucgcauucuucuacaugauaaccgccaguugugccagcaccauuuguugaaaaugcugucuuuuuuccacuggaugguuuuagcucccugucaaagaucaagugaccauaggugcguggguucaucucugggucuucaguucuguuccauuggucuacuugucugucacuauaccagugccaugcaguuuuuaucacaauugcucuguaguacagcuuuaggucaggcuugugauucuuuuuuaaaauaaauaaaaauaaaucuuuguuuuaaaaaaaaguuaaaauguuaccuugaaaaugcuaccucuuuuagucuuuuccuuuuagauuuuccuaaaauuucuaaaaauucaaagauuuuaaauauuggauuuaauuuucuuauuacaguuauuuuuguguauauauccaugcacacacaugucaccuuacauauguggagguuagaggacaauuugugagaguccguuuucuuuauccagcacguggauucuggggauugaacucaguugccaggcuugauggcagggauggaucuuuacuccgagccaucaugucugagcuauccuuagacccuugacuauugaggauucuaauuuguuguuuuuguuuugagacagggucucauauaggccaggauggucuuggacuuacucuguagccaugaugggucuugaacuccucccugauccuucuaacuucaccuugugaauacuggaauuauuaaauauguaccgucgugcucauaucuugugguuuucuguuggggggguggguuucuuuauuuuguucuugucuuuguuuuguuucuuuuuuugaggcagagucugucuauguauuucuggcuguccuggagcuagcaugcagaucaggauggcuucaaacacaagaagauccucccaccucugccuccugagagcuggaauuuaacauacacugucuugcuguuuuguuuuguuuuugacaaagggucucacucugaagcccauccuggccuugaauucaacagcaguucuccugccucagacuuguaagugcugggaccacagaucugaaccacuaugucuagcuuuuaauuuaauuuacuuaucugucagggucucaaauacugaggcccaggcuguucauggcagccuuacuuacuuacuguucuugccucagucuuacuuacaaugggggggaucagaggugucagcuaccaugcuugacuuuuauuuuaaaauaauuucaauuugcagaaaaauggcaaaaauaauacaaagaauucucaaauguccuuuauccacauucucuaaaugcuuggauuuugccacaucuguuguauuacucucuuuuguucucucuauaucugaauaugauuuuuuaugguuggcuauuguuauauucauauuuuauauuuguuauuacguuuuuaaaaaauauugaaucaucucauuaguuugauagagaaguggccuuuaugcuuucuaaagaaugcuguuauuggugaaaggcuuuuaaguaguccucguguauuuuacacauauggcuacacauacagcacaaauuguaguguuuucuuucuggucuccaguaauucaagguaucauuacccuuguacuucacucagccacuucuggaauggagaauuacguagguaagcuguuagagaaaagacaguuuauuuguuuguuguuuguucuuuguuuuugucagagcuuuggugacuguaaaauauuucuacauugagauuacaagucagaaagaaauggcaacuuuaagccugaacaaguuuuacugaaccucccuucagcccuuccugauuucauauuaccaaauugugugauagaucauuaagucgucauauuugugugccagaggagaagaagguagagcauagcugcuacccuagccuauuuacucauguuagucuccauccuucuguccccugcacggagcugcuacuaggcgggagaacgcuuugaggauccuaggcaugguagugguaaugucuacucaucucauaacuccaguucauucuuuaauccacaucaacugagaagccuauuuuuuuuuccuugcagaaaauuugucucaucagugauuugugugugugaagaaacauugcucaucugaauugauucucuugauuucaaguauuucucucugucccucgcugucugucugucugucugucucucucucucugugugucucggucucugucucucucucucucucucucucucacacacacacacacacguacacacacuagggcuguucuguccuauugcauugucuguugauacaaagcuuaacauuuugaugguauucugauuaccagaagucuuccugauuaaaauagaaaguuaggaugggaacuggaguaugcaagauaucaaauggagucacuaaaauugacauuguguaauccagauuguucuaaauuuaggaaucuucuucuuuuuuuaaauuuuauuuauuuauuuuauauauauacgacgaauaaacuguagcugucuucagaugcaccagaagaggauaucggaucccuuuacagaugguugugagccaccaugugguugcugggaauugaaaucaggaccucuggaagagcagucagugcucuuaaccgcugagccaucucuccagcccaggagucuucuuuuagaaucccugauaaaccuucucaucucucucugagcucuaucacugccuugacauaguugguagugggcaauauuuguuucauaacuuauccaguucauugucuacacagaaguacuaaagcaggucacucugaagccuucucaccaaaggcccucugcuuacuaagcagcuauuuagaguaauaaucagaggucaggaauacucagcaucacuugcagagcacuuuaguauuggguugaacagucuuauaggguucuaaaggcaggcagcuguuccuagaccuugcuucauucuucagcucuuacccugcucucagggaaugauguuguuaguacuauguaggugaaauaauagguuggucaguggguuuuaaguuauagcucagaacaaaaaguuuuuacugggaugucaguaaucucagcauuuugaggccagagacaggaaaauuucucaaucugggccagcauggacuauaggccaugucucaaacaagggggaaaaagugcuguugcagaaggggcuuaacuauaauaauauauaauauauuguauauuuuaagaaacuggaaaaaaguuuugacaguuuucaauuaaguguuaaaauauuugaggaaauaaacacguuucaccuguauguuuuuaugugucaguuaagaaauaagguuuuauaaagaggaaguaaaugaccuguauaauagccuucucaaaaacugacuucuuuuuugucuaguugauuuguuaguacugcagacuuucccuaaccaucacaauguuuuucauuugaaagaucuagauaugccauuauuuuuguugugauguuagaaaagagaaagaaacaugcuaguuaaucuuuaucgcauaauuuaagauguaccccaauuuaugacacaaugaaaugugaaaacaguauguuugcaacauuucugcugaugcaaacagugauacuaucagagagaagguguauuuuauucccuucuuuccuucuucauugguuauauuguauucuuucuauuaagugcuagggcucuuugaaguuuggucaugugggccaugucucaguagaaaauauguguuuaaugguugcuugucccaggcaggauggguaaagcuaacgugaugggcgucaauuguuuuugccuuggcugugacaggaaaugccauugugggucaguugcugggauagugacugcccaugacuauaccuaaagccagcugguuuuaauaacacugaauuuucuuaacucaauuggaaaagaaggguagcugcuguucuuauccugcagaucuguuuaaggaggaaucuggcagggagccggagaccugcuccugggagagccaggcaagaugcuucuggagaggaacaauaugcaauuuuuuuugagaccacuuccuuugagaugugcucugcacuaggagguuaacugggugccaaaucuauaucuauaucuauaucuauaucuauaucuauaucuauaucuauaucuauaucuauaugaaugagcugggaaguaguaugguagaccaggaagccuguggaccacaccuguuuauuggauguguuuuaaauaaccuuuaauauuuaaauaacuuuugcuguauuuaaguuugcuaaaauuuaaccaugaaauuucaugcagaaauccagauuuuggcaauacaaaaucagacaauccagcaauacugagccuaguuuguagcuugguaauauuuggcuauuccugagugauaggauuccagucuuccuguuugcuaguuuuuauugcucauccuggcuacaugcaguaggcacuuguuaccuaccuagccucuggaagacuguauaguacaacauagagauuugaaacccaugggaguuuaaacaggccucaugggaaucccuaauaguuuuguguuaugggcccauguacuuaagucucuagucccaguguucuuguguauguagaagaucuugugggugagcuaaggccugcuaccccaaaaaacugccuaauaaaauguguguuacuaucauuagcuggaauuuaugguggggcaggauaauaaaagaaaagguuuuugccaguuauuaugaggaucccaauuguucucuuucucacaaaaagaguguagguagagcagaaggaguagaagauuagggaguggacugugaugguguacaggagccaauugcuaggauaaaugugugaugaucucucuguaugccucauuuuccucuuauguugcuuuagccuauuugucugcugaaggagcuguaaagagguauaagaucauguuucugcugccuuugccugcauuucagugaggagcagcauucagcauaauacagugguccuguccagugugggagcucuggagcucuccauuguuaauguuucuguaugacuagguuguuggaaggguaacaccccagauagaugcuagcuggcugugaaggggaucuuauuuaccucucccccauuucucuuaugauugagcucugaguugguaauugacagggauuauugccaucuuuuuaaucucugcuaggaggcugcuggagucuucccucauuucauuaucccguuaugauggagcaggauccagagagcacccaauuuacccagacccagcgagguaaggccaaaaugagaaauggcacuaggagggggggaggggcggcccuugggguugccaaguugugggaacccccaccugugccucucugguccuggugcucuguugcucuuuagucacagcauugaggcagguguuucaggugauuggggauuguugcagguaagugaauggcaucucuggugacagaaaauuauaauugcgcuauuguccuuugggacucugucugucaguggggcacuaggguaccuguggagggcauagguaguccuuccuacuacucaagagucuguuggcugucacauggacaaccaaaagaagagccaaaguuuugagcauuuuauuuguagggaagauaguuauauuaaacaaauuuacaauaucaaaaggguaaaaaaaaaucaagucaauguuuagacacuuucccaaagaagagaugaaggaagcauaauggaaugaaauugucauuuuacugaagugcuugcuuuauucuguuuuaggagacauuugaaagguuauugaagacccugaauguguuuguguguguuaugcauauguguguuugugguaugggcacaggcagaggccacaugaagacuuuggagucuuucucuguucuucacauuaucauuuuuuucucuuccuccuacuccaccaucaucaucaucaccaugacaucaucguucauuuuugagauggcauuuuuuacugaacuagaaacuugccauuguaucuagacauaccugugaucugucuuucuguaucuuguauugcuggggucacagauaccugugucaugcccaguuuuuacaugggugcuggagaguugcacacaggcccuuuugcuuuuacagcaaacucccuuauccacccagucaaauauuuuucuaagccugaaguuuuuaaaaguuaggggaaagauguuuuucauuugagccuaagggaccauccuaaagucccuagugcugaugguggcgcugauaacaaaaccaaagcuggaacauugaguuguauuacaacauuuaucaguaaagagcagacucaggugguugucauagcuggauuugaugacuuauuagagaucugaaaaaugcuaacuugacuauuauuuaaauaguaucagaaaaagcuauaaggaaaaggauaguuuacaguggugggcuaggcaagucaguaguauaggccagauaaaacuaaaugagcuuucccgucuaucuggaaacaucuuuaaagaccaauuugacucuagagauaguaaaugauuuuguuguugccacaguuuaguugcaguagugcccauucuuaccaagauaguaguggaacaaaaacuugccauggccucuuacugucuuuuccauaucccagaaguagcaaauccaaggaucuagacaguagagagggauggggacauuaaaaauagauaggcaauucagauggugauugaagcaaggucagcuauauuagucucuaauuauguuggaaaacauacaaguccuuaaaaagggaagggaaaguuucacauuuucgggaaccauaaaagacucgacacaacuucuuuccauaaauaguuucuuuucaugcugugacauugcacaccuuuaacuccagcaguugggaagcagagguagguagaucucugugaauuuggggccagccugcucuaccuagugacuuucagauauugguaggaaucucauucucagaaauuuuagacugggaaacuuuaacgauuuguuucggagacagggccagauguacagccugggcuaccucuaggucacuguguagccaauggaggcugguuucaaacuuuugaucuuucugucucugucucagaauguagagauuacagauacugcccuuucaugcagucuguuauuaauuccuacucugauuucuguccuagugaaaggcuuagauaccuaagaucucacucggaacacuuccugguuguuggaugguccuguggcugcucgguggaggguauuuguaccaucuucucacauuaacucauuucuuucuccucuuaguuguguucuacauuauacggauagggaaagcuuuugugagacauuuucuaaaacaugcagaaaccuuccuucccaccuggauacauaagagggcaaaacucugucagaacucuaucuuccuuuauuuguuuauguguacuacuggugauuuaguuucauguccuguaguguaauuaaacgacuaggggcuaugugaugcugugcuuacaucucuauacaaaaguguaguccuuauucaauauuacaucaacagcgcuauuucuacagccauuaucaguaacaguccauauuuuucuguucuuucuggccauccauaagcugagaaaugggugugcuuguugucacuuacguucucuuccacaucaguucucuucaauucuuuccuguuacauauuuuuucuccagucuaauuucuuuguguuuaauccauguucaauuucugcuggaauauuuuaguauauuugguaacaguaagcacaacaugaaggcacugacuucugugcaaugucuggugguuagugguugaaugcuuggcaagcuagccuaugaauagugaaaauaccaugaguugagaaacuuuuggaaaacaguugguguugucugauuaguuugaucuaggcuucugcaugccccugcccaccuacuguacaaaggucauuuggagucauugugcucaguguagcauauuauuuuaacauguaaacuuuugaguuccagugauuacuagcuagcuccuugagaauucuauuugauaagugacccaaaggacaauuuuaaugacagccuuaggucccagugcaguugacuacaagaucucuuuuagccuaggaagguagaacuucugagaacaaaguaucaaagguacuggaaguggaacugcaagauguuugcaguuuugggggugccucuguuacuaauauaaguuuuggggugccucuguuacuaauauaaguuuugggggugccucuguuacuaauauaaguugcccaacugaccugagcugaggcucuucagcuucuugaguagcugagauuaaagucacacaggugugcccaagaauaaauacuuuuauuucauuuagauacagcuauucuaagucaguuuuuaaguauucucaauaaaaagaagacaaaacacaccuucccuuuuagauaucuaaacauuauaaaaauguaaaaucucccagguuuguaacacuagguuuaugacuucuuuuuaaaugcagaaaaaaaaguguguguguguguguguguguguguguguguguguguguguguguguguguguguguaugaacgacaguauauauuucacuaacccuuucucuauuuuacauuuuucuuuuggaagaguugccuuaugaguagauaaguauaauuguuacauguacauacaucuuaaaauguugagagagggucucaagcuaacuucaaacuugugugguugagacugaccuugaacuccugauccaucugcucuagguuuguagugcugagaguauaggcuuaugucacugugcccagccaauucuuuuuaauggcuuccugguguuucucuguauggaaauaauuuacuuaaaucuguugguggguuucuggguuguuucuuggauuuuccccacugaugacaguguugcagaugaacuuucucauguaauuuauauaacauucauuuauauucuuguguauuucugugugauauaauuuacuaguggacuugcaucauugugaguucuuuaaagucuuacaguugguuuagcaaucucuuaacacuaucacauaagacauuuuucuguuguccucaguuuauagucucuaauuacagaacaguguuguaaagauggaggaaaaccuuaagaaagggaaggaguauguagaauugugugauauuagaaauugucaggggccuggagagauggcucagugguuaagagcaccgacugcucuuccaaagguccugaguucaaaucccagcaaccacaugguggcucacaaccuucagucaugagaucugacacccucuucuggugcaucugaagacaacuacaguguacuuagauauaauaauaaauaaaucuuuaaaaaaaaaaaaagaaauugucagagagcuaagacaugucguccuugguuucaacuggagucuauagacugaugaugguuuauuggaacccuagcagaggagauguauucuccauugcuguaauucuacaaauugaaaauucuuuuuucuauuagguuuucuauucucccaacuacaaaaugucucucacucccuauccuggauaguuuuccauguacaaauaccuaugauuaauuugugagggagggaagauacagguuucaaagagacaauaggaguuaggggaaagcuggagcuguguguguguugaagaaagaaguccugguaaagaggaugccucuggguaccuuuguuaaucaucuaaguguucuaccgccuucuggcuuguuuuuucaucuauaaaacauccagacuugauuacuaaggucuuuuucauuucuuaaacuuuguguauggacacugagcaaggaagaacuauuuaaggacacccuuaaaugcuaagccagguuccauaagagccugagaaggaagaaagacccagugauaauccucuugggaaggggccacucuugaucagaagaugacugguuacauggccuauuugccuauucucagagcaggagcacuggggugguguggcacacauuauucugcagcacacaccuccuggcgaguucaaugcucuauaguuuuuguauauccagagcuguaucagcagagagaugccaugggcaaguuggcuuuuucuaucuuucacaguauucuccacauuagugcuaguuuguguuugucuaucucuuucucucucagauuaucuccugcugcauacuacgcccagaggaugauccaguaucucucaaggagagacaguauucgccagcgcuccaugcgcuaccaacagaaucggcuucguucuuccaccuccucuucuuccucagacaaccaggguccaucaguagagggaaccgacuuggaauuugaggacuuugaguaaguauauuuucaguuugcuuccuucuuucucccagacuaagagugcuucugaguuggccucuguuucuguagcaguggugagcauucuugccucuaaccccuaaguuauuauuuaugugcagcaaagugggaugagguucagaggguuuuagguaccuagagcacuccuauuucugggaguuacauugccgauucgccagagccuuugggaagagacaacccauugggccacaggccggaguggaaagaggauggcugcugcucuccugaccacacaccagacaaaggaagcaggaggcuuggugcuuauucucuuaacuagaguagaggugacaauuuaaguuucaucguaaguauagauuuccuugaauaaacuguuccuugagaucugacucucuugccucuuccugcuccuagccccaccugucagauuaagguggcuuggggagugacuccuugaugccacugucagcuggggccgaugcugcaucuccucuuccuccacucccuucucuuuuuucuuuguuuccuuauguuggugagugggguaaagacaaggccuaagagcagggccagccccaaguuccagaguccaugcuuuccagcccuacugcugaguucugccucucagauauucuauuccugaccuucuagccauuuauugugccuccaguuugaaauugaguuuuccuagcuuguaucaaauuagacauuuggcuuuuguuuugauuuuguauuuugacauuuuuuaacaugcaaaagaaaaaaagaaaaagaagcauuucccucccucuuccccaacucccucuuggcagcugcaugaaugguuccucacaagcuaacuugcaauagagcuauagaguauauuuuaucuuuuugccagaaaguagucugaaaaaagauuuuaaugcucaacaaaugcagguuuagcaugaagcagacagagcaugagugugcugguccugucaguaaucccugagaggagcccagcaccucugacccacagccuuuuuucugucuguccuccuggguaagauggcugcauguacaaacagugaaaggagccagauagauguauguuauucuggagcuguaguaguuuuucuagcacaaggguccuuuuagggaaggaguuuaaacauacaugccaaugggguugggauguaauucacuugcuuagcaugugagguccuguguuugauucuucagcacugcaaauauauaaacacacagacacacacagaguggggaguaaugcgggggguggggggagagaaauaaacaaacaaacaaacaaacacuuaaacacugaggcuacgguaguagaaaaaccugggugacuuuaguucaguuauucugcagugcgcuaggacucugaacucuggacucuggcuugccuugccucuucuuucuaugcaugcuuagaaguugaaacugccucucaaccaguggugugauguggggaucaugccucucagcuguacccugccucgugacuuguccuucacaauggaguucuggguuaguuuaaaauguucuguucucauuuuaccuucccuuucuucugcugccaccuccucgcucuccccuuccuucccccucgauuuuccucugucagacugccuucuguguguguucccccaacccaccugugcucucaucaucuuccugggcuucagcaugaccugguuuuacauugccuuuuuuaccuuuccuucaucagcuuaccagguuuuuccucggugucguuauuagccauggccuaaucucccuaaugccgcaccuauauguccuuguccagauguuugccuuuuggaagaugguuuugguacaaacuguaaucuugcuuuugauagcagcuaugacucaguuaccuuaauaugaguaguacaggucuucuagagaaagagguugauacucucuugccaccuguuucuucuuuuucuaucuucucuguccuccuccugguccuauacgcugaguacugguuguaauugcuccuuuucgccucuagugcucaggggagaggcagaaacuagggauuguagcagccuguucuaauuuauuugccauaauccuauuccuuagcuuucauaacuagaaaggauguuauuuaggccugcccucccucccucccuucuuuccuuccuucuuguuuuuugagacaggguuuuucuguguaguccuggcuguccuggaacuugcucuguagaccaggcuggccucaaacucagagauccaucugccuguuucugccaucugagugcugagauuaaaggccugugccacuaccacccaguuugggauauuaguuuuuuaaauaauguuuuaacuuauguguauggauguuuugccugcauguauaucugugaccaucgugguuccuggugcccagagagaucugacuagagucaggucuaauagaacuguaguuacagacauugggagcucccaucuuccaugugggugggugcuuagaacugagccuagguccucugcaagagcaacaauugcuuuuaauugcugagccauaucuccaacccucagaaaagagggauaugugggggggugggguagggggauguuauacagucauuuuauaguuauuuuaaaauuauguuauuuuaauauacagaagcagguaagguuuuugugaucuggaaucugccuaaauggacaccauuaagagacacuguucuauuguuuuuuguuguuguuguuguuguuuguuuguuuguuuguuuguuuguuuuucugagcacauuacaaucuuaccuguaaggccucauauaauccuuuccacucucccuuuuucuaagucauagauucauuuuacuguucuugagcaguuuucauccagaugcauaaaguccccaagaaaucagaucaugucuucuuugguuuucuuucaucaucaaaaauuaucaguuacugaagaguucauaugcauaauuguuaacuacuuauauuuauaguauauauaagcauauauacaguauguauaguuauagccaaaguauccaccucauauauguauauguagcaauugcuaauacuuugcauacagauguagauuauuugcauaucuuuuuauguauaaauaauagauuuaaaauuuuuguugaauccuuuuuaaaaauauauuauuuauuuauuauuauuuauaugaguacacuguagcugucugcagacacaccagaagagggcaucauauccuauuacagaugguugugagccaccaaauaguugcugggaauugaacucaggaccucuggaagagcagucagugaucuuaaccacugagccaucucuccagcccuguugaaucccuuuaauggcccaacaagagggcuaauaaaucauucucaucuguuguucuuugacugaggauaucaccauaucagagauguaucagauuagagaacaggaaugaguauauuuauugucuaaagaucuaaaaccuuuuaacagugauauacaauuauauuuggguccuuucacauacuuguuguggaauaggucuuuccaauuuaucuucugggaggaugcccuuggaaauuggucagguuaaauuuucuauuuuuuuguagucuggauugaugacuaucuucuaagcacgcaucuucuccugucauucaucucuaucuguugaagauugaaauggcaggaucccaguguuuaucaaaauguacaaauaggauguccagaaacuugcugucagcaggucuuuuuugaaguccucagcuagcugucuuugcauaaaguucacaagcaggguaaaggugugucugccuauugacauuacugucugccuguguuaaagcuuagacugcuugcuugaauguaguugucauauaagcauaacaaaaauccuauuuuaauuuauaacuuucccauuagauaaaggacagguagcuuacaaaaaaagcucgagaaaagugcuuuuuuuccaguaguugcuaagacuugcaagagaauaauguguguguguguguguguguguguuuaugauaauucuagcuagucuuuauuuuuaauuaauuaaauuaaauaauaauuuaauaccagguuuuagugacaaacauuuacaugcugagcuaucucacuaacccuugauucucgcuagucuugaaccuuucuuucuuuuaucuguuauucuaauuaugauucuagaaucuuucuccacucauuucccugcccuuuuaacuucuuuuuguagcugcuuugccuucugaggcaaaggaugaauaaccugauccgauacuugcuacugccagaacuagagauguuucagauuagauaagccacaaauaacuuccuccacacauacagccacugguaauuauacucagcuucuuaaagaucguugcuagcauagaagagaauaaacccuuucuuuauucaugguuuugacacugggcuguauuuggaaaaucucagugagaaccuuaaaguuuucaguuuaagauagagucugcagguuaguuagaauuguuuccccuuccucuccucuacccuuccuccuuuucuuccuuucuucccuucuuucuuuuuuuggagggguugggugggaacaguaguaggaauugaaccuagggccucuugccugcuaggcagguuaccugaucacaguugggcccuuuguucuuauuucuagacagucucacuauuguagccuaggcuaacuuguaagucuuuauuuucaugcugcagccucccgagugcugagauuauagguguguguaccaccaugcucaauuuuuuaaaaaaauuuuauuuauuuuauuuaugaguauacuguagcuaucuucagacacaccagaagagggcaucagaucccauuacagaugguugugagcuaccaugugguugcugggauuugaacucaggaccuucagaagagcagucagugcucuuaacuacugagccaucccuccagcccgcucaauuacuuuuuuuuguuguuuuuuguuuuguuuuguuuuucgagacagaguuucucuguguagcucuggcuguccuggaacucacucuguagaccaggcuggccucaaacucagaaauccaccugccucugccucccaagugcugggauuaaaggcaugugccaccacugcccagcugcucaacuacuuuuaaauaaauacuuuuaaaagauuuauuuacuuuauucuuuuauacauauguguguuuagccugcauauauguguguaccacauguaugccuagucagaaggagaacauuggacuggaguuucaaaaagugguuagcugugaguauuggguauuaaacucaggucuuucuucuacaagagcaccaaguauuaguagccuuugagccaacucucuaccccauuuuguuucugagacaggguuuugauguauuuccaaggcagaucucaaacuuuggaguuuguguaauguuuccacccaagcuucuccaguaguugagacuauaagacuauaagcacauaguugagacuaugugcaccaccucaccugcccgagcuucucuuucucugcuccccuugcuaggcaucuuguggcauauauguucuuaauuuuguguuugguauagcugaggagaguuccaaaggcuaucagcucuaacaucuggcugaauaugacaggaaaaguuguugaccuuuaguuuacaauauacucuucuuccucugcccuuuugguauaacugagauuuaguccagccuuuggcaaaggaacuauguuaaaaaccacguaaguauugcuucucauuucaggugauaauccugaaugagacuccuacauuuacuucaaaucuuggcuaggaauuccaucaaagaagccacaugucuucaguaguacuuguucuuaguuucuuuucugagcuaggaaguuccaggauuucuguaggagcucuugacuugucuuuuauuuuauuuuauuuuauuuuuugacuugucuuuaauaacaaauauaacucagagccaagaagaagggcagcuuuugccaucugaaaucguuagagagauauggcuguaucauuuugaaauggucuuuauuucuuccuuucacauauaaacuuuagaaguguaaagaugcacuauaaagcacuaugaagauguuguucuugcugggaggugauagugcacaccuuuaaucccagcucuuggaagauggaggcaggcagaucucugugaguuugaaaauagacuggucuacagagcgaguuccaggcaaucagggcuacacauagagaaacccuuuuucuaaaaacaaacaaacaaacaaacaaacaaacaacauucagguguuguucuuuguaggcugcuaggcaagugcucagcaaauugcaucuguagccaggcaucagucuuaaaaaaauagggucuuucaauaguuaaacuuaggagacagcaaaacaaaacaagaaaagcauaguuauuuugacaguuggcuuuucuugauucuugauagaugcaacuauauuagucacuguaaaguucaaaucuauccaaaaagaugagacuugggagucauagaagugcagaucuuaagaguuguuuuugccuuugagaugagcuuuauccuauuaagauggugacauuaaaacauuuuaguuauagaauaaaaugaucagauuuuuauauaaguauaugaaagggggcuggaaagaugguucagaaguccauagcacuggcuggucuuuuaggggacccuggcucaguucccagaacccacauggcaguucccagcuauuuauaacuccaguuacaggcaagugccucuggccucuguggucacugcauguacauaguguccauacaaacaugcaggccaaacacucauauagacauaaacaauaaaauacaaaguaaaaaguacauaugugaagagagacugugacuuaaagaguuugaccagcucugcaggaaggaagaacagauuuuggaaaaaugggagacuccauggcuugagcuugauuuugaagacugaauaggacuacuuuuuguuuuguuuguuuuuaaauugcgugggguuguuggcauaguggggaagaguugcaucccacugcauggauguauuggguuucaccuuaccugacuuugguucuguuuuguucauaguuguaugaccaacuuaggugauugaguuucugagaauuuucuugucucugccuaucucccuagagggguacacugggauucuacaccagugaccaguuauguccuuauauugucuccagcagaagguguagcccagauuaaagguguguuccgccacaccuuuaaucccagaugaaaggcguagcccagauuaaagguguguuccuuaaacucggagauucaaucuucuggaauccauugccauuauggcucaagaucuccauaccaagauccagauaaggaucuccaagccuccagauaagggucacuggugagccuuccaauucuggauuguaguucauuccaaauauagucaaguugacaaccaggaauaaccacuacaauccaccccuugucaacuugacacaaauaauaucucauguucacaugaaacaguaacaagguugugaauacgccuaacaugauauaacuaucccucguacaaucgcaaacgcauuugucaauuuacaagggggcauucauauuacuuuauaauccucguuucugcaacugguuacguggccuuaauugguauuaucuaguuuuaacauggguucuggggauccaaacucagguuguugggcuuucguagcaguacuuacccgcugagccauuuccccacccccuggacuuugaaagaugaaucugugaggaugguguagaaagaauaugcuagauaaaggcaauaacaaaguaaaagcucagaaacagauuuuacucaagguuuauucagaagcuugaauagaucucuguguagagcuauagugugcuggugauugagaaagaucagaaaacugagaacugugaagggcuugcaauguauggcagaaaauuuggauuguguguugacuuggccuccugaguaggggcauuacaaguauaggucacuaugcaagcguacuugauguuuuccaagacugagaggccuauuugugggugucuuuguaaagacagccaugucaucuacuucuccaaauagaaugcuuccucagccuuuauuaaauaugugcuauaggaagcuaacugaacaacccugauuaaggugauacaaugugacaagucaacugaugaagaacuaguucaguagugaugggcuaguauaagugaagauguuuuaaauauuuauugugaaaguccuuaguguuuucaucguagauacccuuuuaaaaacgaaaaccagggucuuauuuuguagccuuagggauugcccuguuucugccucuggaauaaugggacuaaagaugcucaccaucaugcuuaucugggugucaaauuuuuguuguuguuuuucaagccugguuuuuuguaugaugcugaggcugaaccugaauuucugggcucauaugauuggccugacugggccuccugaguaggggcauuacaaguguaggccacuaugcaagcguacuugauguuuuccaagacugagaggccuauuugucgaugucuuuguaaagacagccaugucaucuacuucuccaaauagaauacuuccucagucuuugauuacuauuacuggagaccauuuugaaguaaguauuuguaaguuaacaagugauccuuagaacaucauugcuugcaauuggaaucuuuuauuauuguugcuagcucuguugacuggguucuagucuugguugagccucugcuguagaaagcuuggaacaucuaacugagaaguuuggauuuuguauguauuuggggcagccauuauucaguuuuuuuuuuuuuuguuuuuuguuuuuuguuuuuaauuuaggcagcaaacucuaaaaaaacaguggcugggggggaccuacuuuggaaaguguacugauguagaagaacaaguuugagaacaaguccuauucccaaggucccagugucugauaguaaaggaaauugaacaacacuggugcuucuuuuaaccuugagguucuuggaucucuauugguguuaacugccuuagaagauuucccuugauacucagcaaagagaaaauaaugagaauucucagaaaguaagagggccuccugaagaggaagagggaaaagcuaucuagugcuugucaagccucaauauguuuccaaaauaucuacuuaugcacuacuacuucuuuaccaaggauuaugaccuguugcuuacaaauguguaacauugcuugacagcuaaagaaauccucuuucugaaaauauaaaguaccuuaugaauguuuauuuuggguuauggagaauaagaaaugagcaaaggaaaguagaauauaucuagauugugccugggcugaaaauggaaaaauacagacagaaagaaugaaaaauacagccaggaaauacagggaggaagacauuaccucuuagauuuauauguuguuuuaucagaaaaugcacaauaugaauauaaauuugcauaauguaggcaaaugagauuaggagguagaauaagggaggacaagaauuuguagauuauaauuaucucauauuacuuuuccuuggagaaaucuaaggcucuguuguuccaggagacgugcauuguuagguuucuuacaaaggaugucaacugggacaaaaauuuaagaucuuuguaagugucgucucuggaaauagaggcugugccucaguuucuaauaggagcuaguaagaaaaggacuugaccaagaucacugugccauucagagacagaaaugcuaaguaggucuucugauauuuguucuuagacacacuuucuuuuuaaauauuuagcaaaaucaacaguacuguugggaagacaaugaccuuuugagcuuuuugauggaauagauucauccucaaggcucaugucagagcucuguuugucugaggaacaaugacaaccugacugucuggugagggcucagacaacagccuguagggauauuuuuuauuccuuuaaauuauggucuuucuuugaagcucuugauccugggcaucuagcagauugcuguugugucucucuuuuguccugaagauguguugccuuucauucaacacaugucuuagaagcuuguuugaaggauuuuuuuuuucuuuauaaaauaauuugaaacaaaauuuuagucguucccccacccaaaaaaauaccccacugagaguuaaucaaagaugcauagaguucaacaacugggaaggccauuaauaguacagucaguuucuauccugcugucuuaaaugcaacuucugaauguuaaaauugaugaggauuucucugauguuuucuuaaaaaguaguccuucuugguggaaagauuguacuagcauauuuguguacuuuguucuucauuucuuucccauaaaagguuguuggcuaucuuauguuagagccuaguuuuuagcacuugcuacuauugcuaaugucaaccaacuguagaucuguucaucuggcauuaucuucagucccguuuugacuuauuucacugcuuucuaacucuugcagcuugcuuuccgcugaccuuguguuagcagugaagugaauggcaggcuccucgucuucuuaaaauaucuuauuuuaagugcaucuaauucuuuuggucuuuucuuggaacucuugucauuaucuuucucucaaaucucccaugcacaaaauuuguucuucuauccccaguugccucuaaacccccuucuuucuaggcaauaaaaucaguuauuucucucaucuuuaguuuauuuggagcugugucaaaauuauuuucccgucuagucacccacuuuggcuuuuggacauucugaucauugcuaccuugacacauucuuucuuuucaagguuuauccuguuaguaaccauuugugcugcuuaucucucaugcuguuuucuccuagacgguuuugcugguuucucccuuaacaucucauuuguguguuucucauauuucauauuuuccuaauaauccugguuccugugcuguccuuuuucucuguugcugcuggaguccuaacacugaauuccgaggcuuaccugcaugguguugaguuacuacucagcuccugcuuacccauccuuagccagaaugcuaagauuaagaccugcauagagcuuuccacucacuuguaugcuguuccauaaugccauccauuugagaaugugccuauaucugagcuagcuaugcuuacugucugucucugucucucugugauuagugauugggucuuacuaugcagcccagacuggucuccugaguacugggaucacuauauaugucucaccauaccugauuugaucuuauuuuuccuuuauauaucauauuucaguagucuaaacauuuuaaagcuauuaccuguggcuguauuucagcccacccuccccauuucuuuaguugguguuuauuuguaugugugugcgcgcgcauguguacacauuauagcacuaaaauuacuacuuuugccccccuuuuaaauguuauuuauuuuauaagcauugauugguguuuugccugaaugcaugucuguaugaggcuauuagaucccauggggcuugaguuacagacaguuguaaguuuccauguggguccuggaaauugaacacugguccucuggaagagcagccaguguucuuaaccacugauccaucucuccagccccuauccccucuuuuuuuaaaaaaauagaaagaauaacugcauuuagguuuuaggcuuuaaaauagcaaaaagagguuugugauaauauguauuguaagagucaaacauuuccccacucauccuugucacuugucauccuuauuucucaccaggcuuuaugcucucucaaaaagcauugcaccucaucaguacuguccacuacccugcccuucauaucuguauucacagauaauagucccauguuacccgaaaagguggaucuauggacuuguaggaacgugagucagcuccacaggugauuuguaggaagaacagcucaguccagagccaugggauagaaucuacccuauaaugcugcuaucuagcuuuguuuucagucuucuuaaggccugggggccucucuauguuccuuucaugucacacuuuuaaacuuuaaaauguuuucuaaaugccuuucaugauaauuguuuacaaucauuaauaaauucauaauaacaaaugcuaucauuacucuaguuguacuuuuaauugguacuuuaacuuaucauaaccaaaaucauauauuugaaaaauaacaauauuuagagcugucuuauuuguuuaauauucagcuucuuugugcgcauguuaggagcucugcaauaauuauauuuaugcagcuucugauauauuuguguauauguggauguguguguacauguguauuauguaccucuguguauauguagauguagacaucuguugaggaggaugugugcacacgcuccugcgauuggcuugaagaugauguugaguaucuuccuugguuguuccuuuacuuuuuguuaaggcagggucuccugaugaacccauagcucccugaaucugguuaaccuagcuaguuagccagcuugccuuugggacccucugucugccuccacagcccuagcaguauaagcuccucuauaccagcccagcccuuuuuuuuuuuuuuuuuuuuuugguaaauaauaaaugauuuauuuauuuuguauacaaaauguucugacuugauggcuagaugagggcaccagagcucauuguagaugguuaugagccaccaugugguugcugggaauuaaacucggaaccccuggaagaacagccagugcucuuaaccuccaagccaucucuccagcccccaagcccagcuuuuauaugacuucugaugaucugaacuccauuccucaugcuuacauggcaaacuugucuuucuccuuauccuuccuuuuauacccagaguuucaagucaacagaauacaauaucuucggaaaacaagaguguaucuuuucauugggaugggggacccaaauacuucuaucggaucagcuuucaauagccuugguauugauugcucuuaaugugugaaacccuuaaaagcuuuuguuucuagcugguacagcucccagugggccaccuaaaagccaaaguguuuaagguuguuuccagggcuagauugaagauuaucucauugauuugaagauaauucaaagagagaauucagauaucccaagucaggcuuucagagguucauguacuucuugauuugcuuaagcagcuaauuaacugcucuguccagccagugcccuuuaaguuauuguuucuuugaugugguggaaacuuaagccacaagaaguuccuuuccucuuuucuuguaggaaacaguaaaaugcagugaagagauccaaagcucuuuccugaaucaucaacuacauucuagccugugaccuuggauuuaccugucugauucuuuaguuuccuuauguaaaaucagacuaauaacaccucauggaauagcuagagauuaaauaggauguuaacaacacugaacuuagcaggcacuuaauaaauggugcuuaaacaucuauaauaaaaaauuuuuuucaaaugacguuguuuaggagugcauuuuucaucauggccaguuuucaaagaaggaacuguggacuuuuucuuauuucugucuuucugcccucuugccuuuuucaugauacuaaggaaugaacgugagaccuugcauaugccaggcaggcaagagcugucacacugaguuacaucucuagcuuccaacccccaucucucucugucagucuuucugccaagggggucaaaugaagaaaaagguauuccugggcaagauguggcaaugcaugccauuagccucagcacucaggaugcagaggcagguggaucucugaauuugaggccaccuuggucuacacagugaguuucaggacagccagggcuacauagagggacucugucuuaaaaauuaaaggaaagaauaaauucuuauguagccuuuccagauucuaagauuucagauacuacgggguucaaagaccacauugacucagaccugcuuuuggguacugaauuaaaguuagucaauagguaacugcuuacuuuggauuccuuuccugaguguaggacuuuaguuugcagaugcuuaguuuugguggcaggugaauaauucugcuucaguaacugucuuauauguagucucucuguuuucuccagggacaauggugacagaucuaggcaccgagcuccccgaaaugcccgaaugucugcaccuucacuuggacgauuuguuccaagguaagaacuggguuguaaauauugacggauccuugaugaaugccuaagguuucauuuuuguguguuuggauuacuuuggcuuuauagagcuggaacugggacccagggccuuccacauacuagagaggcacacugccucugagcuacaccaaccucuggccuuuggauuacccauauauagaauucucuccuagccucuauauucugguccugccauuuaaacauuucaugggagauuauuagccacagugccuagagauagaaaaauggcaccaagagcauacuguucaaagucugucagagucucucuuuguaguucuaguuggccugaacucaucauguagacugggcuggccuggaacucauguaucuaccugcugugccugugauugcugggguuaaaggcgugcauuacuccugacuaacauuacuuuagaagaaggucaguaaggagucacacauuuauaaaaggacaaauccuauagauuuuauggauuuuuaguuaguauaucccuuaggcuauauuuuguuauaacguaucuuuugggacccagucuggucuugaacuugcaauccuuccuuagucuuccaucuuuauaaaccaugccauuuaugcccagccuuacuuagccaacgauuuugaaacuguaguuuuuccucuguuguuugguaguauuuaguuggcuuuuuacaugugauuccuucuuacaggcguuuuuugcugccugaguacuugccuuaugcugggauuuuucaugaacguggacagccuggcuuggcuacucauucuucuguuaacaggguccuggcagguaaggaaauauuucuuuggauuuugaaauugugaaaggcaggaagcuaaaaagucuuccucuuuccccucuuuugauacaacaguuucuucgaauugguugaagcucuguugaguguuagaugcguuucuuaccuccagacaagaaucaguacagcugaaaaacuguuucucuugucuaguucuacuuccuuuaggcccuuuugugaaaacaaacaaaaaaggagcggggagccagggaagaagggaaaaaacuuuuuuuccccaagacagcauuagcuauccuggaacucauucuguagaccaggcuaacuucaaacuaagauccacaaaccucugccucccaaaugcugugauuaaaggcucacauacugacugucucggaaagagaauuuuuaaaaaccauuuguuucuuaauauagauaaguaacuccuggcugugcuuuaauugggugauaaaggugucuuguucaugguucaguuggugagauagucaugagcuagauccugugauuuuaauuaagagccuaaugcacaggucucuacccauuugcuucugccagcccguggagauuccaggcacuggcacuggaauggaaugaggaaggaggagggaggaaacuuguggaggcagcucagaacuccacaggguagagagaggcugagcaagcucugcugcagaaguuuaugauggggggucccuuuagugacccauguuuuagggcguagagguauggugugaccaauuucugagacauuguaugcagcugcuuuuggacagucuccagaaaagggaacaaagcagaaaucuacuuuuuguggugaagauuguuucuuucuuucuuucuuucuuucuuucuuucuuuuuuuuuuuugauuuauuuauuuauuauauguaaguacacuguagcuaucuucagacacuccagaagagggagucagaucucauugugagccaccaugugguugcugggauuugaacuccugaccuucagaagagcagucgggugcucuuacccacugagccaucucaccagccccaagaucguuucuucauugcauucuuugucaccuucccaucgcuuucaccaccaacuauuaugucugaaaagacagaaaaggaauucuauuaggcauauauuuaaagggucuuuauuagaaaaauuuaaauggcauucuguucuggaaaaccugggcugugugaugauuaaagguagaaaggcagccagugugaagauuucacugggggacaaugagaauguagcacacuguuagcuuugguucagagauacacucuccacccacauccgucugcccaucccccgccccuuucuuuuccuucccuuucccucuuucccuuucuuuuucuuuucauuuuuuuaaaauguaacauagucucacuauguaccugaagccuggaauuugcuauguagaccaggcugaucucugacucccaagugcugagaucaaaggucgguacgcaucucuaaacccaggugcuugagggaguuuuuguuuuguuuugaggcaaagucucacuaucugucuuugauuggguuagaacuugcuuuguagaucaaccuucccuugaacucauagagaucugccuuauucuuccuuccgaaacugggaauaaaggccugaaccaccaugcccaacuuuauuacaaugcuguuuuggcagcuggcagaccauaggaucuggucuuccccuugaccuaacauaaaaucccagaaucccacaauccucaggagguucucugccagacauuagggcuucauacauaggcccuggucugguaggugaacugauuauuccaaccuccagauaaccguugaaagaugacucuagcccuaguuguuaaacaguggauuugugccucuccgugcauguggcaaugguugaaggcuugugaaagauaaccacuaaccauuugcugccaggcaaugauaccaaagaguucuucugcccucuuuuuuguuccaaacaucugucuuggucacuccauaccacauaucuugcuuuucugccagcaaaaucuguuuccuugguauuaaaagagcuuuaaaaaaaauuacagcuguauaguuuuucuuuuuuuuccuuugcucuaguaauucuguaccuuuacauuccauucccuacuuucugaccaguggccugaucccugcagaccuguuugcuuuuacagaugcauuugacuguaagaggguauguuguaacguuuuauagguuauguauggguaugacaucuacagggaaaauuugucuaucaaaugauuccaaaugucaccaagagaagaaaaucuagauaucuagaaccuuaugccugaguuagcaguucuuuucaucauuaauacucauuuucucaauaucaauauuagcaugccuauugggacuuccucugaagcugucaucauguauagauauuuguauaucccuccaaauucuguuaacagcuaugucauuuuucuuuauguuuccuuuuugaaacaauacuaguaacaacaaccaaaacccaaguguguauugcuguguacuaggaagcauuuuaaguacuuuagguacuuuaggaauguuuuguuuuaguccugcaguaguucugagacaacugguauaaagaucaguggaggaaacacuggugucccuggacaugccuuaccugcacucucagcuagagaguauaggagccagggacugagcccaggcaauggacuuguaagaauucccuccaaaccaucuucuagucugcugccccacaauuaucaacacagacuguagaagacagaaagggcuccugggaagcuuuugcugaccuucaguuuuucuuaauuccuuuuuuugguuuuaaaugcuuccuagacaugaucagagcuuuauaucugagugguacuugcugagggaaaucuuacuauaguaguagcuuuuucucugagccuucuuguucuccuggguauagauguuuugcuuuuuauuaaacuuauuuaugauauguaauugaggugcuauaguaaugacuuucagagugcaagagaaauuggucuuuuaaccuuaggcauucccaauuuucuuggaaaggcucuuuucucuucuaugauuggaaccagaucaugaugguccuagaaugguuacacuuggcaaauaguuguugugcugugguuacaguccagucagugcucugggccagccucaaacaagacagagagaauuccugcucuccuguguuuuggagucuugguggcaaauuauaucuuaaaagugcugcucaguucuugguuccaaacauaaguaaaagcucuuaauguuaagugggucuuuacaaaggcgugguauggaaauuuggcagauauagagggacaaagggaauauacauuugccauuucaggaauugugaccagcauugugguggcaaaugagucuccagugggcucucagcaaagcuauucugaaacguccauaaaaguagauuuguggaaaauuaaaacccuuuaaaucuguucucuuccaucacagcuaggaugugaucauagacaaacuaaacccuuguacccaagugccagugguuuguuaaucuucaucucuucucuuuuaguuuuuguuuuauuuuguaucuucuccacaauuauguaggucucuacuagucuccaacuaccuaucaaucccggguagcacagacucuguacccauauuuaaauaaacacacacacacacacacacacacacacacacacacacacacacacuuaaaugcuauggcaucucuuaauacauauacggagagggggcauguagcagucuagaaagcuucccuuguugacauuuuagcagagagggauugaaaugaagcugagcacugccucaguggaucagguguggucauuaguacuuuccuauacacugucucuguaaaucguugugaagugaguguugguuuuaguauuucuauccagcagagaaaucacuucauuugcccagcauaguacuaugagaggcagauuugggagaucaaagcugguuugccuaacugucuucugucuacugagccauuuugcuugaguuaagaaucucccaaaagguucuuaagcuuauaauaguuuucgacauguuugaagccuuagagaaaugaaaugagaaguccugguacaggacagcuuccuuuuaauuacuuaaagaaaaaaaauucuucugaagauagggccugaguaauguaggguguguuaucuucccugaauaauccucuugacuuucauccuaaugagcagaugugagccuaauguacuuaauucacuauuuugauuaaagucaaugggaagugucagacuuuucauguucuuauccacaggucauuagaaucuagucaaaugucuuagauuagagaugguguugugccuaguuaucuuuguuucucccgugacauuuuagcccagagguucucaaccuuuggcuugugaccccuuggagggggugugugagcuguucuuucacagggucauuggaaaauacaaauacuuacauucugauucauaacaauagcaaaauuacaguuguaaaguagcaaugaaauaauuuuacaguuuggguucaccacaguaggaggaacuauauaaagggucaugcauucggaagacugaagacgacugcuuuagucgcuuauagaugcauuguuuauuuuccacacacuuauaacugucucuauuuucuuuuuccuuuuucuaaaaaaaaucucugauuuaauuuugguguggcuuaagagcauacucuaugauuucagauauuuaaauuuuuuuaacuuaguuuuuggcuuagcauaugggcuaacccagcaaaugugcuugaucagaguguauauucuguugauguuagaugaaauuguguagauccuuggugaauaguguuaauguauuguguauccuuguugguuuuguuucuuguucuauccauuaucaagaugauacugaaacaaacuauuauugcugaguuguguauuucucccuuuaguguuauuacuuuuuuauuaaaguguuuuugacauugucauuaagauaucucuacucuuauuucuguccuagagucuauuuuuacauuuguauagcuagcccgucucuucugugguuucugauuguaugauauauauuuuccaucuuucauuuucaacuuaguuggguuuuuuuuguuguuuuuuuuuaaaagauuuauuuauuuuuuauuauauguaaguacacuguagcuaucuucagacacaccagaagagggcgucagaucucguuacagaugguuguaagccaccaugugguugccgggauuugaacucaggaccuucagaagagcagucgggugcucuuaccuguugagccaucucaccagccccaacuuaguuguuuuuauauuuguucguuuguuuggcauaguuucacuguguaccucaggguggccuggaacuuacucucuaacccagguuagccucaaacccacagcgagccucccauuuauaagucacuaugaguagcuuuuauuuagauuucuuuuuaacuaaaagaaagcauaugguguaucuuaguuuuagaaaauauauuauuuguguauaaguacaugauauguaaauguguggagaugcacgugucaugcacagcucguccguucugugugagaggacagcuuuaggguuugguucuuuuccuuccaccgaggauucuggggauccaacuaggcuugucaggcacagugaacacuuuuccucgcugagccuucucacuggcccacaucuuuuuccuugagucagacggucaugucuuuggauuauucauucacauuuaaaguuauuauuguggauuuuuguccaucauuuuuguguuuguuuucuguaucuuuagugugcuuuuucgguuugaguucucguacuaugacuuuguauuacaugauaucaucuacuaggccauuuuaaugccuucccugauuuucaaagaacauuuacuauaauuugcuugauauuuauauagacuugauuggugagauagguaaacauuguucuccguagcucuguuccccuucccucuguugugcuguccuuggaauguauguaaaaucuagagauacuacaaacacaauuuaauugcuuuuugugaucuugcgcuccaggcauccugcuguuuguugacuaguuuggguaaggugggcuggagagaugacucagugguuaagaacaaguacuaucccugcagaggucccgaguucaacucccaccacccacaucaggcagcuuacaacugcuuguaacuccagcauccaagggaugucccuaacuucaggcacaugcacauauacagacauacacagauguauauguaaaauaaauaguaauaaaauauuuucaaaacuuugcuuuuccuuauuaacuuauuuucuagucuccuuccaaacacuauuucucauuugauuauuuuuguucaucgagacagggucucacagcuuggccuuaugcuugcaauccuaccuuaccuugcccaagugcuguuuguggauauuguauuaccagcacugacauucuuccuacuuucuauaaaacacuagugcucuuucuuacaugucuuccacuugucuguuacauuaggacuuccauucaaggucuuuccacccuaguuccauucacaucaguuaacaucuggggcuuucugauuuuuuaggaauuaguauaauuugauaaucugauagcaacagcauuauuuaguacaacaaauugcuuuaucaugcauuauauaccacuaugcacuugaauuaucauuuuugggaaagaugaaugacaauagacacagaugggcuaucuugguauuuaguacaaauagaaacaaauacugauuuuacauucuuucucucucugcucuguacaccucugggacacuguagccaggcaaguaaaguaaguaccacauuccaacucaacaacaguuaagauggcuguuuauaaccccagacaaguggacagucagugguggugguacugacuagugcugcuuuaauaauuaacccaauuaccuuuccuucugcuucagugaugaaagugagggugauaaagggcuggcuugguugccugggaaauaguaaauguuguacuuccugagaacacaguccagcugcuggccagcugcagguagggcuuuucucuuacuuggcacaguuauacacucuuugaucacagcccuuugcccuagacucuucuuagaacaccagugagaguuuugcuuauugagaaccuacuuucaaauguuuaugcugugugccugcacuccuucaggccuuucuaggggaauaaaauugggcuugucaguaaacuuuacuggcccuuuaauauuugaaacuuguuuuuuacccuuuuuccucuuuaccccugaguccuuuuuguauugucauuuugaaauacacagcacuuuauaaaugcuuauugccuaguuguuuccaaggcgcauuggguauuuuaagagaauuaaaugcucucaggggguuugcagucuagccagagaaugaccuaauuuugguuucuguauuguuuuuugagggguugaguuuguuguuauuguuguuguuguuauuauuacuguuguuuguuugggaccuaccacuaaaaaaugaaugauuccucuagaauuuccauuguuaguccagauagguuagcucagggccguguauaagugcuguaugacucuuaguauaauuugaaaaagcauagauugugucccuauuaauaguuugagugcggcuucagaagggcagcugacauuugcagucuguugacaggcgggcuuuggaaucagauugucuauugugaaaucuuuauuuuacuccuuuuagcaguuuaaucucugauaauuuguuuaacuuugugacacagguuuuucauauguauaauauaccuaagauagagcuuagcauauagaguuaaggguuaaaugaauuagcaaguggaacauuccuaagcugaaaaucugagcaucaguaaaguacaggaggagaguuucauacaauaucaccuuguuuuauguauaaaauuacucagaauauuguaugauuaccuuuacacuguguauacauugaaguaaaaguuuuaaauuucacuugggucccaacaauccauaaucaagggggaaaagucuaaaauucaaaauacuucuaggcccagaauuucaaauggagaauaauaaacucacauaugugaagccuuuggaauaagacauaugugacaugcugugugaggacuuuuguugugguuugguuguguuuguuucuuuguuugguuaguugguuuuuuugaaauauaugugucuugcucugacucacgguggccuggagcucacaguguagcucagucugguuguagacucacccugguccucgugguucuuccuccagaguuuugggauuacaggcucuauccacuaugccugcucuacuguacaacugucauuauaaaauuuggccccguugggcaugguguugcacgccuuuaaucccagcacucaggaggcagaggcaggcgaauuucugaguucgaggccagccuggucuacaaagugaguuccaggacagccagggcuauacagagaaacccugucucaaaaaaccaaaagaaaaaaaaaaagauuuacaaaauaaaauaaaauuuggccucuguauaaauuagucuccucauucaugcuguuuugcucucucacugaauuuuuuuuaauauauguuaggggaagggucucacagggaguaauguacaggcugcccuuaaacccauuauguagcauaggauuaccuugaauuuauuaucauccugccucaaccccuuuaguacugagauuacaggcaucugcuugcacacagcucucucacagcuucugcaucccucaacauugcuacucuucguagguuuuucaagggcuuucucuccuuugcaauuuuugaagaguuauaaaaacucaggaguucagauucuaggcuaucaauguguugguaaauagagagcuugacaguucaguguuugcucuugucuguaucuguguuacccaagggagaaagagggaagaagccacaaaguuuacacuuaagaagcacuuuucugugcuacugaaguaccuaucuguucagcugucuaauuauuuguugcuauguagccaggacaacagagaaucuaguuaggaucaacauuaucuaggaauuuaccacaaaugcagauggaauguaccccagaugcaucgagccaggcacuuugguuuuaggauuuaggaauuuguguuuuaaaaugucuuccuggugcacuuuaaaauuugagaaccacuguauagaauaacucauuaagccaggggcucaggcagaggcauaaaggguauauaugcuagaaacucacgaagcauuugugcuggagagagaguuccugauggagugauugauuaggaaugggggaaagugaauuagcucuuaaucacuucauggacacaaagcuggcauaucaacucuguaagcauuuaucaagguuucuuuguuagauaguucaggguaaagaaugugguaguaccugugugagcaaggugcuguguccaucuaaauacauagucuaccaucauaaauagcugcaagaaaaguagauacuaugcuaaaugcuaaaguagcagcagaaacagaagcugugagcucagagguccuuaaagcuuuuccaaaguagaaacacuagcucauguagcuguuaugcugaaacagcaaguuccugucaagaguguuagcauuucagucccaggagaaguugaccuuuuaagcuuguggugguuugaaugaguaaugucccuuauaggcucaagccuuugaacaguacuugguuggugguaguguuugggagagauauuggagguguggucaugcuggaggaaauaugccccaccuccagucucucuguuuugugucagaagaugugaucucuuggcuuccuguuccagacaccaugccugccgcuuguugccaugacuucucaccacucugcauucucccuuugaaaccauaaacucuuuuucuauuaaguugcuuguggucauuuuaaccauuugcuucugauguuuuuuaccacagcaacagaaugguaacuaagacaaccuuucuuucaacuuuuagucuuucuuccuacuuguccuauuugauccuuuaaaaaaaaaucuguauaagaccccacuguugauuuguauuuuuaaguugucaucuucuggggcuucuguagacauaauauaaucuaaagauuuaagacccaugguugucuucugugcuggcuaguugugagucaguuugucaaaagcuagagucauuugggaaguggggaacucaguugagaaaauaucacuaccagacugguguauggucguucuugagaggcauuuucuuaacucgugauugcugugggaggaaccagcucauugugggcagugguagcccuggucugauggucuuggaugcuauaacaaagcaucugagcaggccaugauaagccagucaguaagaaggguuccuuccucaccucugaguucuugccuccauauaucugcccagacuuccuuuggugauguggaaguguaagcagacuaaacccuuuccgcccugaauugcuuguggucugguguuuuaucacagcaguagaaauccuaagaccuguacuuagaauuacuguucauuuugauugugcucacugaggacauccuauauccugaaaugacccacucuaauucccagaguucauuacuucucuguuuaugauauuauauaugauuuguuuaugauaugauaugcuuuggcacauuugcacccccuagaauaauuaauccaacgaucuugaaaucugcucagaggauacagaagaguaauagccaaauaugaggucaaauggaggcagguauaauauucauuucuuuguuuucuuuuuuaagauuaaacuuucuuugggagcagaaaucuauucuaaacucaggaaaaacuugaaacagcucucuuugcugucuugauuucuccaucaguuuuuacuuguugaaaauacaugcuaaaagguaacaauacacauagacacuccauuaugucuuuuuuuaaaagauuuauuuauuauuauaucuaaguacacuguagcugucuucagacaccccagaagagggcaucacaucucauuacuggugguuguaagccacaaugugguugcugggauuugaacucaggacuuucggaagaacagucaauacucuuaacugcugagccaucucgccagccccucuccuucaugucuuaaaaaugaucggugguggugguggugguggugguggugaugguggugguggugauggugguggugguggugguggugguggugguggugguggugauggugguggugguggugguggugguggugguggugguggugguggugguggugaugguggugguggugaugguggugguggugguggugauggugguggugguggugguggugguggugguggugaugauggugguggugguggugauggugguggugguggugguggugguggugaugaugauguagaugauguaguaugugauguaccacagcauaccuguagagguuagaugaacagacuuguagaauugguucucuucuucugucuuuuucuggggaucaaacucaugccacaugacuugaauaccaagugccuuuaucugcugaaccauuucauuaguccucuaccacuuuuuuuuagaaccuuaggcucaaguuacaauuuuucuuuuucauggccccagaagccuuauuuuauuccaagcuggguagaaaugccauggaagcugacagacagcaccucucacucucuauacagaaguaaagacaaccuguggguguuuuuuuccuuuaagacuugcugauccacaaggucaggucuuuccugggucccuguggccucaacuggaauagccaacauaaauauuuugguaaaagucuaauguagaaagagauauguguaggugacugacuaaugacuuuuuuggacauuggggguguuucuuuugguucccucuugucacuuuagugcugacuuguuauauccuauaaccacaucuucccaaucuguaacaaccuucuccuuuuuaaaaguagaauuuuuauuuuauuuuuuugccaggcacacaccuuuaauuccggcagucaggaggcuaaaacagguguaucucugugaguuugaggcaaguguggucaacagagcgaguucuaggacaacaaaggccacacagaaaccuugucucaaaaaaacaaaagaaaaaaauaguauucuuauuuuuugagaauuccauacauguauauaauauuuuuuguuugucauuuuuuauuuuuauauaauauauuuugaucuuauuuauccucuuaccuucuuccaguucccuccuucacaaugauccauuucccuccuaacauccuguucucuucucauucucaucccacugacuccaguuagugcauaccucagacaggguuauggagcuauccacugggguguggaggacuuaccacggccaucuucccaaaaaagagucaguuaauuuucuguccuuagcuaggggcggggcccuaagagcuccuacuuuauccagaguggaaucuuugcuggcuugaucuuguccaggcauccaaagccacugaaagccacgucauguccagaaggaagucuuucacaguucucaucaucauccuccagcucuuacaugcuuuuuuuuuuuucuuuuuggcaauuuauuuccuuucuuugacaauaaaauuuuuuuaauugguuauuuuauuuauuuacauuucaaauguuacucccuuuccuuuccugguuucccauuugcaacccuccuauuccauccccccugcccccugcuucuaugagcgugcucucccacccacucacccauuccuaccucaccgccacagcauuccccuacacuggggcaucgaaccuucacaggaccaagggccuccccucccauugaugccagauaaggccauccucugccacaucugcagcuggagcccugggucccuccacauguacuuuuugguuggugguuuagucucugagagcucuagggggucugguugguugauacuguuguucuuccuguaggauugcaauccccuucagcuccuucaguccuuccccuaacuccuccauuggaguccccaugcucagucugaugguuggcuuugagcauccugguuggcugugaguaucugcaucuguauuggucaggcucuggcagagccuuucaggggacagcuauacuaggcuccugucagcaagugcuucuuggcaucagcaagauuacuggguuuggugucugcagaugggauggauaccuaguuggggaagucucugcuccaaucuuuguccuugcauuuccuuuagacaggagcaacucuguguuaauauuuuugagaugggugagugacccuucuuauauuccacaguauuuucugagcuugggauggggaaaaguugauauggaugaccgucuguagcugggcccucacugucacugguucucagcacuuuuaccaguuagaagucucagcacuuacuaccgggggggggggggggggagagugggggggggagcuugucugaucaaacuugaaagcagcaccagucuauagguauaauuacacauguucagaagguagguugacaacaugaccauuugcugaaacaauaccaauaugcuuguaucccaauaguuucuuuuuaagggugguggaaguagcuccccauuuuaucaugagcccugccaugccauguugugagcuauggaacuguacuggcuggcuuugugugucagguuggaguuaucacagagaaaggagccucccuugaggaaaugccuccaugagauacagcuguaagguauuuucucaauuagugaucaagggugggagggcccauugugggugguaccaucccugggcugguaguccgagcaagccuggggaagcaagccaguggccagcucuccauggccucugcaucaucuucugcuuccugaccugcuugaguuccuguccugacuuccuuuggugaugaacagcaauguggaaguguaagcugaauaaacccuuugcuccccaacuugcuucuuggucaugauguuugugcaggaauagaaacccugauuaagacagagacugaauucgggccuaccuggaaacaaacaaaacaaagcuuuugcggcucggggcuguuauagcagauuuccccaaccagcucuccuaugccccuucccccucacccccacucugaaaaaaauucccauaguagaggauuuaacaaguuugggcuacagaggaacagagagaaggcuagacaauaguuagaaaguucaaauuucagguuaaaaguggguuacacaauaggccuuuaaggaaaauauaugauuuauuuucauagauaaaaauggguagaaagguaaccugucuguauaaucugccauaaccauguauugugaauaguugcuuuuuauaguauuuccugacuucuucacaagauuuuacaacacuguauuagucuugaacuaaugacauggggaaaagugggaauaugauagucacuccugcuuauuagaaugccugcucacucuggcggagucugugacaguuuuguaguagcauugaaauuauccaaaaacauugcccaucaugaugaacugacagggauugugaaaauacgaauuuuauagggcuggagagguggcucagcaguuaagagcacuggcuguucuuccagagguccugaguucaguucacagcaaccacaugguggcucacaaccaucuguaauggaauccgaugccuucuucuggugugucugaagagagcagcagugcacucauauaaauagauaauuuuuuuaaaaaagaaaaagaaaauaaaauaggaauuuuagugacucagacauagauuuggccaugaacuaguauuaaaucuuauuuccaaauaagauuuggcuuauaaauaaguuggcuguguuauuucauuuguuuguuuguuuguuugaaacaggcuuucuuguaaccaagacugcccucaaacuccuaaccuuccugucaguuucccaacuguugggaguauaaguguaugcuaacacauugagcuucgaauaugcuuuuuaaacaaauaggacuugaggauauggcccaauugguagagugcuugacuaccuauguauaaagcccugguuuugauccccagcaccacauaagcccuggacauggugacacacacugguaauucugggacuugggugguagaggcaggaggacuagaaauuuaagaccaccaucaggauacauacugcauuugaagcuggccugggcuacaugagauccuguuucagacaaacagacauaaauuguaagaccauuuacucugucaaauacuguuuugaacauuccuaagcauacuaauauuuacauuuuuaugauguaccauuguuacugguguucuucauggaggaagcuggggagaaacagagauaauugaaagagcuagaauuggaaaccaagcagucaacucagauugauacuucaaacagagcuguacugauguaugagugauuuuccucauggguaggaaacaggcugaaauauacacucaggcuuuaagaaaacaaaaauaauuugcuggacucagaaggagagggcugcagauucuuacauucuuguuagcuacagauuguucuuguagcuccuuucccuuggaaagaaggcuuguaugaguauuacauucccaaacaaugaauccugaagagguaauuacacuguugccaucccauugggaagaaggcuggggcggugauuacauuccaaaacaaagcuauucggguauaauugcacugugcugcucuuaucagucuggcgaaggcaggccucuggucuccauccucauuuguuuuugagauguaaucugaauagcauucaauuaauagucaagacccaggcacaggaaagucagccaaaagagccaagaggacauuagcuugcuauugguguuuuccugccacugaaguuuuccauaccuaaguaucagcaaaucuaagagugccugcuuaaaaacauguguuugacuaaugaaaggacagagagacccuguuucaaucauaccucacuggucgcugugaacagcggacagauggaggguagcagggaauuuuuccucugacaccaucagcuuuuccucugucuacagauguuucuuccuuuuagucuuuuaaaagauguacuuuuuuaaaaaguguaugugugagggcuggugagauggcucagugguuaagagcaccgacugcucuucugaagguccugaguucaaaucccagcaaccacaggguggcucacaaccaucuguaaugagaucugaugcccucuucuggugcaucugaagacagcuacagugugcuuagauacaauaauaaauaaaucuuuaaaaaaaagugugugugugcuuugccuguaauauguauguauguaauauaauguauauaugugugccauguaugugcagcgccuguggaggucaggagaaagcaucagauccccuggaacuagguaguuguauguccccaugugcgugcuaggaaccaaacccgagucuucuaaaagcaguaagugcuuuuaaccacugcacauucucuccagucccgcucuuaaucuuuuauuaagauuuccagcauguauuuuuucaucuauauggcuucuaguuguagaacaaaaagcccuucucuguuucuguuaagauaauaagucaaauuaauuuuacuuuuggacuagaguaaauagcagaaccaauuuguuuuguuucaugaaccagagaauagaagauugaguaaccucauagucauguuuguuaaacuaggagaauaagguuggcuugagaauuggacauucaaaguagucuggccuccaccagaguuugcuggugaauaaaguaccacagaggugaauggcuuaaaauuacucacugcccuucacaugucuauguguggacaucuauuugauuuguuuggccucuuaacugccaucaugcucaguugauguggcuacauagucuucgauuauagaauaaugaccugccaaacaguaccuacccuaguccccaguggacauaagcuaugcuguauggcaggaaggccuuugcagauaugguaugguaaguuauagggcuucuuuucagggagugugaaaguuccuaaguugagaaguguacuaguuauuugucuaguagcucugacaaauuacccuacacaaacaguuuacggguuuguuuugccucacagguugaggcaaucuaucaugguguguagaauuauggaggugggaacuugaggcauuuggucacauugcauccacagcaaggaaccagagggcaccaaaugcugcugcuuagccccuuucuuccuguuaagccagugcaggacccaagcucauuacagugugcugcccacacuuuaguaaaggugagucuucccaccuguguuagccugcucuaaacaacuucccacaggccugcccagagguuuguuuccauagugaaucuaaacccugucuaauuggcaguaaaaaucaacuaucucgaaguggggggcucugcccuggauuaucugaguagucuuauuccuauuaugugaacuauuaaaaaaguagaaugcagaaugguuagucaaagaauuauagcuuucagcuacacgguaaugaagauaauaaugaucucugcuagauaucagaaaccucaguauuuuacauguguaaggaacagaauucuuacaaugacaucuagaaagacagaccugccaacuccuugggacacucguugaacuuuggaccuacagaaagauaauaaauuuguguuguuuaaaccaguaaguuuugccagcagugguggcgcacgccuuuaaucccagcacuugggaggcagaggcagguggauuucugaguucgaggccagccuggucuacagagugaguuccaggacagccagggcuauaaagagagaaagccugucucgaaaaacaaaaaacaaaacaaaacaaaaaaacccaaaacaaaacaaaaagacaaaccaguaaguuuguguuauuugugccagcaaccauaaaaaacugacacauaguggagucagcuucauacauguaucugggauuuggaaggaggguuggccuuuuuuguucacuaguaaauuagucucuuuacuguuccuucacagggucucuugauucuaaagauaggcaagauagguuaggccucacgauauaaugagccucuccuuuugucuuguguuauauugaguuuuuuguauguuuuguuaagacagaaucuugguauagcccuggccauccugguacucacuagguuaccuaggauagcuuugagcuugugaaaauccuguugccucaagcucccaugugcuggaaugauaaguuaaugggagacaugugccaguacaccuaguucccugugucccagguguauugaaaaggggcugucuaaaaacauagauaaugggagacuuguguuaugagggguuguuguaauauucuaccccaaguagguuugaggaugcuaaagagccugguaguucaugacgaacaauugcuucuguaaguuuccuuacacauacuaagggagaacauauggaggaauauaaauauguagauuugaaacauucaugaaagauuuuuuuacaucacuuuuauuauucaaagaaaauugaauuuagaaaugacaucccaauaaaaagguagcucugguuuucuagacauagcauuuuagagaaacuaccuuuuuauuccccuggguguuugcuaggaaaaagcccugcacuucugugugcuggaggaugaaaagaugugcaaaagagcucugugggugguugggccccuuggggccacauguauuucuguguaggaggaagacugacagaauuaacugggagcacuuacuaaauugucuguaagugaaccuguauucauggucucauuuauaauccacagcuccuuuaacagaagcaaauuagaagaaaaguuccuggaaacgauggcaaggaaccagucacugcagcuggugaugcuuucuuuauggagggaggcuuuucucagauugggucacaguguuuucaggcugggucaaacucgcacucuugcugccucagccucucaagugcugggguugugugugccagcacuccuaguuuacaugaugccuuuuauaaccgugguuggagaagcuagaacucaggucuucccuuguauaggacuuaauagucuacuugccuuucuugauaguggugguuaaaaacuacuuuauggcuccaaaguugaaugugugguuugggccucgaguuacauggagacaaaucagugcuugacaaggcaguuuuuagaacuuccuugguguucgugcagagccaucucuuuggcugcuaggagacauccauugcucuugggaagcccugcagucauauucuaaauaguauagccaaaagcuggcuuugaccagugcuuccugauggaacuacauaggcuaguaugcuugauaaacaucucuuugccuugccucagcgcuuagccaaaacucaugauaugaugguguggcagaacagggccacugcuagcuugaagugugcucccagaaagugagagaagcagcaugcucaucuuagccuggagugguggaaauguggaguucauucucaagucagaagagaggugccgaaaauggaaacauacagacuauguauguaaccuaaagaagcagaaccgcccucauaaggaacuuagaccuuaucucuuuugaccaauaguaagagagucaacagccucgagacaccugguauccugucucucuucucucaguguccugugagucuucuuucucucacagguuucaguauuuaaacaguuuaagcugggucuuucuuaaggcagaacccacauacauacauacauacauacauacauacauacauacauacauacauacauacauacggcugccaacaaagcuaacugagcuaauaaaaggcacaaaauaauuucuggucuaaauauuuucauugacucuacugaaguaacuggacuaaaaguggaaaauguuauauugcuuauuagguaaauuaacuaaaaccaaaaguauuauaaaauugaaguacauuuccucaauuacuaguuuuugcuuucacauaggaguacuauaggaacagcuuagaaguaucugcugugaagaaguuuuaagcuauucugucuuugucuugccuaggaagaauuuuaaagcccuguggguuagagcagccccaaagacaaggguuggcauggaccucuucacagaacuccccagcuauuauccaacauuaagccaccccagaaauauucuaucuaagugaaaauuguguacuagcucugcugguagcuucaugguaucaccaccuaacauguccuaucucacccauucagcugccaacagacucauguauaaaauucccugagcugcccccggguagaaauccauagcauguggaggaaagacuaagggggggggggcagccgggcgugguggagcacaccuuuaaucaggugaauuucugaguuugagaccagccuggucuacaaagugaguuccaggacagccagggcuacacagagaaacccugucucagaaaacaaaacaaacaaacaaaaacacuaacugcuccuuuucuucccucaccucauguacuuuuuuucccucuucccaucaucauuucugggaacuacauguuguagguuugggcaguguuaucaauaugguuuuuaggcuuuaaauggaggccccgcuuuuuccuuuguguucucaguaucaccuaugaugaaaagggauuaagccaacauagagagguacaggguucuuuucuggacuuggaagaaagugguagaguuucaaaguccugaugaauaaaauaaaacaaaacccuccagcaauuauuuguuuuugagauuagacuuuauuuaaagauguuuuuuguuugguugguugguugguuugguuuugacuuuuuaaccuuucugauauuuuaagacagggucucauaaagcucaaauuggccuuaaaauauaaauaacaaggcuggccuugaaucucauacuucugucucccaggugcuagaauuacaagccugugccauugcaccugcuccuuuucaggggaaggugcuggggcugacccugggucauguguaggcaggcacgcuucacugagcuauauucccagccccguuucugcuuucugcccuugagacugugucuuguuuuccaagccaaucuugaauuugugaugcucuuguaucaucuuuccuaguagcugagauuagaggccuguguuacuagaccugauuuguucgccuuauuugauuuguuugccacaguuucuuauucuaccuuucucagacccugaggccuuaaaaugaaaaagaaaauuacaaagcaaaaaccacaagagcuagcuuuguuuuguuuuguuuaaagauuuauuuauuguuauauguaaguaaacuguagcuaucuucagacaccccagaagagagugucagaucucauuaagaaugguugugagccaccaugugguugcuggguuuugagcucuggaccuucggaagagcagucagugcucuuaaccgcugacccaucuucuccagccccaagagcuaguuuuaguagacuuuguggcaguuuacaauucugagaaucaguguauguggaucauagcuaaaacacagucaagcaagcaguggccuugggagcaugccacuaaaagaaaaggcuggaauuugagguuaaacuuuaugauuuugacaaauuuauuuauccucaggacuucuauuaguccucgccccccuuuuugcuuccuccauugauuuaucugacauagaaugagaauuuguguguagagaaaugaacucagucagugaauguugauagcuaauauagauaagauugagugcuguuuagcuuuugaaaagcauacaagucuguuucccauuucauaggaagaccuggacaugaaacuguugagugcuucacuugggcuuuguugcucuuuugugugggaugguguuugucuugggguaggggugugcuccaugucaauaaugacucuuuccuucaauuuuauauuuuuuauuuuuauuuuuaagacaaugucucacuauauagcccuugcuuggaacucacuacuagucuggucucuaacucccaaagauuagucucagucuuagucccuccuucccucccuugacacacagucuaagugguaaacuuggaacucaacugauuuggcuaggcuggcuagccagaauuuccagagaucuaucggucuauuaucccuaauccagaucacuguauucaugcaugcaaguaauuuacagaaugaacuaucuccccagccccauugcuuugauauuuuuaaaugguaaacauuaggaaauaucaagaaaacacucuauagcugcuuucuuauaagaaaucaaauaugaaauuuucuauugauagaguuuauuuauaaagcuuucuauuccagauuauauauaacacuggacucugaaagcugacugacagauaaucuggguaggguuuaaagacacuuaucuuucccugucucuaccacccaucacuuccuuucucuuuucccucuucuuaaacaauuuaacccagcacccagaaagcagagacaacgauuucuguuaguucuagaccagccuugccugccaauguuacauagugggaccuugucucaauauaaacuauucuaucugcccaaucaauuuucuccuuuuucuacucuccaggagcugagguugguccuggggauagaaugcaggugucuuccucauguuacagacauagaugcagcuucucagucugaugugugaaccuuucauuuccccgcagggcauuuaguuccucugguucuuagaauugaaccuaggacuuuugcagacaugaccugggugucuuagugaacaauucaguauuucuguccuugagccuaaucuuuaucugucagcaaaagggacaacucuauagaaugaagaccaauguacucucauugugugcauuacacacuauggucucuaugagaugugcauaacaauauguaccuucaagcaauuauuucuuauuucugaagccacugaaaaauauuuucuuccugaacugguuguauuggugguauauaccuauaaucccaggccuucagagacaguugcagaaggaucugauguuuaagguuacucaacuacauagcaaguucuaagucagcuugggccauaugagagccuaccucaaagaaaacaaaagcaaacuaaaaggaaaaagaaauuccuuuucuuuuuuccuuuuuucuuuuuuuucucccucuucuucuuuuccucccucccuccuucuuuucuuucucccuuccuuccuuucuuucuuucuuucuuuuuuuuuuuuucucuuuguaguacuggcuguccuggaacuugcuuugcuuuguagaccaggcugacuauacucuguagcugucuucagacacaccagagagggcaucagaucacauugcagaugguugugagacuaugugguugcuggguuaguguucccacuaacuuagaguuucuguugcuaugauaaaacaccaucaucaaaagcagcuuacacuuccaugucauugaaggcagucagugcaggaacucaagauaagaaccuggaaguagggggcuggaaagaggcucagugguuaaaagcacugacugcucuuccagagguccugaguucaauucccagcaaccacaugguuugaugcccucuucuggugugucugaagacagugacagugcacucccauauauaaaauacauaaauaaaucuuuaaaaaaaaagaaaaaggaaaaaaaggaaucuggaaguaggacguaaaacagaagccauagaggaagcuugauccucuugacuugcuugccugcuuucuuacauagcccaggcagcaccccuuacccagagauagcagagcccacaugauugacagggagauaaagggauuggggugaggguccuggagaaauggcucaguggugaagaacacuagaugcucuuccugaggacgcguuagauuccuaacaccuacaugggagcuagcaacaguuguaauuccaguucuaggggauccaauacccucuucugcccuccucaggaccagagauauacaugugggcaaaacacucaaacacauaagauaaaaauauuuuuuacauguccccggacuuguuacaggcagaucuuauuaugaagguauuuucucaguugugauuuccucuuacuagauaaugcuagcuuuugccaaguugacaaaaacaaccgcaacaacaaaaacuccaacccuuuguaaaggguuuuuauuuugagacaagaacuccuuagguuguccagguagaucugaacuuauucuuuauccuuggcaggcccuugaacuugugaucccccugccucaaccuuuugaaggauuauagaccugauucccccggcccaugugcauuuucuguggggauguacaccuauuuguguguauguggggugggcaugaugugcacauuuguacaggggccugugggagccagaggucgguggcagaugucuuccuugacuguuuuucacccccuccuuuuuguuguucuuguugaacuaaucuauuuauuagggaaguguaauccccaaagaaucuauauggaugucacugucaaaggcaagaacuuaaaagguauaaacaacucuacagaaaucagauuaccaaaacuguuaguuuaaaacauuuuagaaauguuccuuuggaaggggugauagguuaccuuucugaaaucaaggcucacugaugccauuuggaaaauaaaacaaaaacaaaaaaacccaaaacugggauucagcuccccccacagcagccuccaucuuaaauuuugagacagagucuucaacugaaucuggaguuuauugauuuggggguagcugucacuaaggagccaccuaucuccaccaguaccagcccuggguugcagacaugccuggcuuguuuaaauguggaguugaguaucuugagcucaggucucaugguugugaggcagguacuuuaccaucuaagccaucacacuccugcguggcuuuuuuguugcugcuuuuuguuguuguugguuugguuuuuuuaacuuguuuuuguagaaaccauuguuucuuacuaaacuaauaguaucugacucccucaagaaccauauuuuuuuguugcuguuguuguuauuguuuguuugcaguguuggaaaucaaauaggggaccuaguauauguuaggcaagaguucuaccauuaagcugcaucucagccugguaaccacuuuauuuacuaagcuaccucuuucuuucuaagcccugguacucuuuucuuuaagccuccuuuaaggcuccuguuucucacugagcuuucuuggucuuuuuuuauuugcccucuguguccagugauucccuucuaagcagcuauggcucugguugucugucucuuauuagaacacucauguuuccuuucuucuguguaauguuuuugauggaagucuuaucuucuaaacuagguuuucaucuucaucaagcaaggagcauaucuuauuaccauuuuauagacgucuuccauagaucuguguuugaugaauaucuguuuaauauucaguucucacucagcuguccaaaaaaaaaaaugcucuguuuugugaucacuaauucuugauucuaggcauauuucaagacuuuguacuuuuguuuagauuccagaucucuaucuuugucagccauaguaagguugaaggccaagccuucauuucuuugcugaugacacuguugguuggcucaguguuccaaucuuuuugauagaacauaacauaugcaauuucuaucuugcaaaauagauauuuaaauauuaaguaugcauuucagauauauuuauuauuucaaagaaacaacuacaacaucacugcuacugagaauuaugaauguucuuccuuuauccuuuuaccuuuauccuuuuaccuugcggcauaauccucugcuggaaaggacugggagaauggggagggagucagcaaacaccccacucccacuguuuucccuugcacucuguaagcaccuacuugguuuuauagagaggugucauuugugauguaucuuugauuccugagcuggaaccccaggaccuugggcauuggagacaagggcuagagggaaugucgauuugugugugaaugaccauauuuuuauuuuauucaaguaugguaggaaccacaaguaaagaguuuuuuccuauuaaaaaguuaaguuaguuacagcuuccaagagaagggucccaaggggaggaagaagggugccauguagcguauaacacaaggcugucuuggaaauuacaaggaggcaaggggaaagcauagguuaucaaagggaagagugagugagguagaguaggugggcugcguaaagcuuaggacucugaacuauaggagggguugcuaguuguccauaccuugcccugaaugaaaacugucuacuggcugguuuguauauuaaagacaugucucuugauauuagcccugggagaacuaguucuuugucuguaagaccugaagaugucaacgccucauaaaauacagaaaaauuuaagaacacaacuaauacauuaucaucacaaacacaugcauauagugcauuugcuucugaguaauuuauuuugaccuucugaagucuguuuguagacgaacaccuuacaaccuaauuugggcagggcgguguggugguguacgccuuuaaucccagcacuugggaggcagaagcagguggauuucugaguucgagcacagaaaaaaaaaaaaaaaaaacugucuggaaucuggaaacaaacaaacaaaaacagaccccccccccaaaaaaaaaaaaaaaccuaacuuagauccugggaacuuaaugucuuuggauguuaauuaaguuuaucucuuaaaggggggggggggguuucccaguuaauuaccuguuaagugaaaagaguguaguagcaacuaacugcucaacuucaugguaaagcuuuucuuuccacuuccuugugaggaguuuguauuuugugccaagaagcuaagccugcauuccuaauugcugcauccagucugugcucgcagggccuccugaugacauuuuaaauacauggaaauuuuugaaugcaugaaaacaucuaguacugauucucugcugcuuuugcucuggcaccugcucuucucuucuuggaguugaucccauugccuaauucuguacauuguuuccaaaccuuucauuaaccauuguuggaaauuuugcuuuuuaaccucagcaucccugcuuaucagaaacagagcucucucugaugaguaggcaucuccuagaaugaaaagcuccccaucuuuucuuuucugacuuuucagagcaugaaaugacagugcuaauccuguuggccuucaggcagaagccacuggugaagcuaacaaaagaggaggccugcucucagcauggauccuccgcaggccauaggagggaacuuucacauuuuaccaacuugcagcaggauaucucccaccccagcuuuguuuuggcugcagacaugaaagaaguuaauucuuggaauguuuccccuauaugaaaccaucaauuucucuccuuucucuuccuucccucccaccccccugcuguccuucuuuccaauaaggucuuacuugcuggaaagugaucuaggcugcagccuaggcuggccuugaauugggagcaauccugccucaacccuuucagugcugggauugcaagcauguacccucacgcuagcuucucuuucuuccccuucacuuuguccauccgucuguccauccguccaucugucugugucugucuauuuuugaguguaaagaaucaauaaauaaaaacaauccauuauguauugaaaguauggaauaaugcuuccaaagagaagauggugucaaguagaaagacuagaaaagggggcuugaggguccuuaaacaggagcuaagaggcacagaguuuuacugggcauuacaaggggaggagggguagaggguagaguauccauaguaggauuagugugaaaaaaauauauauggauauuuacauuuaauacauuaaugaauuuauuaaaacauuuaauaagcaugaguaucaggaaaacagguuacagagagauuguugaggacacugaguagcagacaagaagucugccucguuucaaacaguagagagccuuugaaguuuuuugaguaaaugagucaaaauucuccuuuaaaaauaaucagucgccgggcagugguggcgcacgccuuuaaucccagcacuugggaagcagaggcagguggauuucugaguucgaggccagccuggucuacugagugaguuccaggguagccggggcuacacagagaaucccggucucgaaaaacaaaaaacaaacaaaaacaaaaagaaagaaaagaaaaaagaaaaaaaucagucuuggggcuggagagaguuaagaguacuuccuucguucaaagaacccagguucaguucccugcaccuacguugugauucacaaccaaagaauccaaaacccccuuugguccucucugaauacccguccucauauguguuccacauacauauauacacaggaaaaaauuucauucauucauguaaaauuaaguaaauuacucuaaaaaauaauaaaauaagucagucuugcaguuggguaccaguggcucauguuuauaacuauaacauguaugggucagaggcgggaggacuauuccaaguuugaggauagcuuggucuguguuguaauuuucaggccauccaaggcuacagagugaauacccugucuuuagauuacauaauauaauaaaaauauaaauaaucuaccugacuuguaauagagugaggagaguacagaggaauagguaauuuuuaaaaggaagagcccauaauuuauagaauuaauuauaagacuccuuugugguguucuaagggaaguuugccuauuuccagcuuucuuuguggugacuaacaauggaugugaccuugaaaaagcagaugcuaucccaccaugauccacaggauuccugacuugauagcggaucauguuuccuaguggcacacguaaacagcucugguaggaaaaaaaaggcaccaaaaauacaucgucucccuuugccuucuuuuguaaaaaucucuuuugaaagcuagaaauuugccaccagucuuucuucaacauuuaucuaaccugacauuuaaaauaagccuuucuugucuucaagguaagaugucaaaauagcugaccuggcauguuuauucauguuugaucugaucgaucauacaguuucuaaacccugaaguccauggccauagauggccugcuuuuaugcuauucaaagcucgugugacucuaugcuguucacaggggguaccaaggcaguagcucaagcgucacauggcauaaacuuguuauuucaagacuaaagauguguuucaagugaggaauuccaaguaaauagaauguagucuuucugccugcuugggaauuuagauuccguaucccaaaacacuucacucuagcucauuacugccuccuccacagcuuccugggcgagucugaagguuguaggauacugaaaagggcuuaucuuuguuccuuguugcuuauugcuucuuuccuugugaaaaauucuaaaaacaaaaaccaauugcacguguagaugucuauaacgagcguuugaacacccacuuguuagcaauguguccugcuucccucaacuaguugagauuuuuuuuuuaauuauuauuacccucagugaacugccauaccuaccaccuuucugggcucugcuagguaggcuaggcuggccuggaauuggugaucugcuuccucggccucccaaguacuaagauuauagguuuguaucauuauaccuuucuugaagcaacagauuaaauaaauaaaucucaguuaaauuugaaauuuauaggacucccuuaauuagauuuucucaauucacaaaaaggcaucuccuaucauuuauuugaaugguugcaauccaucuuuuauaacuuaaaauguuaguaagauaguauuuugguuuuuguucaugugguuguuugguuauguuuuuuuacuauaaaagacgaccaaaauauauuaauuuaauauauacuacauggguuuaauuuaaagaauagaaacaaaacaaaaauacuacugcucauggaacagaguucuuuauaaacauaaaggaaagaaugaguuuaaggaaguguuguaaagauggcuuaaggagaagcuggacagccacauggggaauuuuggcuaaaagcuguuugaccuugaguaagcaaggacagcuacugcugcuuccuccuucucuucuaaauacauucacuuguguuuaguguaguuagggacgaguaugggucccagggauugaacucagggucauuaggcuuggccucuaaucucccugagcuaucucagggcucccuucucccuuuuuaggagguuucuugcaaguacuucuuaaaagcuugagacuuuuccagaguuuggcagcuuguguugaaacagcugucaauguuggguucuucuaacaggauggagaacaggaaggucgugcagguggaccucuuguccuugagaugcccggcagucuugcuugagguguccacaugggguuuuauaguaaguagcaggaugugaggaacuuccucuuggaugcuuuagaagguuggcuacuagagauaagggcuuacauagauauagaauuuuauauauuuuauaugcuucacauguuugccugaugcccaaggaagccagaaaaguauguuggaucccuuaaaacuggagcuacagaugguugugagacaccguggugauacugggaacuaaaccugggucuucuggaagagccaacaauacuccuaaucaccgagccaucucucuagcuccaauuuuuguuuuuguuuuuauuuugagacagaggcuccuuauauaguuauagcuggccugaaacuugcuauguagaacagucuggccuccaacuucuagagauccucauaccuuagccucacaacuaacuucugggaucgaagauauauauuaccccuccuggcaauaacuuaaccuauuugaaaagauuaacucggagagaacagaaauguaucaccagacaucaggaaggccaacagcuccuguuguauauagccucuuguccccguccaccacugcuguacucaguuacuuugcaggcaguaccugcuuauaauucugggagacugccguggcagcauugucgaggggacagaaauuugaaggacacauuacagcugcuauuuucuugaaaauacauuuauguaaagcugagcaugauagcauauucuuguaaugccagucauccuaucaguuggcaggggguggccggaggaccaguucaaggucauccucagcuacgugggaaguuucaggucucccuaggcuacaugagcccuuuuauuucuuagacacaggaaaggcaucugggaucguucugauuguccuuacaaagagagccucggguucacgaguuucuuucuaauccugagaccaaagcauuuuucuauaguccuucaacuaagcauuagcuccauggaacauacuuuauuuagucuuccagccuacaaguauaccaccacacccaucaaugugacacuuaaaauugacccuuuccucucaaguagcucuccauuucaagaagaacaaucaugcauugccaacuguugaugugaugacuaacugcacacaagcccccuccaacucccaacuauaugauuggaaacccaacagguaacaagaguugggcuuuuuccccauuaauuuauucauuuacuuuacauccugaucacagccccucuccccaguaucccccucauguggccccugacaaguguuucucauugugaaaguaaccaguaggauucaggacacuuagaaagaggguuguguagguuuuuuguuuguuuguuugauuauuacuauuauuuuguuuuggucgugagucuuagcuuuugggguguguaugugugugagcucccccauuccaucuagacuggccuuugagcccccaggaucugccugucugugcgugguuacagucgugugcuggcauggguaacuuuuuauaggaaugcuagauaucugaacuuuagaucugucacucuuggaagcaaucacuuuaccccccaaaccucuccacagaccacuuuuugguuuuauugagauagguucuugcuggguagcccuggcuggcugcagauuagccucagauucacaauaauccuccugccucgccauccaaauguuggguuuacguaggucugugcccaguauuauuaggguuuuaagacuagagaggcugaugggaaccuguugacauugaaggggcauccuuggcugucucacagaaauggcucccuaagcuuuaccauuguaugccugggauugaugacugaacaguggguuuucauuagaaacuauuucaaaucaaguaccguuuucccaagauccacaacacugugugauucuggagauugucagugugaacagccuguggugagacuggcccauucaccauguuuucuccacuuacucuccagauuuaucaaugaguccuugcacuuuagaauggcugcuuggaaucuuauuucuaugcugggaucugaagggaaggaaaugcuggcagugucuucuuggaugucuguaaagcuucugcucacuaauauuucucuuaggucuacucagcagaauuaguagguuguuuuugcagaaauugaagcuaucuuuguuuuuugaguuguuugguuuuuuguuuuuuaaggaggagucucagagcccacuuagaauuuacuauguuccugagaguagauuuaaacuccuuccuguuccuucagucuccauuuccauccugcugggaucccaagcauguaugccucucaugagcacccacccccgucuuauuauuagcacaugcugccuccuuugcauuaggaguugccagccuuuugguuuuacuuuuuuuuaaaaaaagaaaaaaaaaagccauuugucuuagucacuguucuauuacugugaagagacaccaugaccaaggcaacuauucuuauaaaagaaagcauuauaguuucaaaggcuuaguccauuaucaucaugguggagaacaugguggaaugaacgucauugguuggagcaguaacugagagcuacauccagaucuacagccagcaggcagagagagaugcuggucuggcaugggcauuuaaaaucuuaaagcccacaccaagugacacucuuccuccaacuccaacaaggucauaccucuuucaauaaggccacaccuccuaauccuucuaaucuugucaaagaguugcacucucuaaugacuaagaauuuaaguauacaaaccaauauuuuguauuggaaccauucuuucaaacuacuaugcuguugggaucacacuagucucagugucacauggcccagaauauacuucuuuuggacuaaccuguguaagaucaugacuuaugaaaaguuuucuuucauccccauguaagcuaguaauaagcaagacuaagugcuguuguggagccuaucuuucugaccugacaaccuauuugcccuccaagcuccacggggcucucuguugcugagccuuuucugccccuagguaauguggcaguauaaaggacaccauguuauucuuggaggcccagggagcuaggcuuugaauuagaaaguuagucaagcuuagacauucugggucuguccugugcuaucuggauucuuucuugcaugcuggcccuagcuggcuaggcuguguaagcuguacccugacauguacaggugcucucuugacaggagguuuucaccucuagaagcugggcccccuaaugagaauguaggcucauagagcaguaauucacguguagguggccuguaaggaaaguuuuaacaaaagaguugguuaagaagcugauuuuuuuuuaugcuuuaauucucuugucaugugcugagugggggcggaagaggaggggaggguggggacuggugcuacugaaagcauuuaucuucauuucugccaucucccaguguuuauuacccugugaucgacagaugaggaaagcugccagucaaacccacguucagcacauuuccauuucccuucauugcaaauuuuaggcuuuugaaaucugcauccucuuugcagcaauaaagguuguuugccucuugcugcugacaagcccaagacccucugguccaauuccacucauuugugcuuuccccaaauaauaaaagcagcaggagucuccagaguucaagacaaaugauuggugagagcucuucagugagucagugagauguucuuuaucuuucucuccuuucucccucccugucuuaaaccuccccuuucugcccaucuuugcuccugaggcaugcugaaagaaagguagcuuuccugauuuugucuauaccagcccaccaagccaguagcaaccuuugucucugggaccuaaagauaggagaugccaggcuguaaauguuguauaaguaaaaagagaggagggugauagagugauucuuaauaaucuauccaccuguguauucucuagcagggggagcagcuuugaggaaauuuccgccugguggaagugauuacuaaguguuuuuuagggggaauuuuuaugaggcucccccccccccauuuuccuuaaaugcuguggguuuucagcaugcuguuccuaauaaucuuucaguagcauguguucuuauaagcuuauuuguuuuugucuuaaauaauguuuguggguggaagaaagguaaugaucuucauuucuuucaaaauggauauucuacuuucauaauuacuugccucaauuauagcauuaguauaagugcaaguaauugcuucauuaggacauauauaacaaagaagguaggaguacuacauggugauagaaaugggcuaaaguuugaccucaggccucagagauaggaucugccacuuacccugccaauagccaagauuaguccucaguuucaaagagauaagaaggagucaggacccaauaaggagcacucauucucuuuauuuaugguggagcacaaugcugaacucugguguucuugugauuucagagcaaugugacugaaucacagauuagaaaucauagucuaauggcagccucauuacccucaggcuuucaguagaucacaguuuaguaugaacccuccuuuguuugacaucuuugcuggaaaaaaaaaugguccugaaaagccucuagaguguuucccagucagauauaaccaccuugcuuuuuucuuucuuuuucugcacaucucccccacuaucccccacccccuaucccccauuccucuguguaguuuuggcugucguggaacucagagagauccaccugccucugccucccaaaugcugggaucaaaggugugugccaccaccaccuggcucuaccuugcuguuuuuagcagacaguuugaugccaugucugcaaauagcuuugugagcauguucucuacuuaugugucucuuuuucaagguguaugcuuaaaaagcccauacuaauacucuguuaauagucuacaucuguguuagcuaucgagauugucaaguaaugguuggcaauauuaguuagagauaauaaaauuucauauguacaauauaaaaauauccuggagaguguuuuuacaacacuguaaauauacuuuaaccuaaaaacuguuuuauauuauguucuguuucacuguaguuuuuaaaagcuaauacuagaugcaugguacuguuuacauucugaauugguuguauuucucauugcugggauagaguacucugacaaaagcaacuuauuucaacuuagaguuaagaaaguaguuagcagucagggcagcaggagcuuggggcagcuggguacuuuucauccucagccaggaauugaaaugacgaaugcugcugcucagcuggucucucucucccuuuaacucaguccaggacccuagaccauggguugaugccacccacccuaaaggcugcucuucucuguuaaccugaucuaaauuaucgucucaugggcauguuccaaggcuaaacuaauccuggcaauuuccccaaggugugcuugcuugacagugaaauuaaucaucacaugaugacuaugggagggcagugcacgcugcauagguuaauuuuucuuucuucuguugauucuccuuuaaaccauaauccauugaagcuauacaaucuucauuugaauugucuugagaaugaagcuaugguauguagaaaguuucaguagcucuuccuuucuuugcaacuauccauaguccagaccuuacccauuuucacacugaauccuuacacuaauguuuguuuuauugaccacauuugauaccuugguuucaauaauaccugucuuuauucuguucccguaguccacaauuuagugcaugguggcgcacaccuuuaaucccagcacuugggaggcagaggcaggcagauuucugaguucgacaccagccuagucuacagagugaguuccaggacagccaggagccagggcuauacagagaaacccugucucgaaaaaaaaaccaagaaaaaaaaaaagagagagagagagagagaaagaaaaagagaaaagaaaagaaaagaaaaauuauauccccuaacauuccucuuaguuucauguuggccuggggugggggugccaacucaguucuaacuauagguaguauucucauuuauuaccucaaugcacagacaauccauacacauauagguuacccagguaagcuauauacaauaagagaacuaucaaagaacuggacagaggaguaucaggacuuaaaggccaaccuuagcuacagcaaguuuaaggccagcuuggccuguuucaaaaaaccaaaaccaaccaaccaaaaauaauaaaaaacuacaggggucuaguggugacaugccuauaaauugaacccaccugggguucagcaggguuaugaguucaaaacuagccuaggcuacauaacaaaaccuuuccuccaaaaguaaaauaauugcaaauauaauaaaauaaucccaggggcuggagagauggcucagggcaccuggauguugggaagcucaaacuuccuauaauuccagcuccaaggggucugauaccuuuggccucugugucucuggcacuaaaguaauacacacacacacaaauuaaaaauuuuaaggauuuuuuuuuuuaagaaaaauacagggggcucaguaguuaagagcaccgauugcucuuccagagguccugaguucaauccccagcaaccacaugguagcucacaaccaucuguaaugggaucaguguccucuuuuggugugucugaagaaaacaucacuguacucagauacauuaaauaaauaaaucuuuaaaaaugagagagaaauacagcaagccacuauacaaaugaaaagaaaaggauauugccaauauucugugguguggucgagcacgccuuuaauuccagcacuugggagacagaggcaggcggauuucugaguuugaggccagccuggucuacagagugaguuccaggacagccaagggcuacaaagagaaacccugucuugaaacacacacaaagaaagaaagaaagaaagaaagaaagaaagaaagaaagagagagagagagagagagagagagagagagaaagaaagaaagaaagaaagaaagaaagaaagaaagaaagaaagaaagaaagaaagaaagaaagauggagggagggagggagggagggagggagagagagagagagagagagagagagagagacaaauggguacugaaaauaagguuacuuaaaaaaaaaucggggaggggggguuugugccugguggugguggcagcagacaucuuuaaucauagcacucuggaugcagaggcagguguaucucugaguucaaggccagccuauucuacagagugagcucugggacagccagagcuauacagagaaacccggccuuuuuaauuuuuuuuuucuuguuuguuuuguugccuacauaacucuagcugaccuguuacucacuauguagaccaggccagcuuuggauugacugagguccacgugccucuguuucccaaauacugggauuaaauacaacuacauugaauucagcaacuuuuuaaauacccuuacugugacaugauucaccuauuugaagauguaagucaguggcucuuaaaagaauaaagcagccgggcagugguggcacacgccuuuaauccagcacuugggaggcagaggcagguagauuucugaguucgaggcuagccuggucuacaaagugaguuccaggauagccugagcuauauagagaaacccugucucgaagaaggaaaacacaaaacaaaacaaaacagcaaaaccuuaaugguuuggcuuuaugguauuuuaauuacaucacaauaugauggucaguaaagauacaaacuaaaccgggcuguggugaugcaugccuuuuaaucccagcacgugggaggcagaggcaggcggauuucugaguucgaggccagccuggucuacaaagugaguuccaggacagccaggacuacacagagaaaccuuaucucaaaaaacaaaaacaaacaaacaaaaaaaacaaaaagaauaaagcaaccauuucuacucucuuuauaguuccagacauuuuuaucaccaaaacacccuuuaggcauuaacagccacuuuauucuucccccuccuuuuccuuucuuuacuucuagccccaggcaaccauuaaugugcaguucugguuuuguagcuuugcccauuccagguauuucauguaaauggaauucuauaauauguggcuuucuaagaagaauuaugagaaauuauuaaauuuguucacuuggaucugcccugagcuuucuaggcucagguuuacuuacuucuuagcagguugaaucuaaacuccuguaagacgccagcaaggcagaggcaggaagaguaauuuuaugguguguuuguaucacugcucucuauccccuuacuguuggggauggaaccuagggccuuuugcucgguagacaaguguucugcuacuaaguuaugcuucuuagcuguacccccagccccauucuuaucccaucuucccagcagcagcacauggccauucuaaauuacucaaucuccaaugaaacagauuuuguaggacugaaauguaauuuaaacauuuccuucuuugcagcuugcccuuuuuuacccucuucaaauuagccuuucugauagauuugcuaaugauuccauuguucgguugucuuacugagcuguugaaucacgaucuucauuuccccguuccuagaacagauccuggagauagacuaagaagcuguuuuggcaaaagauuccaaauucuuucuaagcaacaguagacugagucugagacaaacagaggcagagaugcauacaggcccucaguuguguagaccugucuguccccuaacuguugucacuaucaugauuuugccucuagacuuugcugauugagcaucucuaaucuaaauauucaaaauucaaaguguucgaauauccaacacugugcaucaucauuuuuucaggaagauuuauuggugugugggucuauguagaagccaaagccaaggccauggaauucccugaacuggaguuacaggagauuaugagcugccugcugugcgugcugaggauugaacuccuguccuuugcaagagcggccugugauuuuaacugcuuagccaucucucuagcaccugugcuuugcaacguacacauuuaagaaauuacaaagaaaauaaagaaaaaaaauggucagauuuucgaagcugagcauagugcccuuuuuuuucuuccuuuuuuuuuuuuaaagauuuauuuauuuauuauauguaaguacacuguagcugucuucagacacuccagaagagggagucagaucucauugcggaugguugugagccaccaugugguugcugggauuugaacucaggaccuucggaagagcaguugggugcucuuacccacugagccaucucaccagcccuuuucuuccuuuuuucacauuaggaauuuucuauuuuuaguuggagucauguguucuuuagcuuuugugcuguuuucacuaauaacacacacauuuauucuguuguauaguauguuagugauuccacugccuuccccuccaucccccagacagacucuuaauauguagcucaaaugaacuuggaacucacacuguagaucaggcuggccuugaacucuaagagaaccagacuggcauguuagugcuuuuuuuuuuuuuuuuuuuuuuuuuauagacaggguuucucuguauagcccuggcuguccuggaacucacuuuguagaccaggcugaccucaaacucagaaauccaccugccuccgccucccaagugcugggauuaaaggcgugcgccaccacugccuggcuuucuuucuuuauuuuuuaaagcacauguacuacguguacuaauguuuucuuuuuaaagauuuauuuauuuauuuauuuauuuauuuauuuauuuauuuuauguauauaaguacacuguagcuguacagaugguugggagccaucaugugguugcugggaauuauacucaggaccucuuauaguuccagucugaauauuuauuauuacauguaaguacacuguagcugucuucagauauaccagaagagggcgucagaucucuuuauggaugguugugagccacuguguggcuguugggauuugaacuuaggacucugaagagcagucagugcucccaacugcugagccauuucuccaacccauacuaaugcuuucuuguuaguauuucccacaguugauucacacauuuauugaaagauaucuuggcuggaugaaguucuggcaauugugaauaaaguguuguacacauuaguguguagguuuuugugugaaaauaaguuuuacacucaugugaauagauagaaaagagaacauucaugugaauagauacaaaaaagcaggaaugcuggaccuauuauagggagccagagaagaccacucagacauagcuuauagccuuuaaaagucuuuauuccaccugccugggacuacacucagguuuuugggagguggagccuaguaauaguguaggccagggucuuuuaaaggcaaaaaucacauccuucugucacacaugccagcuucagagggaaguuugcacaagcaggcaguuuaacagaaacuaaguuacuugggcauugggauucucuaucaagaucaaauucuagcuaaaccugaaauggcuuuagcaggaauacaagauggaggaaucuuuacacugucuuaccuugucacagaucauaugauaagaguacauucccuuuuccaggagacugucaaacugucuuuuaaaguagaugugccauugcauucccaccagcaaggaauauuacuccagauauugccagcauuuguaguuaucacugcuuuagaaguuugcagcgauaaaacauggggaaugguuucuccuuguuauuaaaugugcugcucuaauggcugggcuggagccucuuucaugcgcucauuuuuuucuguccuuugcccauuuuaaaaaaucagguuguugguuuucuuuuccuuguuugcuuccuugcuuccuugcuuccuugcuuccuuccuuccuuccuuccuuuuuuccuuauuucuuuuuuuuuuuuucucaagacuggguuucuacccuggguuuccuggaccucacucuguagacuaggcuagccucaaacacaaagauauccacaugccuuucugcuucugagugcugggauuaaaggccugugccaucaaucacugucugauuugguuuucuuauuauuuaguuuuuagaggguuuguuguuuauuuucuugcuuuuuaaaaauuuuuugauauucauuuugagguauauucucaguuaaccagacugaccucaaauuccugauccuccuacuucuaccuucuaaaugauuuagaaaaaaaaccaaaguuauaggauugauguuauaaaggguuuguuaaucaauuagcacaggagacauuaaguugcacaaguagaaucuuguuaagggagcauugucaccaccaaaauaccccacagguaacguacuaugcuagcaggucugugacguuuagaauguaggauguaaauguuuauguacuaauaauggccagccauuaagucucauucccuuccucaacaaaagucacaccucuacuggacaucucauggggcaacauauggaucaucaugaaguucuggucugccauuaaguuuccugugcuuuuaucacaaaaaaaaaaaaaaaccauaauuuuuccaguggggcaagauaacccuggguaacaacuauuccaaaaagagcaacacugaugucauuaaaaauaauucugucaauaugaaaugccuuugcuguguaaaucugucugccuaaguggugagacucagucuucugucuuuguuuaaauuguuugaaauguaaccuggggcagggaccucaaagagauuuaaggauggcagugguuuuguaaugcauaagccuaagauguauauaaauuaguaaacucuuauguugggagcuagcucuuuuuuggaccauuagccacagcuagccaggcgcuuuaguaaauuacuuuccgucaucucuaaguaugugaaguaauuuuucuugagaaggcaauuauuucuguaauaugagugcugggauuacaggcguucaugaccaugccaagcuauuacauacuuuuuuaaauagauaaacccagauucaaauuauugauuuauaaaaaggucacacuacuucauaguuguaggaaaugucagucaaaaucugauacauuugacucaccuguguuuuuugaaaccaugaaaaaaaaaaguauaaaauuguaagauccuacuuuaagcuugcuccaaucuaagauagaaauagaaaaacaugguuugcuaagaaguauuuaaaucauucuauaccuuuuauuaauuuccuuuuguauaaacuggcauagccauucuaugguguaggguaagcaacuccaugguuaaggggaaaguuuuuacuguagauaugaaaaaaacaucuagaggcaucuggaagaguccugagcagagagagaaauaguagcuaggguaagagaagccugagagcuggagggagucuagguuggggaggauaugagaacgacugggaggcuagcauggacuuggaaguguauaaggauacuugugauucugaaggagucugaaggccaauaugcacuuugguuugcugauagacaccauaaguagccauaugccccuucugccagagguaggggaauugacuuuauaaggggacuagcuuauuaaguuccugaggagucuuuuauuuaacacucagaaauccuccuauaguacagguugagcucauucuggauauuuugacuuuuuuuuuuuuugcuuuuucgagucagggucucucuguguagcccuggcuguccuggaacucacucuguagaccaggcuggccucgaacucagaaauccgccugccucugccucccaagugcuggauuaaaggcaugcgccaccaccgcccggcugauauuuugacuucuuauuggaggauggagaaauagaauuuccuuugggccugacaccuuacauuaucaaugucacagucaauuugagucccuuuagcagaagauauucuaagagcaauacuuucuugguuugguuugguugguuuggauguggucuuacuauagagacauacugaccuggaauaggaauaauaauauauacuauuauuauauauuuugcccucccaguugcuuuaauuauaggcauaugugaccaugaccagcccaaauagaucuaaaguuacuuuucuuggaauuacaguguagcuggcauaaagcuuaccaccuagggauggcuuuuaucaauaggaacauuuggugauaucuggagaaauuuucuuugguugucacaguguucauggguagaagccagagaugcuuccaaauguuuuccaauacacaagccucuucauuguucuuugauaaaugaucugauuuggaauaucaguaaguuuggcaguuaaaugcugaaucuagggcuagagaaaugacucagcagugaugaguacuggcugcucuuccagaggccccagauucaguucccugcaccuuacauggcaacucagaacucuauauccaauguaccuaacuccacuuucugaccucugcuggcaccagacacacauagagugugcauaaauauucuaaggcaaauaugcauacacauaaaguaaaaacagaugcauuuuuguggguuuuaaaagguguuuuuguuuuugaggcauggucuuuuuuucuauguagucucaacuguccuggaauuugcuauguagaucaagcuggccugaaacucagagaucugcaugucucagccuuccaaguccuaggauuaaaggcauucuaccacuacaccuagcaaaaauaauuuuuuaaauaaaaaauauagccaggagugguggcacaugucuuuaauucuagcacucaggaggcagaggcagguggaucucugugauuuuuggaggccauccuagucagcagggugaguuccaggacagccagagcuacacagugagaccuugucucuaaaauacauaagccaacaaacaaacaaauaauauuuuacgaaauuaauacugagauggguaguggugacgcacgccuuuaaucccggcacuugggaggcagaggcagguggauuucugaguuugaggccagccuggacuacagagugaguuccaggacagccgaggcuauacagaaaaacccugucucgaaaaacaaacaaacaaacaaaacaaaacaaaacaaaaaagaaauuaauacugagucuaguuuacuacauaugaaaauauuuaagcauuagaaaucauuuagccuugggcuggugagauggcucaguggguaagagcacccgacugcucuuccgaagguccagaguucaaaucccagcaaccacaugguggcucacaaccaucuguaacaagaucugacgcccucuucuggagugucugaagacagcuacaguguacuuauauauaauaaauaaauaaaucuuuaaaaaaaaaaaagaaaucauuuagccgucaagauuugcuucuaaggcugaaugccaccucuauccauggcucaguccauuaacuaacuggcucuggcacauugccugcaccuugagccaaagcugcuaagugguggguggguuuuuuggguuuguuuuuuuaaacaggacaaugcuuuuucuuccugauguuuccaagagacaggcgcaguuggccagcagcucucgugcaagagagccuggugacgauacuugaaucuguugcuggcaucuuucacucccuaaucuguguuuacacggcacugaaaauugacucucugaugccaagcucuguuucugugcaguacuccugcacgguuggcagagauccccucccuagucucuucacaguaccacccuacacguguauuuauugcacagcuguuuucagaagcguacgcuguacaggaugucucuggaguuggggcuagagcugaaaucauuuuguucccaguuacaaagccagcaugugcauuucugaaccuuuucccugguuguagauuuaaucuucugcuugagaaaauaguuguuucuuuaaucucucuuagcaacuaacauuuaguucaucauacgugaagaaagccaauuuacuucuuuguguuugggguuagagauaugcuuuucuaguaaguuagaagaaaugguaaggagcuaaagcagucugagacuggcuguuaaaggagaugucagugaucuagauaauagaagugaaagccuggggaauaauuuggaagcucaguggaaugaagccucuaucaaaaugaaaagugauuccuuccagggaagugguagaucuucuaacuaaaaugguuugcauuauuaaugaggccaagaaaaucugagccugauucuuuuuaagaaauuuuugggcuggagaauggcucagcaaggcuaggcugacaaccaaaaauuaaaaaaaaaaaaaaaaauccugcaggcuuugauagugugaaauucuagagucauaaaacccacuaaaaucuuucagaaaggaaaagaaaagaaggaaauuccuacagacagcagagccucuuucuugaccuaauaaucagcaaaauucucacaucagauuuuuuuuuuauugaaaauagauuuuccccccuuauaauagauucugauuaugguucccuucucccaguuccuccuggauccaccccaucucccuaaauuuguauacccuuucucucucuauuagaaaaagacauccaaaacaaaaugaaaacaaaccagaauagggcaaaacaaacaugggagaggggcaacaaagaauguguacauagagauguuaaagacacaucacauucacauauacagaaauuucauggaaacacacaacuguagacaauaauacacaagaaaaagaccucuaaggcagaaaaccccaaccccacacugaagaaaccaaaauagcauuaaauuuguuuuguguugaccauguacugcugggcauaggccugcccuuuaguguaguuuuuacacccagugagacuccuuuggagaaaacuguuuuuugagaugggagcucaucucucagugcuggaacccaucugacuuagaccuguggggcgcucuacgugcugucacagacugagaccugacuuagaccuguggggcgcucuacgugcugucacagacugaggccuuuugugcauuaggccuguuuugucuagaaggccuuuuugcuuugugccuuccaucuccacugacucuuagaaaaugucuacuuguucuuccacagaguucucugaaccuggggggaaggauuugauaggaacaucccauuuagaauugaauguuccaagguuucucccucugcacacuguccaguugugggucucuguauuuguucccauuuacugcaggaggaagcuucucugaugauggcugagcaaggcacugaucuauggaucuaacagaauguuguugagaaucauuuuauugccauguucccuuuaacagaacaguagugcuugguuuuucccuaggucuguggcuguuucaucucagguucuuggccaggcaagcaguguugggcccugucucauggagugguccuuaaauucacagcaggucaccauuguagauagaaggcuuugaagcugcauugguguguuugccuuucuccucuaguagugcgcagaggacccuucaguacuauggacacugcucaguaggggcgaaggcuccagguaggcaccagcucgacuucucuguauucagugaauuauguaggugucaguuucaacaguagaaccuuaucaucaguuuguggagagcaaccaauucuuuuagcaauagccuggguuauuuagccuuccauugggccccuuucaccaacagcuugauuagaugugacucauucccagcacuggagguuucauuugguggcuggauaugucuacuugggucuuugucucuuuguuauuugcugauuccauuuuauauaugcauauauuuuaagaaacuucaucugaauuagauuuccacauggccccucaaaugguccuuaguuuuaccuaccccgcccuguauccccccucuaaccuauacucaagauuuuuuuuuacauuucuuugacucugugugugugugugugugugugugugugugugcgcgcgcgcgcgcacgcgcacgcaugugcuugugcaugcacauacuacaggucagaggacaacuugugggggucaguucucuccuuuacugugugggucuaaaagaucaaacucaagucuuuggccuuggcagccaguggcuugccuagugaaccauuucaccaguucccagauacaauuauagaaggagaauuuucuguguuaaaggaagguagauaaugcaccucauaugaguggucauauguagcauggagccaucugguuugacgucaguggccacauugauaacaccugcaaaugcugguuucuaacgcuuuugaguacaucacacuuguuugauacuguguuugauuuuuguaagacuuuaaaacuauuuaagacuaucaguuuauuuacaauaguauuuuucgacuuguuuguuuguuuguuuguuuuuugauagaggguuucuuuguauagcccuggcugucuuggaacucacuuuguagaccaggcuggccucgaacucagaaauccgccugccucugucugccuccugaguucugggauuaaaggugugcgcuaccacgcccggcgcuauuuuuugacuuuuauuuaacuauccuucucccaagacauuucuuuucauucucccucccauggacacacuuauacaugguguguguccauauauucuggcauugagaaggagaauuaaugagauuauacuaaguuuaugggggcacuccuuuuuuuaauuauuuauuuguguggaaaaguggaaagaacaagaacacacacauacuccacagcacauguguagaggucagaggauugagacaggaucuuauuucugcugcuagucugugugcaggagcuuccauccaguucucugccuccccugcugcuguaggagugcuggguuacaggaguacagguauacucuuccacaucccaucuuccuggccuggaggcuuuuacuucauuuuggccccauaagccuuuuuuuuaccuccaggaaggcaauauuggccauguugaaaccauauagccuaaaaaugucaucaucuaggaaaugaacuguuauuuguaucuuuuguuaaauuaaaacugaaagaaggacuguuaauaaacuaacacugaaaaauaucuucugguacaguagccagcagcuccuagauaaggaaaaagaguaaguuuccuauauuucaugauuguguagaggguagguucucucuuggucauuugaggaaagagcagagaaaucuagagacagcagaguaauaaauguagcucuucaaaagaaacaaguagagguguuuucuccgugauauucagaagucaagggcuagaugauauugaugaauucuggcguaaaacugccuugucccaggcaugucagcaugggccagaucugcaggggaaaauaccauauagcuuuucuugcuauuguacaaggaucuucuguucuccugagaaggauugguucugccucaucaaaagggugggcuguguaugaaaugcaccuaggaaggaggaggaggaaaugacauguucguguaaaugaaauacaacugcaaauuaaagugucacccuguuuuaaaaaaaucaaauuuuuauuuaauugguuaccaaggaaaaaaaaaugucauacugaaguguauaucucagggaaaauuaagcugaaacauuacaagugaaucuggaaucaaaggaaggucuuggagaggagcauuuuaaaaaauugccuuaauaaaaauaaucucauguuacaaaggcagacucauaaauaucugcuguguuauaugccugcauuucaaaagagauuaacaguguuagcucauuuguucuuuacugccucucuccagucaccauguguugacugccucuucucuggaggaaguccucuuuugagaugucuuauuaggaaaaaggucacuaaaaaaggaggaccugcuucuccuaacacacccagaacugcaaggccugaacugaaauucaccuggucuguguucaugguagcuuccccuuguugucaaauuucuuuacuaacauuugcaugaaaacucaucuguguccccagauaauguauauauucuuagacagcauauauucaggaccugacacauuaauaaugggaaggacaugugaaugauguuccauuuccacauagaacuguuucuugugaaagguugugucuaguuucucuuugcagugacuugccauguggaucucucaaucuuucgugaguuuuaguugugauucuucuuuuucuccucuacuaacucauguguuccauuauauucugcaguagaagcauacagaaaaagaaugcacuguauguagucuaauguggucuuguugucuucucugucaucaggggcaguaauuggagauggacagucugcuguggccaguaacauugccaauacuaccuacaggcuccaguggugggacuucacuaaguuugaccuuccagaaaucaguaauggugaguagugaugggcaagauggguuucuggugagacagaacuuugaaaaauacaaagcagcaaaguagcacuggauugucugucucucauuaaguuguugauggucaugcacuauuucuguaugcuuagccucagcuaccaguaacacauuucagaaaacaguuuaggggaaacgccagaucucccccgaggaauuuguggagagauucauagagacuaaaagacuaaaagagguagcugacauugagaaaaggccauagugaguggagacuuguuggcaaauccaagccucaacuaagcagaugagugaugugauuaauaucuguuuacaaaugugugugacugauagauauguuuccuuugaaagacauccauggucccauuguucagcauugcagauguuuccccugccuaaggaagggcuuuugugcauuccuaagaggugagaaucagccccaaccugucugcagcugcugauggccucacugucacuguuacauuucugcuggaagguucuuucucacagcaagcuaccaugagucuuucuuuugaggucacuucaucccauucauccuauuucugcugcugcaacgccauguaauugguuuacuucuuuuacacaguccuucaguaaucggaaaguuccucuacaucucaccuuucagaucaaagcucugcagauuuuuuuuucuaaugugguuuccuaucuguucuuucccccuuuaacuuugugggugaaacagaacagaucagaaaauuaaugaugugugcuaaaacgcaauacagugauguuugcuacagaucccagcagcguuuucugaaguuaauauugcauuuacgguaacuuaaaguuccuugauaacuguuaguaagccagcauucagcccguuuguauuaucuuccugucguugcagugcuaguucuuccuugcagcaccuuuauuuguccuucucuuucagucuuagggaucaucugcuaauuugauuaacauucuucucagucuuccuuuagauuucuagcaaaaauggcaaauaaaucaggaaauugcauuaagccuuguuaagguauguuuuuggguuccuaucaugguuuuggaacaugaauuauuuuuacuuucgguuucacaucugaagcucuucccuguuaaagacagcuucucagggucuggggaaacggcucagcaguuaggagcacuugcuaauuuuccagaggacucuagaguucaguuuccagcaccaugggaaacucacaagugccuguuaacuacuguuccauaggauccauugcccuuuucuggccucugagaguacccaaacauacauucacagaaaauguacacaugccagguguauuggcacaugacuuucagucccagcaucuaggaggcagaggcaggcaaaucucugaguucaaggccagccugauuuacagagcaaguuccaggacaguuagggcuauacagagaaaccccgacgccccaccccacccccaccuacccccccaaaaagaaagaaaacauacaugaauacacauauacauaaaugaaaaguaaaacaagucuuuuaaauaaaucaauaauaaaggacaguagcuuuguauaguauaggcuagccuugaacuaguuguccuccugccucagccucaaguguuagggccgcagacaagcacacuuauguuuucaguaucauguaaagcauuguaagaguuuggagauacagcuaaaaauaucuugauuacugaaagauaaucauuuuaugauguaccagucuuuaauauucuuaucagacaagauaaaugagaauaauuuuuaaugcuuuguucuuagugaauccuaaguagcaacuacucauuuuauucuaagugccuauaagccauaaaucaagucaaguaaucuguucuuuugauuuuuuguuuuauuuauuauuguguguagguaugcacaugccacggcacauguguugaggucagaggauagcuuucaagaauaaauuaccuucuuccacuaugaauucuggggguuguacucaaguuaccaugcuugugagguaaaauguuuuuacccacugagccauuuugcugacugguacacuaaucuguucuccaauucuucuaaaaauccaugguagaagagucugccuuuuccuuauugaaaacucaaguucaucuguagauuugugacucauaucuuauuggccauaguucaucuucaguuauuuuuauuuuuuuacuuuaucauuguuuaaauuagauaauauaguuacaacucaaaacuuacuuaaaggauauacaauaaggggcuggagagauagcucagcaguucagagcacugacugcucuuccagaggaccugaguucaauucccagcaaccacaugguggcucacaaccaucuguaaugggaucugaugcccucuucuacuguaugucugaagacagcugcaauguacucauauaaauaaaaaaauaaauuuuuuuuuaaaaaaaggauauacaauaagaacuuucuuaacccuacacccugcugccugugacuccuuguaguagguaaccacuaucaguuucaguucuuaucucuugaaagaugaauguguauguguguauaugcacauugagagcauugcuuuccaucuuuugugugaucuaaauguaaauguguuauacaacacucuucucacuuuuuuuucuguacaguguaucucaugaucuuccauauuuuuguaaagaguaugugugugagugugugugugagugugugugucuuauauguaugcaucuaugugugcucaugcagaggccugagcaagaugucuguagacuuccucuauugcuucucauccuacugccuugagagagucagaaggcacgcaggaucugccugucguucguuccucgguacugugauugcagaaugccuuucuuccuuucucccuuuccuccuuucuaccuuucugugaccaguuuauugcuuuggugcugggagauuuaaacucaaguucucaugcuuucaggacaagcuuguguuuuacccacugagcugucucuaguucuucaugucuuguuuagagauagggucuuacuccgaaucccagguuagccgggagcuugcagcaguccucuugucucugcuuccuggagugcugagauuauaggcaugagcuaucacucugguggcagcugcagcugcugcugcuauugcugcuggugcaggcagcccccacagcugccacuccuccuccuucccugccugcaccccuuucuccucuuuugaaaaaauagcuaccuaguaauucauuauaaccaguguccucuugaaggacuuuggaguucauaaucuugcuauauaaacugcuaccgauugucuuacacaugcaugucaguaggauagcugcuuugaaauacaacuucagggaaggaaaggugcauguauuauuuugguagauauugccuuaucucccucucuacacagcuuguuccaacuaauaaucucaucuauaggcauuguuuguuccuuuuuguuuucaaacaaauccucacuguagcccaagacugguuuugaauucagaaaccucuugccucugaaugcuuaggauuacaagugugagccaccgcuugccuugcuccacccccauacucuuucugagugcuugauuuuauaaacacuugcugaaggaaugucuuuccaaacuucaauauuuauggauuuaauaggguaaagaucacuacaugagcauuuauguuucuaucuauuccuuauguuccccacauccuuaauggugcugccuugucuuggcuggccaagugcuuuaucucuuuuucugcauguuacugcccccccccucauaauucuguagaaguucuuuauaaauuaaaaaauuaacuuauaaaaggaguuucuugucauuugucuuugacuuuguugaagguuauuuuugucauagaacuuauuuuaagucaaaauuauacaccuuuccuuuuaugguuccuaggcuuugugucaucauuaagauaauuuccuaccuuuuuuuugguuuuugguuuuucgagacaggguuucucuguauagcccuggcuguccuggaacucacucuguagaccaggcuggccucaaacucagaaaucugccugccucugccuccggagugcugggacuaaaggcgugugccaccacuggccaguucauuuccuacuuuuauauuuuaguuuuauacauuuaaaucuuugauccauuaggaaacuuaguucuagacaaccaacugcuaucuaugcauucaauaucaauuuaagcuagcuuuuuuuguuugguugguuuuuggcauguguuuggaguuggggguggcagguggaggaacauuaauaaugucuccuagcuguccuggaacucucuguguagaccauucuggccuugaacucacagagaucugccuaccucuuucuuccaggugcugggauuaaaaugaguaagccauaaugcccagcagguuccuauuuaacuacuuuuaacugauuuuaacuaaaauuauagcuaagcuauaaaauauauagucauagucuugaccuuuacucuugauagauuuagucaguaaacugggacucuguugcuguaggauucguuuuguuuuguuuuucaaagucaucugccuccugcuagagguuagcuuuaaguuucagaagcugugcuccagccuggaagucacugaucuuuaguuucauuuauggguucagcaggcaccauguugcugcucauaugauuuuucugaaucaacuuuaacccuuuucuagaauuagguuaaugauucuugcuacuugcuucucucacuugagauuaaaggagcugaugaauuuacccugcguuggaagcuuagaauguugugaauaaugcuucaccucauguugauuuuuauuuauaggugugauugccuauauauguguauguucuauguguucaggugcuugcagaggccagaaggugguguuggauuuccuggagcuagaguuccaagagguuauaagcugucugauauaugggugcugagaauuuaaucugugccuucuagaagagcagcaaguguucuuagccacugagccaucaucuccagugccucauguagaauuuuuaugcugcuuucaugaauaacaaccccucuccccaaaaaagaucaauagagugagggaaaagcuaauuuaauuaaauuuacucugggauucuugguuuguuuugguuuuuugguuuguuuuuuuuuuuuuuguuguuuuguuuuuguuuuuuuuuuuuuagacagagucucuguaugcuuguccugacuauucuggaacucacuauguagaccaggcuggcuuugaacucacagagagacccaucugccucccaaggcuggaauuaaaggugugcaccaucacaccuggcucccucuuaauuuuugagagaaaacucuucuuuggugaaugaauggcuuugaucacuaagauauccugccaaaacaggccauaagauccaguggauauggagacugaugccuguaaggugugauaauagugcaauccggagcucugaucugcaguagccagaggaacucagagauguagccaagaggaaauugugcuucugauuuaaacccuucuggguuuuccaaaucucugugugauggguuuguaaagcacugcagcugccaaucacucucacggucucauuuggauggcaauaggcuaccuauagagcuuuguguaagguauaguuuauaauuuauagaucugauaggaaagcagagcuaucuacuuuucuggacaucaguauuucuagucccuccuguuucuugcuaaaacauuuucacuaggaaauaauuucccuuugaagguacuccugaaccucuugggguuuuguguuugcuuuuucuuuggcuauuugguugguugagguguuguuguuguuauuuuuugagagccacuuuguaacccuggcuggccuggaacaucagaguacaucagaauacaucagaguuacaucaaacuugcugcuguccuacugccugugcacucuaucccuccuuagagcagugguuacagauauacacacugcuguacuugccuccccugacacccuuaaguaguuuugguuuuauuuucuuuccauaccagaauugaauucagaaucuaccacguguaagauaaacauucucccauugaguuauauauauauauauauauauccccaguucuagcugcccucuaguucuuucccauaugugucucaccacuaaaggacaggcucaguucucagccguggucccaggcuuucagcauuugagccaccuggggccuugcuggagauauuugcccucagccucugcccagcauuguucaggugucacugauccaagcugcacagcagagugagguauggaaaaucaacaggauuuuccagugcugugagcugacaguggcuuaaguuguguuucauucacaucuuuuuuccuaucuacuuaccuauuugcucaauccaaaauggggugaguuguucuuuaccuuuaaaauguuacuuuucucuacccaagaacuguccuugugcauauuaucuaacuaaaauuucaacuuugugaggggaaacugcacacaugaacuauaguaaccacugaccauuauaacuauuuuuguuucuaaacaggaaauuauuaagcaacagacagcaaguguaaguugcuaauuggagcuuugaaagaaaaaugaaauaguacugucuauauaauagugccaggugcugucucuaauggagcuaucauauuccucugugugccuaucaaauaccuuuaaugggguagaaacauaggcccagauaaauagaucccuagcugucuuucugagcucauuauaguuaucaggagcuguaaugaaauuggguagacuuggaagagggagcagacuuugggaaguaaccauugacuuuaucaaauacaaacacaaauauaguggcuuggaaucgagucugacagaauguuuuuugucuaucugcacaguuuuugcaagcuuuaagccaagcuuuccagaagaaaaaccauauauucucuuauccuuauaauuaguugcuuaaguuaauuagaugcuuaagaauguuaguaguuuaaguuuauucauuauggccccccccuaccacauagugauaaugggauugagccuagguauccucuauauagcuaauauucuuccacugcaauauccccagcccucuuuguuacuuucuauaguuagguuucacuaaguugucuaggcuguccuugaacuaucuguauguagcccaggcaggccuugaacucucuguauguagcccaggcaaaccuugaacuuccuauccaucugucucagccuuuugaguagcugcaauuacaggccagugccuguagguucagcuuauuauaugcuucuguuuuuaaccaaaauucaugcugauauauacaagcuagaucucuaucaucaagacagaugaacugucauauauaucgggaacauagaauagaaugguaauuaugcaaaguaguccauagcauucuaucaucuuccuauucuuuguuguguugugguguuguugguguugauguuguuguuguuguuugagacaagguuucucuguguagccccuggcuguccuggaacucaaucuguagaccaggcuggccucgaacucagaaaucugccugccucugccucugccccucugccccucugccccucugccccucugccccucugccccucugccccucugccccucugccucccaagauuaaaggugugcgccaccacugcucagcucagcuuccuauucuuaaucccacuuaauauuuuuaagauucauuuuuauuuuuauucauuuguauuuuuguuuguguauauaugcuuauagacauguaggugcccauagauacuaggaaaaggugucagaucccuuagcgcuagaguucaagugguugugagccaucccaugugggugcuaggacucaaacucagguccuguuggaguccuugucaagaucaguacaugcuugaaacugcugagccauuucuccagcccuucuacuuaauauuuguuacuaucuuuauucccugccuuugguggcaauucuaaaccauuaaguuuuuuccucuuacuuaggauuaugccuauaucaagguuagaaaagcaaaauagacucacuccugaaagcgacuuuaauauucuuuugugucuucuccuugacuagaaucauguggauccagaggaaauuaccauauucuuggcaaaaguuuugggacccugugucaggagcagacggucccaugcuaacaagauaaaucuagucaugcaggcuggagcagauggcggguugggaguugagcagcagagaggccuaauggugauagcaguaguauuuggaugucauuauuuuauuaguuagcaaacagaacuguccucaguuuauuuguaauggugcuguaggugucagcccccagggauuggcacaacagccuaaucaauuuguucugaugucgguuuuaucuauucuguuaucucuguagcuuuguuagcaacacauagggaaaggggaacaaauagaacuuuacacaucacucaaucucuaaaccugugagccuuuuaaaacauucuuuuugcuuuguuuuccuugucuaguuuccuagggaaacuugcccuuucugucucacuccugaauuuugccuugcagggauauauuaccuggaaucugaugacgacagccuaagcuugauuuggcuuugcuuuuaacuuauuuuauuuuaacuuuacucuucuaaugguggacaucucuuucaaauaagagaacaaguauaaagucacuuuaaguggaguggagcuaagugaagcagagcuugggagcuuggccuguuuguauguguccuagugaucugccaguguggguggcaggugggcccuuuguaaaccacuuucccuuagcagggaaccccacagugcaaacauugaggguucaaauguaagccaaagcuaaacuaggugcaguccugugcucuccagcaucucauuagucccuucaagcagagugugaucuccucaccaucucuagccucuagccccgacuuuguuuuguuuccucgucgguccagucuacugccuagccagccagugcauuauucuuaguaauguagacguagauaaagucuaccuugggacauugguucaugguauuuaagaggcacagaguauaaugagaaaugcacagaacucccacugucuaguccagggugggcuuuguuucugucuuucuucuguacagaguugggauuaguguuccuggagauauaaacauaccuuucugaaauggcuaccuucuuugagaucacauagcagguucugaggaggcuuguuuucccaggagcgaucugccugcauccccuuuauuuuagaaccaguggcuuuguguuuucauuuaucuuggcuucauacuuugaacaauagcagcauuagggugggucuccaggacauuuguuaauaacuuuuuucuuaucuaaucaguugugaacuaagacucagaugguggcaaggauggaaauggacuguccuagaguuuuucuacuaagugggauaugcacagauccuuccugccucucuuauuuccucuuagauuaaucaagacagcuuaccccauuuccaaagaggagucaugcccuuagaagggcccaaaaacaucauggucucagaauuucuaacagugugguguuuaaacuuucuccccuucuuuucuuccuuccaugcagccucugugaauguccugguacagaauugcaagaucuacaaugaugccagcugugacauuucugcagauggucagcuccuggcagccuucaucccgagcagccagaggggcuuuccugaugaaggcauccuggcaguguauucccuggccccccauaacuugggggaaaugcucuacaccaagcgauuugguaagggauaggaagcccaaccuaaugacagaguugacgcugaugccuuggcauaggcauuccuaggugaggcauggagugcaugggugagaguaauggucacauacuaccuaccucugccuuuguucacugaggcacaggccagagaaagauugcuuugcaggagagcugccuauagcauucauuacagaagagucucacaguaagaguucuuccugccacaguagcaucacuagugcgccccugugacaaaggcuagcaauaaggaaggagcuuuuuagcuguggcauggaaagcuggguaagcacauauacuuacugcaaggugauuuggcuuuguguuuuaaacgccuuccaaaauauguguguucuuuaauccagauuuuuuuuuuuuuuugguuuuucgagagaggguuucucuguauagcccuggcuguucuagaacucacuuuguaggccaggcuggccucgaacucagaaauccgccugcuucugacucccagagugcugggauuaaaggcgugugccaccacacccggcucagaaauuuuacucuaaggaaauaauagacuucuaaagacauaaucagaaaacuacaaagauuauacagagauauuugugcuguguuauuuaucauuacaggaaaacaucaaauuguuacuucaagagauuuuuuuaaggaggagcuuaaauuaaaaugacuauacagugauggcauaaaauacaaguagcuuuaacacugcucuuaugaaagauuauuuaauaauggaaaagauuuauaaugucuaagugaaaaaaauauuucagaacagugcuuagaaugugcuaacagucuuguaaaguuaugagaacccuaguuaguauucauuagugccaauuguucaccacacuacacugcacacugcaacccuagaagaucaccugagcauagucagacuaugaaagcuggagaaaaggagaaaggacugcaugaaaguugcuuccauggaacgucaagaguacugagaaaugugacugucuucucuugguccucaggucccaaugccauuucuguaagccuguccccgaugggccgauacguuauggugggcuuggccucacgaaggauccuacugcaccccuccacagagcacaugguagcccaggucuucaggcugcaacaggcccaugguggugagacuuccaugagggugagugucauuguuuacaucucuccuggacugugaugugauccucuggucgggccaguacccuaguccaggugacccaugaccaggaacuuucagcugcaccuauugucauuguuccaucucgagagguugaggcaagaagauucuugccuuaaaauaaaaauauagacaaugggaaguaguaucuugguggcauacuugccuugcgugugagugaggaucauagcaccaagaaacacaccucaggcuucaugcucccuaaccuccaugugaaccuguacugcagagacacgggaagggcccaggagauaaaguucuuguucugcuuugguauuaaggaaacaaacuuuuuuuuuuuaauuuauuuuuuuauuagguauuuuccucguuuacauuuucaaugcuaucccaaaauucccccuaggaaacaaacuuagaaagugauuguauaccaugauucuaccauguugugguggaacaagaggauuuuaggcagcuucuuugcucugaauuaccaaacccuuuuaccaacagaguagaaaugcuguuuaggacccacuccuguauaaggcaugccccucuuguauggccaugagaguguauuggguguaguaugguuaauugucuucuggacucaccuagacuaguguggcugacugaguuucccucauccucuaggggcuuauuuggccaggguuuugucagggagaaucaagcauuugaacagcucucuaauuagauaguauuuaagcuugguuccagucuaagcacuggugaauuaauuccucacuuucauguagucugugccauuuauaguuccaugcauuuggugggguuguuuuauuuuguuauuugguuaggguguguguguguguguguguguguguguguguguguguguguguguguguucccuuuagcugugugucauguaugguuaaucuaacccagcuggguucaauauaaguuccuuaagaauaaagucccugggcccuucaucuagugcugugcuuguaaagacuuguugaaugcuuggacuaggaagcauuuauuaucaagaaaaaaauaguagagauaugcaaagugauggaagggugugcuuggaguggucuuuccuuugcuggccucuucuuccucugguuucuuaauuauaguauguuuuggcugacugagauacugaacugcuuuucaaacucugugaaccugauacagauaaggcucuuguuugccagaauaccuuaaaaccugggauuuuuuccucuucugcagcuugaguugcccucaaguuuguccccuccuuuggcagcuuccuuuauagaacugacuacuccuaccugacugaguacacaccauuaugcuaauacuugucucaccaaccugcaguuguuucuauaugcuggacuuuagcuccuucagagagcagagucgccuguuuccucuuuaugaaauccaaguaccuaguagagaaccugaacacaguagaaacuaagugaauuaaagagaaucucagaaaagcaccuuugccccuuaucauuuucaggugguaacuaucaaaaugggaggcauccuugaagaggcagcaacaaggcacucugcuuuugauaaugagacaguagaguucugauacuugaguucuguaugggugagaauaagaaagccaagcucauuuucuuaacuagauaccugaagauggaaguagaguuuuaguguaguguuguucuuucacuaauccugagcaccuggugucugccucucaccaccuacaucuugaucccaacagcucuucuaauuaguuguaaaaaaauaaaaauuucuuauggaucuuauugcagugaugcuaauacacaucuccagcuacuucucaaaacccaggccucuugcccaguuccuaggcaaaacuugccaucucuccaucuuucucauaaucagucagaaauaccuggcuaaaaucaaauaccuacaagcaaaaacgaaggugucuuuugucaugugaggccagagcugagggaauuuguuuggaggauucugcugggaagauaggauccaguugguccacugcugucuugcuaaggcauucaauggcagcucgcuagcugugugccucaugcaagcagcuguuucugagcaugcccaucuccagugaggcuuuuugauucucauuaaucugucauuagguaagaaaacugaggugacuggaaaaaucucauuugaaaagcauuccucucaccuagaggaucaagguaucucaacaaagauuuugcucaaucagacauucaccaacucugcuuuucugggguuuugaggucuugcuuguuccuauauucaaagaaccaaaguguucaguaaaugucucuaacucacucuucaguggaagggaagccacacauguuguaugagugcacacaugcguguguacauguguguuuugcuaggauuuaaaugccuucaugcaugcuuggcagccugagauucccucuuuuaguugugcuagguacacuguaaugugccauccuuaggcacacugugaugugccugccauccagcauauccagaaauuuugucaaaugggacugaagcaucucucugccucggugucugccuaucucucuucucucucucucucucucucucucucucucucucucucucucucucucucucucucucucuguauaguuuagcauaggugcuucucuaucuguaaaguuagcuuugcccuugaaacaugcguaugcagagaaggagccuagagauucuccaccauguauuuccuccuacccacuaugcaauaacuucuuggauucacuaugauaauauucaaagagaugaacuuguuguaccaacagacauucccaggggaaaauccucugggguauugauuuauuuuaauucccacuaagugaugucucucgaaggagaugaucucuuacaggaucccauaugaaaucucuucuguaaaugaauugcuaauugcuguuagcuuuggugugcuuauucuaagaguucaacaguagugcuugggcauuggaacuauaguuccuauguaacgggggcccucgaaaacacagauucacuuuagaccuccagucacaagcguggguucuggugaucccagcuacucugaggcugaaucaggauugugcgguuggaggccagcccauucuguuaugaggccguaucuccaaauaaaaaguauuuacaagauauaacagugguacagugucuguaucuuaaaacaagcuucccauacuagagaaguggcucuguggcuaagaccauuuacugcuuuugcagaggaccaggucuggcucucaagcacccaccuggaggcucacuaucaucaauaacugcaguuguagggaaucggaagcuuuccucuaaccucuaagaagggcaucugacacucauguggguggugccuguacaaagaugcaagcaaacacucauguauauaaaaggguuuuagaauuuaaaacaagccccuuccucccagugguucugcucgucuuaaugucuaccaccuucaccaggguguugccuuuaguauuucagcaaggcaagcagaggcucaaucucagauuuucuuacucugucaugagucugagguauguccugccuugauccuuugcugauuucauugcuguuucuauucuguuuccaccaaacuccgcuucccccagggucucacuguauagaccaggcugaccuuaauuuacagagaucugccugccuuuaucucccaagcucagggauuaaagucucccuguccuuuucuuuuagauuuuagaagacaaugcuuuuauuucuauuauaucuucagauaguuauauacacuucugguguagcuugguaggauagagcuaguaaagacuagaacuguucuuaacugcgucaccacccaguccagccuggucauggagcugucauugguucaucaagguaggagggcaccauagagcagagcaauucccaucacagcccacacucagccuucugcgugccugggcuucaccucuaaucuuuuuucaguuguugagguucuccaggucauuuguucacuuaguuguaccucuucaaggcuuugauuccucaggucgagucauuuucaguucuguccuguuucuaggagggaagauccuuuuaguguucccccucgaugcuuucugaggcuccuucuaauucugagacuuggcagagccaggcuccuguuuucugucucccuucucuguccacuagagaaccccuaagcuggaggugagacucuauaacucagucaccuuugcuguuggauucccuuucacuagagcaaguaagggcuuuuuguuaauuucuguuuuguuuuaaguuaggcuuuuagagacugcugagcugaaguuuugcugaauucccaaaacacuaaacugccuguguucccgcucaacuuucauuuucuaauuggaacaaggcacaauauuguaacagaaaacugcaauuaauuuucuaaaauaguggcaacuuccacauuauaauaacuuugguuguaaccaagugaaagcacaauaacaaaauuacuaaugaagccagaaauagucagauaccaaguugcuccuugaguuuguguguauaagcccuguguuacucugggaaagagugaaaagucaggguuagggccggggcucaaggacaagggauuuacuaggcauucucaaccaggaaguaggaauaaaaagaaggauuaguaucuuccaaugggaguguuaacaugucacguucuuuucccuaaggcauggacuauccuuccucaacagaugcaaauuauaggcagcagacaaaugguuuagagcuggagcuaaguaguagagugcuuuucuacccagugcaagaccagauucuauccccagcaccacaaggagaaagaacuggaaacaauucucaguauauuagaggcucaaggaacuugaagcucagugcuucuggcccauauaccaccaccccacuuucucucuuucuguagaagugauggacaagagugccuucauuuaacuugguugggggaauaucagccuauuuauugaaaaugguuuguuuaugcaauaaagcugaauuuaaaggcucaguauuguccugguuagccauguggaagauguauuagaaugucugucugguuuucauguguuugugaugcuagagauugaaccagaccucagagccuguacauacaacugagcuacacccacagcucucuucccuucuugguuuuaugaguucugcuguuuaguggugagcucucaucugguuuacuucuccaguuccuccuauuaaccaucuuuuagauauuuccaaguagcugagaaauugauggguauuccauguccuaggcuuucugggucauguuaaccaucauccuaguguuagugcccuggaaagauuagggacuagaacugagccaggagugaugcacaccugagcccaguacuugagaacuaaagguguaggauucaagguuagcugugagguagaucaacagguaaaggcaccugccacuaagucugaccugaauuuaauccuuuaaacacacauagugaaaggagaaaacuagcucucaaaaggugcccucagaccuccacauacuuauuauaucacagacauacacacacauaaagcaaaauauccuuacacauaaaauaaaaauaaaucuuacaagaaaaaaaaaaaaaagacaagccuagacuauaggaaaaaaagcacaaccaauauccaccaaagaagauuaauuggaaagacaugauaugcagagugcucaucuuccuguaauuuccauuguagcuuagauccuggaucugggugugugccugaagccauggauccccuggaccauccuacauuuauuuuaaugugucuaaucuucaccacuauccugccccagacccccaccuguguauuuuaaaacuuuaauuuucuuuuuuuuuaaagauuuauuuauuuauuuauuuauuuauuauauguaaguacgcuguagcugucuucagacacuccagaaaagggcaucagaucucguuacgggugguugugagccaccaugugguugcugggauuugaacucaggaccuuuggaagagcagucggugcucuuaccugcugagccaucucuccagcccaacuuuaauuuucaaaggugauccaaacucugacuuggugaagaacacucagaagguccaagggucugaauuauuucuuagucuuggggaagcagauuuggcuuugagugcggaguugauacugaaauuacagacucuuuauuuuuaucuauuggaaggauaccauuucuucucggaaagauugggacagaagcaaggcagcuuuguugucaaaaaugauuuaccucuuaucaagauucuacccucauuaauuuccuuaaagcugccugucaguugauuaaaagcuguuuccgcugcaauuaucuuaaaguugacuucagugauguagcacaaagcaucuauccucaaaacguuccucucuucagaacauugcagaaaaguaggaggggcaaguuaaaagucagaggugucucugaugugauuugucagaggaggggagaacaagauacaaaauuaaaaauaacauuagaacugccaucagagccauucguucaggagaauuuuuccaugacagucacacagcucugaugauccccucacacauacucaccccacggugucucucuuagcagaauggaguccauacuacaugucuucucaaaagaaaauugugcugugugccuccuguagguauuaaacugaaacucuuaggacccagggagcucugaauuaagaguuuauuagacugggcauguaguucagcaacagaguacuuacuugccuaacaugugagcagcccuagugaaucaccaguaguggaagggaaaguaggguauguuuccuccaccaccuacagcaaggcuagauagcaguuugaaaaaugucccuaaaaccaagaucuaagaguguuuuguaacaaaagauaagagaaagaaaauguaaauucacauuggaccuacauuuuuaaauaugaggagcagaauuauucugugacacuggagaguggcuguugcaucugaauuggagaaaucaguagcuaacgauguuagccuugguguugaauguaauaagaauggagucaagguuucaauaugcauucaggaaugugagagagggucuuucauuaugucuaauuaauguuucucaucacuuccuuccaccucccuccacucuuuuucgagagaagguuucucuguauagcccuggcuguccuggaacucacuuuguagaccaggcuggccucgaacucagaaaucugccugcuucugccuccagagugcugggauuaaaggcguucgccaccacgcccagccuccacucuuugaauuaaauucaggucaucucagaauuuugcuucugucaagguccagguacuaggcugagucuaggaauauaacaguggccagagaccucuugugcaucucaguuaauaauuugcugcuuuuguuuuguuuuguuuuguuuuguuuguuuguuugguguugggggcugugguugagaccauccugcuagguaaccuaggcuggccuugaauucaugauccuccuguuuuagcuuccuaaauucugggaucacaagugugucccaucaugccaggccaaccccugcuuaucauuuggucuuaucauuuccacuuccaaaaucuuuauuguguauggcacccaggaggcauggguuguuaguuccgugaaugugugugucauugaguucuguguguuaugugcuucccaguuccugcauguacauaaucuguucacugccaccgguguacacaguaaaccauaauugagcaaaggccccagggaggagcuucuuuugaaaacagggagucacuuauucauugugauuccgcuauucuuguguuaaccaaauaaaaagaggaaaauuaggggacuggagagaugacucagcaguuaagagcacugacugcucuuccacagguccugaggucaauucccagcaaccacaugguagcucagaaccaucuguaauggggauccuguacucucuucuggugugucugaagacagcuacaguguucucaccuacaugaaaucaaucaaucaaucaaucaaucaaucuuuaaaaaagaagaagaagaaagauaaugaaaaaaaggaaaauuaacuagcuuggcauucucaucguuauuuuuuuaaaagauuuacuuauuauuauacauaaguauauuguagcugucuucagaugcacccucucucauuacaggugguuguaagccaccaugugguugcugugauuugaacucaggaccuuuggcagagcagucaguguuccuaccugcugagccaucucaccagcccccucauuauuguuuuauaauaaacacuccauuagucuuucucuuuucuugaaacagucuuucgcucuagcucaguagaucaugaauuuaugaucuuucugccucaccuccagagugcuaggauugauugcaacuauaugccaccauacaugguuucaaauaacuacuuaaaaaagacuuugaggcuggaaagaugacucggugguuaagaauccauacuucuguugcaaaggaccaaaguucagaucucccaccauguugagugacucacaaccaccuauggcucuaguuccaaggggaucugaugucuuuuuauagccuuuugaagcacauagauacacacacacacacacacacaaauaaguaaaaagauuaguugggggggagcggcacugaaaauauaguucagcaauuaagagcucuugcuccuucaggagggccugagucaguuaccagaacccauguccaguggcucacagcuagcugcaauuucagcuccaagggauucaaauccucuucuggcaucugugaauuuuauuuauauauauacaugcauauauauauacacacacauauauauacacacacauauaugcauauauauauaaauaaugguuugagucaacaagaugguuuaugauuagguuuggcaccaaaccuaaugaucugaguucauucaauuccuggaauccacaugauacaagaagagaucugacuccuacaagcuggccucuguccuauacuagugugccauggcauucaugagagcauucacacacacacacgugcgcagaaacauaaaugcuuaaaagaaaaauuuaauccacaccaggaguguuggugugugguuaaguggaagaguguuugacuaguauucauaagguccuggguuuuaucuuuaggacauaaaaguaaauacacaggccuuagagauagcgaauguuacucaaguuucuuagaguuccggggauguaauaguaguggcagaacacucaccuagcauuuacagaauuauacauuagaucccuaacacuacaaaaagaaagaaaacuaaagcuaggcauggugauacaugccuauaauucaguaucccagauguugagacagggauuguaaguuucaggccacgcuaggcuguacagcaaggccaaacccaucucaaaagaaaaaagaaaaaaauaguaauagugugccacccuccaccaccugcccuaggauauguguuucuuggccuuugauuaagacaccuaucuauccaguguuucuugucaucuucuuuccaauaaucuuucccaucuaaugacacuugguuuucuucuaucaccuucuuuugaaaacuuaaaaguauccgugcuuucuaacagguuuuccaucccagggcccuucuauccucuauuucuccuuucuugaaccagcuuccauugucuuaagguaacauagacccaccaacugcauuagaccccuagccagcacuauaaaguuccaguuucacugauguuguacauaaaagcaacacagguuuuuuucuccuagcuucuuaacuggcuggcucugagcaaugcaguuuguugcugagcuaauggccugaguuuuauuuacaugcaguagaacagaaggguuaaaggcuauagcaugcuuuuccugugcuguguuguguuguguuugggacaggcuuuuauagagccuagacuucucuagaaugccuuguguagcacaagcaagccucagauuuggaaucuucugccucuaccucuguggugcuaggauuaucauaugcaccacuaugcccagauuucucugcauuuuaaagguuuuccacuaaccuuucauucuucuuuauacucuccuaaacagaaaaaaaaaaugcuuucaguuuuggaacuuuuucuuuuguuccuaccaaagcugaaguuuaagcaggugaugcaaagaauaccauagaaguggaggggucacaaucguccucugcucccucagaacuguaaagcuuuggcgaccugacccaccucugugggugugcugaggccgcaugagcacuaaaaucuguucguuuuagcguacugauucucauuuccuuuauagaugacagacagaaugaaaaugcuguacuuuaaggggagaggugugcuguuagcaucugucauguucuaggguauuagcuacagcuaaagaaggugagacuaggacuuuucaggcuugaaucagcaguuccguuuuguauccaaccuugcguagaguccccagguuuucauaauucucuuccaauguccuagaauuaaguaguguaccucaugggaagucacuuuuguccuggggucauagagguuggcagacuacuagcuugaccuuucacauccccugaugaauuucaggacacuugaacaaucuuaaggaaaccuugcuuugaacuuucuucauugaaccuuagcuaaggcaaagcuauccccuaccuacacugaugcccugucugugcagauggacuugaucccaucccuacugcaguccccauugagucucacagccaaccuggucucugguuuagacagacuaaugacugagaucauucauguuucgcaguagcuggagcuaucaaacaucugucacuauuggggaaauuauugccuaguuaauuuucucaucuccagcuucuaggugcuaggaucacagaugugcucagucaugccaggccaggaguuucuuaguacaucaagcauaguuaggacucaagccaaagccaauucuguguguagguaaaagcucaaucagcuuuaugaccauagcagaaccagucuggaagagugccaacagcuacugaacacauuguucaguuccacaccugaaaaguuacugauaaucaggauugugucuguguggcaauagcauggaagugcaugcauuguagagacuguuggugaaggccuuucuagcugauacacaaagcacacauacccaauauuuuuaaauccaagacugcuugguuugagcagauuauagaggaagcccuuaguuugauuuuuaacucuuuggagugggacauugagguagggucauaccauguagccuaagcugaccgcaaaacugagguccucuuacccagccuuaagagcugagguggaagggucguuugaauacaaacauugaaggacaguuugggcaagcauacaccaccccaguuuuuuacuucauuacuuuuuuauuuuagucucuuuuuauuuuuuuuaaguguucauacaagcauauucuuuucucuccccuuuuuagucucuuauuagaauaaucagaaaaauaauuaucauccagagugguggagcacaccuuuaaucccagcacucuggaggcagaggcagauagaucucugaguuugaaaccagccuagucuacagagcaaguugcaggacaaccagagcuacagagaggcccuaucuggaaaaacacaaaaaauacacaaagaauuagauauggcuaagauagaaggaucauuugaacacaaaaauugaagggcagcuugggcaagccccuguuaccaaaccauccuaaauuucauuucauucauauauauauauguguguguguauguauguauacacauacacacacauauauguauauauacacacacauacauauauauauauguacauauauguguauauauguguguauguauguauguuaauuucugaacaaccugccucugucaucccuaagcaaguaaagguagagaaaguucaucccugcuguguaguuuaaaaaccauggaggcuagaacaaaagcagagauacaugagaagagacagaggaaaugagucuccauuccuaucccuucacagacccuuucuaaagauccuagaugaacguucccagcaacaggaucagcagcuacuguuuauaagcuuguaccaugccagacaacaauuuuuaugucccuccgugcccaaguuucucugguuauuugaaagcaaauguguuguugguggugguggggguugguugauccuguucuccccauuucccugccaucugcgguacucagcauguaacucagggcuuguacucacuuuuuuuuuuuuuuuuuuuuagcuagaacaucacauagcccaggcuaguuuuuaugucuggucauccugucucuaccuucuaagugcugggauuucaguuguguaauaccaggccaaguuuauguggugcuggagaugaaacgcagggcuucaugcacgcuuaggcaagcauuccaccaauugggcugcauccucagccuugaauggggagacuuucaggccgagaucaagacaaguuguuauguagucacaucaggguucacaguuagguccaaguaaaugucccugucuuuucauuucucuccucccugccuuagucucugaccaaaggcucuuuugaaaggauucucagguagagaccuuguagcuggauuucccuucagcccaaacucuacaugcagcuaggucacccucaggacagaguagcuugggaagauaacagaagucacugaaagggaaaguucugccuuugaagaaggagauccaucuaauggugguuuauauaagccagaaggcacucacaaguagaagguuccucucugcucugcuccccacaucugaauacaccuuuuggguuuccuuaacaauagcaauuuuaacagugcuuuuaauuagaugaauuaagaauguucucugauguugucacccccucccgccccccuaucaccuccaauucccuauuacugugagagaucuggguuuccauaguaacaauacuaccagcucagguugccuuucacugguuauacuggucagaggaaaguauggccauuccauucuguguggcaggcugugggugagaccuuuaagguccugaugauagagggaugaggugagggguacugagaggcuaagauguuaagugugcuccuaaaagagaccuugcucucuggaaagugaaagggcucccacuccuccuucaccagagucucaaauaugaguugaaagucagcccauuccagccuaaaguuuucucccuucccugugguucauugauccuugcauuuuauuauuuuugauaacaagucauuucuccucccauucucucucucucuccuauccagagaguuuucaauguccuuuaccccaugccugcagaccaacggagacacgucagcaucaacucugcccguuggcuacccgagccagggcuugguuuggccuauggcaccaacaaaggagacuuggugaucugccgaccagagugaguugcucaagggaggaugugaggaacgggugggguauggacacuaucugaucagaggacuaaacaaaauaguacuuacuuguaggccuggccagacagguagguccuuuuacacggacaaucuaaaaccugcuagagagguauuggagggagcacgugaaaaagaugaguagagggaugaaguugaaaaaaagccugcauuacauaacaagacccuaucuuaaaacagagagggguuaaaaaaaaaaaagaauccucuguuuuauguuggucccugaaccaccuucucucaagaugaaguuagcucuucauuccaaaucgugucaaaaaaacuguuuuaguuguuggguguagucagguacccauaugaucccaacuguuuuagaggaugaagcaggaggaucaugaguuuaaguccagugcggguuauaugguaagcuccaguuugagugacagagagcugagaguguggcucagugauagagucuaggauauguaaguucuuagguucaaucucugacauugccaaaacaaagcaaagcaaaaccuagacacuucagugguugcuuucuugaaucuagacaguguuguauuuuccuuuguuguuucuuaccuguuuaacuagugauagcaaaguccucucaggcaaaagaguggauaucaaagauucuuuuuaaaaaccuuuucuagaaaaauucaacaaguggucuaauguuuauauaaaugcaacagacagaaacuuaagaaagaaauaaaauugaguggucagugguggcgcacgccuuuaaucccagcacuugggaggcagaggcaagugaauuucugaguucaaggccaaccugauguacagagugaguuccaggauaggcaggacuacagagagaaacccugucuugggggugggguggggggaaggggggagagagagagagagagagagagagggagagagagagagagagagagagagaaagagagagagagagagagagagagagagaagagagaagagagaagagagaaaaaaauugaagcuagcaugguuucucacaccuuuaguuccaauguucagcagaagcagguggaucucuguaguucaaggccaaccugaucuaacccugacuucuaggacagcuaggacuguugaacccaaauaaacaaacaaauaaaauuaagaaccgucuccaccaccaccaccacucccgcccgcccacuaccaccaccaccaaaaaaaaaaaaaaucuggggaugguucagcaguugagcgcacuguuucucuugcaaaagacccagguuagguucucagcacugugugaugguucacaaccauuuguaacuccaguuccaggggacuugacuuccucuucugaucuccauguguaccaggauacacauguauauacauacaugcagacaaacauacacacaaaauaacauuauucuaucuucuuaauaucaugaaauuauaacaauuauaaaacuauaauguaacgauauuuuguuauauaauuauauaauaaaauauacuuuaaaagcauacguauaagauaaauaaaucaaaccaacuggucagucuacugaccuccuguguccugcuguuuuuacuagaagcuguagcucagaauaguggcagcagacugaaaaacucaguguaaagucauggugaugauucucugccuuugaagugaggaagaaaggcgagcaggagcacaucugaccuaaugacacccuuuucccuucuccggcuuuuugagggauagaggucucuucagccacauacucgagauccuggaaucagccugauuuauuauuaguuucuagacccagccagguggagagugugaagcucugcuucacugcagagcaggcugauugcugugugugaggcacugcgggguuccugcugacuaaaugccacuucugucuccaggcugcccuaaugcugcucuucacucagugcagucuucuagaguguuguacaggcccgagugcuuguugugacuguuguucaaggcuuuugaccuuugggagugcccacauugucuuuauuucuauuuauuuauuuuuccagacaagaucuuauguauucagucuagccucagaauuuauaucaccaaggaagauugugaacuucugacccucuuugccuccaccuuccaggugcugagauuauagccaugugacaucauacccaguuuauguuguacuaaggcuuuguacauuaauuugcuagguaaccauuuuucaacugaucuauauccucaccuuccauauugccuuugugcuuuggggggaccuugauguggggaggagggguuguuuguuugcuugcuugcuugcuugcuugcuugcuuuuccuguuuuggauaaguucuuguggccugguaguuaucuggugauugacccuaucagcucucagcugaguugacaguggcauuagggagggaaaaccugguucauuacaaccagcaguaucuugauuccaucuugaauauuuggauacccuccccaaaagagguugcugucuguaacucugacccagugaaguugcucuuguagaagggagagggccuuguucugaaugcuacuugcuccuaagugucuauguccaggaaugcucucucacuacucccuugugucuuuccauaacaaagccuacauacaucucugagcugcuuuuaguacagaugcuggaccuaacacuuugugcccuuucucucugcugucucugguccagaaucuguguggguucucaaguacuuuuccccaaaccacaugaagcuggcuggcuaucuuauuucuucuucuuaggaauuccuaagauaaaucuaguagauauccuuuccaaaaucgguauagaauucuggacuagaauuuuauucaugccaacauuauaguuagaggcauuucuuuuccuguuuuuuccacaaucugguuuuacccuuggcucucacaacucaccuuugucccuagcaaaguacucuaggccucucccuugcaaagcgaugccccuccagaggcacucucuaacccaguuuguagucaccccuccuccuagaugccaugccucaaacccuagcccacguauuuggugugagucacagacuccucagccaaacaugaagguggcuuuggccucuauuuucucucuucuccccauauguugucuucagcaucccagagucuuacugagccuaaaacaucuugggcuucuaggagcucaagccuauuccuaaauaaaaaugggcacuagaccaugggacaguccuaucccaggccaaauggggguaacuuacccaccaguuaugauucugcuauuuauuuauucugauuguuugggacccuguagcuguaagacaggaaauuuagggucucauaaacauuuagccuggaugagacuuugucuuaaguucuucaaaguuaccccaagaucuucguauguagccauggcuggcugaccuugacacauauuauagccuagaguuccucaaacuccccaaucacaggcacuuuccacuauacuggacuuaaagcuuagccauaucuuuuauuuuuacugcaggcaaaguaagaauguuaucuuaggccuccccacagaucacuguuagaauugggccucuuaauuuuccaauugagaucucuuuccuacaaaugauauuuaagccuuuucucuuuaaaaauccuucuaaaaccacguaugguguugcaugccuauaaucccaucacccaaguggcugaagcaagagaauuguguugaguuugaacauggguuggauagcaagacucuauuucaaaaaaugaaacguaaaacaaaagccuuugagaugucuuuuuucuuuuuuuaaagaaagcaauauauucucuccugcauaaaaauauaccacaggaacacacccaugcuuuuauaauucccuaagaccucuagguccuauuuaggugaaccgggugucuggggcauugggaaaaaggaaauaagccaguguuaacaucugugauugauaggccucuugccuagacgaagaacaaauagagaacuagcagcuuagaguaccagucuguuucauaggcagcugcuuaaggcuugcugucugucccagugugacgcaguucccuggcacacccauucccaagggcacagaaucuagcccaccagcugggccaagauugcagcccucccccaaaacaggugguugucugccuuuguccaggcacaggcagcugcacugcauuuugugcucucagugcugcucuucauucuuuuccauugucucagccucaguccucagccaagcacaaagacugggaacaagcuucuuggguaucucuuguaaaguccuacuugucacccuaggaaagagcucuuaggacucccuugagccugcaccaggcucucacgccaugauggcagaagcucaguaaccccuuuccccuuccugguaaugagcugugcacuacuuccaagccgcugugccucuggcugauugccagccuagccagcaccacugagccucacagugaauguaaggaccacugcuggcuucauggcuucccuguaaaugagggugaggggagauguuacuagacagaaggcagaauagaguuuagcagaagagaagcaaccugaguguggagugccuggaaccuuggcuaaggacggcacuccuuauaaagccucaguucagucagggggagcuaccugugugaaugguaauuauaaucaagcauuauuaaccaaggaggggaaaggcauaauuuggaacgaaaaagggagccagaacugccacagagagacuguuucaggcuagccaggagagucaggugccaggacuuucccucaccauagagauggugcaaauaacugcuagucguccuggaagcagucaucagagacaucccugagaugucagaugaggagugcucuuaggaacuuggggaguuccaagccacagauugugugaacagaacauugggaucacugagaaagcaaggcuggcuuuuccuucuacucaaggagcccaggagggccccagcagugagacugauugagccacacccagaaacacagccuagagagccugcugaagagaacugggugcuguguagaaguccauuugaaacacugcuucuuguagaccuucucagucuuuuguauguuugucuagcucccaagaagaaccuagaacagugucucaaucguccuuaccaagucccaagaaagaaagagcuggcugaaaaucauucuuuaacuaaaaugcagaauccgugacauuuaguuaccagaaaaggucucaucaacucugauccuugaguacaguacucagauaggagaucaaguccaaaacgugcuugccauugucaggcucacuggccacaaaaacagggcagugagacagggcucauacucaagacccuccauccuuacccucccagaugcuaggaguacaggucuguaccuguaauuacacacccaguugugacgucuuccguaaguagccuaguccacagcucauaagggaugguacaugcagcgaguccaugacuugcagugucuuguugauggucccagaacagacugguucuuccagaguuuccguucugagacaggaagaaggcuccuggccacaguacaugauuuguuguaggcuugcugugagcaguuuguugucacuaacuaacccugaguaacaggaauuacagaggagggauuuggcagaggcccacaugguauugcaaccugucaauaaaucuugacaaguuuguacauccaaggcuucuuggcagcuggcuucacauagagauaaugcagccaggauuugcucaccaaaaagugcuauuuugagaagaucugcaguuugucucuggccauuugucuuuuccuaaugcaaggcuaccucucuccuuugcucuccaguagucuuuagaccacaggaauaacucuguagaaaugagacuguacucuauagagaggucuaguuaaaaguucagugagcaugagguauacaagcauguaagagaguagagaaagaguaagcuagcauucccucaggugaaaccucuaccagaaugacaggcucugugcagcuagaucuagggucuccccaauucugcugccuucugcacauagcagcccaaccuuccacuguaguccuugcucauucaugccugugcugacucaucaggauuggaaaagaagccccucaaacuucuccccaaacucaucuucuucuagcugacuuccaucucuuguucccuagggauguucuguugucaaaagagagugacacuguccccagguugcaaacugauauacuagaguauaucauaaucuauuuaggcugccuuagcaaaacacauagaccugguggcuuaaacaacaaauacugauuuucuuacaguucuggagguuggaaugacaaccaucagagguuuccugagagggcugacuuccuuguuuauaggugccuaccaucucaccaugccauuacugagccucuaagagagaguccuuucuuccucuucuuguuacaccauaguccuaucagguuaggacccauccucauguccucccuuaaccuucuaaacacugguguuggaguuuagaauaggaaguuggaagaacagagcucuucaggaacuugauuuccugacuuguuuagcagaacuuugggguaauuuagauaucauuuaggcugucuaugagagcuaauuagugaacuuuaaaaacuuguuugguugguuagauauaucagugagugaagguacaacucccacacauuauccucaaaaccuucacgugccugccauaccaugagacacacacacuauacuagauaaauauuuaauaauauuuaauaaauacaaaaugccuauuuuaggagggguuggagagauggcucaauaguuaagagcacccacuguucuuuuuauuuuaauuggauuuuuuucuuuuuuuuuuuuuuuaauuaguuuguuugguuagacaguuucucuguguaguccuggcuguccuagaacucacucuauaaaccaugcuagccuucaacuuagagauccaccuggcucugccuccugaaugcugagauuugcauguacugcuacugcccagcugaaaaaaaaauguuuaugcaauauauucugauaauuuuccucuccaccaacucuucucagacucuccccauucauccaacuccacauccuuugucucucucucucuuaaaaaacaaaaacaaggcugcuggugagauggcucaguggguaagagcacccgacugcucuuccgaagcuccagaguucaaaucccagcaaccacaugguggcucacaaccauccguaacaagaucugacucccucuucuggugugucugaagacagcuacaguguacuuacauauaauaauaaauaaaucuuuaaaaaaaaaaaaaaaacaaaaaaaaaaaaacaaaaacaaaaagaaagcaggaaacacaaacacacaaaaccauauaaauggaaacuagaauauacaaguaaaagaaacagugggacaaacuaguacccagacaaagcaaugcaagacgaaagucuacauaaauaucucugagcuaaucuuguguuggccaacugcuccugggcaugaaccuuaacuugaagugugguuaauauucccagugaaacgugauuggagaaaauuaacuuuuucuuugcaagcagcuaucauugugaguggcuucuuggcuagaagugguaaccaugucuacuuuucccgucuuagcacugggagcucaucuagcuugaaccuguccagguccugugcauauuaccacagucucugugagucuguauguacaucaguccuguuacagcuggggaauaauauuuccuuagagucauccuccaccucuagcucuuagaaucucuccuccaccuccucugcauagcucucugggcccugaggggaagaguuugaugaagacaucccauuuaggagugaguguuccaaagucucuuauucucugcacaucgucuaguuguggguuucuguguugauuaucaucuacugcaucaucuacaacugcucugaugauggcagagugaagcacugccuguggguagagcacaaugucauuaggauuauuuuacuguuguguucuuuuaacagaugauaguguugguuuuccucuaggccaacugguaucagucucaggguuuugaccaccuagcaguaucaggcagggguuccauuucauggggugaaauuaaauaacuuagauccaguuacugagugguuggcuacuuccacaacauguaagccaugauugcaccagcaugucucucuggguucaauuccuagcacuucccuggcagcuaauaacaagcugauaacaaguucugggggauccaacacccuuguuuggcuucaacaggccccaaacaugccucuggugcacauauguaaguugaagcacucacacauacauauaaaauaaaaagaaaucuuuaaaaaccagccaaccccccugccgggcagaaguaggcagauuucugaguuugaggcuagccuagucuguagagugaguucccggacagccagagauacacagaaaaacccugucucaaaacaacaacaacaacaaauaacaacaacaacaacaaaacaaaacaaaaaacauaaaacaacccccuuucccacuucuuguuccuacagccaucacuaguguucucagccagugucuguuacaaggcaauacuucaucagagaaggaucuuuaauuuucucuucauuuauuuugugauacaguuucauauagccuagacuagccuggaauucucaaucuuucuaccuuuaucucccacguugcuagcaguauaguuaguuaccauucugccuggcuagggaggacucuuccaaagcaagauagucugugucuguguugguaaagauuuaaccuggggcguuaugcaugcuagcuagguacuuuauuaguacugaauccccagaagcuguuuguguuuagggaucuccauugucauguaggacuguagcuuuuggugacaagucuguguagaaaaggaagugaucacugcuucccucuggcuuggggagaagcugccugauaagacuugguagcccuggggaacacagcagguagagcacugcagacaguccaccugaacuacagcuugaccugcugagccuggccauggaggcucuccagccauucaucucggguacauaagguuguugaggugcuucuguucucucucucggccucuuaucaacccgagaggacuugggcacaagugacugcuuucugaggacugaguucauccuucugacagcuguccauggcacauuucuccaguaaguccccuccagccucuuguucacugucucuaccaguguguuucuaaaagauacuuagaacuugcagcauaucugauauugguauuuuuauugccucuuggcuccaagaagaagccuauugaaggcauuugggauauucaacauauaugagaugcuccaauauugagcacccuauugcuggagcuuucuggaccuucuccuuucugaauggaccaccccaccacagcccccaaguccaggacuugucaagaauuccugaccacuucugauaccuuucaccuuuuauuucucacuuuucccaauggaucaucagggccuuaaacucuggcaucgaguacuacugggaccagcuaagugaaacagucuucacuguccacucaaguagcaggagcagcgagcggccuggguaagcuaaagucggaaaguccuguguuugagggucucuggauguuugcucaaccauagcagccuuuccuugaucuguuaccugucuuaggcuuuuacguacagucaaaagaagacagagacuaaagagauugcuuggugcuuaggaguacauacugcuuuuauaggaccugaauuuaguucccagcccuauaucaggcaacuuacaaccacuugcaacuccaggucuagggaugccugaugccucuggucucugugggcacucauaucugcauucauauccucauacccauacacaaauguaugucacguaauugcaaaagaagacaaaacccuuacucuuggagucuuauuguagaacacaugccuucucuaauucuggccauggugucugugcacacuuggagugaaaauaaggagcccaggagaaaaacucugcccugugaaaucugcucauuugcccaaggagaauugaggaguggaguauugcuuuaagaugacuaggggccacaaggaccaaguugcuaauggcuauagcccaugggccacugaaaauagaaaucuggcacuaaucaucuuuuuucacuuaauccacuagugaaacccaggacauuauaaaaacaaaguacugguucagugggagaccuaaggcaggugcuguuugcucuagggacugcagaguacagcuagaaaaauaaucccagaagaagcuaaaagugaggauauggugagucucagaagucuggaacucagcuguccugccuguccuaggcucaaaagucuaugucugagaaauauuuuaaaaaaaaaaaaaaaaggcgagcacuacucuggcuccugggcuuuauuuguggguagcugugcucucaaccuaccaggcuuuuuuuucauggcucccaugaagaaguacuuguaguaucaugacucucccuucuuaggcugugggccuggaauugguauggaauucaagacuucuggaaaggacccaccccaagcucuucugacuucuuauccuuuucaccuagaaccagcagagccacguggcggacagacagagacauggguuugaugaaugcaauugggcugcagccucggaacccaaccaccucugugacaucucagggcacccagacucuggcccuccaguugcagaacgcugaaacacagacugagagggaggaagaggaaccaggggcagcaucuucagguccuggugaagguaggagccagggacaucugacugaaaaucaucuguccucucggggagaauaagaccuaugcucauggaggaccaaagagcaugcguggaaagugagauuccauagggagugcuccuuccagagccaaggcagggucccuagcuuaucuccccucagcuagcauggcauauugguacugcucaagugaaauucuuggugcuccucugguagcaguguuuugauguuguuguagauacagcugggcauaccagcaguccuuccucucaccuacuucagguaugacacagucagcaucagccgcgcuuucugcuggccucacacauuuaagaaccaauuagcacuucccagugguagggcucaagccacuuuguaacccaucagcagcugcguucagcaggcuguucucacucuccuuaccuccuaccucuagccccuugcugcuccuaguucuacacaagguagcgucuaaacagacuuucuaguucucaucaagcuauuugcuugaaagacaauggaaggagaagcccugaugugcaucaggccaagaguaacaaagcugcugauauugccuccagggaauagcuuucuacacugcugcucuccaugggcccuuuccuucucccugccaugaacugaaauguucagaguuaaaucccuuuucucaucugcagccuaguccaucucucacaucugaagcccagggcucuuuauggaguagaaaccccuugcuagggacaugagcagcuggcaguauuagcugagccaaccagcugcagccuugagccuaagugagauggaggaggaagaggaggaggaagaagaggaagagacagaugaaaucucauucagccaucuccaggcccauuuuugcagggauuuauggacucugagccacccuggaaucucugaagcucauucccagaaguuuagguucuaagugcucaaggaaccacugcuucuccagcagagccggaaaguccucucagcuggggcaguggucucuuaagaggaccugaugaggcaaguaucauggagauuuacccacucggaagagauucuaagaaugagcuuccaugcuuccccucagagcuuggaggugagagaugcuaaauagccaacagcuaggcagcuggcaccuucagugugauagggaucuugggagggacaaggaggggccagggaagccgaguccuugagcugaguaauaguuagacagaaugugcuggcaggagcauuugagcaugugcaagaacccugaguuggaaacuauaucauguggacagaggcccacuagcagguguuuuguuugaggaaagccuggcacacauugagaauugaggcuagcuguaugugcagaguugcuuauagaauucccagguggagggcgacuucugucugaaagguaaaguacagcgguggcugugagcagaauuugcugcugaagagauguguaccuccuagugucugaccucccacaagaauccugucuuugucuugcugauuuuggacugcaguuuauuucuucuuguuugagaguuggggacuaggguggguagaaggguagaagcagacuuuuucagguuuuaagggcuugaaccuuauuuccuguugcuccccaucucuggcuuccuuaaagcagagcaggaaguugcugguccagaagcccagcagacagcagcaucaggaauccuggcagaaccggaagcuucuguccucagcccugcaagcuuccuucucucagagcuccagacaccaccaccaccaccacacacacacacacacacagaaccagcuucuccacgaauaauagcccauuucaaaaacuagacagaaagggaaggugagcugcaagaggaagugagggguugguugcuaagugcccucugggacccugauuccagauacugguugucaggguucuccuuaucugcacugucucauccagaggcaggcgcaauagcuccucacucuuuaaguagacugaacuuguggccaggucuccaggggcauacauaggagaagccuaguugaaguuagcccucugggcuuggcuguauaccaccccaccucacacacccaggcuuaccagggccuggauuuguuauugagaaccagaucugguuguaguaaucauuguccuguagccagccacuccuuaaauuauauaaacccaauagaaccugucugcuucucgcuuucuuuuucugaaacucugagagucugggaguguagcucagagguagagcacaugugugaggugcuguucacuugcuuguacucccaccucuccaaacaacuaagagccgcucagccaguuguaacacuugagaaacucuccacaagggaauuugcucuuaugcuugccaggcuuuaagcaggaaguuguguuggagccgcugugggacgugaaugugaguuacccugccacacgcugcccuacucucuguccaggaggcagcacagagagugagaaaagcucacugugcucccagcucuggugcacauggaguacauggccagcaugcaguuggcauucaaguaguguguagaacaaaugaauggaaccacaggaggcccugucucccugcuucuuggagaacuccauggcucugccucucagccuugggccuuuuucuguuguggugaagacaaaaguuaaaacagcauucacaguucaggccucaggcuagggaaaaacaagugccauuauggaagagcuagaacauugcacgugcacgugcacguguacacacacacacacacacacacacacacauauaugaugggaaguacacggucuuaguucccaguuccuuucuccuccuuggcuguauaccacucccagaauuaaaugcagcugaagggcauuaugggaaguugcugaucccaccugucuucugcauucagaacuugccaaggaaacagucuaccaacagcacuaaaacagucuccuguuuuugaaacucuaaaagaaauacauaagcuccuggggaagaggcagcagaguugcccacuguggucaccauugcucagaugcagguccaguggggccucaggcuuucuuuccucaugagaauauaccagcugccucuuagccucaccuuaucauucuaagagagaaacacaguuuaggauuuugggcugaggcugcucacacucagccccagcagcuguuacaugcccaucucucaaugucccauccacuauuuuucagcgucucauuauuuuuccuuugucucauuguaagaagcaccaugaacugacagguuuuagacaaggaaucacgugaaccauauaauggcgccucgucccucaaagggcaaguccauaagggaagcagacauagaaagauuucuccugaagcagaauaagaccuaguuuuaaaguugccuugagucuggagcugcuaugugcagccuggcagauagacauuucauccuagaccauguauuagcacugcccagagaugaauaagaucuccaggaagguccagcagcaagagauguagucacuaguaacugagucagagaaaagguauguagcaugagugaaagauguggcauuuauacugacuccugaaccugagcuuguauaguaucucaguaugcauagucagggagcagagcugggucagcuuuagaaaagacuguuaugugcauugauugaauaggucaagaaaaugaugagggucuagucagaaaguccucaacugucaaagagauuuuugagagcacuggagaugcugagcuuugagcaguuguggccuuaacuagagcucgguuaacuaagaauuagagguaaaagugggcagaucucugaauucaaggucaaccuggucuacugaucaagucucagaacagccagagcuacacagagaaaccuuguguuacucagggggaaaaagaacuagacccauagugacaacaccuggaaauaggauggaaagagagaagagaggcaguuaggaaguagccaagugggggagucggggagucacggacaggcaacagaaaaagacagagucuuauacuugagugcugaucacaaggcacuuuggggcugggcuuggguaguuuuucucucccuggaaacaaccacugggaaguucuaggauuugaacagacagaauuaucaugauggguucaaugcccauaggccccagaccagcccacuacagaucuccaagaaacaggaagaguccucagagagcucuugggaaaccguggagauugccugacccauaggaaggaccauaggaagggcagcucauagauggaggcuucacuggcacugagugagggcuagcuugccuucucccuugccuuguccuguuauuugaaaguuugguccuuaggacucagagcccuuccgguuuccuaucuucugaauguaaagcuggagccuagcuauucagggcagauagaggagggcagcugucauggggguuaagaacaguuuccugggaugucaggaaaagccagcugaauaaaagccaaagccuggguagaguccucacugcuuagagcugaggaaaauggaucaagacccagaggaagaaaugugagcgauuaucugccagguccuaugcaagagagauggggccuuagacagaguuaagucaugaaguaaugaagguaacugaccuagaagucuaagacaaauaagcaaacagagaaaagacuuagggcaagggacaaagaaaaccuuguaaaaccagcuaguaacagguaaccuugaguuaccugucauccaugaguacuucaaaaccaaggaauuccaaagugggcaggguagugaaaggagacgaaucaacacucugauggagcugguccuggucuggcagcugggagccuugacuguagcugcgcagcuuggugaggaguagagaagacuugagguagaaguucugcugcuuccugcguaccaguuaucuggacaagcauuuccucuccagcacuauacacguacugagugagggucuuggccaaguccagccagccaucggcuggacugugaauguccaggucucauaggggaacacaccuauguuauccagggcugcaaguugguaucacagcuggcaguugguucucuccaggaaaugugguaucaggcauacagcccagggagaacaguaacuaggagauaauguaugaagacccauggguaaagggagaaaagaggcaacagaacuucuaggggcauuuaaaugcucucagaagauaacaagaacagagcaaagauaacguugaaauaaagccuggcagacugccuuugaaccaccuccugcaggccaaagacaggaccaggucugaaagucaccccauauagggacagacacggcaaacuguccagucuucuccuuugccucuuuucaaagcaaccugcauucugaaaggggcuagaaggguucacuaaagccaagcccucaccuugguccaagcucugcugacagacgcauaaaacuuggccuuuuccuccccaguaaagcagaggugugaagagcaguccuugggacucaacucuuguccugcucuuaggacuucaguuuucacaguggugaggguggccuuaauccuguuguuuguuuguuuguuuguuuguuuguuuguuuguuuguuuuaccuacaaucccccagugucugcuagcuccugcgccugacucagaggcucagaucagcaacuaacuccuucuuucuucugcuuuguaccuuccaggcgagggcucagaauaugguggcaguggggaagaugcccucagcaggauccagaggcugauggccgaggguggcaugacagcugugguacaacgggaacagagcaccaccauggccuccauggguggcuuuggcaacaacaucaucguuagccaccgcauucaccgcagcucccagacaggcacagagucaggggcugcucguaccuccucaccccagcccuccaccucucgaggacugccaucagaaccugggcaacuggcagagcgagcgcuaagcccccggacagccuccugggaccagccuaguaccucugggagggaacuaccccagccagcccuguccucuuccuccccuguccccauuccagucccccuugccagcaaugagggaccaaccaugcacugcaaugugaccaauaacagucaccuuccugagggugaugguagcaacaggggggaagcugcaggcccuaguggagagccacagaaccgauagagacaaaaugaggcacugguaccucccucaagcugcugagcagaagcaggaccucacagcugacugggaacuguacacacagaagagcugaugccugcauccaggaacaggaggaaugagaggguggggcauggagccaguggauaagggggcaguccaaggggcaaggcuggccugggguacuagagccuuccaugaucuagagcccagaagaaccacacugcugagccuggugugaaugaagaagcaagugggugucucugcuaugaacccccauuucuccuaggaucacuggccuaggggacucaaacaacccugggcagaagccccagaagaguaaagucuuccagauuuagaccacaccauccuggacagaauggugggacaguucuccccugcccacuacuggagggacaagccaccaggagcagaggagcaacaccccccccccauugcuuccaucucuaaaccuuccagaguuccagccucucucauccucuuagcccacagagauggaaaagucaggcacagcuuccaugucagugacuuaugcucaccaaaugcggacaccuguggagugaaggaaauagccugcuugccugacacagaauggagucaauacaugguggugaacagguccucaggaguggggguguaggcuggcccgcccccagcauguccaucaagcuccccccuccacaaggcccuccaugcagcaccuaugggugucaguauuaccuaagcauaggccaaagccagcccagggcuggagggaggagauuccaggucagaaugugaggucuuggucugugauuugagguguugcauguggaauccugaacuguacguguaguuuuuaguggcgaaaucaaggcucugaucauuuuguuuuuaguaugaaaaugugauuuccuuucuguuugucacucaucauagaaacauuguggugggaggagaggggauagucuacugcuaaugagggagacaccaaagaucuacaucauuaaaaugaugacacgccccucac

SEQ ID NO: 920 - RNA, 8142 nt, Mus musculus
cacagcgccgggagcugcaggcgaagcaggggccgccccuuggcacccuguccccgcccccggcccccggcccagucgcccaccccaccgacucgcagggccucuggcuaguuccgccgucuguccggcgccagcggagcaagacagaagcagcgggugaguaacuccgcggaaucgcgggggcggggggcuucuaugcaagaugaggauguaggguucugggacccccugaaggucuccagaggugggucgggcuggaacagggccccagaccccuuugaaaggcaagcgcggugcggaaggggcggagagcucagagauggggcaccccucuggaagaaggaccccaggucucuaaaagguuucucuaggugaaccucuagggauuggugaucauugagaaggcuaggggaggaauagucccagcccacagcccaaccccgaagcagagcagccgucgggucaggacccacacucccucacucccucccguuggcucuucuucaaggcgccggaagaugaagccccaaagcgcccguuucccgcccgucucccugcccuccguucccaccuuggcccaccgggagccuccaguacgcucuagcccguuggaguccucuguccgcgaccuugagccccgacggaaaacaccccuguucucuccuguuucccuucccccucuccaggaguacccucucuuuuacucauccggggagauacaucucccagcccuccacccucccagcucuuagaggaaguguuaggcacaaugauuuggcccaauauccagcaccccucucucuuccccuaaaguacagaggcuucucuccgccucaggaacaguccugggggccauagcuuuccugaagugaucacuuaauaaucgaaaaucuaccccacgggcgcccagagcacccuuucccgacuuguccccagcagggguaggggcucgagaacccgcggaagcacauugcccacgcccagagacuacaggaacugcgugccuggggguugaugggagggcggggcaucggagaaccuuggcccuuucgaccaggacccagacgugauggagccgggagaugggcccaaggguaagccccgagauugucuuugagauagaccugagcccacagcuugggaacucggugccuauuuugacugacaggacuagacagggccucuccagggguugcggguugaagagugaagaacaauuuuacccuccugacccaggccucgacugggcuccccguuuggaggcucuaccccugcccucaaugcguagggcacaucaaacugagcucggugacccucacggcucgacgacuaucgcagaggcuucucgacagaagucagcccacugcugggacugcacgcucuccauucuugacgaugcaguuaggaccaggugccuggggccacuaagauaaugguuccaaagucaggguuucuucgcagcccaaauuuugcuccuuucucaacccuuuccccacccacagaccgggcgcuugccggugguucccgccaugggaacuggucauucgcugauaguccagcauuugcucccgcacacaaauucgcgguuacggccacccaagcucuauggccagacacgcacacacaugcacacgcacguguccacauggcgcugguaugcucacacguucaaaggcgcaccgguauccaggcguggcggggcgcacacuggcacaugcaaacagcuacuagugucuacucgagcucccgaguagucacacacaaacacaacucgcacucguuuucccaccuacacguuccuugaugggugccuugcggggugcggguggaaucccgacgcccuaaaguuuuucauccucgaaacccuggccgaaccuaagggaccuuuguggcaaccugggaccacggagacaggcaguaucucccucccuuugcuccuuugugggagaagcccugcccugacgcuuuucuguauuugcgguuuacucugggacuugacguggugaaccuccggcucgggguccggagcuggcaccggggaccgacauugccaucuagcggugcucacaggccagggugauggcugcuugccuucucggauucuagaugggcgggauuugggggggggggggaggcagagaauugugccugaaggugcuguggucugaacaucugagagacuaucagagaagucuagaaagaaaacugggaccaaguugagaaaacugaauuuacccagucugcaucugucggggcuccgggaagaccaaaccacccaccauucaucuggucauuuacuugucaaggcuguuucuuggucccaggaggacaaaaggucaaacccaagugagggaacuggaauaugaggguuccacaucuaagaugcaucuuggggggcuucuauccugugugguuuggggaauaucuuggagauaaagugucgcagacccuccccuucuuacgaauggaugacuuugaucagguucauuaucacgaugcccuucgguaagaggacuuuuaugucuguaagaggagguuaccaauaguacuuaccuugucugggugcuauaggcaguaaacuuugaggggcuucugacucaauaaacaagagagauuguauuuuuccuagcucacacaucuugccccccaccuccccaccuucaucuucuuauccugcuggcugcuggcugugcucugguccugagagacuaaagugaagguuuccuuggugcaugcuaauggcuccccuacugccucgucccugucccugccaguggguauuugggguggggugagguagggagaacagccucuaugcuugaugcuacccuccaagcaucugaugcuuaaggccccauuuuggagcugaauaccacuguggagucccuugaaagaacugaucugucuuuugcccuugacuccuugggugaccuuggagugucacuaccccacuuccuccugucuuccuuugaccaguggauuuaacuuugaagccagaaggcaaucucuuguaucucuuguguuggagcuggagagcuuggcccaagcuuggcuggugccauuuccaguuggagagcaagcugaggugcuaaggggguccccuggcuguucaaaggccauagugggacaagauccucuauuuuguaaaugacagaacuaguucucagagggcaaaugguucuccucggacuguacagcuagaccuugcuggccuacuauugaacccaagcugcagacuuggcgccuguuccuccacagcuggcugcugcacccucucuuccucuuacacacacacacaggcucgcaugcacgcgcgugcacgcacacacacacagaugcacacacagacgcacaggacugcguauacgaccugcguguggcugagauggugccuuugugcguauguggaaugcuuguguguuggcgggugugaaggaggcugggcugagcggcugcccuggcacagcgugcugggcgugggccucccucacauguauggaagaggaaggggaggaggagagaugaagggagccuggugggagggaaggcaaacucuggggaggggcucuguaggacuuuagcugggucauccucugugugggaugugaacucuuaggcuggcuccgggguaauucccucaucuuuuggcuccacgagggagcuuguccuuaguucuugggaaaucaaauagacccuucuucagcugcugugucuuucaggcuucugauuucuuugcuggggaucuaacagcccccacucuguccauucuucaccccugggacugggcugggcaggcgaagcugaacuuccugcgucaucucucuagucccuuuccuauucuuccucuuccaggugucccagcucccaccucaccuccucuggucgcuagcgugaccucccuagcccuuagaaccaucagguccugugucuuucuugacugcucuccuugcucccaaaugcacuggagcagccacaggaugucaaggaaauguggaaccuuauuuaacaccucugagccuguuuccucaauaucugccuucgguugugaggaaacacagagugcaggaacucaguagacaaucuaugcuggcugcgaugaugaugauggugguggugguggugaugaugacgacgacaguguaggaaugggagaacaaaucucccuuggccacgauugguuaagaaauguccacguggcuggacaugguggagcauaccugcaguucugguccucuagaggcagaggcaggcagaucaaggccugugacuuugaggucagccaggucuacacaguaagaccuucuuucaaaaacaaacaaacaaaaaaauuaaaggaagaagaagaaagaaaagagaugagcaaguggggcugcagauguagcucagcgguacacguguguggcacaugucugccauguguauagcuuugucuacaaccuucaguaaccaaaaaacagggguugggaagugacaggccugagugggcaaacaacuagacauuuggccccgcugccugcuucaaguccuuggggccauuuccucaugccccuugcuuuccugagcucugucucugggccuuugccguaucuccuugccuuccuucccaccagcuuuccuccuugcccucaucugcgucaucuucagggugaggccggugaucagccagcaagcaccaaguucucucccgucuucucucucagccuucccuucaccaucuucuuucuagcagugucccccucccccgccauguguuucuguuuccccccaaaacuagaugauccauucugagauggggaccauguguguucauucacuuuuauaaccucagcccugagcugauuacaguacuugccugaggaagcuuccaguaaacgguagaggacugagaacucaggaaugguuggcacagggagcccugacauuuuccuggauaaaguuccuccagccacaguuugugacuccucccccccuccccccucccccauccucuuccaccauucacuucugugcugucuccuuccuccuccagccacugcccaccugucuccaguuggguucagcauggcgaacuucacaccugucaauggcagcucagccaaucagucugugcgccuggucacaacagcccacaaccaccuggagacaguggagaugguguucauugcgacagugacugguucccugagccuggugacugugguggguaacauccuggugaugcuguccaucaaggucaacaggcaguugcagacagucaacaacuacuuccuguucagccuggcgugugcagaucucaucauaggggcguucucuaugaaccuuuacaccuuauacaucaucaagggcuacuggccccugggugccguggucugugaccuguggcuggcccuggacuauguggugagcaaugccucugucaugaaccuucucaucaucagcuuugaccgcuauuucugcgucaccaagccccucaccuauccagcccgccgcacuacuaagauggcaggccucaugauugcagccgccugggucuuguccuuuguacucugggccccugccaucuuguucuggcaguuuguggugggcaagaggacagugccugauaaccagugcuucauccaguucuuguccaacccggcggugaccuucggcacagccauugcugccuucuaccugccuguggucaucaugacggugcuguauauucauaucucgcuggccagccgcagccguguucacaagcaucgacccgagggccccaaggagaagaaggccaagacucuggcuuuccucaagagcccucugaugaagccgagcauuaagaaaccuccaccagggggcgcuucucgagaggaacugcgcaacgggaagcuagaagaggcuccuccgccagcccugcccccgccuccacgcccaguggcugacaaggacacuuccaaugaguccagcucaggcagugccacccagaacaccaaggaacggccacccacagagcuguccaccacagaggccgccaccacaccagcgcugcccgcuccuacccugcagccacgaacccucaacccagccuccaagugguccaagauccaaauugugacaaagcagacaggcagugaaugugugacugccaucgagaucguaccugccacgccagcugguaugcgcccagcagccaauguggcccgaaaguuugccagcaucgcucguaaccaggugcgcaagaagcggcagauggcggcccgggagcgcaaagugacucggacaaucuuugccauucugcuggccuucauccucaccuggacacccuacaaugucaugguccuggugaacaccuuuugccagagcuguauccccgaaagggugugguccaucggcuacuggcucugcuacgucaacagcacgaucaacccugccugcuaugcacucugcaaugccacuuucaaaaagaccuuccggcaccuuuugcugugccaguaucggaacaucggcacagccagguagacgggcaggugccuuaggaggugcuggugucaagaguguguaccggggaaccacauggcucaccggcuguggaggagagaguaggcggccccacucugaguucgcaucugcugaagagaacaggucucccagacaccgugagguacaagaggcucuucgcugggaugggagagcagaucucuacugaagccuaggaggcucggcccagggacggucugaacuggcaccaccuggcccauaucuuuuaccuugccucaggaagaugggggacgauggcuggagugggcaguggcucuaucaaggccaaccaucgguggagguggaugaauagagcagaacuugggagcaucuugagaggagcaaaaggagccaggcuugcaaggguggggucccccguuaugcuguaaucggugcuuuccgccuuccugcgcccuccucucccuugcauguaggcucagcccuuccccugcccccaagucccacuccaaggugagggacuucccugccacuguugcucagccaggcucuggaugggaagccaagcccuuuggcacuccccuggccagcagucaucuggacagggcaacugggaggccaugcuaagccgagauacagacuccaggggacugaaucaauuaaugguggaucuuauugucaaauugucaagaacccccccccccaggucacacaucaaaugaacagcagugggcaguguuccucucuaccucugagcggagggagguauggguccaaggagggaaaggugaugguggggaacuuggugauccauacagcccacaguggcgaaugacacaagcaagcacccucauggauccccaaugagaaaauuccagacuugcaguagccuggaccagaaacucuugaugagcugggacagaguucaagugagucaccuagguccccuucccuaaccccagcccugugggucccugggagacuuuuuuuuuuuuuuuuuuuuuuuuuguaaauguucugcucuuuuuccacgagcuguagggagcacuuccuucauagcccucagcuccccucaguccaucuuuccccaucuucccaccuccgacagagcuccauggcaaacugggaaggggcuuuuauauauuaaaaaagaagcuuuuauuggaaaaaagugaguuuauuuuauucauuucuuaauaacaaguaucaggguggggagaacaaaagaggguauggggaggcucacuuuccagaaucucuugucccuccccacuuugggcacuuggugugggcgugagaggacaggcgugauugacagagcugacaggaagacaaaaggcacugguggguuauaucuugggccugugggagaggagggcuccguucaggcuccaggcgaggccggaggcucucuggccuccugacuuaguccuuuccuuuuccuuucuuggcuggaaaacaauaacggagaugcauuagugcggugggugaccuagcucggacucaccagacaacgcagacauguccaucaaggagagaaaauccugcccccuaguggugacugaccaguucaccuggaaguggugggaaagggcagccaugugauaugaaaccuuucuuuauucguucaacuuuuuaacccucgcgcccccccccccccuuuaa

SEQ ID NO: 921 - RNA, 8142 nt, Mus musculus
uuaaagggggggggggggcgcgaggguuaaaaaguugaacgaauaaagaaagguuucauaucacauggcugcccuuucccaccacuuccaggugaacuggucagucaccacuagggggcaggauuuucucuccuugauggacaugucugcguugucuggugaguccgagcuaggucacccaccgcacuaaugcaucuccguuauuguuuuccagccaagaaaggaaaaggaaaggacuaagucaggaggccagagagccuccggccucgccuggagccugaacggagcccuccucucccacaggcccaagauauaacccaccagugccuuuugucuuccugucagcucugucaaucacgccuguccucucacgcccacaccaagugcccaaaguggggagggacaagagauucuggaaagugagccuccccauacccucuuuuguucuccccacccugauacuuguuauuaagaaaugaauaaaauaaacucacuuuuuuccaauaaaagcuucuuuuuuaauauauaaaagccccuucccaguuugccauggagcucugucggaggugggaagauggggaaagauggacugaggggagcugagggcuaugaaggaagugcucccuacagcucguggaaaaagagcagaacauuuacaaaaaaaaaaaaaaaaaaaaaaaaagucucccagggacccacagggcugggguuagggaaggggaccuaggugacucacuugaacucugucccagcucaucaagaguuucugguccaggcuacugcaagucuggaauuuucucauuggggauccaugagggugcuugcuugugucauucgccacugugggcuguauggaucaccaaguuccccaccaucaccuuucccuccuuggacccauaccucccuccgcucagagguagagaggaacacugcccacugcuguucauuugaugugugaccuggggggggggguucuugacaauuugacaauaagauccaccauuaauugauucaguccccuggagucuguaucucggcuuagcauggccucccaguugcccuguccagaugacugcuggccaggggagugccaaagggcuuggcuucccauccagagccuggcugagcaacaguggcagggaagucccucaccuuggagugggacuugggggcaggggaagggcugagccuacaugcaagggagaggagggcgcaggaaggcggaaagcaccgauuacagcauaacgggggaccccacccuugcaagccuggcuccuuuugcuccucucaagaugcucccaaguucugcucuauucauccaccuccaccgaugguuggccuugauagagccacugcccacuccagccaucgucccccaucuuccugaggcaagguaaaagauaugggccagguggugccaguucagaccgucccugggccgagccuccuaggcuucaguagagaucugcucucccaucccagcgaagagccucuuguaccucacggugucugggagaccuguucucuucagcagaugcgaacucagaguggggccgccuacucucuccuccacagccggugagccaugugguuccccgguacacacucuugacaccagcaccuccuaaggcaccugcccgucuaccuggcugugccgauguuccgauacuggcacagcaaaaggugccggaaggucuuuuugaaaguggcauugcagagugcauagcaggcaggguugaucgugcuguugacguagcagagccaguagccgauggaccacacccuuucggggauacagcucuggcaaaagguguucaccaggaccaugacauuguaggguguccaggugaggaugaaggccagcagaauggcaaagauuguccgagucacuuugcgcucccgggccgccaucugccgcuucuugcgcaccugguuacgagcgaugcuggcaaacuuucgggccacauuggcugcugggcgcauaccagcuggcguggcagguacgaucucgauggcagucacacauucacugccugucugcuuugucacaauuuggaucuuggaccacuuggaggcuggguugaggguucguggcugcaggguaggagcgggcagcgcuggugugguggcggccucugugguggacagcucuguggguggccguuccuugguguucuggguggcacugccugagcuggacucauuggaaguguccuugucagccacugggcguggaggcgggggcagggcuggcggaggagccucuucuagcuucccguugcgcaguuccucucgagaagcgcccccugguggagguuucuuaaugcucggcuucaucagagggcucuugaggaaagccagagucuuggccuucuucuccuuggggcccucgggucgaugcuugugaacacggcugcggcuggccagcgagauaugaauauacagcaccgucaugaugaccacaggcagguagaaggcagcaauggcugugccgaaggucaccgccggguuggacaagaacuggaugaagcacugguuaucaggcacuguccucuugcccaccacaaacugccagaacaagauggcaggggcccagaguacaaaggacaagacccaggcggcugcaaucaugaggccugccaucuuaguagugcggcgggcuggauaggugaggggcuuggugacgcagaaauagcggucaaagcugaugaugagaagguucaugacagaggcauugcucaccacauaguccagggccagccacaggucacagaccacggcacccaggggccaguagcccuugaugauguauaagguguaaagguucauagagaacgccccuaugaugagaucugcacacgccaggcugaacaggaaguaguuguugacugucugcaacugccuguugaccuugauggacagcaucaccaggauguuacccaccacagucaccaggcucagggaaccagucacugucgcaaugaacaccaucuccacugucuccaggugguugugggcuguugugaccaggcgcacagacugauuggcugagcugccauugacaggugugaaguucgccaugcugaacccaacuggagacaggugggcaguggcuggaggaggaaggagacagcacagaagugaaugguggaagaggaugggggaggggggagggggggaggagucacaaacuguggcuggaggaacuuuauccaggaaaaugucagggcucccugugccaaccauuccugaguucucaguccucuaccguuuacuggaagcuuccucaggcaaguacuguaaucagcucagggcugagguuauaaaagugaaugaacacacaugguccccaucucagaauggaucaucuaguuuuggggggaaacagaaacacauggcgggggagggggacacugcuagaaagaagauggugaagggaaggcugagagagaagacgggagagaacuuggugcuugcuggcugaucaccggccucacccugaagaugacgcagaugagggcaaggaggaaagcuggugggaaggaaggcaaggagauacggcaaaggcccagagacagagcucaggaaagcaaggggcaugaggaaauggccccaaggacuugaagcaggcagcggggccaaaugucuaguuguuugcccacucaggccugucacuucccaaccccuguuuuuugguuacugaagguuguagacaaagcuauacacauggcagacaugugccacacacguguaccgcugagcuacaucugcagccccacuugcucaucucuuuucuuucuucuucuuccuuuaauuuuuuuguuuguuuguuuuugaaagaaggucuuacuguguagaccuggcugaccucaaagucacaggccuugaucugccugccucugccucuagaggaccagaacugcagguaugcuccaccauguccagccacguggacauuucuuaaccaaucguggccaagggagauuuguucucccauuccuacacugucgucgucaucaucaccaccaccaccaccaucaucaucaucgcagccagcauagauugucuacugaguuccugcacucuguguuuccucacaaccgaaggcagauauugaggaaacaggcucagagguguuaaauaagguuccacauuuccuugacauccuguggcugcuccagugcauuugggagcaaggagagcagucaagaaagacacaggaccugaugguucuaagggcuagggaggucacgcuagcgaccagaggaggugaggugggagcugggacaccuggaagaggaagaauaggaaagggacuagagagaugacgcaggaaguucagcuucgccugcccagcccagucccaggggugaagaauggacagagugggggcuguuagauccccagcaaagaaaucagaagccugaaagacacagcagcugaagaagggucuauuugauuucccaagaacuaaggacaagcucccucguggagccaaaagaugagggaauuaccccggagccagccuaagaguucacaucccacacagaggaugacccagcuaaaguccuacagagccccuccccagaguuugccuucccucccaccaggcucccuucaucucuccuccuccccuuccucuuccauacaugugagggaggcccacgcccagcacgcugugccagggcagccgcucagcccagccuccuucacacccgccaacacacaagcauuccacauacgcacaaaggcaccaucucagccacacgcaggucguauacgcaguccugugcgucugugugugcaucugugugugugugcgugcacgcgcgugcaugcgagccuguguguguguguaagaggaagagagggugcagcagccagcuguggaggaacaggcgccaagucugcagcuuggguucaauaguaggccagcaaggucuagcuguacaguccgaggagaaccauuugcccucugagaacuaguucugucauuuacaaaauagaggaucuugucccacuauggccuuugaacagccaggggacccccuuagcaccucagcuugcucuccaacuggaaauggcaccagccaagcuugggccaagcucuccagcuccaacacaagagauacaagagauugccuucuggcuucaaaguuaaauccacuggucaaaggaagacaggaggaagugggguagugacacuccaaggucacccaaggagucaagggcaaaagacagaucaguucuuucaagggacuccacagugguauucagcuccaaaauggggccuuaagcaucagaugcuuggaggguagcaucaagcauagaggcuguucucccuaccucaccccaccccaaauacccacuggcagggacagggacgaggcaguaggggagccauuagcaugcaccaaggaaaccuucacuuuagucucucaggaccagagcacagccagcagccagcaggauaagaagaugaagguggggagguggggggcaagaugugugagcuaggaaaaauacaaucucucuuguuuauugagucagaagccccucaaaguuuacugccuauagcacccagacaagguaaguacuauugguaaccuccucuuacagacauaaaaguccucuuaccgaagggcaucgugauaaugaaccugaucaaagucauccauucguaagaaggggagggucugcgacacuuuaucuccaagauauuccccaaaccacacaggauagaagccccccaagaugcaucuuagauguggaacccucauauuccaguucccucacuuggguuugaccuuuuguccuccugggaccaagaaacagccuugacaaguaaaugaccagaugaauggugggugguuuggucuucccggagccccgacagaugcagacuggguaaauucaguuuucucaacuuggucccaguuuucuuucuagacuucucugauagucucucagauguucagaccacagcaccuucaggcacaauucucugccucccccccccccccaaaucccgcccaucuagaauccgagaaggcaagcagccaucacccuggccugugagcaccgcuagauggcaaugucgguccccggugccagcuccggaccccgagccggagguucaccacgucaagucccagaguaaaccgcaaauacagaaaagcgucagggcagggcuucucccacaaaggagcaaagggagggagauacugccugucuccguggucccagguugccacaaaggucccuuagguucggccaggguuucgaggaugaaaaacuuuagggcgucgggauuccacccgcaccccgcaaggcacccaucaaggaacguguaggugggaaaacgagugcgaguuguguuugugugugacuacucgggagcucgaguagacacuaguagcuguuugcaugugccagugugcgccccgccacgccuggauaccggugcgccuuugaacgugugagcauaccagcgccauguggacacgugcgugugcaugugugugcgugucuggccauagagcuuggguggccguaaccgcgaauuugugugcgggagcaaaugcuggacuaucagcgaaugaccaguucccauggcgggaaccaccggcaagcgcccggucuguggguggggaaaggguugagaaaggagcaaaauuugggcugcgaagaaacccugacuuuggaaccauuaucuuaguggccccaggcaccugguccuaacugcaucgucaagaauggagagcgugcagucccagcagugggcugacuucugucgagaagccucugcgauagucgucgagccgugagggucaccgagcucaguuugaugugcccuacgcauugagggcagggguagagccuccaaacggggagcccagucgaggccugggucaggaggguaaaauuguucuucacucuucaacccgcaaccccuggagaggcccugucuaguccugucagucaaaauaggcaccgaguucccaagcugugggcucaggucuaucucaaagacaaucucggggcuuacccuugggcccaucucccggcuccaucacgucuggguccuggucgaaagggccaagguucuccgaugccccgcccucccaucaacccccaggcacgcaguuccuguagucucugggcgugggcaaugugcuuccgcggguucucgagccccuaccccugcuggggacaagucgggaaagggugcucugggcgcccgugggguagauuuucgauuauuaagugaucacuucaggaaagcuauggcccccaggacuguuccugaggcggagagaagccucuguacuuuaggggaagagagaggggugcuggauauugggccaaaucauugugccuaacacuuccucuaagagcugggaggguggagggcugggagauguaucuccccggaugaguaaaagagaggguacuccuggagagggggaagggaaacaggagagaacagggguguuuuccgucggggcucaaggucgcggacagaggacuccaacgggcuagagcguacuggaggcucccggugggccaaggugggaacggagggcagggagacgggcgggaaacgggcgcuuuggggcuucaucuuccggcgccuugaagaagagccaacgggagggagugagggaguguggguccugacccgacggcugcucugcuucgggguugggcugugggcugggacuauuccuccccuagccuucucaaugaucaccaaucccuagagguucaccuagagaaaccuuuuagagaccugggguccuucuuccagaggggugccccaucucugagcucuccgccccuuccgcaccgcgcuugccuuucaaaggggucuggggcccuguuccagcccgacccaccucuggagaccuucagggggucccagaacccuacauccucaucuugcauagaagccccccgcccccgcgauuccgcggaguuacucacccgcugcuucugucuugcuccgcuggcgccggacagacggcggaacuagccagaggcccugcgagucgguggggugggcgacugggccgggggccgggggcggggacagggugccaaggggcggccccugcuucgccugcagcucccggcgcugug

SEQ ID NO: 922 - RNA, 2495 nt, Mus musculus
uauauuaaaaaagaagcuuuuauuggaaaaaagugaguuuauuuuauucauuucuuaauaacaaguaucaggguggggagaacaaaagaggguauggggaggcucacuuuccagaaucucuugucccuccccacuuugggcacuuggugugggcgugagaggacaggcgugauugacagagcugacaggaagacaaaaggcacugguggguuauaucuugggccugugggagaggagggcuccguucaggcuccaggcgaggccggaggcucucuggccuccugacuuaguccuuuccuuuuccuuucuuggcuggaaaacaauaacggagaugcauuagugcggugggugaccuagcucggacucaccagacaacgcagacauguccaucaaggagagaaaauccugcccccuaguggugacugaccaguucaccuggaaguggugggaaagggcagccaugugauaugaaaccuuucuuuauucguucaacuuuuuaacccucgcgcccccccccccccuuuaaagacagacucucaagucucucagucuguaaccuugaacucaaggcaguguuacugccucaguccugaagugccgcuuuuuacaggcacgagcuaccaagccugacuuucaacuuucuauuuucaucuaggaucagaguacuccaaguuccucaccggggaaaugggcagagucaccucugcccugcuggccucaauagcuguugggagucagguagcagcauguaccuuugggacagccuuuccauaguuuuaagcgcagaguuaacuccucccugaucccaccccaccuuccucaguugacaaagacaagccuuucccaggaacccaggucggaugauccaacagaaagaguaguuccuacuugggcagaggguuuagcaucuccugagaguggcccucaagugccugcccauuccuaacuuuaagacugcucugcagagacagagcauggaguagccuggcccacaaccccaccauauucgcugaccuuuggucuuugacuuggucuuggaggugcagggcuuagucacgcggauggucuccuggcacugggcauuguaccgcgccuucuucagggucccuuggcgggcuuuggugccagugcucccaucacacgccccccagcucucaaacuuguauuugcagucggcugaugggagaguggccccacggugagagacaggaggguuguggauguccucccugccuccgguuuauaaggacauacccucuggcuucccgcccuccucccgcgcgccaccucaccuccaaauuccuucuuccaguugcagggcaccuugcaauggacgcgcugggucugggccccacagguacccucgcggaagcccaugccgcaguccuugcugcugggggugcagggcccccagguccacuccgaacacucgcugcccuucuucaccuucucuacagggcgcaaggaacaaaguuaaggacauggcgugccggaccagcacuuggucacacggccugccucaccugcccaccccagcuuuuacuccugagcccauccuaucccaucaccuuuuuuuuuggccaccgcggacgugaccaccaagagggcaagaagggcgagaaggaagaagccucggugcugcauccuagggguaaaaccuggguuagaguuucucgccuagucucuucuccgcuaggaaccgcgggaaggaccucccacccuugacugacuugucccacuuuccaggcccaaaacgucggaccgacaagggggagacggagggaggacuuggaaccgaugucucagcguacccccacccccaccucagcccccuugguggcagagcagccgccugaagggacuggggccacagccacugcgugcgcucacucgcucacugcucgaugcuucgcucccucccgcuccggccugucccgcuaaggccgcuaaggccccuuuugucuccagaaccggucugagccggucacaugggcccccgccccuccccccaucccguggaaggacccgcccccuccccccaaacccgcaccuccccagaccccccuaguccccgccuccacucccgccccucgccgagccgggacucccgcgucugugccucucaccucugaucucugggucucugguccuggaguucgguuuuaccagugcgcuucuggcucagguccccucguagcaggcccagcucucuauccccuccccuuccccuggucuaggccugucuauacuuuucccucucgcagccugucagcucucaggucaccacuucgcuugcccaccgcgggccccgggaguauguccuggugucacaggcucggggcggccaccgcacccgcgaaccuucccuucgaggcccggcucaccuccggcuugguuuuuuuuuuuuuuuuuuuuuuuuaaucaguucacucagagugcaagaagggucucugauguggcagggagcuggguaccugggaccucagauggcuccg

SEQ ID NO: 923 - RNA, 2495 nt, Mus musculus
cggagccaucugaggucccagguacccagcucccugccacaucagagacccuucuugcacucugagugaacugauuaaaaaaaaaaaaaaaaaaaaaaaaccaagccggaggugagccgggccucgaagggaagguucgcgggugcgguggccgccccgagccugugacaccaggacauacucccggggcccgcggugggcaagcgaaguggugaccugagagcugacaggcugcgagagggaaaaguauagacaggccuagaccaggggaaggggaggggauagagagcugggccugcuacgaggggaccugagccagaagcgcacugguaaaaccgaacuccaggaccagagacccagagaucagaggugagaggcacagacgcgggagucccggcucggcgaggggcgggaguggaggcggggacuaggggggucuggggaggugcggguuuggggggagggggcggguccuuccacgggauggggggaggggcgggggcccaugugaccggcucagaccgguucuggagacaaaaggggccuuagcggccuuagcgggacaggccggagcgggagggagcgaagcaucgagcagugagcgagugagcgcacgcaguggcuguggccccagucccuucaggcggcugcucugccaccaagggggcugagguggggguggggguacgcugagacaucgguuccaaguccucccuccgucucccccuugucgguccgacguuuugggccuggaaagugggacaagucagucaagggugggagguccuucccgcgguuccuagcggagaagagacuaggcgagaaacucuaacccagguuuuaccccuaggaugcagcaccgaggcuucuuccuucucgcccuucuugcccucuugguggucacguccgcgguggccaaaaaaaaaggugaugggauaggaugggcucaggaguaaaagcuggggugggcaggugaggcaggccgugugaccaagugcugguccggcacgccauguccuuaacuuuguuccuugcgcccuguagagaaggugaagaagggcagcgaguguucggaguggaccugggggcccugcacccccagcagcaaggacugcggcaugggcuuccgcgaggguaccuguggggcccagacccagcgcguccauugcaaggugcccugcaacuggaagaaggaauuuggaggugagguggcgcgcgggaggagggcgggaagccagaggguauguccuuauaaaccggaggcagggaggacauccacaacccuccugucucucaccguggggccacucucccaucagccgacugcaaauacaaguuugagagcuggggggcgugugaugggagcacuggcaccaaagcccgccaagggacccugaagaaggcgcgguacaaugcccagugccaggagaccauccgcgugacuaagcccugcaccuccaagaccaagucaaagaccaaaggucagcgaauauggugggguugugggccaggcuacuccaugcucugucucugcagagcagucuuaaaguuaggaaugggcaggcacuugagggccacucucaggagaugcuaaacccucugcccaaguaggaacuacucuuucuguuggaucauccgaccuggguuccugggaaaggcuugucuuugucaacugaggaagguggggugggaucagggaggaguuaacucugcgcuuaaaacuauggaaaggcugucccaaagguacaugcugcuaccugacucccaacagcuauugaggccagcagggcagaggugacucugcccauuuccccggugaggaacuuggaguacucugauccuagaugaaaauagaaaguugaaagucaggcuugguagcucgugccuguaaaaagcggcacuucaggacugaggcaguaacacugccuugaguucaagguuacagacugagagacuugagagucugucuuuaaagggggggggggggcgcgaggguuaaaaaguugaacgaauaaagaaagguuucauaucacauggcugcccuuucccaccacuuccaggugaacuggucagucaccacuagggggcaggauuuucucuccuugauggacaugucugcguugucuggugaguccgagcuaggucacccaccgcacuaaugcaucuccguuauuguuuuccagccaagaaaggaaaaggaaaggacuaagucaggaggccagagagccuccggccucgccuggagccugaacggagcccuccucucccacaggcccaagauauaacccaccagugccuuuugucuuccugucagcucugucaaucacgccuguccucucacgcccacaccaagugcccaaaguggggagggacaagagauucuggaaagugagccuccccauacccucuuuuguucuccccacccugauacuuguuauuaagaaaugaauaaaauaaacucacuuuuuuccaauaaaagcuucuuuuuuaauaua

SEQ ID NO: 924 - RNA, 42183 nt, Mus musculus
gguugaugcugaaucuuuuuuuuuuuuuuaauuuugccuucuuaaagcaugugcugagcugguggaggagcaguuuggcaaauuaaaaaggcccagcagcuugggcagcggcagggagaggccuggugaggguggggugucccucuuccccaggccaagggguagcaaagcccgcacuaacuucauaaaauacaaaauaagggagaggugacgggagggagauuuguaaaauacaauaucuuaggggauugacaauaauaaaaaauaagguucauuauuuacaaacgauuucuguucuuggucucuguacaguaggagauggggguguguguuuguguguguaugucugcuuguguguuuguguaugagggggccaggaacagugguugcguuggucacuaugggaaggaaacggguagcccagugagugguuuaucggaggaggacggauagugguaggagggaaaggugggaacggaguggucagcccaggggagcaguccaagugucuggggacauagagcguccccagcuacuacagggacccggggggcagggguaugagcuggaucugggucaucgagcaagagaacgccucuucugggugccaggguguccguccuguguccugggucuuggaguggccuaggagaguuugauggugguguuggggcccagaucccuggggagagaagaagauccagggaugaaucugcccugggguacccgucauucaacugugagccaggacuugaccagggcccccucccccugggaagauguggcugagggaggcacagccugggacccugggaagggaaggcugucccucugcucaccugucauggaaccacuccuuggggugggagaaguuggggcuggugccguugucaucaguguccucuggccaggucucucucaaguacuugguggucucauggaugcugucugcacggucaugucggaggugguccuggggccucugcucugcuggacccccggguuugagcucccagccuucugggggcuccacaggcaguagagcaccucggccaucuucccaugagccugccccaucaucguagaacaguaggcuucgggaaggcacuguggagaaaaccagggugagccacggaggccccucagguaugugcccucugccggaucugcuucauucacuugccgggcaugaagaguacagccucugacaucuuacaggcuugacuccuccuccuagcccugaggaucccuggcuaugugauuuuaggcuagucacacacucugcucugauuuugcugggcaucaguuuguugaucuguaaaauggggauaguauaaccaaccucacggagauucaaggauucaaugaguaaacgcaguauaacaauugaagcugugcugcuuuuuguuuuuguuuuuguuuuuguuuuuuugcuuuucgagacaggguuucucuguguagcccuggcuguccuggaacucacucuguagaccaggcuggccucaaacucagaaaucugccugccuuugccuccuaagugcuggaauuaaaggcgugcgccaccacgccccgcucggagcucacaaaaauguagcacuucugagcaagacaauaaugguuugcuuacugggaacugggacuuuucccuccuuauauuaaggacugaacccagaacuucguaauagcuaggucaagacucucucucucucucucucucucucucucucucucucucucucucucucucucucucucucguuuauauugagacgggggggggucucacuaaguugcucaggcaggccauuaauuaauuuuguagcccguguaagccuuacaccuacgcucuuuaggccuugaccuaagaagcuaggaucacacugacaggaccugcugagagcuggguucgaauccucccgugccacuuacuuccugggagaauuaaggaaacccuuuucuuuucucuucuaggcuaguuccucugggaagucaaggggagagaaaaaaaaaaaagaauguuuguuggacacccgugccaggcuuuauauaaagcccuuagcuuaaagccaauuaaaucucacacgaagcccugggaaugaggugcuuuaagccccgcuucccagagcucaucaucaaggguccccguaaauuggcuuccuggcuccagucugcugccugccucccagcuuccccugcaggguuuaaucuaugagaaucuauggaaaaggcggccccuggcauugugugaagcugcaguccggaaaccagcccgcucaacaagccaccuccuuccucagacgugcccucugcccugcccugugcuucacucccuccagaggcucauucauguccucccucccccucccugggguuuguacuuuagcacagccccuccucuucugugucugcuuccucuccucuguccuugauagccuuggcccgccccgccccgcccccgcgccagccccaccccaccgcuccaucgcagccccucuccucucaguucuccucccagcucccagcuccuguccucccuucuagccucucagccuugcucaccgcccccacccccacccccgcaguaccccuccucuccauacacucccugcucuccccucucucugaccucucaucuguuuccucuuucucuucagccacguaagauucaugucccuggcauaugaaggauggccuagaaguucuuccaugggucuaccggaaguggccucuaccucugaaagccaugcuaaucuuugcuguucccuauacucuugcuguucguggccugucuuuccccucaugucaggagcuauuccagaaggcaagguauaugcucacuguaaggauggcaguuucuggagucuagaaaucaacaugaagccaagaugugcacccuggcucacacaacuagcaaaugcagagccggcugugacugauucugaaaugaaccacaccgcacuccauugggguggcacccacaucacaacuaccaugcuccccagggguaggcacucccagcagaguccugacaccugcugcagguccccugugccucagcggcuuucuuaacacugucacaucagaaaugacugaagacugacacucacuugcugucccuagaacacucugccgcccacuaagucugcccucuccacaucgcugcgccaaaggaucucagagaggcaaagaaucugguccucaggcuggagagauggcucagcagguaagagcacugacugcucuuccagagguccugaguucaauucccagcauccacacgguggcucacaaccaucuguaaugggaucugauacccuuuucugguguggcugaagacagcuacaguguacuuacauauaauaauaaauaaaucuuuaaaaaaagaguauagaaugagauaaugccaacccaaaucucuuauaaauauuuauuuuuaauuuuuuuaauguguaugaaugcuuugccugccauugugucuguguacuaccugggugcuuggugccuucggugacaagaauuuggcaucucauccccuggaacuggaguugcagguggcugugagccaccauaugggugguuaggcaccaaacauggguccucuaaaagagcagccaguaccaagccaucuaucucuccagcacuccagacuuuuuggagacagggucucacuaauguaucccuggcuggucuggaacuccucauguagacugggcuggucuugaacucauagauccaccugccucugccuccagagugcugggauuaaaggugugagugcagcugauauggcuucucucuaguaacuggcuaacacccagaguuuggagguacuuacucugacuggcugcauagacacugucagcugcgauagggucuucuuucacagucauugagccggaagagaaugcaggaaggcagggcacaagggagcccagcaccagaacgaagcacaaggcugccaccuaguaguagacagagcagucuauuauuagucggaucuggggcagggcaggccuacaagacuggccacucccaacucuccucacccuaaagcauuggacgcaaaaggcucaguuucccccaaaugccuccccagagcuggcugcucucuuggaagcagacacaggcuguucaagucaccuuuaauccaaucuagugacaugaaagggaccagagaccagagggcgggguucugugugguuucaccuauagagaaaucaggaaaggaagaaaggggaaggggggaaggggaagggaggguugcaacugugaccagggagaaggacacauagccacaucaccuucgcagccugagccugagaaggagccaagggccccggggagcuccagcgaggcccugcccuuagaaugucagaggcaacaugugcuuaccagggaggacagacuaauggaagagagccacucagaggcugagccugaccuagguguccccucuagccuuggggacccugaggggggcuccuuuauuuucucccuaucacccaucccaagaagaaucacacuccuugaaucuauagaagccacuuuuccaaggaccugccuuucacuagauuuagcagcaucaaccucacaucuauuagaacuggccuggacaggucacugguccccucagacucugcucacuguccuggagagcuagccucaagaagagcuucccccugcugccuuaugcuaaggaguagcaccuaccaugaggcaggugccggucugcguggcugccaucuuguacggucuggagaucuugcuggugaccagagucuggaguuucugcagcugcuggagcaggguccugaggaaggcacagaagucaccauggggacucagguacagcagccaugucugcauccuggccucuccugaggagcccuggcuggcuccugacugggccucuaugcuuuggugcccauuguagucaagauauaaaaggucaccuccugguaggcuuucugcagccuggcuugggucucggggaccugacucauggugggaagcugggucauccuguagaagcuuaggggugccuaacucuugcuccugacuucucaggagaggauggauuuccuuuucuuaugcagcaccagucacagagauauugacucuccucccuugcaccccacagcacccugauuccacaagaaagacacuugacauaguguguagugcagucaguaaaugggccauuguuuauguucauuuauugcuguuuuaccauuaucacagcaccuguagcacauuagcuuuauuuggggaguuccauuguugucucaguugcuaacugagggcaagaacuaggugcugcccagcacagaauccugguuaauacugcacuucuccacccagcaguguucaugcaguuccugaaguggacagcagguggcgcaauagucuuaaaacagauuuuuaagggcagagguagcgaggugaaguuugaaggcuccgccccuaccccauuccugccugagaagcugggucugagaaaggaaaggagaaaauauguagcaaguucuccugaggccugggaaacagaaggaugcccaaguacauaggaaguucaugacugagcuacaaaacagaaaaacccugauuucaaaaauugagcacucagguuaggcuagguggugcacgccuggaagaagccuugcacugggccaggcagccagaggggaaggaggaucaggaguccaaggacagcuucaagggcaucaugaguuuguggucaaccuggcuacacaagaacauguuucaaaaagugacaggggugguuaaauggcucagcacauacaaguacuugccagcaagccuaauaaccccagucccgucccugguaccuauggguggaaggagagaauugacuacuauaauuugccaucuaaccugcacagguaacagcauggugugcacacacauacucaaaaaauaaacaaacuaaaaacuuaaaauauguaaacagacaaaaacuaaaaacauagcaagggagcuuagcgaagugguaaaguguuugugcgguguguacaagguccuagguucaacuuucagcuagcaaggagacaguguuaggauucuacuaaauacuguugcuugugugacuguuauuacuccuagaaaacaguauggauucauagcccaggacacagaaggcaguguccuguguuaggauucuacuaaauacuguugcuugugugacuguaaucacuccuagaaaacaguauggauucauagcucaggacacgaucuagaaucaagaagaaagcacucuuuaaugccacagaucauuuugguuuugguugugucuuauagaguuucacaucagucccguuagccaguugcuggugucacaucacugucaccaagaauacugaggcccagagaggcucacaagaaacaguagagucacagacaauagcagaccagagccagaacccaagguccaaaucuguaguuuuaugcuacaagccaggugccaugcuggcuuccugagacucaugcuucucaaacccaauguaauggacccauccaggguacuuguuaaagugcaauuugagagcuggcuuagcagguacagugcuaucacccaagcaugaggaucugaauuuguauccccaacacccauguaaaaaaagccaggcaugagccaguggcucaccccuuuaaucccagcacucaggacacagaggcaaugaucucugugaguucgaggccacucuggucuacauuagcagcuuccagggcagccagagcuauauaauaauaauaauaauaauaauaauaauaauaauaaucaccuugucucaaauuaaaaaagaaaaaaaggaaggaaggaaggaagaggugaaaggaaggaaggaaggaaggaagaaaggaagaaagggagaaaggaagaaagagggcuagagagauggcucagcgguuaagagcacugacugcucuuccagagguccugaguucaauucccagcaaccacaugguggcucacaaccaucuguaaugggauccgaugcccucuucuggugucccugaagacagcuacaguguacucauauagauaaaacaaauaaaaucuuaaaaaguuaaaaagaaagaaaagaaaggcuggcuggguauggcugccacaguccugguguguugggaggaggggggcaguggacacuggacacagagccagcucagucagccacccagugagugucagauucagagaaggauccuguuucagaugauaaggugaagaacaaccaaagaggaugcuggauguugaccucugcauacuuacgcacgcaugcacacacgcaugcacgcacauacacacaauguacauucuggcucagcaaucuuagaaaaguccugaaauuccugauuucucacaaguucucgggucacauggggagcuggcuuugaguggcaaaggucuuggccaucagauuuaguaguauaggaauugcucuagggacauacaaaaguauugauugaaggggcuggcaagauggcucaaggguuaagagcacugaccacucuuccagaggaccugggcucaguucccagcaucuauauggcagcuccuaauugucuggaacucuaguuucagaggauccaacacccucuuguggccuccauggguacugcaugcacaugcugcacagacacacaguaggcaaaacacucaugcacauaaaacaacaaaccacagcaacacugguggcagccagguacagggacacaagcuugaacucuacuacuuaggugguagaggcagagagcucagcaagucuggagccagccuggauuauaugagacucucucaaaacaaaauaaaaucuacacagaucgcugaucccugccucugcaguaaaugacucaacagacuuagcucugggccugaguauaagcacuucuuucuuuuccuuuguuuguuugagacagagucuaucuaugcuuuccuaccuauccuggaacucucuagguauaccaggcuggccuugaacuuacacagaucugcuugucugugcccucccaagugcuaggauuacaggcaugcacaaucaugcccaggaagagagaagaagcguuucuaacaagcugagagacgaugcugacgcugagaagcacagcuggaaaguuucugcccugcacagucucgcuugaacaucuuacuggccugucagaagucuagaguuaugugcagucagggacaccugggaagucagggacuggcaggaccucagagcucccagguaauggggugcaugcugggguaucacccaggucauggggugcaugcugggguaucaacuugagcugguucucuuucucuccugccucccagagccuuuagugggcaggugggauacaggggugccacucaccuguuggcagucucuaggguuuccacuuucuuccacagcucauuguucucugauguauaugucuccacccuggaagggucaagcaggcacaggcucaggguguucccacagacuccucugucccacagucaucccacugccugcagccaggccucuggcuggugacaccagguugggguccuguccugaauguggcacuuacuucuuuucuagacauuccacauacuccuucuucuugcggcggcucuccugggcagaaaucugaggaggaggaggaaguuccaaaagagggguuaccauggccuaguauccccuucccaggcagccccugguuucagagaugacaucaccgaggggcagaggcccacuucagugaaaauguccucacaguccuagggcagggacagcuccggucuuaccuuguucuuaauuuuccugcguacucucuucaaggccuucuccucagccuuggugagggggagcuugguggggauaggguaacccuccgcgaucaagguccgcuucuccucuucugucaagagcaguggcccugauguccccugcaguuucugaggaaagcagacaaucuggggucaaacucaagcacuacuguguacugucugcguauucaacucuccgacucucgguuuccuccuuggagaaggggacgaaucugaguuagguccaguaacacggaucaaguguuugaaugguuuugggaggccccuucaucuauccuacccuagaauccacagucucaaagcucauucgucuaggguccccuaaacagcacccuccucaggcccuuucccucaguuccaauuaagaggagccaugaccuccucaggguucaaagucucuuccauuuugccccccaaaaguacuucuuggagauaggcagggucacucguuagggcucagaaacgucagaaucucaccuugguuccauaacugguugcauccaggccccaccugaccuugucucucuaucuuugauuucuagucaucuugaggcagaacuggaacauuccccucuuaucuguuaaucagguaccucccccccagaucugaugggguaagugucagacuuggggcucccugacccucuucacugaucagggaacuaggugagccuacuuaucaccucaucuccagggucagcccaucccuaguugcuuacgugaggggcagugaggagcggagagguggaaauggccguggaggagcgggccaugggccggacagggcuggaggggggaagagagcggggacucugggagccgucacugucacugccauggcugcugggggguguuggaggcaucuguacgagguccucugcaaaaaguagaggacuugguuaguaggacugcaccccaucucugugguaaugucaugagaacagcugaaccagcccugacugcagaaaauguaccgagaggcccuugacccgagcuggguaucagaugccccuagcaguguuagaaaagacacuuggcacccaugaagaugauugcugagugcuaccucugugaugguugguauaugcucgacccagggggugcacuauuagaagguguggccuuguuggaguagguguaucacugugggcaugggcuuaagacccucauccuagcugccugggagccaguauucuacuagcagccuucagaugaagacguagaacucucagcucugccugcaccaugccugucuggaugcugccaugcucccgccuugaugauaauggacugaaccucugaaccuguaagcuagccccaauuaaaugcuguccuuauaagaguugccuuggucauggugucuguucacagcaguaaaauccuaacuaagacaaccuaucucucucugcuggugcagagggagcucccugcuaucuuggugaggaacccccugggcugcaugcuuccuuacccauagcuucacaggauucaggcuuuuaaagccccaguucuguaaguccagagaggacuaaguucaaaccagaccagugggguucaggcugaccaauguccuuucauuuccuuucucugacucuaaaacauggauucagucucaggguaauaggaugggugguaaucaaaugaacagaugugugaguggagugagagauggauucauggauggacagauggguggauggauggauagaugauuggauggacagauggguggguggauauauggauggacagauggguggauggauggacagauagguaaacaguugaguaggagauggauggacaguuauauggauggaaaagaaaaugacugguggcuauaaaauaguuuucaguuaucaaguggauggaaggaggcucagcaaauggagugagguauucguagagugauggugguugaagauuggguaaggaaggaauggaaggagagggaauauggauagacaaggagcaagagauugggaaggugagaacauuugggggagaagcaggaguuuugaggcacagggguggucuagauggagguggucuagacagaugccaucuguccaugacuagaaggagucucuuguacacacuuaccuggugucacuuugagaaacuggcucauuucugggggcucugcuuugaucacuggcagcugagucauuucuccuggggccugaggaagagacagauucaucuccaucaccugccccugggacaauucucaucaagcccuucacuuuccucccucccuuugacuggagguuugcccugcagagcuggaggaauggcuggccucaggaguucugggcucagcccaggcuaguccucaugauuagaaaagccguuuggcacauuggacaaugaacaguggcuacacacuguaggccagaacugagucucaggaagggagaguuccuaugguauccggggccaggccgcccuccagauagaggcugacccuucacugugaaagccauguagaccuugguaugugguugccaugagcacaggaggucauguuaguuccacuguagcuguuggaugaaugggaacaaugguucaggaggaauuaagugggcaaggcugagagaaagcagcaggagcugaaaugucuuguggauccuuggauacaaaugggaguagagcccagucaaggaagcuugcagcagugagaacccuuggggggcuucaaguuaggcgugggugcaaucagauguacgcucuuaagaagaauguguuccuauguaucuaaauuccaaagugacguuauagucagggcuucaggaaaaugugugguuuuguacgugugcucauaagugguggucuccgugagaaggucuuggcucuugggacugucuuucccuacugcaucugcugccugccaagaucacgacacugugugggagacagagugcugggcauaggacaacgagauguucaggcgcuuggccguucccuggucuccauccagcuuaauggcagcacuucggauaaggggaccugaggggaguguggagcggugcagcccgauggggguucagauaguuacagccuggcuccuguguccuguguggaguggaaaugcucugcucuaggguccgacaggccaagcucagcugcaugcuuuagggcuuaacuccugggaucuuguuuccuuuccugcugcggcucauucuuccuucugauauuggcugagcuaauccuggagacucucuggggaucaagcuggccauucguccuuggccuugggggcaggggaaggugaccuuucuugcuuaggaugaccuacuuugaagaaguaacccagguggucaacaaacuucuggccuagggauuaguguuuauuuauuuuuauuuuuuauuucuuauuuauuuaauuuugagugcucugcugcaucuacaucuauaugucagaagagggcaucagauccccuuauauagaugguugugagucaccaugugguugcugggauuugaacucaggaccuuuggaagagcagucagugcucuuagccacugagccaucucuccagcccuagcauuuauuuauuuaaacuauagaauuuuaggcccugugucuuguuccuauuuuacaaagaaggaagcugaagaaaaaagagagcccagccuggagcacagcagggaaccaaaccugaccuagggaagccucucccagaagccaggaagggucucagauuuaaacgguuaccuauacacuccagaaguggaggcaggcauucucgugagcgcgguuuauuaauauacauacacguuaaccuuucuuaaauccuggaacuuaaaaggaaaggaaguauccugggguaucccccguucagauauccuucacuuggaaaccaacccucagcccuuccugguacccugcaagcuuucucugaugcagggagggcccagcgugcuuggagggcacuggaggaugcggaagugacggugagugugggagguccaagucccucagcucccgggguucccaguucauggacccuagggugcgguccaggacuuugggugugacucccuucccucccucccucagccccugugcgcaguucccagccuuaccuggugagggaugggcagccggggcauggggcugaggcccagcaguggugggguggccauggcggcggcagcagccauggcagaggaggcagccaggggaucuacaggcagcuccgggcucugcuccugcuucaccaugauggagcacagcuuguuucccagggcccacgcuccguguuccacaucugggguggggguggggugaagugggaaaggcucagauucgggggcucccagagcacagaacucucugaccuacugccuaccggggagcacccgggacugaggagugaugucagagcacccauacggucuggcagcaaacccaggccacucuugugaagugagauaggugggcuggaaccggaagaggcuagagcauccuuguauugaggcacugacugaaaggcuuggccucugcauuuagacuucuccuggccugcugugugaucuuaggcaagcugcuuacccucucugagucucagcuuccucaucuuuaaaaugcggaaaguggggcugaggugauggcuuucuguguaagaaugaggaccucagcuuggauccccaggacccguauaaaaaacugggcacaagagcauaugacgaucaguccagugaugaagggguagacacagggugaccgccaggcuugcuugcuagccaguguagccaaucagugggguccaggcucaaugagagacccugucucaaaaaauaauggaagugugauugaggaagccaccagacaucugucuuuggcugacucauacaugugcacacacaugcacauauaaacacacauggaaaaaaaauagagggaaugaacagucagaccuaauggggagauuuucaggauuccugguacaacacuuguuaacacuuaacacagugccuagcaagaagcgaacguucauuaaucaguaacuaguguuaacacgauuaucguuauucaguaaacacugcccuguuuagcagcgugagaacaccuggggcagggaugcuggagucagaaaggugagcagguagcauggacuugggagcugcccuagggcuguaccaugauaggauucauaacuuuagauuuauuucuauuaugugaaaguuaagagugugcugggcuggagagacagcucagugguuaagagguuaagaacuuuaagagugcucuuccagaaguccuaaguucaauucccagcaaccaugcggcagcucacaaccaucuguaauggaauccaaagcccucuucuggugugucugaagacagcuaugguguacucacauaaaauaaaaucuuuacaaaaaaaaaauuacaagugugagugcaugcaugcgugcgugcagaugucugaggagaccagaagaaagcacuggaucuccugaagucaaagacacaggugacugugagccacggagaagggugagauccagcuggggucgucugccggagcagcacaggcucucaaccacucagccaccuucgcaauccucggauucugaauuuugcucuuucaacugcuucccagacaccaugaagugaacugcucuaguacaccccgcccuuccugcuaagcaggucugagggcuggcucaguggagcuccuguccugaugaaggagauccagggacuucaggacacagagguuuccuagcagugagcugaaacuuacgguugugauugaaaaccuguuugaaaauaaaaacaucacagccaucgagacggcucagugugcgggucuggugacccaaguuugagcccuggaaaucacauauagggaggaggaagagcacacuccacaaaguuauccugugaccuccacaggcgaucugugguacacaugugcucuucaucccacacacacacauaaugauaaugauaaugauaauaguaguaguugauaaaaauuggaaaaacguuuagauggcugcaguuucuggaggugguaagauucagaauguggccauggaaauggacagcugaggaugcuguguuggaagacgacucucuuguguuguccuaucuccuggaauuguaugaagggcacuaccauccguguacacccucagauucauaguuucauagacuggagccuccuuacaggaugcuccguugcuugcugcuugucaucuuuagauuugaaugugaguugugaagcccauuauaucaaaggaccgagcagaccggcucuauguggggggaaaucacggugaguagaauagggugggugggaagggaugcguggggcggggaaggggcggguaaacagugcaggagagagaagaugcagagcgagcaaaagcaggcagugggaacagagaagaaaguugacuuuguuggucuuuuuaaagaggucucaaguaguccaggcuggcccuggauuugcuauguagcugagguucacuuuguuggccuugauccuccggccuuaucuccacuuccccaucaucagguuuacaggucugugcugcugugcccaguuuaugcuaguacuggggauggaacccaagccuuuaucuagacuggaccaccacgugugugacauuagaaacaguucaaagggugaguucuacaagacucagugaugggggcucacgaagguggaaggaugcuuagguuuucccauggcagaguccaccuccuaacacgcaaucauguaggguguaacuuguagucauguaagguggaggucuuuugguuacaccugggcuucagggcuugcaugccucagcucccgguaggcaaugggcaucccucucuuccagggcaguguugcagcaguaaggcaggggaggucggcuugcagggaguuggguggaggagacucugaggccugcuaaugggcauggagcccgagaacccagcccugggccacaggcagcccccaagguccaggaacacccacagucuucccaaauuacagggccaagcugugggcguucgggaagcuguccccacaaagggccacagacaaauugccuuaaaaauagaccugggguagcugagaaguugcugagccagucagcaggguggacugaaacucuugucauccaucugccgucaucaucugucacgggcugagaggggccgcgucacgcgucacgucccugcucuucccaggcuagggucugagaccucauagaggucuaggaacuuggcaguugcggaaguguggugagcagcugggaccucagcugucacaagccacggguccuccuaaaacuccagaaggugucccuuccuucuuggcaggggggacaaaaaccaguuucuacucuuguagagacucugcagcacaguucagucuaagagcagaaugcucgaagcuaacagagauuccaggaaggcaccguugucuccccauuuaauagaguggccaaucaagaguuuacacccaaggccagaguccucuggaaggcaagaugagcaaauuucauucauuguucuaaccacuccuagaauuaauaggaauguauauuccaugcugggcccagaacugaaaaccuuauggacggauauguguauguguguguauguguauauacgcauauauauauacacacauauauauguauacacacacauauauguguguauacacacacacacacacacacacauauauauauauucauucuuguccagaucuuucagguacauauuuuuuaucuuaaaaaaaaaacuuuucccuuaaguucuguguguaaguauugggugugggagugcagguacucucaggggcacuggggcucccugaaucuggggucacaggcaguuguguacagaccugcucaggugcuggggacugaacucagguccuccacaagagcagugugaacuccuuacuguggagccaucuuucuagcaccuguuuucaucuuauaauugaggaaauagaaguccagaaagguuaaagacuuuacacagacacccgugagcugaugggaauaccaggaugcacaucuaauccucuugagaucucaacccuuuugcagccccuggaggcuguagacagaaggggugcagauuagaaucagggggugcugguucuagcucucuguucuguuugcuagcgugaacuaggcagcucuccuuuugugaaguccuuauuuuuuugagacuggguuucucuguguagcccuggcuguccuggaacucacucuguagacgaccaggcuggccucgaacucagaaauccaccugucucugccucccaagugcugggauuaaaagcaugagccaccacugcuuggcugugaagucuuuuuuaugggucaaauagggauuauuaaaguauuucuaccuugucuggacauugugcgguacaaauaaaacaaggaagccgcuaauuaccauggagacagacggugcuuugcacaccaugaggcugcccccaaggguagaugaagauacugaggcuucucaaguuuaagagacagaucugggggcuggggagaugacucagugguuaagagaacuagcugcucguucagaggacacaggguucaauucccagcacccacacagcagucugugacuccaguuccagaaaauuuaucacccugguuugcauguaugugauuaacauaccuauguguaagcaaaacaaccauaggcagaaaauaaaaacaaaucuaagagggacaggucuguggucacccacccauaaaaaaacgacaagaucuggauuaccugucuuagaggaaaggacagaacaggcaguguuuugggauggagcagugugggucucaguugcugaguacccuugaggagcaguuuggaggcagagggcugcuugcuucaaagaugggagaugggagagagguugccucgcuaagcuccacuucaggagccaaaauugaaacagggcaccuaagugauauuuugggguaugucaguauaaggagaugggagguucuagauacucuguaauuugccuauauauugaugaugaugaugauaauuguuauugcuauuauuuugagguagagugcaugcuggaauccaaagcugucuuggagcuuguuaaguaaccaguccuggccucaaacucaccauccucccugccucaguuuuuuuguuugguuaagacaggguucucuguguagcccuggcuguccuggaauucgcuauauagauuaggcuguccuugagcucagagaugugccagucucugccucccaagugcugggauuaaaggcugaugccuccccugccuaucgacuuugaacuuucuauccuccugucucaguguccuauguaacugcauuccauuuuuuaaaaaaauauuuauuuguguauaaguguccugucugcaccagaggaggacaccugaucucacugcagauggucgugagccaccauguagugcugggaauugaacucgggaccucuggaagagcagccaguguucuuuccuuuccuuuccuuuccuuuccuuuccuuuccuuuccuuuccuuucccuuuccuguuucuuuuuaaagauuuauuuauuauuguaucuaaguacacuguagcugucuucagacauaccagaagaggguaucagaucucauuacagaugguugugagccaccauguaguugcugggacuuggucccaugaucuucagaagagcagucagugcucuuaaccgcugagccaucucuccagccugcagcuaguguucuuaacuacugagccaucucuccagcccucauuuguuguuuuguaguuugugugucuggagacaaggucucaccauguaguccagguuaaccccagacuuagcaccaucuacccagcacccugagugcuguuaccaacacucaccuccaugcuggguuggcugcagcuuugcauugauuauuguuguuguuuauuuuacuuauuugauuuuaaagacagcguuucucuguguagcucuagcuguccuggaacucacuguguagcccagguuggccucuaacucacagagaucugacugucucugacuccugagugcugggaugaaagguauuaaccaccauaccuggcucuuauuuuauuuuauguguguggauguguaugggaggguucagaugugugggugcauguucauguguguuugugccuguguagggcaaagguggguggauauuauaugucuggcucugucacucuccaaauuauuauuugaggcaacgucucucacugaaccugaaguucccuguuucaguuaaguugucuggcuagcaagccucuaggagcuacuugucucuggguuuauucuucuccucuaugcaccuaccccaugauuaugggaccaccacuaucuagccagagguucaaacucagguccucagacuugaguggcaggcacacugaccucuaagccaccuccagcagcuccgcaaaaggcacugcauuugucacaggcugucagugacacuguugucuaaggaccacucuuugugaacugcuuguugccauggguuugauuucagggggaacccggcgcuguacccugcuguaaggggcuugugggcagaugcucugggagucuugggcugcagaugcccccuccccauguccaggagcgucuuucuuccucuugagcacuuucccaucuuaccuugagugguguccuccaucuugacaggcacaagggggcucuggggugcagaauccccacucagggaguagcugugcucagccuggaugccuggagcgggggaguccaguuccauguccagcagagcacucuucucguccagcacagggucaucaaagaaacugcugaacaggucauuggagaaguccuccauguucuccacaaagugguccaggugcuccgggaagugcuggggagggaagggaaccucagugaggcuuggagaggggggacaggugcugcugugaugggcaccucuucauucuuuucuuccuaccacucauacuauaugacaccauaucaugacacuacuacccuccccaugaccaguguaccaggacacugucacccacccggugaccaacaucacucaucacuggcuuuaacuuuucuuucuuucuuucuuucuuucuuucuuucuuucuuucuuucuuucuuucuuucuuucuuccuuccuuccuuccuuccuuccuuccuuccuuccuuccuuccuuccuuucucucucucucucucucucucucucucucucucucucucucucucuuuauuuauuuuaauguaugagugcucugcugcauauauaucugccugccugaagaggccaccagaucccccuauagaugguugugaaccaccuuuugguugcugggaacggaacucaugaccucuggaagaggagccagugcucuuagcugcugagccaucuuucuuucuuuuuauuuaaacauuuuuguuguuguuguugcugggcauguggccuuugccuuuaauuccagcacucaggaggcagaagcaaguggaucucugugaguuugaggccagcccagucuauauagugaguuucaggacagccagggcuauguagaaagacccugucucaaaaaaccuuuuuguuauuaucaucauuaucauuauaauguguguguauguguaucugugugaaugugugugugaaugugugugaauguguguguguguguguacaugcaugccacugccuauguauaaaugucagaggauaacuuuguggguuguuucuaucuuuccaucuuuaagugggguuggaggaucuaauucaggcugcuaggcacaugagacaggugccuucacucacugaacaaucucacaaacuuccucaccuuuaaauuuuuuauuuauuaaaaaaaaacuagcaucuggagagaugguugagcaguuaagaccacuggcugcucuugcagaggacccaucuuagcuuuaguucccaguacccacacaguggcuaacaacuauuuuguagguagcuccaggugaucugaugccuccuccugacccuccacuggcaccaagagcacauauagugcacauacaaacaugcaagcaaaacacucauacuuauuaaauaaguagaaacacaucuuauuuagcauacaaaauguauggaacuggagaaaccaggugaccucuggccuacacacacacacacacacacacacacacacacacacagacagagagagagacagagagagagacagagagagagagagacagagagggagaugcagauagacauacagggcaaaagucacaaauacuaucuaugaagaacauaggguucaguaaaugcaauguagcccaggaaaccuuguaauucugugguuccacacaccuugauuuuuuuugggggggggggagaaagcuauuuauuuuuauuuuagacaucugaguguuuugucugcauguaugacuaugcaccuuguguaugccuguugucuguggaagucugaagugggcauuggaucccuuggaacuggaguuacagauaauugugagcccacauaugagcacggggaaccaaaccuguccucugcaagaacagccagcagucuuaacuucugagccauuucuccagccuuuccuaccaaugggaucuuugauaccguccuggaagucacuaaguagggauaggcuaguuagcucugcuggaauccaccugucucugccuccccauuuggagguuauaggcaggcucgaccaugcucuuuuaagugagcuaaagggcgcuaaggcagguccuuaugaauuuuacugacugaaguagggaaugacagaagcccugaguaggaaguccuagugaauguguguuggcaugagcacagccacagcaaggccuucaggaccucagaccccugggacaauugacaaagccucaugagaaauggcaaagcuuugcuugggagcccaaguaugugagcucaugaguuauugaucagugcgugcaaagacuggcaacugcagcacccuucugagauugcucauguccagagucuucccauucagacuagaagcccucccacugugcuguagcuaauuaccgagauuucagguuacagcaggauaccaugguaacagaacccaacuggaccccacccagccuguaugugugucuguaucugucauuucuucauucuucaaugucccuaguuggaguuuuggggcccaagucugagcuaugucccaacccaguaccugucugcuuuucuuuuuauuuuaugcaaauuacuauuuuauuuuauguguaugagugcuuugccugaggauauguauguucacuccaugugugccuugugcccuugaagagugagccagagacgacuuuggauccccuggaacugggguuacagaugacugauagauuuuauguggguacugaaaacuggacuuggauccucugcaacaagugcucuuaauggcugagccaucucucuagcccucgugucugcuucuuugagacaggguguuguuaaguagucuaggcuggcuucaaacucaugauccuccugccugaggcuucugagugcuggaguuucaggagucuacugcgccccucucaggcuguucucuauccugaggcaucaggcuguggggccgccucacggaggcuugcguccuggccucaaucauuccagcuguugacucagucuguguaagcagcaaguggugacucacuaauguguuaugaaaucgauucagugggucgugaccagaacuuaaaaaaauauacuuagaaaauuuuuccuugacacacaauaacuguacauaucuauggggcagacuuggacauuucauuacaugugccaaugcacaaugcccagaccaggucaagggggcauagccaucagcuuaaacacauauacuucuuuuguggggcacugaaaugcugucuccuagcuauuuugauauauauaauuaaucauuguugaccacaacuucccuacugcaaagcauuagaaccaaccccuuugccagcguaucccugaccccacugcccccucuccccagcccccauuuucucugccauuccuagccccuaggaaccacuuuugugcuuucucauuuuaccacauacagguaaaaguauguuuuuuauuuucaucuggggccuuguguaugccaagcaagugcuuuauaaagucuaaguuaaauaaacuggccccauguccaugugggcauuuauagccagauuuuaagaaaaaauagcacaaaacaaaauacaaaauaaguagaaaauaucagaauccaucaaacauacugaaguaaaaacccuggcaaacuauuaaucucagcuauauguauacuugguacagaugucaauuuucuuuuucagaaauaaacagacaaaagcuuugaccaugauugugggaaagcuaauuaacccauguuuuaaccuccucugugcauaguggggcuaauuauaguuuccauugcuaagacuauuguggggaauaagccaauccauaugaguaaagguuuaggauagucccuuguacagucauaagucaagaaaagucauaucaucaauaaaacacuccagggccaacacauaguaggugcuuuuuuuuccucuugaagagucauugaugugcaacacaguguuacuguuguucaugugcacuagcugguugguugaaugagauugggccaggguugcuccaggcucuguauuccaccuggagacugugaaggggauuggcuccaggaccagucauuggcuuucugcguccugaacuauuaggacacaggcagggaugagcagugccuucugcuucaggauaaggcucagcaauggaugugugguuuuucaggagcagggaaggcgcaagagucuggaaccauagagaccuguucucaacucuuccacuacuugcugacuuuuaaaaacuucucuauagcuccuacuccacagcauugcuauggggaucaaauguugguuagacuccugguacccaccucauaugauuaugaggaugcuaugguugagugcacgaagcacucaaaacagcaugugguagguaguauguaugaaacacuugguaguuaauagcagccccuaaacucaggcaugagcuuggacucuauagagggaggugguuugagguuccccucugagcaagugugacaagaaacuccagggcaaaacgaauccagagacaccauugguauacucugggcucccauuucucuucuuccgggaugcuucgucauuauuuuauauuuuucuuuuuacuuaaauuuccccaagugcuuucauguauuccaacuucuccauacccuacggugggcgaccuugaauuucugauccucuugccuucacgagguacugggauggaacucaaggccuugugcauucuaggcaguagcccuuaccuacugagccacgcccccagcccuugcacccguuuauuacaccccaaggagcaaaggcauugcuuuacauuugaugggcagggcaaacagagccagacaaagccagaacgugcccauggucccucaauacccagaccuuccccugccaccacaccacacaccucucuguuugggacucgccuggcugaugccagacuauauuccuggagacaagucuaugcuuuguucaccugcuagccacucauucaguagcggugcagggguagggccuugcaucucagaguaaggccacuaguguuuuagcuguucaguagagucugggcagugccguacaaagagcucagggucugaacaagucucuagaacaacugagaaccuagacagaaacgcuuuagggauguaugauccauucuaacgaccaucaucccaggccaugauugagagguucacauccgcagcagaaccaggccaucccaccugggggcgcuuccuuccagccgaacucggggauugggaugcggugaugguggugguggggcgcucuccaaggcugcgguggggcccaggggaggggguugcacagagcuggaagagccaugagucagcggccacgguauuucuccagcagcugcuccgcaggcgauaagaguuugccaacccccuucccgggggccugggagagaagagccagcccccuccagccuggguuaggggucccugaagguuuuccaguuuuaggaaaauaagcgaggacccucuuugggggugcccgaaugaacuugcuagggggccucaaauggccggguguugugagacaccccccaccccaccugcuagaaacaacagccaacgcucagcaggcugggagcggugggagccaaguggaagaagagggcggccaaggggcaggcagggugggguagaggagcucccgcgcucauuccucccugucccagguuccuggagugcuggguggauggugguccugucacauagcaccuagacgcaucagccucucaugggagcauugccaccaguagcugcucacugaauaauguagccuacuuccaucugaugucuggcauugagccggcaucucaguuaugcugugagacagcaggaacccgagaaagucaguggucuaugccccucaacucauuugcuaacaagaaagcuaaaauccagaaagagcaagccauuuacccacagucacaaggcgugucacuaguauuucggaugggguucuccgcagcucugggauugaacugaggguaaggagguuucccuuauguucuauacccaccucccuccauccccguaaagcucacucuagagauuucaaaccuccccaucucuggcccuggucgcucucgcccgcuauagagccuuccuccagcucacacagacacacaagaaucauauuuaggcugucugauggaaauaggggguggcgcuggggggcgggggaggggggaggaaggccgguggccaggaguucacagaaggcucacgccagcguuugagggggcgggguguucuguuagggugggcagucuuggggggggugccauuccguacaggcaacgggggugggaagccagagaaggaggcacuggagauauuucccuccuccuuaaagacuuuuuccuacacuugugccaauaucagcucuuucucggccgccacgggcaacaggcgccgguuccacucccuggaaggagagguccccagaccuccggcucucaggccggcacccugccuccccggcugcugcuucucuccuuggcgcuacagcucagccgcccgcccuuuaaauuuuagggguggagggagcccugcucgcucagugcugcaguuacguggcuuaaucggccucuugggccccgccccucccaggaaucccgcuugccauuggugagagcagagaagcuccuggccaaugauaggaggcugcgagccaccgcccgccugaccaggaacgcgguugcgcagaguaggauccuagaccuggaagcuugcuacacgggggaggggggauauaaucaguucuuaguuugugucuggggcagagcugagauggcaauuccacgacccuaaucagucguguggccacucgcgaugauaggcgaacggagagagagcaacucacuuccagcucugccccuccgcuccuuccaguaaucuuaccaugggguggcacgaauggagccccagccagccccucgugugagaggagacguucccaggguuguacagacugagcucuuucuuuccuuaacccuugcaaaggggucacugcagacagugaaaauaucuggacgcagcggucagcugugguauacguacaagcagccacugugcaucucuuuccccuagaccuggaccugguucucugaugccugcacuggugcucugguuucugcaccaaacccugauccagagagauucagcccgugcugcgugggagagaccuaaguugguccagacugagaugugggaucaggggugggggaaauccccugcgaacuuuccuucugagaaaauaagcucugggaagagaugggaggggaauccucucacauuucccucguucuuuucccagggagggcagcagacgccucuuguccccuaacacacugacccacacauucccggacgguuacuugccuagugaucacuagauaauugccuccauuucaagcccaaaggccacugcugugagucacugcuguguccagugugggugggaguugggugagggaaacuuaagacugcccagagauaugggcuucuggguccccaguugucaguagaucuccuuguccuuaaacaucaccauccagguauuugggggcccuaagagacuaagaacuugucuucuagagacaggcucuuggcugccugacgaaagggcauagauacugaaccagaacucaggaggccccagauggagagcccuacuuggcucugcucugagguccaggcauggucagguggugugcccagguuucuccuggguuacuguuuguguucccccugaauugagcggucagggucagaagucagcuccuucuuuguuuagccuuucuggaccuagaagggauaaagucuuccuagagcccuccuggcaggugugggaguuacagggagucugcugcucuaaccuccuaucaggcccucuuccuacaggccaaggaagggcuggugcuggguugaccuguuuuucccuuauucaacgauuaaccaugaaaccuaaauccaaauacacagggcugcuucugugagugcacauguguacacugcaucucagagcugggaugggagggaccuuccacccagggaaucuccauuucucugacaugacacaaugagagauacaaaccaccccuacccccacaacugauacauugagauuugucuugcacagggucuaucauauguauauuaguacuccacccauagcaccccaguuuacauagagggacacuaccagacaguaacacaagcccaaugagaaacucaucagauagggucagauggacaccaauucaaagaaugucgcucagagguuagagcacaugcuauguaugcaugaggcccuggcuucuaucaccaguaccauaaccccaccaaaggccaggucuggugaugcauaccucuaaucccagcacuugggaggcagaaguugguggaucucuaugaguuuggagccagccuggacuacacagagagaccuagcucaaaaaccaaaacaagaaaaacacaacaggagaaagacagucacggccaccacacucaccaucucacacccucccaggccuaaaagaugagcaagcuaagcccgagagucaugugagccccagcaagagaagguuugggaguccuagcuuguuugacacugggacagucacagcuggauuugaggauuggcugucacggagacuggagcgggguuugugccagcauaugcuggaaaaauaagcuggcacccacugcaggcuucuucuaagccaaggaagguccugagagggcauauaccaccuccgcaaucccugcuugguagucuaaccaccuacuuuuuccuggguaggcuaaaggucccccacguuccuggccaaccccugccaucuucuaaccaggcggcuccuaugcuguggcccaacucugaggcaggcgccaggcacugucuggacaggaggaagcuauggcagugaguggcacugcccaggguucagauuagcugugacuggcaccacugagggauggcagcucauggucuggccgcugaggaggcugguccauaugcaguugccagagaaugccuucgggacagcucaggacacugaaaaccaagaguuagaaguggcccuggggaccucuggagaauaagcaggcagucacccccauuacccaucacguacccacucauccggccuuuacuguucaucuacuuucaguaagaguucguaguaaaagcucauuuuucuauguucagcucugcagaaugagagaugagcaagcaggccuguaucccauucuagaaagacuuucugauauuuggaagugugaucauuuuuuagagcugugaucuacuaaauccuaaaacaacuaugccauucccaaauuuacccaugacucgcaagcgcccuggacuagucugagcuccauaggguagcuuggaaugaucaugucgccucugacuagcugugccgaauccugcccucaaccccuuuucagaccaaguccugcugauucguccaggaugaccucaaacucguaauccuccugccuuagucuccccagugucgggauuauaggcauggagccugccaggcucagcucucauggguauagccaaugcauugcaugcucauguagaacacaggcguuuggagacuggcugagcaggugaaugaaggcacguguuaaucagcuaauggacggaggcugcuccuuccguaguagagcguccaggaaugaguguccugaauucugcucugcugccagccugcuccugcucuaggcagaguuuccacuggcuuggacucccucccuggguuccucccuggggagagggggauaugcuauacccauuuuucacauuggucuggccugaagacuuuuuguguuuaagccaagacagaccgguucuguaggguccagagcccccacucaguguuggagaagcccaggccaggucuuugaguauacauggggccugcugggcagcuagcuggcuggauccccucucuuuuggguccugaccagcuggaaguccugcuaggcuggagccuagcgcuuggcucuugcugcaguucugcuggccucuccccucuccucggcacagucaccgcucaguuucuggcuuccucaaggcccagccugucugaaucguccucagguuuuauuuuuggaacaacuggcauuuucucuccuuauauccucccuuccuucugggaagguguaggacccuuggguuccacuggggaucaggcuauggcuucagugccuggauucugguucccucuagaacuucaaagggaaacuccuaacccagcagaugcacccaagccagauguucugccuucuuuccccacccagugugugacuaaugccuacccuuguccuucuugaagagcauagcucuagccaaaagaaaacauaauuugaagcaccuuaaggcccaccuccuaucguuguggggagugguguagucacgaucauaaacagagagacagacaggucugauuccaaccuuggucugcuaugugcuguguagccugugccaggcaguuaaccucucugagcuugagucucaguuaugaagcagggggacuucuaucuacagccucaggcugcuaggaaaagggaacaagaaaacaucuguaaagugcgucaauagugcagggcacacagaaggugcuaguucaguguuagccauggcaggugaagaaaauggagggccagggauggaguggacuugccaagggucauaucacucacagcaagcugccuugagagcauuaugcaucucucucuagcuuccuuucaaggaagagacuggcaggagcucuaggaaggacgcucuugaaucagucagagaagcgagcccucaaccuuccaggauggcucccuaguacccuagucaggcccucuccagucggccauucuuuccucuauugcaacauuguuuguuuuguuuuucucucugggugccuggaacucagguugcaggggccucagaacucagucccauggacuccaggccaguaggacucugcgaggggugggggagcacuagguccugccugacaucagaguagagaaacuggagcaacucucaggccagcuggggcucuuccagcucagccagaugucucaggaaugugcugagcuggggacuaccucucauccucccucaccacaccccacccuuacgcugcaucugcuugcucuggcuaggccucagccccaccccccugcccuuucucauccuauucuggagagccuggcaguuccucucaccacaguccagccccccagucuucuggagggggugucaaaggcaaagguucuuugcuccgcagaccccugcggguuggguugaccuugcgggagcccaggcugucugggaggggagaguucugagugccagaccccaaauguggaacugauuugcagugcuggagagagaggggugagggcuuuggggcggcagaggguagggcugggcguccacucugggagaagaucucaggcaucuugucccagcugagggcugggagagccaaggggugcugugccaggcugggcuuggcugaagugugggauucagaaucuuccagucccccggacuucacagggacaugcuuugucuagcaucggaggggucugaguuccuggaugggauaggggaaucccauuagaguccugagcuugggccaugagacagggcauugguugggagagaccccagcucuaaguagagaccacuuauccuccugcaaggguggaguugccuuggauucuggugucaugaugaaagggccuggggacugcugcuucugacuggggguaggggugggggaggaggugugagguggggacagagucacaccaggucauggggucaguggauggggggcugugauuacaaggcaggaggagaagguccugacucacugcugucucgugcuaccuugggcuuccagaaaacuguuuccucuugaggaaagccccuaaucauucagacagacagagaucuaagaaguccuaaugaauucuagaucuccuaguaccaagacaggucacaguuacuggggccaccaccuguccaggccagaaguaucacgggcucccugcuuucuguugaaaaaaaucugcacuuccuagaaugggaucaaaggugugagauaacggauuucacaggagaguuagccccucuuccccucucuccagcuuguaagauugucacuuccuuugcuuauacccugugccuggaauguucuuuuaucuucucauccuaccccucccauccuccaagauucaccucacaggcugcuuccuccaggaagccuguccagaucauucagcuccaagaauucuuucuccugugcaaccauagugugcaggcugcuggcuaccgguuaaugccgugcauaacucuauacacaaugggacccaacucuccuuuuaaaugggaacacugagcacggaaccaguuagaaguccucacaguacagcugacaguaauaauaauggcgaacaugcgggugacggccccuccucugcuucuuugccuucagagucucauuuaggcuucagaaaauaaaguagauacuaucagagccauugccuuacaaaccaggaaaccagggcgcacagagggaaauccugcccagcguugugcugcuuguaguuggucaaaccacaguugaacccaguuuugacacuagaaauuguacuuuagugucugugacaucacagaauggagguggguuccuguuaguacagugcuguguacaaaguaugggccccugcuccaggcauggagucuacacccagggcccagcucuguuccuucccuggcuuuccagaucccuagaagcacagagcucugaggccugggagcuuaacccaaagaaaggggcuucuauccagguaugguguugcaggcuuguaauccuaacuaugcaggagacugaggcaggaggauuacaaauucaagggccugcccagacuacagaguaaguucaaggccaagucugggcaacuuugaucuugucuuaagauuuaaaaagggaaaagagggcuggauccagcugaguggcagagcacuugucuagcaugaacaaggccccgggguccauccucaguacacauaugaaagcuucuaccuagaucuggagaaggugauuugucuccccaagggcaguggugcccaaauguugacaucuuucuucucagaccaugacagcaucagauugaaagcagcggcagcaacuguguccugcagagggcacugugcacggcucugcacagggcccucuucaagaauuccuaguuaggggccaauaagauggcuaagcugguaaggguccuugaccccacagugcacgugcacacacacacacacacacacacacacacacacacacacacgcagaccuucauauguaucccacagugugcacacacaugcacuugcagacuuuuacaugugcuccacggcauacacacauguauacuugagacaaaggugugugugugugggggagauucuaguugacuuuucaugagaacccuacuuugaccauuuuuccuacuauaagcaugaagaaaagaagucugagcugggcaugguggcccacgcccuuaaucccaguacucagggggcagaggcaggaggaucucugccagccugguuugcagugcaaguuccagagcagucagggcuguuacacagagaaacccuguuccaaaacaccagaaaacaagagaaggaaagagggaaagaaaagaggaagaggaagaagaggaggaagaggaaaaggaagaggaggaagaggaggaagaggaaaaggaagaggaggaagaagaggaagaggaaaaggaagaggaggaagaggaggaagaggaggaagaggaaaaggaagaggaggaagaggaggaggaggaggagaaggaagaggaggaggaggaggaggaagaggaggaggaggcauaguccagcugcccaaggccugccagcccugucaccuguuuuggaccugaagucuauauaguuugggccucauucccagcccuguuugaaggcauuugggguuugaaucucuccacagugaguggacucgagagcuaugcuuccuucucacccaaacccauucuauuuagaacacugucuguuucuaauagugucuggugaauucccagauagcuauuuuuauuuauauagaguccacaggcaugcauuauuguauucuuaauauuucacauuagaaaagucaucaugggagcuggaucaaacugggagcuggauagcucuguggaucaaacacuugcugcacaagugugaagagcagaguugagagccccaacagucgcaugaggguaggcaugguggccagccuguaaccauagcacuccagagguggagacaaacuugcuagcuuagcuaggugccuggugaacucuggguuuagagauagaucaugcuucaguagcuaaaguggacagagguugagggagacacucuaugucaaucuuugaucgcuauacacacaucgugugcauguauacccauacaaaugugaacaugcauguacugugcacaugcacacacacacacacacacauacacaaaggucaucaugauaaaguggacagcugaggugagacaugacucugcacuugaaugaaugaaugcaugcacacauaaauggaugaaucgaaaauacuuuuagaagaaagaacaccaaaauugggaguuuaagaguguguuugcuucauuauccucugcagacugauucccccuccacuuccucccuacccaacucuucuuugcacccauuuuuccucccaccacccacacauccauucccuccucuucccaauaaucuuuccucuuuucuuuccaucuucuccucauccauccacccauccaacuaucuauccacucuuucucuccauucauccaugcaaacaccuaccuacauaucccucuaucagccuguauuguaaauaaauaccuccugagcauuacagcuaugauuagagaauggcugaaauuaaugaaugauccucugccuucagggaacccugaguguuuagucaaggcccagagagggaaagggcuuugccugagaucacacgguaagcugaggaaugaggugacugagggauaaagacgguccagguccaggcagagcagagcccacaggagcaggcugagucuggcuucuggcuaguagcgcccuacagucacugccugagaacugccucccggcucuccaggagggccuuaagggccugccucuugucucugcugcuuucauuuuuguuauucuuuuggaaggggaaggaggaagcggcugcugcuguccagcugcucuguuggaccacacaucccugcuuagaugugucagccucuuugugaagggugaaaugguuucugggccaacagccaagggccaaggaagcaucauugaauucucugucccuggagagcugggggaggagcagacugagccuggccacucaacucagucaagucaaacucauugaugauaugguauguccaguucucagggaucaaggacuugaacuuugcagggaaaccaauauccaugacacacucccuuugagggucaagguucugggucauauucuauuccucccagcuucugagccagacuuuccaaccuccacauuuuuccugcuccuggcuuaggguccugucacugacugugacuucccugggucugcucaagggggguuacacagacuuccagccaaagcaaugcucacagucuucacucaacuccacccaaaucuuccuccuccauccugccccccuggaguggugagacuuccagaagaacagccuguucuccaacaucuggaacugguuucuccagagagguucaagggcaaaccaggucccugauagaugcucugaaggucccgaguauagagauugcaggagguggagaggacccaguugggaggaauuccuugugguccuauagagaacagaacccagcauggacauaaauagggggcaagaggccuguccagggacuccagcuguguaccuaaaacuccagguauccaugaugcccuaaggacggcaaccuggagaaugcaggcagagcccuucggaugcaaccaaaacaagaaagcaugcaaaggaguuagucucuagcuauuucucucuguucucagauucccuggagcauucucaauuuggagagaauuguguacccucucugagucuccuuuucucaucugcacaaggaaugggaugcugguuggaugcucaggcaggagaagacggauggugcuacccgcucuguauugauggugcuacccgcucuguauugcuucucaauggagccuucaccaucagguguggaagacacuggggagggcaugcaaggucaccuuggagaaaccuugcaagaccucuaacuugucuucaggcccuacaaggugucugcucugucauggugucaacgaguguccccauauaggaagcaagagaaguccugggugaguguguauuguuaucauggguauggccaugacaaggacucgaaugccuuagcaucaugggagugacaaaagcuucuccaggugaaucucagagggauggcaaagccucccucaggaagaucagagugucacuguugauagugugcgcagaaaacuguagcuuacucuccccuaguuggucgcagccugaagacugcuccccuacaagaauauuaacuaagccugccuccugcucagcuguguauaauaacccuggcuccuaguucagcuguauguaauaagcugcucuccuuguuuaucuguaugcaaugacucugccucucugcucaacuguagauaauaaacaugcugaguuuccaggacacugcugcuucuccauuagagagcuaagccauugaaucccagcuuuucuguaucugcauggacacauguaccaaucauuucuuaauuucuugacugcugcacuuagaucacaucuagggagcuaugcagagcacggcauccauucucucuguuuucugguuucucauuuauugauggguagugauuuagaccugggugggucuccuucacgaaggaacccugggaucugccaacaugccucucuaaugcuaagccauuguggggauggacauguauauagugaaugagaaauagacuuucuggcagaugcaggaugccuuaggggcaggcgaggcuucucugggcacccccagcacacucaggguuggccaggucaggaccuugaggcuccagggccccuucuggaauuuccugcauggcccuugagcucuuagcucugguucauucucauuguuucuaaacagcuuuaccuuaaaagaacuuucuuugcaaacacaguaaauccuugacuagauagagcaaaguccucuguagugugaagaaaccugugucucugccucaucuccaggcucagucuuagauaaagugggcagaucucugugccuguggggcucagaaacagguacccccaucuccugugggucugccucagucugccguguagccuuuacucuugcugcgugggacgacagguccaucugccugaaauguaucccuuuucacugacucuacaaacauauagcucaguguuuuauauaauuuggaagugggauuuugcauuauuguagaauuuuacuauggccagugccuauuuugcgucacaauacuaugcggaggguuuauggcaauguauaaaauugauauggucucugcuuuuaugggaguucuucauggcggaaauauauaaaaagucaauaaaacagcugcagacugggauucgggccaugaagaaaccagaaggaagggcacagaacacagcagggucccgggcaucugagcugagggugggaggcggaggugggaugagaaggugggaggacuugaggcugagcauugcagauggcaggagaggcuuggggaaaggccugaggcaguaguacugcaaaaggaccacagccuuagggagcugaauguaggucuaagagaccuagaaguaccugagaaagaaggaacagaagacgacccaggcucaaagucuggcucaagagccacagguucaaauucccuaugguccaaccaacucuaggcuguacgagacuagggccugaggggccucgggcagauuauggcaaugccuccuagcagugccuacucuuuggaaaccauggugauguucuuuguaaagcccagaagcaacacccacugcaggacucugauggcugggagcaggugaauuuagcaccuuugacuuuucucccuaaaacguauagaggcuaagggagcuggggagcuggcucagucaguaaagucuuugccacauaagcaugaggaccugaguucgauucccagaacccacccaggaguguacacuuguaaucagagugcuagggagguggagacaggcagguuccuggggcuggccagccagucuagccuacuuagugagccccaggccagggagagacagucucaagaguuaggugguuccgagaagggaguccucucaccuccauacacccgagcacacaccugcauaccccaccacauaacauaguuggagucugaccugaaccucguucauucauuuacgcaucugucaaugguugaccuacaccuuguacggaguucugucgggcacugggauaauggaggcagaugaagccccuggcucucaggaacuuguuuccucaaaagucagggaaggaaaaaaaaaaaguaaaaauaagcaaaccauggacuccaaacucaaguguuugagaagcccucacuauugaaucagagcucugagauuuugauuucccaaugagguuuuuuuuuuauuauuauucauuuuuuccucgugccuuggcccuucuuuuggucagacuacacacacacacacacacacacacacacacacacacacacacugcacacugucgaaggcuacagaaagcccacccacacaggcacauccaaacacacauacuucucuaaucuccccagauccucuaaaggcuggggggugggggccuguugacuuuccacuucagcauuagugcaaaagucaggcugggaaucuggggagcagugaucggccugaccucccuccaaaccccuccucugggcuaguccugggguccccucaucuccacaccuggcuuucccagcugcugagagguacauggguguguugagcaaacauccuugcaacuuccugcugcuccccucugagacaacagaaccccccucucccugcucccccucuuccuccuucccacaccucccagcugggguuucucuggaauccugagucaguucccuggagagaaaccagagauaucccuuucuucuggccagaggagagagauaagacacgcacagacccucucucuuucuguucuuccaugccaguuaucugaguccagacucuuuauugcacgcacagggcugaaaggaccauagggugcugcaagagagcugaagaacagucacuugggagcugugggaggacagagaggcuggaggagaagcccugcaccucuggggagaaggaccacuguucuguucuaagggggccucuaaaguugcauaggacucaucucaauaauaggaagaaggccucagagguaggccagcacugguuaccugcaggcugccugcuagacucccuggguucugucuucucaguuacagccaggagaaacuggcuuucccuuuuugguuuuagugcagugggggugggguggggcacauggaguccccauguagcuuuaauggcccacauuagggauuuuuaaggacacugaagacacaaauuuccaucuuccaaguagacacauccuuccuauccugaagacccagggaaggaacaggacucacucaaagucacccagcaacucccagcugagcguuuugucuccuucauucagugcauggaagaagucaggucucuuccuuggcaggccuuaaucuacaucaucuuuauguuaauuaauuaauuaauuaauuaauuaauuuugggggguuuuucaagacaggguuucucuguguaacccuggcuguccuggaacucacucuguagaccaggcuagccucgaacuuagaaaucccccugccucugccuccccagugcugggauuaaaagugugugcuaccaccaccuggcuauguuaaucuucuaaccaaguccuuacaauaaugcuacagggaaagaugcucucccauuacagauaagggaaucaaagcccugaagagcauaagucuaugugaacagcuccauuagcugguggcagaagcagaggcagauguagaauuuccauguucuagccaggagaggagcccucuccuccuggaaaccucuucgccaugacuauccaacccugguccagaugagggcuguggccccagcuggccauucccuucuggugucccacugcgcaucaggaauucuuuccugcacuggagcaaggccagaagagcagcuacagagcagagcaggcugcagcguucauugagaagaaagcccagcucagucgguccccagcugcacugucccuggagccugggccccaacaaaccucuuucccucugagcagaaucuuuuaccugcuccaagagggcuauguggucccucaggaagcuguuguuuuacuccugggaagcaucuagaaccauccuuaggaagcacuggcccgguuucccuccauuuuacagaucagguaauggaggccugagggggaaagagagacacgcauggcccaggcucacaagggaaacagaggcaggaugaggguguugccacuucuccuaagacuaagcaucucuccuaguuccuuccaucugauguagaagacuaagacuugaacaaccucccucagacagcaaggccgggacaugcugcuugagaaugccugggagaucugucaccccaugacucccuaacugauggagacgcgaaaucaagcugagcaggacacucaaugacaucuaaggccuuugucugcuuaaguuuuguuagagcaagagguagagacaaacagguggggagccauguguuuggucucuggugugugugggguggaggggugugcaaauguggcucauuccaugguggggguggguucccagaagauucuccaaacagcccacguuucuucaggaugagccccugaauccugcccccccccccccccaccgcgugugcgugugcgugugcguguguguguguguguguguguguguaucugucugucagccaugcuccuccuccaucaagucuuagggcugagcccgagugaaagagagugaaaggaaauaagagagagccacguuuccuuagaaaagaaggggaaaggagugagaaggaggauaacuucacagcuaggagcagucaugaagccacagggagagacaaaguuagcagaaccacagggaacuuagggacaagaaguacaguggccaagagacugauaggaaaaaaaaagggucuucugagacgucacccggugcuucccugucccaccacccccuacugccuucccgggagggaggccagagcaggguucuucaguuucugggucuggcucuguaucugggucugccucugacccccuagaagcuucgggcgucuggccugggaaagcaccccugugcgcccccaggcggagauacagccccagagccaccgaggcccuaaagagggcgcaggaaagagcuccucuacuuugcgcccagucugguuccagaaccuugggguggguggagggcggauggaagacuauggcugacuaugccgcgcgcgggcugugggguuuggggugaggauuggugucucguuaguucaugucgagauucagaggccccuuacgccuccuuguccccuuccucuagaagccagaggccaacguguucuuggauugaguccccaggagugguguggggcgagagcugcgagccuacucucuaggcuccuggucuaagaggggcguccaaggaacuaguugccccaucuuaaaacccuagcacguguccauccaagggacccugugcugaacccccuccuuggcucuugcgggucuuugcaggguuccaggcgcucugcggagaggggugagaguugugugcaaaggggaaccgagacccuuucguucuuaccgcauuguugaggaaauccgacucauucaggucucccaaguccaggaagcuggaucccgggaacagccugucggccgggaaagguuccaagacggcguccaucgcgccggguuccaggggaccccuucgggcugcgcuuuccucacuccagggcggcggcgaaccccgcaccgggcugcggcugggcgcgggcaggcggcccggggggcagguccgggcgagccccgggggaggagcgguggggguggcgcgggucgggggcgcuggggggccuuagggcagcggcgccgaaagcaccgugggcuuucagccgacuccuccuccugcuccucccggggcgcagcuggcuuccauggggagcccggggguggggccgaugcuggaggagccccccaggccgggcgggagccaggggcgggggagcucaaugcucccccgaggauggguggcugccgagucgcagagaucucucugggucucuuccucugcgcggcuucugucacuu

SEQ ID NO: 925 - RNA, 4383 nt, Mus musculus
aacauaauaauaauaaccagcccgauagaccucugcuccugugcucagugcucuuaaggacaauaaugacaacagucauaauagccacaguuuauuaagcgcuuacucuuccaucgcaguguuaagcgcuuugcaggcaacaacccucggagguaaguaccguuaugcucccuauuuuucaggaaacuagggcagagagguuaaguaaccugccccagggcacacaacuagcugaugucaaugccagaaucccaaccuaggcugccuguucuaguguaauccucgagccaauccgucaaggucgggagcauucucuccaucuuaaagaugaggaaaacaaggcacauggaaauuuaaguaccuugcccaaggucaccuagcuggaugaggcagaaagcgaacccagggcuccucucuguccgcagaacccucgaucuuggccauaggcgaugccauuuccaaaccaccucggauagccccggcuucugggaggcaaaagcagccgcugguggauuuggguagauuccugcagcuuccgcucagcugaugaaccggguguuuuggagcagcguccuugcucugccuucaagcguaggauggggacgccucuccuggaauccagacccagacuaggcucggcgaucccgagaagggacggagcgggggcggaggcagcggaaggaaucccgagucccauuugaccagcggcgggucuaggcuccggauuugcaccauauaaccagcagagggcgcugccgcucgcgcauggaguuuccguccccucugccuacagccgccugcaguggcuuuccuucuccaggugacugagcccacgccgcauuuagaccggcuucuuuagaccgauugacauucguucaaggcuucccaagucccagccgcuucgaucuuguuuuguauaagggggcaacggcagagauuccacucgguuaaaaggccuagguguuugcaaauucagcucggucuggucaggucuucccuucuagugagcccgagggugauuuaaaauggagguagacccuccacuugaaguagauuacaaauauucuuuccuuuuccaaaauggcagaugaugacuaaagagagagcccacagacgagagggucuauuuucauaacagccgccgccuauuggucgcaccaggcccuuuuuagaccuugauacaguauggccuguaccguggggaucaugauuccuguuugauguaaagucaaaaaacuaguaaauaaugacaccuggauuuaaucuaggaacucccuuaauuaacaguuacauucccaauacccagaaugcacaagcagacacaacugauuggaagauauugguuauaaucccaaaucuaccggugcuuagaacccuaccauggaaucggggacuuggccagcuuucugagcuccccccccccaccccgaacucaaaucucuaaaacagaaaaauaaaauauaaagguggccugagagcaugagcuggaggcuuuuugcucaggcuuggaagaauauccagugaggcucagucacuuccuaugucugggcucugaagacauaaagguggaucuaggaaaaucugaaacgcauggaagggaaggggaaaacucuuucuguggcuuuuacuuuaaacuaagccucauuuugcuauuugugcuauauuuuuaaauuaacguggcucuccccacccuugaaauuggcacacaaauagcaaaaacagaaggaaggccagcucgcagcuuuaaaugugguucucaagaaggagggaccggacuuaaaaaggaaaugggaauuaaaaugaggugucuaauucagacagacuuuccacgaggaauuuagaucacggcucuuguaacaggaguguugucuggggcuggggcugggucugggucuugugucuaaaugggagugcccccaaugaagagguugaaucuuccuuuuugaauacgccugcaucucugaucaucuggguguaagauucaggggugggguggggcccugcccccuggaucugucucucagucgucuuacuuuuccagaaguuuguuuggaaauucaauccaggugugaccgucaauaaucacaaccuuaggcgugguuaaguagaaggacuccuugacuauagcauuagcagcugguggcuuuuccagacagggaagccagugaacagaucucaggagacuugucaccuaauagcugucucuguugcacugucuuugagccagaagaauuagcccucuucacucaacacaagagaacucaggcuguccucggcugccuccugcaaaauagugggccucuuuguccuucuggguaacgccuuuccuucugucagagcauucaguccacaaacaugugacgacaacccgaaacauacaucagcuaucgauauagcagagaccccaacgugagcccaaggcgcaugguuucaacuuuccugccgcgcuccaugauauuaauaacuuucuucuccagcuggcuccuaacucccauuccuuuggcucauaaaagcacugcuacccagaccgaaacagaucgggccauauuuaugaagcacgacuuacaaugaaaaucccaaacugacacaguacuccgcugcugacaggaaaaugcuacuuuaaacagcauugacugcugggacacgcuuccuaaauucauuuuuaaaaaauaugcaucuuagaauuaagugagucacaauaaucaggggaagaaagaagacaggguuuuuguuaacucucaagauuguucaaucaaaacagacuuucaccauccacacccuaaaaaagacagaauauguaagguaaaaugccagguccccccccccccacuuuucuggaaaauccauuaacauugaaugaucuuggccuugaccuauuuuaaaaaaugaaaagaauugaagguaagaaugagacugucucugaaaacggguggauuccuaaucugugcugggauuggcagccagagaugugcacgcgccagcgaugcuccugagcuacuacauccccagaccucugaguguucuuaaaauuccacccccgagacugccccaacccuucuagaugaacaccauuuccuucccuuugaggaaggcagcggaacuagaccuggaagagugagggagaagcgaaaaacaaauuuuucugcagcucacacaugcuauagccagucgagucaaggacacuauauaugggcgccgccuaggugugaaugugcgguccugcauucuguuugaggcccaaaucuccagcacacugcgguaugcccuaagaccgauauaucguccuacagagauguuuccauccagagggccuccucccuagcucagggucuucugcauguucagcugcucgggguacagagcuggaaacucucccggugcauuccugcugggagcucgccaagcccauuggggaaacgucugcaacgcuuagucuggggaaaugaguuuugcacuuucacagagugugaaauuccucaggggcauucuuguacucggaaagagaaaucaaacccagcucuuuccuucaggguccuugcgguuaagaaaguaagucgaauacagaucagucuguggccagcggugcauggggacaggagcaacagagcuaucuggcucacaagcuugagauuuuaggagcuuguguugcaggcggguagacauagggaggggcaaccaaugcgccuaaaccaccaagaaggagcucaaaacugcgcuaucuuccuagaaaccuuggcggcgcggcccgcugcuugcugucugaugcaacaguuugcaacgcgguucugggaguggaggccuguggugcggcacucgggccgcugacgcgcaugcgccggcuguguccugccccgccccgcggcgggaaucuuuucaccagaugugcggggcggggauggaggcggggccggaggcgcgaagaccuuuuggcagaucgcgcuugcgaucugagccgaauuagaguucuucgcaggcauuggcugacugacccagugauccaaaaaaaaucaccccaaaggagccuggagagagaaguuaaagagcuagcuggcuuuugagucgaccucccuucccgagccuccggauuucugcugcugucccaccuauccugcccugaacauuuucuuugcaggagggaacaugucacaucaauauguucugccuuucagaugucugacgauccagaugaagacgauugucuuccauauacacauuccuccgguauuauagauuguaacugacuucuauuuuauuaacuguuucucuaaauuaacuuuaaaucgauucucuuuuuauguacccuugccucaagagauaacauuagagaaaccauagccugaaaauaagcucagaacuauucaaauaaaaauguuuguuguuguu

SEQ ID NO: 926 - RNA, 1846 nt, Mus musculus
uagggugguuuugcaccauggcacggggagggcuaaaggccuuggggacggcuacccagggugguccugugcccacuaccugcacccuccuggcucugggacuccauuccuaaggggaggaacggaugacucucaaagaauuggcaaacacaccgcggaaguuuaggaagcugaggguaguggggaugggauaggaauguccggcccagagguuagggacaccugcucaguucgacgacaggaggcugggccugcuggggccaccuguagccugcaggcguccucccuggcccuuagcccuacccagaagcagacuggaagaugcgggcacugugcccuuuugaaggccaccuccccuccugcuggccaagagccuccuugccgcuggggcagggccaggcaucccccacucuugucuagaaagcugugauugugccgggcuccaaggccuggauuucuuccucccuuuucucuccacccuucagcgggccuccggcacgccuuuugcccuguaggggugcagggagcucuggacugugaaggagacccgccacggucgguucagcacagacugaaugccaagcccugagcuaaguguuugccaagucuuuacucagguaauccucacaucacccgaaggacacaagaugagauugucccugaagagugaaaggaaccuaccuauagccuuuggcuacuugcuaggcaggcagccuuucacugcuccuguaggcucccagcuguggcgggucuucuaccucaagaccugccccugcccuuccuccuggaauguaguuuucucuacaucucuuacuuauuuucccagguccucaagggaaguugaaguugccuguuuguucugggagguagcccccaccucccacaccuccacgcacauuccaggcauucaauguguguauggaaacugggugagaacuuggaccugcccuuuaagguaagggccucaccagcagcucaagcugggccuuuuagcgggaaaguccaguuguauaaagggaggcagauccaucaacaguagccuggggcuggcucccgugaucggaaugccuuucucugggagaugaggaucagccuguaggucuuuagcgguugcuauggaaaccgaaagccgccucuuggacuuuuaggaauuaagagaaaacccuggugugcagggcuuugagucccggugcuccauugucauccucagccugcugugcaguugggaucugggucagggguggaugagaguggcccucaacccagagcaaugguugugggaaucaaaaugugaaggagcacggagggucacaggcagagccuagaccaagguaauuucauaaagagaggugagcugguggagauacuaacucuguugaucccacuugggucacucauguggauccugucgaaacuucagcacugugggugggguagugagagggaagggcagaaaaaaucugcuggaccuucaagaagcccuuugggagucuuccaaggaaaggaaagcccaagugagccuaguccuuaggagcugagaucucccccucuccugccaaccauuugagccaguucuuugcuuugugaccuuggaccugucccgaacccucucuaggauucugccguccucaucugggccuguccaacuggucuuucuucuccccaugguuuaggacacaccgaaggugugaggauccagcacaauuuaucccgaggccuuugcagcccagccuugccacuagguccaggcaggaauccaaaagggaggggccuccugccugcccgccaagccugcgcacaccucugcucuuugucucuggagccuaaucagccuccagaucuagaa

SEQ ID NO: 927 - RNA, 30429 nt, Mus musculus
caacggggcggucgggcggagcggcagaccgagacccaguccaggcggcgauggcggcggcugcugugguggcagcgacgguccccgcgcaaucgaugggcgcggacggcgcguccucggugcacugguuccgcaaaggacuacggcuccacgacaaccccgcgcugcuagcugccgugcgcggggcgcgcugugugcgcugcgucuacauccucgacccgugguucgcggccuccucgucugugggcaucaaccgauggaggugaggggacccuaugcugcgggguggcaacaccaagcggacuccccugggcccaggaacuccagccugcggccacucugacacagcguuuuugcccaguguggcccgcucugaacuccugggaggccugggggacagaggucccucuaugcugacgagacucucgucaaaaacgcgaagucaaccugagggaggaucugcagccagucccuggaagaauggggacugggcuuuuaggggugugcugugggagcggagaaaagcuucuucaagagaaguagccccucguggaccccccccccccaagggcuucccuaagccucggauuuguuugacucucccccacgccucuuuucccaucccgcguaaccucucuucacagacaaacgugguggugaucagggaaccuagcuuagcauuagccgguuuuaaaaagaccccaagggcaucaucggguaauggcacuuuuguguucuugacgcauuuuuuuuaaaaaacauugauugggaaaggacaugcauggcauggcaguguauagaguuaaaaggacgacuugcagguucucacucaccauacgguuccaggguggaaagccgggugccuuuacccaaugagcaaucucucaggagguccccuaacccaucugagaggaucccuguguaguuauaacguugcuagaaagauauucaaagaggguugcaucacccgucagcucuuccgccuguugucaugaaguguuuuuuaggagagcugggccauuacagaugagacuuuuaggagcugauguggaaaaacaagaacacaauaugaagauucggugauaacucccaggaggcugaacccuuucccagcaugcugugacauaauaaaucggcaucugauguauuuucucuguaaccagucuucagaaacaagacguuuugauacaccauguucccaucacugucuaaaggccucccugcaguagcuugguuuguuugcauuguuaugagagguguuugcuuauggccuuguugcacagaugagugagguaguucccaggagaccguggcucucagcguccacucuuuccucuccaagagggguuugcccugcuaggagagcaaguguuccuaguagcacgccuacuaaaugccccuuccugccccauuuacacagagggagcaacuaaagauaguccugugaagagccagcccacacaguuuucagauugggcuauuacucugucucgcuccaguuuccauagauaggagguuggguuugacaaacaccggcaaaugaccaucucugcuguggacauuaaaccaggccucagacuuugcccuccccuuccuuuuggcagugcgccaguguggacagagucaauagaaucugacucuuauuuguuauguugucaugaagauguuucguuuuuuacugggauuuggggggagcgcuaucuaugacugccuacuccuuugugguaguggaaauaaaagagccuuuuuucccccuucacaagguagauugaacuccaguaugcuugguuuuaugguuuuuugauuuuugugggucacccuuuuguagcggcacuuucgagagaaugaagcagaaaacgacugaggcagcucagaugcuugggcaacaucucaaguccugugggagugcagguacugagaaugggauuccaggaguuguagcugguaggcugcugccgagcauggcagugaaccgucgggccucggugagcucccacagccuccagagaccugcaucugaguagagaaagacaagcauaaauggaggccuaaaugccgugagcagaaugggguggggguggagguggggagacacaaacuacagaugugcuuuuaauauuugccucacguuggaaucacuuaaggacccuugaaagcuuccugggcuccccucccccguuucugcuucucugauucaguugccuugcccuacccuaggcugccuugguuuuuuggccacugcagccaagcuucagaagugcugcacuaaggaacuauagcaagccaggcaacccagggaguguguugcuucagugcauugaccagaagucuaauuagcuuuggcauuuaggaggacaaggugaaauaacaaaaaaacagaucgaauaugguagcugcuucugagcccggcaucaggcacacuccagcagccucgccguuguccuugcccccagugguuugagugcggggcuaaaugccauuugugcacaggguuggaggugaggaguuggaggcgaggaguccacccaucccaccccaccugccccccucagcugcauuucugcauaacuacaguauguguaaucuuccggcacugcuucugagcuugggaguagucuuaagagaauggugcugcugcagcaugacggcccugcccccuacugcuucagcaaccgacucucucuagaaggguggggcccaucuggcagcagagggagaucugauucugucaccucuguuacacugacugccucccugcagauggaauccgauuaaaauagccacaguguuaaagagaaaggcaaccaggaaaaaaugugcgugugugugugugugugugugugugugugugugugugcgugcgugcgugcgugcgugcgugcgcgugcgcgugugcgcgcgagugugcgugugcaugugcauguaggcauagaagcaggcugucauacccauugccuuagugauaauaggaagucuauggaccacuuccagcucuguggcucccaagaauguuuuccuaguaucuuucgccauuuuccucuguccuuccuuccccaaauuugcuguaucuggaaaggaggggcugcaggcaagaucaaaacaaaaggcagcugugaauggcuucuagauuuuaaaaaugggucaggcucgauccaguauuaauuuccuucucucugucacagcuuagaugucagccagaauucuccuccuacucuguugaaaucauuuggucucuggcucugugcuguaucuuuuuuuuuuuaggaacuuccagaacagagggaguuaguagaagugucuucuuucuuagccauuucucucagaaguuagccagugauacaggauggggacucuugucaucuaguaguugaaugcagcugggcagcugcaccaucaaagaggguggccugggaacuuggucaacgaggaggugggaucaguaguugcuaguagagagauuuguguuccuugagcuguucacacuguaacucuagcaagaggcuucacuguucuguaagccaagagcacauuuccauuugcccaagagggguagaaaacuuugaucgagcuguuuaaaauuaagcacucugcaaaagaaaaaaauaaaaucuauguuucuauuugaaugagauuuaggaaccauuagauuauuccuuuugguggggccuaaacucuuaauuucuugggagugaauuucugucuauuaauauccuguuaccagucugccaguuuauaauauuguugugguuagauaagcuugcuugaagcacaagaauuuggucaaggacgucugaaccugaagacuucacuacccuacccacccacuccuacccuccacuccauuaacagauaaaucaaguguuucucaacacagccacuucuguccccccaaaagaucucucugaguggaaguauggaacucacuuguucugaagggaucgccuccuagaguugcuggaugacaguuuucccuguauuuuuggaaaucccaauuugguuuucuccaguucugucuccccuggcuccagggaacuuacguaauucuggagcaaggacuauucaaaagguggagcucuggccgcacccuuagggucugugacugcucccucagggggugugcucugcacuguggcccugugaucuccccuuggagcaagcgugacgaucagccccgacgccaacccuuccagugcucaccuguuuuccuuugcguuccccccuccuuaaguaaagagaagugagcaggggcagaggagggcucgaagggagcacagagggaaaggccaguucucccuggcuaagacagccuaggccugucuggugggcacucuccaggagcagcuagcuccaguucuuucggugcuuugcagagcagcagauacaaaaggugaugucauggcaguggccucccugucuguggcugccugggggcuggaaacuacucagggaucucccugucuccuuccuauugccuccugggaagcuguucuggguccauccuggggaccaugguggaaguagcucagcauugcccuuucgugguggugguuggagcuugagaugguuucacuguaguuugucuguccugaaacucacgcuauagaccaugcuggcucauagagauccgccugccucugccucccaagggcugggauuaaaggcaagggccacuaccaccccacuaguuaaaaguuucuuagggguugagguagaacccaguaaaagcaaaguugaaacaaaaauguacagaguaccaauauugaggucaaguugaagugcaugccacaguggaacuucuugaguuuuuaugaacaagugaauucccaggaaaauucugaucguauuagucugggauggggcccaagaguguauguguguucuagcaaguuccuggucaugcagagcuagggcuccucacacuacaauuuggggaguaaagaucugcagaaaagauguuagccuuuaauugagcucagguacucuaauugcugaccccuaggcaguaucacccaccucaaguguguguagcucagagcagugaguauacgcacugcugaggcccagagccugguagcugagagugaacgcugagcuguaguauuccagggcuccuaguucuguccaguuacuagguauauuauguuggagaauauacuuaaucuuugaaugucaguuucuucacccauaaaauggggacauccagggacaggguugucugauaauuaaauaauacaugcaaaacaagugggacagagccacacucagggagugcuuaguaaaugucgcuauugccauugugaauugcagcauuguuuuguugcuagcuauagacuuugccuucugcuuccugucagagaagacaaggguauucaucuaugcuggagagaugcugccggaagcucuccguuuaggaaacaaguucuaaaaauaaagguguauagaaaacagauugcaacauacucuagaaucuauacuuccugugcauuucagccuuaauagcugcagauugacguucucugagguguggugaguugugaagauaaagacccuuaaaguguauggcugggacauauuagcaucuucugaugggaagaagcucugcccugagguguggccuugugccuagcagagcuccuguuucagguggcuggggcuaucugcucccccgagucuccuuuauuuuuauuuuguguguguguuagggaugagcagcaaggugcuucucccacccccaagaccaauuuaagcaggcuugcaaauccaaauuuaagugggcuuaacauucaaagggugucagguuuucuaaaucagaaauuucacugcaggagaacuugaggagcccucaaagcaaccuuuaggcugucagccuccugucucaaccccuuggguacgccuucgugcucuuuagcucagugcugcucugggcugggcuucugcuggaaugugggucuacagcauuggacuugggauuaugucauuuuauguacgucagaggcagcaggcggggccugguucugauuggcacccucaaggcuucuguaaaccuccaguagucagggaauguagcucagggaucgacagcagguucuguggagggagccuggcauaagaagcuuggccuguucaggcuuggcuccugaggaggaagauaggcguguggauagacugucugggugaggcuuguguuccaggcucaggagacucucagcccuugacugaaguguuuagaauggaccacugaaaacaaacaaggcuuuaagagucuggucugccugggccacuaugcuagcucagucaccuaacagcugucugcuuugguaaauucccuaaccucucuugucaguuucuuugucugcaaaaugggaauaguucaguuuccuucaaaauguguugagggagucaaauuaugaaaguacuuaugaauuagaauagaugacugugguugacuagggaaggcaagggaugauauuuuacucaguacccacuugucacugggauuuugaacacaucagaagauaaacaagaauaccguacuugaggcucaagggacugugggucacgagaggcauggaaauugaacuaccaaacaaaccuucagaggccacccagccugugguuguggcuuuaguauuuaacagacauauaaacagcaccaagagcagcucgcagugaucaugggaguucugugccuaggguuuuccuugcacucugauuuuauuucuuagcgauuucaugagguaacaucuuagcaagucuaagguucuacucucaauuccauggcauggagagaaagcaaguaaagagguuaggucacugccuccgaucacagcuagugaguguguucaccccaucccucccgggcggagcucaggcuaggccuccagcccugcgcacaccauaccaacuuguuuagcaugaacagugacuuuguuaagaaagugugugugugugugugugugugugugugugugugugugugagagagagagagagagagagagagagagagagagagagagagagagaacccaugcuaauaaugaggucuuuguggaaucugcagguuccuacugcaaucucuggaagaucuggacacaagcuuaagaaagcugaauucgcgucuguuuguaguccggggacagccagcugauguguucccaaggcuguucaaggugagcauggagggcugagagggggcgucugcugcuuagcaucugccugcccacagagugaaaugcuguucuggcuggcaaaauggaaauacuggcuccugucuggccacuaaaauggcugcuagggaggucagaagcagagacagcugguaaauuugccagcaggguggaaacugaagggaaaaaauucuguaaaauuaguguugugcuggaaauaucccagcucagcccagacacgcagagcgugaguccuuccacccugcugccgcuggcuuccucaugguuccuuggcucaagccaguauguuuuacuagagcuuguuccugccaagacuuugagggugggguuuccugucuaacaaggggugcugaccaccucaucuugcucugcuuauuagggaaaaagucagucaggcauuugagggagccaucccuguuucccugugguaagcaaugaauaaaaucuucauucugggaccauacuggaggcaagcccauuuccucaagcuucuuuaaaaugcauguuuuaaggcccaagcagagacaaaaguucucauggauagaacauucuagaccauucuccuucauccucaguagcacuccaaguacuauaugaaaaauuuaagaaaauagcuucauugugugcguccccccauaauucuucacacaccuaugaacacuagucauuagcauucuccuagggcugacugagucguguuccaacugcuaccaugugcuaacacucacccccaacagccccgagggguggguucugcugucccagguuuacagguaaggacgcuaucuugggcucucugacauagagcuguguguuuccuugguauacccuguacaugcauuuguuagucuguggcuguggcuuagcaguagcacacuugccuaguaugcaugagacccuggucccauccccagcacaguaaaaccaaaacaaugguaauagaaaagauuuugucuuuccugucccuccacauugcuccucucucccaggagcucagaggccaaauggucuguagcucagaacuauagauaccuucgcuguucacugagucgcucaucguguauucacugagccuucacuagcaucaggccccauacuggcugauagggugauaucgaugcuugugcaacccagcgugauuucuacccugcguucacacagugauggcaaaacaggucagugaugggcaacuucacugccuaugaugagugcugucauagaaacaggacaaggcacaggagaaucacccucacggaguggggccugucauuuaaugagaaucuucuuauucacaggguuauaugaguaugcaaugacgucaccucuguaaaccacucagcauaguaagggauaaauaaauauguagugcacugggacuuagaugagcuggauauccacccugcucagaacucacuccccugggcaggccugaauuaggauagugaccagugguccaaagcuguaagggacuuugaccacagacugguuagauugcuuccuucuugcuaguuacaugcuauagggcuuucuauggcuugucuagauagcuuucaccauguccgcuuuccccugguguugcuaggagaccaaagugacugaaagcucaggaaaaaaaaaauuccccuuuucacaaccuguagccccuccaguuuguuuucucuggacucaggauagcuccuccuucuccagcucugagagccauuagcucuguuugcuucuggccuagggaguguugcuguggaaaccauuaagacacuuuacauagcacaagucugccaggaaaacuaggccacaaguuuguagagucugaggaggccugggaaaggcuacagagcaggcuggagugugugugugugucccccauuuccacugugagucaguggcucucugagcugggggcuccccugggaacauuguauuuauagccucauucccccacuucaaggccacagugaacacuggcccuuucuguugacuccaccaccgcagugcgcuuggccucccgguccuggcugacaacuccacacuugcagagcuccggcucuuugcuuucugauuuaaacuauuguccaggcccuuucuuuguucuguagcuauucuagcacagcucaaggucagcccugcucacucccagagagaagcugaguacccaggccccucuucuugaaccaagcauaacagauuaucucuaugcaggaauggggggugacccguuugaccuuugaauaugacucugaacccuuugggaaagaacgggaugcagccauuaugaagauggccaaggaggcuggcguggagguggugacugagaacucucacacccucuaugaccuagacagguaagacacgggggcucucgguaagguugcccauggugaggacuggggacuggggcuccuccuaaguggaauuuggaccaguucagcaagagggcuaacugaacuggacaauaaugggccagaguugggggcuuaaagaagucaccaagagguuaacccgauuuggauaacaaaagaggcuugguuagaccuaagcugugaaagcagggaggcucugucuccacacagucuucauagaucugucauuggcucauugaguuucaugcuccccccccuccucuguugugcucccuaacuacagaacccuaaccuuggcagaccccaucagacuccucccagcaggccucuguucucucagaccuaguuuccacucaaggaugaucccgggucugcuuggccuaucuggguuucagggccaugcauucugauaauguuugagggcucuagagaccccugcggggugcuggcaaccacagcagaaccuccuuccccaggggccagccucugugcuuuugucuccccuucccuacuagagaugccacccucuguagcugcuacugcucccugcccuccucccaacccagggcuggcugccaggaggcugggucacacagcugugcacgugagccaagcccucaggaggagaggcuugcuguggagcccuuccccugccacgugccaggggagggcagggacugcagaggcagcagccagcuccuaucugggcuaaugggggcagcacagggagaacaaacugggaaaugaacucacccggacaggcaggccuugcauaagcuccuucucggccagcgagagccuaggaaucugccuacagaccaucgaaauuuauccucacagacgcagugaacccuccucuccagugcccaugccuuuccuucuugcuugugagaagugcuuggcacacugcaacacucuuuauacuguugcuguuuaccguagccccagacucugacugagggagcauuagccggccuucacaucucugcucuagugaacagggcuaacaggacauugauccuccaagaaaggagcauguuaugucccucacuguauaucccucggaggcucgaaaugggguagagagaagcccuugguguggucagauaggugcccagaggcccauggggauuuucugucugauuagagagauacggucagucucugucucuaggcggcuccacguggacaccagggaaccuggaauugagucccagcucuggcccugccuugcuccauuaccugaggcuccuguuccagcucucugggcuucauuuucccucucgguaaaauggagauacagccuccccugugccccccuuucuccucagggacgggaccgugaggugaugaggagagcaacccucagagcuucuugugucuugcgcucuuuuuuugggguggccagggaccccaaaauaaagaaucucaggagugacuucagaugugcuuugggcuccccagaaucaucgaacugaaugggcagaaaccaccccuuaccuacaagcgcuuucaggcccucaucagccgcauggagcugcccaagaagcccgcgguggcugugagcagccagcagauggagagcugcagagcugagauccaggagaaccaugacgacaccuauggcgugccuucccuggaggagcugggugagugcccuacagcacaccacacaggccgcugcuuccugugggggacguggccuuccuguuuccuugucaaaguuagaaaauacuggcuuaguggcucaugccugcaauccuugaaacugagagacagaggcaggagaaauaggccagccuggacuacaugagaccuugucuuaaaaaggaaaagaaaaacagaaaagguugcuguuauccaccauaugaccaguuaguuaacuaccugugcccggccaggcugcugcuguuuguagcugaagccucuuucuguaguucccucucuccaucaguagaggcacugucuggugcuggucaguggacuuccucacuaggauaacuaauccaggcuuuagguacccagcccaccuuccugccucccuccuccugcccacaccaucuucugaucugaauaaagcuaaccuucugcacuuuaaggguuuucucaguccucacagcaccaaguccaaggucuguaguuccguuuaaagagcagaucagucugaaucguggaaauuaccauuuuuauauuugugaaucaucuuaaagguguuuacugagcuguuucuggggugaccugaccugcagugcuacugccuacuguuccuuuuguaggauuccccacggaaggacuuggcccagcuguuuggcaaggaggagagacagaagcucuggcccgccuggacaagcacuuggaacggaagguauggcccuguuucugagccaugggacugacuacagucaggaccacagggaugugggucagcuucaugucugagggguugaaaacuaaaaacucuuccugauggcaagauuaacagcagcucccaguuggaaaguccacccugugcuggccgcuggcuuaugugccugauugcauuaucucccuucgucuguccagcaggcagcuauuaggcuccccaucugacagauuacaagccugggcugagagagguugaguaaccugccugaggucacaccauugguuagcaguguagggaggugcaguuccacaugaucacacaguuggcaccagucugacuuucuucuguggacagcuuuugcuuauggaaagggcagccaaccaggcuugaugcaugccuguagucccagcauugaagagggaugaggcagaaggauugcuuuaaguuccaggccagagugggcuacagggugagacugucugucucaaaagaagcaauaacacuguugaguugguaaaacccaucaggucaguuauugggugucagguggccccuccucaucucuuuuggcuucauuucccauuugcuuagauccagauagcaaauggccuaccuucugugcagugggaaucagcaagagggagaggccaaggcccagagguuccacagcauccgugguccuuaccccccuaugaccagagaaggagugcagguuccacggacuugaggacuccugcuuccaaacucccugacccugcagucucucuguagucugucccucaaaagcacagccuuuucuguccccaugcaagugacaaggucuuuugccagcagcuagguacuagcaauggaucaagggcccaaggcagccugcuaaagaagaaugcuuucccagccucaggaguggccagccagcauuggaggauauggugacagccucagccucccucagcucaguagacuuaauauucccauucagauauuucucucagcugaagauaaaacaaguuccuccaaugaaagaugaggcugagagucaaaagcuaugagggacuagcuuuguguguccacaucaagagcuauaugagggagugcuucauguguccaucaagggcucugcacagggcuggguuauagcuuguugguagacuguucuccagccaugcucaaaaccaucaguccaucuuagcaccagaugaaaggaaaaaacaaagcaucauacccagugauucaaaggcucuuuggagagagauguuuggucagagcagggauggagcugacaaaggcagugauaggaggagcaggauucacgagagacagagcuacaccaauucucauuuuuguuaucuuaacaauauuuguaaaggacugccccccaaaccaccaaaccaggagcccauuuuccacacaccccuggaugccacccuauccuccacucacuggggaaaaccagagguuugggguugaaaaaauuaaccuucuuugguucuucaaaccugaagggagcagcaguuuauaucaucaagauguuguaggagcuagaaagacugaugguuaggacagacaugcggaagcacauuguguucaguuagaaagccuaaggguuaggaaagccgcaggucaggcuugcaggagcagagagcaucaggauuaauuaucaaucaaguguugcacuuuagcugcccuuugaaagggagaguuuuuaaaaccaauguaaccaggaaucuaagguguagccuuuggguguagcagcauccaggugucccaagagugguaaagcagguacccuccauucccuggcuuugcuguccucugugaguccauccucaagugggcuucccuuagcaguggugaagguggucggcauagccuaccugucuucugucuguauagcucaccagaggaaggggcuugcuugccucuuuuucaaaagcaucaguaaaaguccaaagaaauauuuucauuggcuuggcuuggguccugugcccuuccauggcuuagucacuguggcuagggauggacuguuuuccaugacuacauucacauccugagccacuccuggggucagaaaguaggcauggaucugucuugcccacuagaacugagaguagagaaggugccccauuaaaacaccaaaaggggcggggagggggcagauuauaugcccuuuaccucucugggguccuguauugacauuccuuuuuuuuuuuuucucaagauuucucuguuuauucccaccuguccuggaacccacucuguagauucuguaugucuguuuugcuaacauauauguauaugcaucacauguguaccuggaguccacagaauccagaagaaaguguuagaucccccugaacuggagcuacagacagcuuuaaguaccauguagguucugucugaugaaagaguagcaagcaagcauuuuuaaugcugagccaucucuccagcucuaguacucuauuaaaugaaaaaaagaauaguagaaucggaguggcccuguuugcccacucagggaugacacaggcauaaugaccauggccacuaucagagacaggcaaguuucauauguccccuacuacagacucauaaaggaucauacccaaguucaguccagucccugguaccagccagcuuacagguaaggcacaagacagggaugugucaaacuauacaugaguguguaggcaccagacaagugcagucucugugcucuuccacagaaacaucagaaggggaaggaaaaggugccagagagugugugugugucuagaagaaacuuugauauaaauacuuuuuaaauggcuaagacuaagcuauagggcugagggaugcacuuuuggguaguagagggcacaagcagguauguagaaauccaagaauaguuguggaagaguaaguuugcuccaaacacacuuugcaaaagcagaaaaaaauguaaacaucucaaaaauguaauaauuauaaaagcuguggcuggcgucaccagggggugggaggagauuggugaggacugagcacggaccgggugacuggcaagguccuguuuccagaguuuaccuggauauugccuuuagaagaacuugugaagcuacacauuugugugggucucugugucugcguuuaaaucuucauuuaagauuuaaaaaaaaaaauuggggccuggagagauggcucauggguagaaauguuuguuucacaagcaaggggacugaguucagauccuggcacccacauguagauggaaaaucagcugaccaaaaaaggaaaaaagaaggccaguugugaucucacacaccuguaacucauuacaggaaagguugcuugggcagccuaaccacaaccuaugccucccccaaaaacacacaaacgagcuccaaguucuggcaguguuugggucaaggaaaagaguaagaaaacaauaaggaagacagccaguuuuuccccuggccuccacaccugcacacauguacacacagagaaaaagaagauaaaauguuuuauaaagcuugaaaccgcaggguuaagggucaggggaacaaggagaugugcuagcagugucugaugagagacacuuaaggcgcaggggagagaaccccaucugccaaggcuggagacgccacgggguugagggacuggggccagagaggccagagaggugugagcggucgugugccucugggcagcccagacacuccauucccaguguggacagcgcacuggaggagguugucuucacaguccagucuagauuuuaucuuagcagcacuggauggaaagaacaucagagaucguuagguggagcauugaggacauggugaagggggaaggugauggcagugacguggauaaaguugccuucucuguaaagaguccagcacaggagcgagcuuaagcaacaaagcagguucuacauccagguggacccagcugggcugcagcugugcacaagagugccugccaaaagaugggccuggggcaaggacagagcccggggcuggaacacuggagggauggagaagagauagaccuuacagagagccuagggcagugcuucucaaccucccuaaagcuaugacuccuuuauacagguucucauguugugcugacccccaaccauaaauuuauuuuccuugcuacucuguaacuguaacuuggcuaccguuaugaaucaugaucaggaaggauaucugauaugugaaaggcuuguuccgcaaggugagagccacugaccuagaaugaauagcagcuagcaggugcagcacaugagugccagagauaccuguggauuggagacagacagggggagcacccagaauccaaaggcagcaguacuuggagucagcgcagcgccagcagagucagacagcagggccucggcagauccuggggucagugcagcgccagcagagucagacagcagggccuaggcagguggcuggaaaguggagaugagagaggauggugggcacagguuggcuguagaggacagggccuggugcaagaggcccacuggcuaucacaaguccuaugacuuguuggucauuugcuugguuuguagaguaggagaaaugagaucauuauuucauggucuuugcguggaacuuguuaggggagagugucagaucccaaagaaaccuagacagcucacucaauaccguuggcuccuccuggcacuucucaucccacccccacccuaaaccucuccagacccuuccugggucugggcugggauucccuucccucagcuucugauuccaauauaauccagcccuuucgcuguguucucucuuggccucauggucuucagcuccucuuuugguccacuuguccucuccucuuuucuuguucucccccggcccuccccucuccucccauggcccugcucagccuggacucuucccgaugccucugcaugaacucugccuccuauccacaguaacauccuucuccauuggaccuugcaguggcuacagccucacuuucauucagagaggaagaaggugcuggaaagcguugucagugauacugagucucugaaaguugaggauuuauccccaacuagcgaggcaggguaaaguuuuuccuaagcugcccuugccugccugucacaggaaggaagggccccugaagugagacagggagguauugagugggcaggaggaaaggugucaggaacagagaugggaacauggagacuggagucuaaagugagacucccaggcucucuccgaccccaagaaugucacagaaguauucugagcccacuuacucuauuuguagaggaugauagcauaauugauauucuuacagucuagugagaauccuccucagaauggugucucugagaagcagagcaguaaagcggccaguaaugaaugacaagaggccucagaagugaguggcucuguuggucuuuggaacuuugagaguuuccuguguuguuccugguuguuuagcaaugaugugaggacccugcaguggcagccucaggguucuggugaccaagcuaggaguacugguuucugucaagcauaugccuucccaccuucuauguuacugcagaguuugucccauguucucaguguucuuucccacuucaguuacuccccagagacgggaaauguucuuauuuaauagcuaagacgcuaaauaagucauucacagucauccuacacacugaacaugaagucagaacaagaacauggccaucucucuuuccuagaguccccaggcaggagagggaugcacgcagugcugcaggccugguucuagggccuuucuuugguuugguuugguuuuuugaccuuagaugaagaauccucacuuuguaacaucaguccugaccuugugucaccucucuucugcaggccuggguugccaacuaugagagaccucggaugaaugccaauuccuuacuggccagccccacaggccucagccccuaccugcgcuuuggaugccucuccugccgccucuucuacuaccgccugugggacuuguacaagaaggugaggugcggggagcaggcacggucgcccccaggcacagcacuuguugccagucaucccagacgaggccccuucucuuuggcuuugggucugggcugugagaguucuggagacaguucagagaagccagagaugggugguuuccuagaggugacagcugggcacaacugaguuaccgauguggaugaagccagcuucuccugugguucuggagacagaagagcuggccccgagggcuucagagcugguauauuuacuagcagcugauaagugaaggcuugggaccuggggugggaagugagcgucgcggccagaggcagucauaagaagggcacagcugccaucacuggagcugggacugaagucuaaggggaaguccagggccggccuggaagggcugcauacaggaccgugccacgcagcccgcgggcugucagagcaucccacggagaugguccuuagguccuacuaugccuuggauuuuuaguguugcuuucccuagcccugccaguaucagcuucauggaaugggguagcuuugaaggcuugcuguuuguguagaguccacccuaaucuguucaugucucagacuuuguaacuuuuuuaauacaguauauucugaucacagcuccccaugcccugacucccagauucucccuacuuuccacccacucaggucaacagcguuucuuucucugucucccuaaaauacaaacagacaucuacaaaaacagaagaaaacaaaauacaaaaaaucugaauuggacaaaacuaaugaacaggaggaaaaggagucaaagaaaaagcccaagaaaacauauaagcacacacacauauauccacacacauggaagucccauaaacgcacaaaaccaagaaccauaauguauaagcaaaagaccugcaugcugcaagguuuaaaugaaagaaaaaagaaagaaaggaaggagagaaggaaggaagggagggagggagggcaggcaagcccaguauuaugaacuucccccccaccccaaaaauauccucuaaaagcaccuuugcgucaccuguguuggcgucuacugcugcccuuaagugcaguuugcauacccaauaagacucauugcagaaacgaaauucccuuugugagcaguuaucaauuggagguagcuucuggguuagggaugagagcuguguccacuuccucugaucugggaccuugucugacuuuggccugugcaggcagccacaguccugugggcuccaagugcuucaguccugcugucuagaaggccuuguuucggugcugucuuccauccccucuggcucuuacaaucuuuucaucuccucuuccaaagaguucccugagcagaggggagagauuugauguagacgguccuauuuaggacugaguauucugaagugccucacucucugcaauuuguccaguugugggucccuguauguguucccaucuaccacuggaggaaguuucucugacgauggcugagcgaggcacugcguauagcagcaugucuuuaggagucauugcuguauuccuuuagagcaguagaguuugguuuuccuauagguucauggccaccuggacagugucagggauggccccaucucauggagugggucuuuauucagucacauaauggcugguuacucgcauagcaugugugccacuguuguaccagugugucacgggcaggcaccaauguagaucagagggcuugcaacucuguuggugguuaccuuucuccucuggcagcaugcagaguacguuccaguacuaugaacacuagguaguggaggggaaggcucuagguagacaccagcuccaccucucuggauucagugaguuacuuagcuguucagauuucauauuuuaaauugcugaugauguguaaaaucccuucagcuuucuagaagguaaagccacagaauuggaguagucuugaagaguuugguucccauggcagaguucuauagcaucauucccccaccccaacccaccccugaagccauucuuggugcccaaggcagggcugcauguuguacacugagaaucuuuuaagucuaguccugcugcacaucucaaggauuuggaaccauggcgauugggagacacuccagguuguucugugcaggagaccugagcaucgucacagugcuaagagccaggcagacacucaucucuguguaccaugcccaccccuuaggugaagaggaacagcacacccccccucuccuuauuuggacaacuccuguggcgagaauucuucuacacagcggccaccaacaaccccagguuugaccgaauggaggggaaccccaucugcauccagauccccugggaccgcaaccccgaagcccuggccaagugggccgagggcaagacaggcuucccuuggauugacgccaucaugacccaacugaggcaggagggcuggauccaccaccuggcccggcacgcuguggccugcuuccucacccgcggggaccucugggucagcugggagagcgggguccgggugagugcaagcuagccuguacccugugaccaggccuagccaagggcagcuccuuauagacuggggcuggggugggauccuugggucuaggagauccuuucugcaucccugggcccucagcagaagggcucuggcucccugaggguguaauaguguuacagaaguggaaagagccagagcgucaggucuccaaggaggcugguuuuuccucaucuagguauuugacgagcugcuccuggaugccgauuucagugugaaugcaggcagcuggauguggcuguccugcagugcuuucuuccaacaauucuuccacugcuacugcccugugggcuucggccgacguacagaccccaguggggacuacauccgguaaggacacacaccagacucuuuggcucuggagccucccuccuggauugggguacccuaggcccuuuaaagaagagucacagugugcugauacauuaccugggguguguuucaggcgguaccugcccaaacugaaaggcuuccccucucgauacaucuaugagcccuggaaugcccccgagucaguucagaaggcugccaagugcaucauuggcguggacuacccacggcccaucgucaaucaugcagagacuagucggcucaacauugaacgaaugaagcagaucuaccaacagcugucgagauaccggggacucuguaaggauccccuacccccucuggcaucucacucaccaagggaggacgaaaccugaaagcuuuuucagguguuggcugcccccaggcuguaaaagaugcugcaggcugggccagauugggcugccaaagcggcugugggguauuggaaaggguggaggcuguguccugcucuugcccuccuuggcuucuuuguuucucaugaucugcagcccucuuaaucuugugugcauucaaucccccaggucuauuggcaucugucccuuccuguguggaagaccucagucacccuguggcagagccugguucaagccaagcugggagcaucagcaacacaggugaccagucaguuacaccugccucuggccucccuggccuucuguggccugugucaccaccacauuagucauuuagggcugaggccaaaaugagcauguagcugaugaagcuuauaucccaccugggacauacuguaagaccaucacaugagaacauuaaggauuuuggagggagguagcacugaguggcuugaugugggacuaggaauggggccucuuuagggccgcguuagauaggagaagcccaagggcaccucuuuaagcaucaucuugauaagaaccaggaaaggaaauaucgagaaaggcccccaaagcaggcacaagcagaguccacuguaggagcagaaggauccagagccagggaggagggaagcagagcagcuuuggcacaagucgcccugccuuccugcacugacggaggccccacugagguuuuaaaaccccacugccugccacauaaacggaaacaauggggagaugaggaauaaggugcucaggaggcugggcaggagaagccacagggaagagcaagggugcuggucggguucgggaugcuccacaacacgaaaaugcccagaacccugggauuucccgggacugcgaagggaacccucaccuucagagcaaggacggcaggacggcagguaggccaaccagucucuggccuggcgccagggaucugagcaccagaaguuggccuugcugccagcaggccaggccaugcccuccucauauaguuccaagugaggucacugcugcaaaggaggccagggcagggcuuccuguccccacagcaagagacuguuaugguaaguaacuaugaccuguuucugugccucucuacaggccccagagcacuauccaguggcccagcuucccccaaacgcaagcuggaagcagccgaggaaccuccuggugaagaacugaccaagcgggcuagagugacggagaugccuacccaagagccagcaagcaaggacuccugagagugaguugugguuuaaaaagcuguugcuugccagcuggagggccaaacagcaaaccagauuaaaaugcgaucaggguaggacuucagcuuguuuugcuacaguuaugaaucaucauguaaauaccugguagucaggagaucugauaugcagcccccaaagggucagggcccacagguugagaaccacuccuguaaaccuuugcagugguaagggauggcugucuuuguuuauuuguuugagacagagccucacuggguaguugaggauaguuuuggacuuagagcaauccuccugcuguagccauauccuccugagugcuggaaauucagauacgagccaccaugucuacuuuaccuucuaaaauuuaaaaaaaaaaaaauguaaaggaagaggguuuauuuuugaagagugaaacuuagaaguugaaacccuuugauuucuggcgaggguuuaguuuaguuuuguucuguuuguuuacuugaccugaguucuguagguggccaagcgagggugauacugagcuucagauggcaggaaagggcucagcccagccccagaagcugucucugccucugccucagggucucuucucacgggcucuggccgugcacgugccaguccauccucaucuuuucuacaagacuccugaaucauuaaaaaaaaggaaagaaacagagggaaggagagucagucagucuuccuccucucggcuccuccuucccuaaggcaggaaaggcuuuuaggccaguccuggagaaguguggauugcuguccucucaggcuguggacagucucuccuggcaggcucuuccgaccaucugcaucaggagaucggagggugcuuuucaccauggaggguuggugcuuuuucuggucccgaucacucggccucacugaggcuuccgcagugucucgauuuauguccucgugggguggcaggcacuuggugcuuuguccucuagacauugccagugggaggacaagguugugcugccuugucccuggaagagccaccaccauagaugccaugcucuccagugcugagcacagagcgugauggcuucugaacuugcuugguuaauucccugauuuugaggcaagauuaacaaacagaaagauuagauguaugagucaaggaugcucaguaagcugauggcguauaguacagcaugggcguguugccagcagauguauagggacagugacauauaacgcaugccacauuaaugugggauccauccacagugacuuaggaaaggaagacuaacagccuacaguuccuagaaagcugcagaccuggcuuaucgggagagcuguugaugggcugagcguggagcaacuuuacaccacagcaaaaccaauucagaguuuauaugaucuuguacaaauuacauaaucucuaggaggaugguuuccuuccugaaaucaggucauuguccccaagauuaagugcagaugcagucaagagacgugggggugcugcugugggcucagcaucucuaagucccagcucccaaaggcuccgaaacccaacaccgugugagugucaacagggaaaucugugcagaucuccuuaaauucagaaaauccaggcccucacagccugggcccagcucugaaguacucucugcuggggugauuaugaucggguuucuugccuguugagucuggugcuccuggaagacuguuagaccaggcagugagggccccugcagggacuuccuaggagagaagcugcuuguggaacaggacgaucaaaccagcaucggaagcgacuaagcacuggauggggcccuaagagagccaggugcgggagagccacaugagaggaccaauacugacgucaagugacaucaaccagguagaggagugccuuuccugcaccgugucugggugaucaugugucaccuacugagcucccaggggcugguuuucacagcuuaugcccuacaucuucauaagguaguuaagccaggaaaugcucuugaagauggagagagggacugggaggccagacgaugagacaggaguagaguucuuuccaagacagacagugggagcaccauguuucuggaaaccccaagagaaaagaguacaguguacaggcuaggguaucaggaccuugggacccgcaucuguugcauuaggcuugcuagagaaacagacccuacggaacguucauguuuacaaaagaauauauuagauugucuuacucagagggagagugaguccaacaguggccaucugcacaguggagagacuaagaaccaaggaacuucacaaucugcaaggcuggugcugaaggacagaaggauuccuggagagccucuggucuucaaugugcauacaucagagaagcuuaguucugauguccgugaagaauggcaguagcagcagcagcagcguagaugcacuuagcaacaaggagcgcagacagucaggcagaagcagucccacucuucucuuggaauccauaucugggcuacugcuagaaggcacugcccuggggaggcuccuauccucacagacccacucggagacaaggcccuaugcucccaaaucuaaucaagaugacagccaggauuaacccucacaucugugaaccacuuuguagugcuagucagcugcccuaugcugggacacacauaaccggaaugucaaggagaaaaucuagacucucgggugaaaagucuaacugagggaagcacucaggcaggccuugcgugugcuucugagcgacuuugaucacaugacucgugggccacaaagagcagaguuguguggaugggagaccuucugcccauccucuauccauuuuagucaugugacucgggcuugaggccgaggucugaguaaucauuccccgaggucagucucuuagcucugcucuuccucacugugagccugcugucucaugagcagucauuacaacuuaaaucaguacuccagaaaaacaccucuagguucugugcuugccucaaacacacgccagcugaauguucuacauuuaguuuuuacaauguucacuaagcugaaaagggaaaacagugagcucccagauagcaguccugucagcuggugcccguaacccccagaucugcugacacagggcuccauuggcaucccguucugcacuggcucucucgcuggcccagugagcuuaccgcggggcagcacgugugcuucauuucccugucuagcacugcacagcagucuuucaagagaagccccugcaggaauagaggaccauggccaaggagcgccuucccucacuguuagugcuguuagugcuaagguuuccccgccuagaccguggcuuccagaguccccauuguccucugacgcuuguucaacugguacgugacagguguguugcugacaaccuguccguguggagauggaggcggcccaucccucccagagagcugcauucugggccgugcuccugucugcagagcauccagguguagcucagcuuagucucagcuucugacuuagagccauaagaaagggggcugaugcuuuccauaaaugauaaauguugguggagacugauggggauauguuuaacaugcacguguguuggaauagcacaugagaaguuaggcauagcgaugcaugcuuggaaucccagcacuaggaaacuaaggaaggagggucaggaguucaaggacaucccuaguuauauaucgaagucaaggccaaccuggauuauaugaggucuggucuaugaagagaagagaagggacaaauauuuuuucaaaaucacauaauaugucacuauguacaauuuuaugugucaguuaaaaugaauuuaaauuuuaaaaagauauguccaucuaagggaaagguauggcuagacccuuuuucaagggaagauggcugaagugcuacuugguuuaaagaacaagguccugggaacugcccccauguguccacuucugcuguguguucuguccagcuucuaaacucuaaagaguaucacacuccuggugcagcuggcuuuagcuuuagccugaggccuuaauaggauugcauggacucugaacagcuguaguccuagcaccuagagguggaaacaggaagaucaggagucaggcucccucaacugugcaagagaacaccugaaguaggauggaaugugcuagaaggcuagauugucuccaaaucugucuggcauuuguuuugugucaaaacaggguuucucuguguagcccuggcugcccuggaccucacucuguauaucaggcugucgcugagcucagagaucaauugccucugucucuugaguacugggauuaaaggcgugcgucaccaccucccaucccauccguguucccauuucuaacccuuccacuuuauuuugcuugaguuucuaucuaugccacaauauugacuuucuuccuuuuuacaucucguaaaagucuuggcccugcaaugguggugcacaccuuuaaucccagcacuugagaggcagaggcagguggauuucugaguuugaggccagccuagucuacagagugaguuccagggcagccagggcuacacagagaaacccugucucaaaaacaaacaaacaaacaaacaaacaaaaaaagcaaagucuugguggggaguaauauaaagacucccuacuaguuaaaaacaaaacagaggcuggggagccgcucagacaauacuggcugcuucugcaaaggucccaagguuugauucccagcacccaguggcagcccaaaccaucugugacuccaguugcagggaauccuggcugguuucugagaacaccaguuacucacguggugcacggucuugcaugcagguaaaacauacagauaauauuaauuuuuuuaagcccacggguuuugaauccuaaaggcccaggaauuccuaucuccccucuuuguguggacacuugugucaguucaguuucucacuuaugaaaauggaagaguagcagauugucugggccuguaagggucugugagggccaccauagcagagcaccguucuagugucuggaguccaagaugauggucucugcacucgcagagguuuuucccucgguucuguccaggucaaaguucuuuauccauuuuguauuugaggucagcccagccaucucaguuuuaccuaaagagagucacaccuugagguacugggagucaagaccugagccacagaaacaaagacauuaguuguggacgcgggaucgugccugcccugcagccacuccaucagccuguugucacaggcuuacccuuucuucugaugaggccacuucucucucugccccagaucuaagauguucuaaauccuugugucccuauuccccuuucugcccggccccauagcccugugccaggguucugugauugguguguggaaguuuaccuuccugcugguucuaaacgcagucauugccucacucugcggaaucacuagaaccaggcgacuucucacacagcugcuuucccugacccuccaucucuggaagcaauagccgugcucuugucauuucugaacaaauguuccucaaggugucaagugauggcauguagcuguccuuaucccucaguagaagguauuuagggagcacuuacccuggguucagaacugcaauauucagcuacccucaugguugcccagcaaccaucuggcccuggggacuguggccuaagcagcauguguguugggcugucccacucucugucugggaauccccagggaagcagccagaggaacuggugccugggcaacugagcagccuccugagugcccccuuugcacauguuuuucucuuucagcuggagagccaucgcuccgugagcaaagcccgggugccugagcuaccauggccacagagugcaaucugcagagaagccaaucaccaacagacggagcgagcgagugugugcguguuugcagaggaagguguggugugccauuugugugugcaugcaucuguuuacacucucaugauccugaauguugccugcgcuggaggagucccuagaucguaucuucuuaccagggcugcuucuugaccuccagacacaagacuagaagccacaguagugacuuucagcccaaaucugucccugggagccccuuccuugucccagugaggugguaguacccuagcucaaauucuggccucugccucccuugauuuuucuuccucccuccuccuuucagacaaggagcuggagggccacauuuuuugacucucaucugaagcauagaguuucagaggcagccagaguccugcugacuuaguucccauguucugacacuagaaccugagcaggcuggaguaccagucuuguaaaacuccauacuacuagcaggcuucccugaugucugagacaacugacuggugugcugugugcccaugcugcuuaugucagccucaaacagcaaaucugucuguguagaaccuucuagaagccaaguggagaauagacucccaggcuucugucccuucccccgcagcuaaggcccagucucccaccuucuagaagccgugaacaggccagggucugagccgguggaagaaauccucgucccuuggcugaaggccccugguuccucuggccaugcuccugacacgacuugcuccagcaaguccugcugcuacccagccaggcaagcgggacagucugcucugcaggcuuccagggccggcccuggaccaaucagcacccacacugcagugucaguccaggacugagcuucaggggacucagagagacugagagugaagcacugccuggggcaguugguggaaggucagagaucacaccuggcacaccaaccucuucucagagcagcaguggaagguuuggccuagagaagucaagccucacuuuccaggggagccaacucucccgcccacugcugggucuuauggagaaagaaguuaugaaaagaaggaucugggggcaccugagcaagucuuccuucuaccccguggccugcacuugagccacaguguauguguggggagaaagagaaagaguguguaugugcgugagagagugugugugugugugagagagagagagcgugugugugugugugugugugugugugugugugugugugugugugugcuguuuggauuuuuguucucacauguaacauuaagcuggccucugggccuuuuccuuucuaccuccccugugaccuuuccuagccucagaguuguuaaugcccuuggcccuggccuuuaucaugucagaccagaagccuggggucagacucgccucuccagcugucuaguacaucugacaggcuucuuuuugagauggccucagguuuucucagcagagagcugccuuuaguccaacuguuuguguccaucauucugacuagaagcauccuaugauugaucgggugaagaaacagggcaccugugauguccauguuuagaguucugggguguaaccucccugcuccuuagcccaggccaagaggaaggagccaaaccgccuugcuggcgagaagguagagugggccugaaaaaccagucucaggagcaaaggcuaauucugcguccaggauuuaguuugcaacaucuucagcuguggggacaauggccuucuccgcuuuuuuugaugaugguucucuucacaagguauaaguuggcaagaucaucuguccccccaccuccuugacaagcuggcccauucccaggccagccuuccaaugcaaggagcagucuacacccacagcugagauagaguggccuggagccuuggggugacuucaugccucuuuuugccuagccugaguggcccugaggacugucacagaacagugccccauguccuccuccugggaccuagcauggggaagagaugguugcaggcaagaagcacuuuacagaguucccuauugcugggaagguuguguuucucccacaguuuguuugugaauauuuaccuguuuuauaaaugucugauccugucugaguaaaac

SEQ ID NO: 928 - RNA, 23419 nt, Mus musculus
uagauugaacuccaguaugcuugguuuuaugguuuuuugauuuuugugggucacccuuuuguagcggcacuuucgagagaaugaagcagaaaacgacugaggcagcucagaugcuugggcaacaucucaaguccugugggagugcagguacugagaaugggauuccaggaguuguagcugguaggcugcugccgagcauggcagugaaccgucgggccucggugagcucccacagccuccagagaccugcaucugaguagagaaagacaagcauaaauggaggccuaaaugccgugagcagaaugggguggggguggagguggggagacacaaacuacagaugugcuuuuaauauuugccucacguuggaaucacuuaaggacccuugaaagcuuccugggcuccccucccccguuucugcuucucugauucaguugccuugcccuacccuaggcugccuugguuuuuuggccacugcagccaagcuucagaagugcugcacuaaggaacuauagcaagccaggcaacccagggaguguguugcuucagugcauugaccagaagucuaauuagcuuuggcauuuaggaggacaaggugaaauaacaaaaaaacagaucgaauaugguagcugcuucugagcccggcaucaggcacacuccagcagccucgccguuguccuugcccccagugguuugagugcggggcuaaaugccauuugugcacaggguuggaggugaggaguuggaggcgaggaguccacccaucccaccccaccugccccccucagcugcauuucugcauaacuacaguauguguaaucuuccggcacugcuucugagcuugggaguagucuuaagagaauggugcugcugcagcaugacggcccugcccccuacugcuucagcaaccgacucucucuagaaggguggggcccaucuggcagcagagggagaucugauucugucaccucuguuacacugacugccucccugcagauggaauccgauuaaaauagccacaguguuaaagagaaaggcaaccaggaaaaaaugugcgugugugugugugugugugugugugugugugugugugcgugcgugcgugcgugcgugcgugcgcgugcgcgugugcgcgcgagugugcgugugcaugugcauguaggcauagaagcaggcugucauacccauugccuuagugauaauaggaagucuauggaccacuuccagcucuguggcucccaagaauguuuuccuaguaucuuucgccauuuuccucuguccuuccuuccccaaauuugcuguaucuggaaaggaggggcugcaggcaagaucaaaacaaaaggcagcugugaauggcuucuagauuuuaaaaaugggucaggcucgauccaguauuaauuuccuucucucugucacagcuuagaugucagccagaauucuccuccuacucuguugaaaucauuuggucucuggcucugugcuguaucuuuuuuuuuuuaggaacuuccagaacagagggaguuaguagaagugucuucuuucuuagccauuucucucagaaguuagccagugauacaggauggggacucuugucaucuaguaguugaaugcagcugggcagcugcaccaucaaagaggguggccugggaacuuggucaacgaggaggugggaucaguaguugcuaguagagagauuuguguuccuugagcuguucacacuguaacucuagcaagaggcuucacuguucuguaagccaagagcacauuuccauuugcccaagagggguagaaaacuuugaucgagcuguuuaaaauuaagcacucugcaaaagaaaaaaauaaaaucuauguuucuauuugaaugagauuuaggaaccauuagauuauuccuuuugguggggccuaaacucuuaauuucuugggagugaauuucugucuauuaauauccuguuaccagucugccaguuuauaauauuguugugguuagauaagcuugcuugaagcacaagaauuuggucaaggacgucugaaccugaagacuucacuacccuacccacccacuccuacccuccacuccauuaacagauaaaucaaguguuucucaacacagccacuucuguccccccaaaagaucucucugaguggaaguauggaacucacuuguucugaagggaucgccuccuagaguugcuggaugacaguuuucccuguauuuuuggaaaucccaauuugguuuucuccaguucugucuccccuggcuccagggaacuuacguaauucuggagcaaggacuauucaaaagguggagcucuggccgcacccuuagggucugugacugcucccucagggggugugcucugcacuguggcccugugaucuccccuuggagcaagcgugacgaucagccccgacgccaacccuuccagugcucaccuguuuuccuuugcguuccccccuccuuaaguaaagagaagugagcaggggcagaggagggcucgaagggagcacagagggaaaggccaguucucccuggcuaagacagccuaggccugucuggugggcacucuccaggagcagcuagcuccaguucuuucggugcuuugcagagcagcagauacaaaaggugaugucauggcaguggccucccugucuguggcugccugggggcuggaaacuacucagggaucucccugucuccuuccuauugccuccugggaagcuguucuggguccauccuggggaccaugguggaaguagcucagcauugcccuuucgugguggugguuggagcuugagaugguuucacuguaguuugucuguccugaaacucacgcuauagaccaugcuggcucauagagauccgccugccucugccucccaagggcugggauuaaaggcaagggccacuaccaccccacuaguuaaaaguuucuuagggguugagguagaacccaguaaaagcaaaguugaaacaaaaauguacagaguaccaauauugaggucaaguugaagugcaugccacaguggaacuucuugaguuuuuaugaacaagugaauucccaggaaaauucugaucguauuagucugggauggggcccaagaguguauguguguucuagcaaguuccuggucaugcagagcuagggcuccucacacuacaauuuggggaguaaagaucugcagaaaagauguuagccuuuaauugagcucagguacucuaauugcugaccccuaggcaguaucacccaccucaaguguguguagcucagagcagugaguauacgcacugcugaggcccagagccugguagcugagagugaacgcugagcuguaguauuccagggcuccuaguucuguccaguuacuagguauauuauguuggagaauauacuuaaucuuugaaugucaguuucuucacccauaaaauggggacauccagggacaggguugucugauaauuaaauaauacaugcaaaacaagugggacagagccacacucagggagugcuuaguaaaugucgcuauugccauugugaauugcagcauuguuuuguugcuagcuauagacuuugccuucugcuuccugucagagaagacaaggguauucaucuaugcuggagagaugcugccggaagcucuccguuuaggaaacaaguucuaaaaauaaagguguauagaaaacagauugcaacauacucuagaaucuauacuuccugugcauuucagccuuaauagcugcagauugacguucucugagguguggugaguugugaagauaaagacccuuaaaguguauggcugggacauauuagcaucuucugaugggaagaagcucugcccugagguguggccuugugccuagcagagcuccuguuucagguggcuggggcuaucugcucccccgagucuccuuuauuuuuauuuuguguguguguuagggaugagcagcaaggugcuucucccacccccaagaccaauuuaagcaggcuugcaaauccaaauuuaagugggcuuaacauucaaagggugucagguuuucuaaaucagaaauuucacugcaggagaacuugaggagcccucaaagcaaccuuuaggcugucagccuccugucucaaccccuuggguacgccuucgugcucuuuagcucagugcugcucugggcugggcuucugcuggaaugugggucuacagcauuggacuugggauuaugucauuuuauguacgucagaggcagcaggcggggccugguucugauuggcacccucaaggcuucuguaaaccuccaguagucagggaauguagcucagggaucgacagcagguucuguggagggagccuggcauaagaagcuuggccuguucaggcuuggcuccugaggaggaagauaggcguguggauagacugucugggugaggcuuguguuccaggcucaggagacucucagcccuugacugaaguguuuagaauggaccacugaaaacaaacaaggcuuuaagagucuggucugccugggccacuaugcuagcucagucaccuaacagcugucugcuuugguaaauucccuaaccucucuugucaguuucuuugucugcaaaaugggaauaguucaguuuccuucaaaauguguugagggagucaaauuaugaaaguacuuaugaauuagaauagaugacugugguugacuagggaaggcaagggaugauauuuuacucaguacccacuugucacugggauuuugaacacaucagaagauaaacaagaauaccguacuugaggcucaagggacugugggucacgagaggcauggaaauugaacuaccaaacaaaccuucagaggccacccagccugugguuguggcuuuaguauuuaacagacauauaaacagcaccaagagcagcucgcagugaucaugggaguucugugccuaggguuuuccuugcacucugauuuuauuucuuagcgauuucaugagguaacaucuuagcaagucuaagguucuacucucaauuccauggcauggagagaaagcaaguaaagagguuaggucacugccuccgaucacagcuagugaguguguucaccccaucccucccgggcggagcucaggcuaggccuccagcccugcgcacaccauaccaacuuguuuagcaugaacagugacuuuguuaagaaagugugugugugugugugugugugugugugugugugugugugagagagagagagagagagagagagagagagagagagagagagagagaacccaugcuaauaaugaggucuuuguggaaucugcagguuccuacugcaaucucuggaagaucuggacacaagcuuaagaaagcugaauucgcgucuguuuguaguccggggacagccagcugauguguucccaaggcuguucaaggugagcauggagggcugagagggggcgucugcugcuuagcaucugccugcccacagagugaaaugcuguucuggcuggcaaaauggaaauacuggcuccugucuggccacuaaaauggcugcuagggaggucagaagcagagacagcugguaaauuugccagcaggguggaaacugaagggaaaaaauucuguaaaauuaguguugugcuggaaauaucccagcucagcccagacacgcagagcgugaguccuuccacccugcugccgcuggcuuccucaugguuccuuggcucaagccaguauguuuuacuagagcuuguuccugccaagacuuugagggugggguuuccugucuaacaaggggugcugaccaccucaucuugcucugcuuauuagggaaaaagucagucaggcauuugagggagccaucccuguuucccugugguaagcaaugaauaaaaucuucauucugggaccauacuggaggcaagcccauuuccucaagcuucuuuaaaaugcauguuuuaaggcccaagcagagacaaaaguucucauggauagaacauucuagaccauucuccuucauccucaguagcacuccaaguacuauaugaaaaauuuaagaaaauagcuucauugugugcguccccccauaauucuucacacaccuaugaacacuagucauuagcauucuccuagggcugacugagucguguuccaacugcuaccaugugcuaacacucacccccaacagccccgagggguggguucugcugucccagguuuacagguaaggacgcuaucuugggcucucugacauagagcuguguguuuccuugguauacccuguacaugcauuuguuagucuguggcuguggcuuagcaguagcacacuugccuaguaugcaugagacccuggucccauccccagcacaguaaaaccaaaacaaugguaauagaaaagauuuugucuuuccugucccuccacauugcuccucucucccaggagcucagaggccaaauggucuguagcucagaacuauagauaccuucgcuguucacugagucgcucaucguguauucacugagccuucacuagcaucaggccccauacuggcugauagggugauaucgaugcuugugcaacccagcgugauuucuacccugcguucacacagugauggcaaaacaggucagugaugggcaacuucacugccuaugaugagugcugucauagaaacaggacaaggcacaggagaaucacccucacggaguggggccugucauuuaaugagaaucuucuuauucacaggguuauaugaguaugcaaugacgucaccucuguaaaccacucagcauaguaagggauaaauaaauauguagugcacugggacuuagaugagcuggauauccacccugcucagaacucacuccccugggcaggccugaauuaggauagugaccagugguccaaagcuguaagggacuuugaccacagacugguuagauugcuuccuucuugcuaguuacaugcuauagggcuuucuauggcuugucuagauagcuuucaccauguccgcuuuccccugguguugcuaggagaccaaagugacugaaagcucaggaaaaaaaaaauuccccuuuucacaaccuguagccccuccaguuuguuuucucuggacucaggauagcuccuccuucuccagcucugagagccauuagcucuguuugcuucuggccuagggaguguugcuguggaaaccauuaagacacuuuacauagcacaagucugccaggaaaacuaggccacaaguuuguagagucugaggaggccugggaaaggcuacagagcaggcuggagugugugugugugucccccauuuccacugugagucaguggcucucugagcugggggcuccccugggaacauuguauuuauagccucauucccccacuucaaggccacagugaacacuggcccuuucuguugacuccaccaccgcagugcgcuuggccucccgguccuggcugacaacuccacacuugcagagcuccggcucuuugcuuucugauuuaaacuauuguccaggcccuuucuuuguucuguagcuauucuagcacagcucaaggucagcccugcucacucccagagagaagcugaguacccaggccccucuucuugaaccaagcauaacagauuaucucuaugcaggaauggggggugacccguuugaccuuugaauaugacucugaacccuuugggaaagaacgggaugcagccauuaugaagauggccaaggaggcuggcguggagguggugacugagaacucucacacccucuaugaccuagacagguaagacacgggggcucucgguaagguugcccauggugaggacuggggacuggggcuccuccuaaguggaauuuggaccaguucagcaagagggcuaacugaacuggacaauaaugggccagaguugggggcuuaaagaagucaccaagagguuaacccgauuuggauaacaaaagaggcuugguuagaccuaagcugugaaagcagggaggcucugucuccacacagucuucauagaucugucauuggcucauugaguuucaugcuccccccccuccucuguugugcucccuaacuacagaacccuaaccuuggcagaccccaucagacuccucccagcaggccucuguucucucagaccuaguuuccacucaaggaugaucccgggucugcuuggccuaucuggguuucagggccaugcauucugauaauguuugagggcucuagagaccccugcggggugcuggcaaccacagcagaaccuccuuccccaggggccagccucugugcuuuugucuccccuucccuacuagagaugccacccucuguagcugcuacugcucccugcccuccucccaacccagggcuggcugccaggaggcugggucacacagcugugcacgugagccaagcccucaggaggagaggcuugcuguggagcccuuccccugccacgugccaggggagggcagggacugcagaggcagcagccagcuccuaucugggcuaaugggggcagcacagggagaacaaacugggaaaugaacucacccggacaggcaggccuugcauaagcuccuucucggccagcgagagccuaggaaucugccuacagaccaucgaaauuuauccucacagacgcagugaacccuccucuccagugcccaugccuuuccuucuugcuugugagaagugcuuggcacacugcaacacucuuuauacuguugcuguuuaccguagccccagacucugacugagggagcauuagccggccuucacaucucugcucuagugaacagggcuaacaggacauugauccuccaagaaaggagcauguuaugucccucacuguauaucccucggaggcucgaaaugggguagagagaagcccuugguguggucagauaggugcccagaggcccauggggauuuucugucugauuagagagauacggucagucucugucucuaggcggcuccacguggacaccagggaaccuggaauugagucccagcucuggcccugccuugcuccauuaccugaggcuccuguuccagcucucugggcuucauuuucccucucgguaaaauggagauacagccuccccugugccccccuuucuccucagggacgggaccgugaggugaugaggagagcaacccucagagcuucuugugucuugcgcucuuuuuuugggguggccagggaccccaaaauaaagaaucucaggagugacuucagaugugcuuugggcuccccagaaucaucgaacugaaugggcagaaaccaccccuuaccuacaagcgcuuucaggcccucaucagccgcauggagcugcccaagaagcccgcgguggcugugagcagccagcagauggagagcugcagagcugagauccaggagaaccaugacgacaccuauggcgugccuucccuggaggagcugggugagugcccuacagcacaccacacaggccgcugcuuccugugggggacguggccuuccuguuuccuugucaaaguuagaaaauacuggcuuaguggcucaugccugcaauccuugaaacugagagacagaggcaggagaaauaggccagccuggacuacaugagaccuugucuuaaaaaggaaaagaaaaacagaaaagguugcuguuauccaccauaugaccaguuaguuaacuaccugugcccggccaggcugcugcuguuuguagcugaagccucuuucuguaguucccucucuccaucaguagaggcacugucuggugcuggucaguggacuuccucacuaggauaacuaauccaggcuuuagguacccagcccaccuuccugccucccuccuccugcccacaccaucuucugaucugaauaaagcuaaccuucugcacuuuaaggguuuucucaguccucacagcaccaaguccaaggucuguaguuccguuuaaagagcagaucagucugaaucguggaaauuaccauuuuuauauuugugaaucaucuuaaagguguuuacugagcuguuucuggggugaccugaccugcagugcuacugccuacuguuccuuuuguaggauuccccacggaaggacuuggcccagcuguuuggcaaggaggagagacagaagcucuggcccgccuggacaagcacuuggaacggaagguauggcccuguuucugagccaugggacugacuacagucaggaccacagggaugugggucagcuucaugucugagggguugaaaacuaaaaacucuuccugauggcaagauuaacagcagcucccaguuggaaaguccacccugugcuggccgcuggcuuaugugccugauugcauuaucucccuucgucuguccagcaggcagcuauuaggcuccccaucugacagauuacaagccugggcugagagagguugaguaaccugccugaggucacaccauugguuagcaguguagggaggugcaguuccacaugaucacacaguuggcaccagucugacuuucuucuguggacagcuuuugcuuauggaaagggcagccaaccaggcuugaugcaugccuguagucccagcauugaagagggaugaggcagaaggauugcuuuaaguuccaggccagagugggcuacagggugagacugucugucucaaaagaagcaauaacacuguugaguugguaaaacccaucaggucaguuauugggugucagguggccccuccucaucucuuuuggcuucauuucccauuugcuuagauccagauagcaaauggccuaccuucugugcagugggaaucagcaagagggagaggccaaggcccagagguuccacagcauccgugguccuuaccccccuaugaccagagaaggagugcagguuccacggacuugaggacuccugcuuccaaacucccugacccugcagucucucuguagucugucccucaaaagcacagccuuuucuguccccaugcaagugacaaggucuuuugccagcagcuagguacuagcaauggaucaagggcccaaggcagccugcuaaagaagaaugcuuucccagccucaggaguggccagccagcauuggaggauauggugacagccucagccucccucagcucaguagacuuaauauucccauucagauauuucucucagcugaagauaaaacaaguuccuccaaugaaagaugaggcugagagucaaaagcuaugagggacuagcuuuguguguccacaucaagagcuauaugagggagugcuucauguguccaucaagggcucugcacagggcuggguuauagcuuguugguagacuguucuccagccaugcucaaaaccaucaguccaucuuagcaccagaugaaaggaaaaaacaaagcaucauacccagugauucaaaggcucuuuggagagagauguuuggucagagcagggauggagcugacaaaggcagugauaggaggagcaggauucacgagagacagagcuacaccaauucucauuuuuguuaucuuaacaauauuuguaaaggacugccccccaaaccaccaaaccaggagcccauuuuccacacaccccuggaugccacccuauccuccacucacuggggaaaaccagagguuugggguugaaaaaauuaaccuucuuugguucuucaaaccugaagggagcagcaguuuauaucaucaagauguuguaggagcuagaaagacugaugguuaggacagacaugcggaagcacauuguguucaguuagaaagccuaaggguuaggaaagccgcaggucaggcuugcaggagcagagagcaucaggauuaauuaucaaucaaguguugcacuuuagcugcccuuugaaagggagaguuuuuaaaaccaauguaaccaggaaucuaagguguagccuuuggguguagcagcauccaggugucccaagagugguaaagcagguacccuccauucccuggcuuugcuguccucugugaguccauccucaagugggcuucccuuagcaguggugaagguggucggcauagccuaccugucuucugucuguauagcucaccagaggaaggggcuugcuugccucuuuuucaaaagcaucaguaaaaguccaaagaaauauuuucauuggcuuggcuuggguccugugcccuuccauggcuuagucacuguggcuagggauggacuguuuuccaugacuacauucacauccugagccacuccuggggucagaaaguaggcauggaucugucuugcccacuagaacugagaguagagaaggugccccauuaaaacaccaaaaggggcggggagggggcagauuauaugcccuuuaccucucugggguccuguauugacauuccuuuuuuuuuuuuucucaagauuucucuguuuauucccaccuguccuggaacccacucuguagauucuguaugucuguuuugcuaacauauauguauaugcaucacauguguaccuggaguccacagaauccagaagaaaguguuagaucccccugaacuggagcuacagacagcuuuaaguaccauguagguucugucugaugaaagaguagcaagcaagcauuuuuaaugcugagccaucucuccagcucuaguacucuauuaaaugaaaaaaagaauaguagaaucggaguggcccuguuugcccacucagggaugacacaggcauaaugaccauggccacuaucagagacaggcaaguuucauauguccccuacuacagacucauaaaggaucauacccaaguucaguccagucccugguaccagccagcuuacagguaaggcacaagacagggaugugucaaacuauacaugaguguguaggcaccagacaagugcagucucugugcucuuccacagaaacaucagaaggggaaggaaaaggugccagagagugugugugugucuagaagaaacuuugauauaaauacuuuuuaaauggcuaagacuaagcuauagggcugagggaugcacuuuuggguaguagagggcacaagcagguauguagaaauccaagaauaguuguggaagaguaaguuugcuccaaacacacuuugcaaaagcagaaaaaaauguaaacaucucaaaaauguaauaauuauaaaagcuguggcuggcgucaccagggggugggaggagauuggugaggacugagcacggaccgggugacuggcaagguccuguuuccagaguuuaccuggauauugccuuuagaagaacuugugaagcuacacauuugugugggucucugugucugcguuuaaaucuucauuuaagauuuaaaaaaaaaaauuggggccuggagagauggcucauggguagaaauguuuguuucacaagcaaggggacugaguucagauccuggcacccacauguagauggaaaaucagcugaccaaaaaaggaaaaaagaaggccaguugugaucucacacaccuguaacucauuacaggaaagguugcuugggcagccuaaccacaaccuaugccucccccaaaaacacacaaacgagcuccaaguucuggcaguguuugggucaaggaaaagaguaagaaaacaauaaggaagacagccaguuuuuccccuggccuccacaccugcacacauguacacacagagaaaaagaagauaaaauguuuuauaaagcuugaaaccgcaggguuaagggucaggggaacaaggagaugugcuagcagugucugaugagagacacuuaaggcgcaggggagagaaccccaucugccaaggcuggagacgccacgggguugagggacuggggccagagaggccagagaggugugagcggucgugugccucugggcagcccagacacuccauucccaguguggacagcgcacuggaggagguugucuucacaguccagucuagauuuuaucuuagcagcacuggauggaaagaacaucagagaucguuagguggagcauugaggacauggugaagggggaaggugauggcagugacguggauaaaguugccuucucuguaaagaguccagcacaggagcgagcuuaagcaacaaagcagguucuacauccagguggacccagcugggcugcagcugugcacaagagugccugccaaaagaugggccuggggcaaggacagagcccggggcuggaacacuggagggauggagaagagauagaccuuacagagagccuagggcagugcuucucaaccucccuaaagcuaugacuccuuuauacagguucucauguugugcugacccccaaccauaaauuuauuuuccuugcuacucuguaacuguaacuuggcuaccguuaugaaucaugaucaggaaggauaucugauaugugaaaggcuuguuccgcaaggugagagccacugaccuagaaugaauagcagcuagcaggugcagcacaugagugccagagauaccuguggauuggagacagacagggggagcacccagaauccaaaggcagcaguacuuggagucagcgcagcgccagcagagucagacagcagggccucggcagauccuggggucagugcagcgccagcagagucagacagcagggccuaggcagguggcuggaaaguggagaugagagaggauggugggcacagguuggcuguagaggacagggccuggugcaagaggcccacuggcuaucacaaguccuaugacuuguuggucauuugcuugguuuguagaguaggagaaaugagaucauuauuucauggucuuugcguggaacuuguuaggggagagugucagaucccaaagaaaccuagacagcucacucaauaccguuggcuccuccuggcacuucucaucccacccccacccuaaaccucuccagacccuuccugggucugggcugggauucccuucccucagcuucugauuccaauauaauccagcccuuucgcuguguucucucuuggccucauggucuucagcuccucuuuugguccacuuguccucuccucuuuucuuguucucccccggcccuccccucuccucccauggcccugcucagccuggacucuucccgaugccucugcaugaacucugccuccuauccacaguaacauccuucuccauuggaccuugcaguggcuacagccucacuuucauucagagaggaagaaggugcuggaaagcguugucagugauacugagucucugaaaguugaggauuuauccccaacuagcgaggcaggguaaaguuuuuccuaagcugcccuugccugccugucacaggaaggaagggccccugaagugagacagggagguauugagugggcaggaggaaaggugucaggaacagagaugggaacauggagacuggagucuaaagugagacucccaggcucucuccgaccccaagaaugucacagaaguauucugagcccacuuacucuauuuguagaggaugauagcauaauugauauucuuacagucuagugagaauccuccucagaauggugucucugagaagcagagcaguaaagcggccaguaaugaaugacaagaggccucagaagugaguggcucuguuggucuuuggaacuuugagaguuuccuguguuguuccugguuguuuagcaaugaugugaggacccugcaguggcagccucaggguucuggugaccaagcuaggaguacugguuucugucaagcauaugccuucccaccuucuauguuacugcagaguuugucccauguucucaguguucuuucccacuucaguuacuccccagagacgggaaauguucuuauuuaauagcuaagacgcuaaauaagucauucacagucauccuacacacugaacaugaagucagaacaagaacauggccaucucucuuuccuagaguccccaggcaggagagggaugcacgcagugcugcaggccugguucuagggccuuucuuugguuugguuugguuuuuugaccuuagaugaagaauccucacuuuguaacaucaguccugaccuugugucaccucucuucugcaggccuggguugccaacuaugagagaccucggaugaaugccaauuccuuacuggccagccccacaggccucagccccuaccugcgcuuuggaugccucuccugccgccucuucuacuaccgccugugggacuuguacaagaaggugaggugcggggagcaggcacggucgcccccaggcacagcacuuguugccagucaucccagacgaggccccuucucuuuggcuuugggucugggcugugagaguucuggagacaguucagagaagccagagaugggugguuuccuagaggugacagcugggcacaacugaguuaccgauguggaugaagccagcuucuccugugguucuggagacagaagagcuggccccgagggcuucagagcugguauauuuacuagcagcugauaagugaaggcuugggaccuggggugggaagugagcgucgcggccagaggcagucauaagaagggcacagcugccaucacuggagcugggacugaagucuaaggggaaguccagggccggccuggaagggcugcauacaggaccgugccacgcagcccgcgggcugucagagcaucccacggagaugguccuuagguccuacuaugccuuggauuuuuaguguugcuuucccuagcccugccaguaucagcuucauggaaugggguagcuuugaaggcuugcuguuuguguagaguccacccuaaucuguucaugucucagacuuuguaacuuuuuuaauacaguauauucugaucacagcuccccaugcccugacucccagauucucccuacuuuccacccacucaggucaacagcguuucuuucucugucucccuaaaauacaaacagacaucuacaaaaacagaagaaaacaaaauacaaaaaaucugaauuggacaaaacuaaugaacaggaggaaaaggagucaaagaaaaagcccaagaaaacauauaagcacacacacauauauccacacacauggaagucccauaaacgcacaaaaccaagaaccauaauguauaagcaaaagaccugcaugcugcaagguuuaaaugaaagaaaaaagaaagaaaggaaggagagaaggaaggaagggagggagggagggcaggcaagcccaguauuaugaacuucccccccaccccaaaaauauccucuaaaagcaccuuugcgucaccuguguuggcgucuacugcugcccuuaagugcaguuugcauacccaauaagacucauugcagaaacgaaauucccuuugugagcaguuaucaauuggagguagcuucuggguuagggaugagagcuguguccacuuccucugaucugggaccuugucugacuuuggccugugcaggcagccacaguccugugggcuccaagugcuucaguccugcugucuagaaggccuuguuucggugcugucuuccauccccucuggcucuuacaaucuuuucaucuccucuuccaaagaguucccugagcagaggggagagauuugauguagacgguccuauuuaggacugaguauucugaagugccucacucucugcaauuuguccaguugugggucccuguauguguucccaucuaccacuggaggaaguuucucugacgauggcugagcgaggcacugcguauagcagcaugucuuuaggagucauugcuguauuccuuuagagcaguagaguuugguuuuccuauagguucauggccaccuggacagugucagggauggccccaucucauggagugggucuuuauucagucacauaauggcugguuacucgcauagcaugugugccacuguuguaccagugugucacgggcaggcaccaauguagaucagagggcuugcaacucuguuggugguuaccuuucuccucuggcagcaugcagaguacguuccaguacuaugaacacuagguaguggaggggaaggcucuagguagacaccagcuccaccucucuggauucagugaguuacuuagcuguucagauuucauauuuuaaauugcugaugauguguaaaaucccuucagcuuucuagaagguaaagccacagaauuggaguagucuugaagaguuugguucccauggcagaguucuauagcaucauucccccaccccaacccaccccugaagccauucuuggugcccaaggcagggcugcauguuguacacugagaaucuuuuaagucuaguccugcugcacaucucaaggauuuggaaccauggcgauugggagacacuccagguuguucugugcaggagaccugagcaucgucacagugcuaagagccaggcagacacucaucucuguguaccaugcccaccccuuaggugaagaggaacagcacacccccccucuccuuauuuggacaacuccuguggcgagaauucuucuacacagcggccaccaacaaccccagguuugaccgaauggaggggaaccccaucugcauccagauccccugggaccgcaaccccgaagcccuggccaagugggccgagggcaagacaggcuucccuuggauugacgccaucaugacccaacugaggcaggagggcuggauccaccaccuggcccggcacgcuguggccugcuuccucacccgcggggaccucugggucagcugggagagcgggguccgggugagugcaagcuagccuguacccugugaccaggccuagccaagggcagcuccuuauagacuggggcuggggugggauccuugggucuaggagauccuuucugcaucccugggcccucagcagaagggcucuggcucccugaggguguaauaguguuacagaaguggaaagagccagagcgucaggucuccaaggaggcugguuuuuccucaucuagguauuugacgagcugcuccuggaugccgauuucagugugaaugcaggcagcuggauguggcuguccugcagugcuuucuuccaacaauucuuccacugcuacugcccugugggcuucggccgacguacagaccccaguggggacuacauccgguaaggacacacaccagacucuuuggcucuggagccucccuccuggauugggguacccuaggcccuuuaaagaagagucacagugugcugauacauuaccugggguguguuucaggcgguaccugcccaaacugaaaggcuuccccucucgauacaucuaugagcccuggaaugcccccgagucaguucagaaggcugccaagugcaucauuggcguggacuacccacggcccaucgucaaucaugcagagacuagucggcucaacauugaacgaaugaagcagaucuaccaacagcugucgagauaccggggacucuguaaggauccccuacccccucuggcaucucacucaccaagggaggacgaaaccugaaagcuuuuucagguguuggcugcccccaggcuguaaaagaugcugcaggcugggccagauugggcugccaaagcggcugugggguauuggaaaggguggaggcuguguccugcucuugcccuccuuggcuucuuuguuucucaugaucugcagcccucuuaaucuugugugcauucaaucccccaggucuauuggcaucugucccuuccuguguggaagaccucagucacccuguggcagagccugguucaagccaagcugggagcaucagcaacacaggugaccagucaguuacaccugccucuggccucccuggccuucuguggccugugucaccaccacauuagucauuuagggcugaggccaaaaugagcauguagcugaugaagcuuauaucccaccugggacauacuguaagaccaucacaugagaacauuaaggauuuuggagggagguagcacugaguggcuugaugugggacuaggaauggggccucuuuagggccgcguuagauaggagaagcccaagggcaccucuuuaagcaucaucuugauaagaaccaggaaaggaaauaucgagaaaggcccccaaagcaggcacaagcagaguccacuguaggagcagaaggauccagagccagggaggagggaagcagagcagcuuuggcacaagucgcccugccuuccugcacugacggaggccccacugagguuuuaaaaccccacugccugccacauaaacggaaacaauggggagaugaggaauaaggugcucaggaggcugggcaggagaagccacagggaagagcaagggugcuggucggguucgggaugcuccacaacacgaaaaugcccagaacccugggauuucccgggacugcgaagggaacccucaccuucagagcaaggacggcaggacggcagguaggccaaccagucucuggccuggcgccagggaucugagcaccagaaguuggccuugcugccagcaggccaggccaugcccuccucauauaguuccaagugaggucacugcugcaaaggaggccagggcagggcuuccuguccccacagcaagagacuguuaugguaaguaacuaugaccuguuucugugccucucuacaggccccagagcacuauccaguggcccagcuucccccaaacgcaagcuggaagcagccgaggaaccuccuggugaagaacugaccaagcgggcuagagugacggagaugccuacccaagagccagcaagcaaggacuccugagagugaguugugguuuaaaaagcuguugcuugccagcuggagggccaaacagcaaaccagauuaaaaugcgaucaggguaggacuucagcuuguuuugcuacaguuaugaaucaucauguaaauaccugguagucaggagaucugauaugcagcccccaaagggucagggcccacagguugagaaccacuccuguaaaccuuugcagugguaagggauggcugucuuuguuuauuuguuugagacagagccucacuggguaguugaggauaguuuuggacuuagagcaauccuccugcuguagccauauccuccugagugcuggaaauucagauacgagccaccaugucuacuuuaccuucuaaaauuuaaaaaaaaaaaaauguaaaggaagaggguuuauuuuugaagagugaaacuuagaaguugaaacccuuugauuucuggcgaggguuuaguuuaguuuuguucuguuuguuuacuugaccugaguucuguagguggccaagcgagggugauacugagcuucagauggcaggaaagggcucagcccagccccagaagcugucucugccucugccucagggucucuucucacgggcucuggccgugcacgugccaguccauccucaucuuuucuacaagacuccugaaucauuaaaaaaaaggaaagaaacagagggaaggagagucagucagucuuccuccucucggcuccuccuucccuaaggcaggaaaggcuuuuaggccaguccuggagaaguguggauugcuguccucucaggcuguggacagucucuccuggcaggcucuuccgaccaucugcaucaggagaucggagggugcuuuucaccauggaggguuggugcuuuuucuggucccgaucacucggccucacugaggcuuccgcagugucucgauuuauguccucgugggguggcaggcacuuggugcuuuguccucuagacauugccagugggaggacaagguugugcugccuugucccuggaagagccaccaccauagaugccaugcucuccagugcugagcacagagcgugauggcuucugaacuugcuugguuaauucccugauuuugaggcaagauuaacaaacagaaagauuagauguaugagucaaggaugcucaguaagcugauggcguauaguacagcaugggcguguugccagcagauguauagggacagugacauauaacgcaugccacauuaaugugggauccauccacagugacuuaggaaaggaagacuaacagccuacaguuccuagaaagcugcagaccuggcuuaucgggagagcuguugaugggcugagcguggagcaacuuuacaccacagcaaaaccaauucagaguuuauaugaucuuguacaaauuacauaaucucuaggaggaugguuuccuuccugaaaucaggucauuguccccaagauuaagugcagaugcagucaagagacgugggggugcugcugugggcucagcaucucuaagucccagcucccaaaggcuccgaaacccaacaccgugugagugucaacagggaaaucugugcagaucuccuuaaauucagaaaauccaggcccucacagccugggcccagcucugaaguacucucugcuggggugauuaugaucggguuucuugccuguugagucuggugcuccuggaagacuguuagaccaggcagugagggccccugcagggacuuccuaggagagaagcugcuuguggaacaggacgaucaaaccagcaucggaagcgacuaagcacuggauggggcccuaagagagccaggugcgggagagccacaugagaggaccaauacugacgucaagugacaucaaccagguagaggagugccuuuccugcaccgugucugggugaucaugugucaccuacugagcucccaggggcugguuuucacagcuuaugcccuacaucuucauaagguaguuaagccaggaaaugcucuugaagauggagagagggacugggaggccagacgaugagacaggaguagaguucuuuccaagacagacagugggagcaccauguuucuggaaaccccaagagaaaagaguacaguguacaggcuaggguaucaggaccuugggacccgcaucuguugcauuaggcuugcuagagaaacagacccuacggaacguucauguuuacaaaagaauauauuagauugucuuacucagagggagagugaguccaacaguggccaucugcacaguggagagacuaagaaccaaggaacuucacaaucugcaaggcuggugcugaaggacagaaggauuccuggagagccucuggucuucaaugugcauacaucagagaagcuuaguucugauguccgugaagaauggcaguagcagcagcagcagcguagaugcacuuagcaacaaggagcgcagacagucaggcagaagcagucccacucuucucuuggaauccauaucugggcuacugcuagaaggcacugcccuggggaggcuccuauccucacagacccacucggagacaaggcccuaugcucccaaaucuaaucaagaugacagccaggauuaacccucacaucugugaaccacuuuguagugcuagucagcugcccuaugcugggacacacauaaccggaaugucaaggagaaaaucuagacucucgggugaaaagucuaacugagggaagcacucaggcaggccuugcgugugcuucug

SEQ ID NO: 929 - RNA, 7778 nt, Mus musculus
uguuuguuuuuaaaaaaauuuuuuuuuuauuaaaucacauacaacucagggcaucaggccccaccaacuucauuagaacccaugggaagucggaagcagaggcugacaugguuuccccaucuucucacgaaagagacaaagacaucaaacaugacgccaaggaaaugaggguacaaaaggccaaacagaagggacuaggacagugacagcuacccugaggauaggaggguguggugcugggcaucguggucugagugcuucuguccccaaauucauguuggaauccuucuguugaaggcuuuggggugaucaggucauggggcggagcccucccagggcuagugcuccuauacaagaggccugagggagauuaucugugccuuuaccaagugaggauguggacagggguuuccucagaaauacugggucuaugaguaccuugaugugggcuucgcugcccccagaacaguuauaagccaaccuccacuguucuuagacacacggccuaggcuauuuugugacaggagccugaugggauaacuccgagaaucagugcgcuccuccggccccagccucagagaacauaagccuaccuucaugagaggcucagggguccaagcagaugggaacagaggcugaguggaccccacuuccugccugaagauggagguguuggggaggaggcuaaugggggggggaaggggaagggaguacagaaagagaguauagccagauagcugggucagguguuggagaacaggaugguggcccuucugggccaagagaagccaggcagggaaagugggguuaggggcuguagaggcauucaucacuccacuuaaucuguaaaacguguggcucccccuuuucuaaaguugaaaauaugaaguguggaggugucagucaccccauggacaguuggucugucauacccauccacacagaagagggcagaauggccaucucucucucucggcucagcucccaacugccuccaaagguagucugaaguguuauugauguuaauagcaccuagcuauuaugcuaccugcccagggccccagagaugugggguuacacagcucccuucaacuagcuauaguagggucacaacccaucucccuuguguagaaaguaagacaucacuucaucaguccagugcccaaagagugcagcuggccccaaccccagagaccauauggagguagacaggccccaggaggaggcaggaagggugccacuccugguagggcuuucccaagacuagaagauggggcaggcaggagauuuggcagcuuucugacauuaucaggaaagaaccuggcucuucuuagauggucuucugagaaggauguaaacauuauugcucagggccauacccaguaggcucuaugggaagccuuccgugcugggcaggccccacccgagcucagcccuggcucccugaaggagcucacacccugauagcacucuucucaccaucuuuggagcugggguccuccugggucuucugcaucucccagccccugacccagguguaggcggaggagccacccagcaccaucagguugcuuguccaccacaggaagcucuuaaucucuucguaguagagcacggccagcacugucugugcacaggccuuggccgugccugacacguuaugggucaggggacuggugaauuugaucugcaguccugucacauagccgauggcaaagccaaacaggccacccagcgucaucaugagccagaagugggcacugcucagaugagugaaggccaggagggcacggagcucgcccagcacuaucaucaggggcaagaagagcacgcaggcauugacauuguuauagaagguuaggcgccagauacuguggucuacugcagggagcaccuucuugguauagauggcauugagggagacgcagaggcuggccagcaccccgaagauggugcccgucagggacaagguucccucagcuccuucuuggucuauacccagccagaaaccaccugcaacagacagaagagugacacgguaaggagggaugaggacaggagggagagggacaggauucugacaccaccguucugacuguuccauggcccuuaccucaucaucaacacauacaaagucuaaccccugcacuaagaaagggccgagggcguggagcccagagugagaaccuguguucccccucuguugggggucaguccuguguacuguguauucaccugcugauuugggggcccagacaucuggauacaguacagguuacgggcaagcaucucaagggucaagcaucuccauccucagugcuauguaaaaacuguuuuuccaucaucucugauugguuaauaaagacucaaucagccuaugacugggugggagaggacaguacagaugggacaucgggucccagugagagggucccugguagagagaggggagaaggaaaaguguggagaggccauguggggaaaucaggaggauucaccaugaggucacacauggagcagagcaagccagagaaagacucggauggcaagcauuggggcaucuaucugggcauuagcagcuuagaggguuagaacagcucagaaccugcccagcagagugccagcaguuuguuaaugaaaauaccagguuucugugucauuuauuugggagcuauaugggcuaaagugggcacagaaaugcccugcagauaaagggagcaaagcagggggugggggcagggguggggggguuauaacuuccccaaauuucaccaauacccuccacauucucccaggcagaacuuagcagagggggaauauauaaggacagaugugacccugucaacucucuaauuacaauuguagucauuguaaugaaggcuauaaaauaaaauagcauaggugccugauggccugugggggccaacagcuguaaaggaagagggccaguaaagugaccuuggacacuaaaaagggacagggcucuaagccuugguucuggcucccuuggugagaacauuaggucagagcugcucauggccugauguuguuuacagucacuccugggucacccccccccccccccgcccccugcucaaagaaccuacauggcucccuaggccacagcaccgggcuuccugcaucuagcccgacuuccucugucacaugauggccccaagccaccuacuuagcuccccacuucucuguauauccacagagcucuguguaucugcaucuuuccagggacuccaccauucuucaaggccaaagucagccucuccuggggaucccuuccucauccccccaguacucagccucuucccagcuuccugcugcuaacacagcauuccuugccacccccaguugguagaaaccugcuuguggcaaugcuauggucucuuuauuuagacuccucauuuccacaaggcagagguuuacugcugcugcaggaauuagcaacauggaauagugggaccagcacaggcaucagagccaucaggccccugccuguucugugauuuuuguagcugagcugcuugggagaaguuacuuaaccucucugaguuccaauucccuucaucuguaaaaacuggggccacguuuuugcuacuauguuaaccaaucuacuacucugucuuacaacuaaauaaucuuucuacaguggauauuuccuguggcucccaacugucuucaggaaacauucaaauguguguucccagccuguacuacuggagcagucucaugccagcaaugacuuuucagcuaggccugcucagguuaucccacaugcucccugcucccucuagauacccacagcccuuagcaucuaguguaacuaucguuucugccaucaacaucauucacggaccaggagcaaggaccccacccuuccuuucucaaacuuguacccuaaaacucaguacagggccuggaaaauacuuggccacaagcuaauagcugcucaauggauggagugagagcagauagagacugcuaggagaaagguacaagucuucaagaagcuggagagaggcaagguggugcuccugcagccccaguugccugggacuugagggcaacauagcaagaugcuaucucagaacaagggcaccagacucuccagccucacaggcacuuggcucagcagagcccacgguggguuucccugcacagucagagcacccuguaccuccuggugguuaccacuagagucuagaagugacuccauucuucauucucaagguccuagacccuagaggggcugugagcccgacaggcuuugcaaagugccgcaugucuaggaggccuuuccagagaugggccuucuccacaggaggaagggaggggagagccaagagauggggccaguagugggggcagcagagagcuccacuuucccgugccacuugggcaggccgccauggggcucagcugccucacuaucagcuacuugucccuuuggggacccgggcucagguucuccagagacuguaccuuccugcauguaaguucuccuacuaggaggcccauccccucuaacguuggcagggcugguggacugaagugggaccccacgguagcuuguaggcuggaaggaggaguaccagaucucuuaggguauguaugugggggcagugggaggcauccugccacuaucugaccucucuccgcccagaccccuuaacccuggauccaggagcugcccaaccagggcaauguuucuagggaagacaguacagguuggccuggucccuacaucuagagcacccagccugggccucagagacaccagggacaucuaaauaggccaaacaagacgaacuaaaauccagagcagguacaaaugaagguugcuuuucguucauucaggacucugaggggaaagaugcccuggucucuguaacccagcagccacuaaauucauucaaaguggcaaacauguucccuaacacaugcuguccaagccaagaggcccuugcuccaugugacugccgggcacugaaaagauguuggcggaaucaggacauaguggcugccguuaaggggccggaugcuucaaaguuccugggcuuucauuuaaaagcacauuuagacuguagugauaguguugguuuucauugcgcuaacucccaagggucaggagcaaagcagacuggcuugaaacacaggccagggaguaugaccaacuggggacugcgucccagacuaucugcuucuuaguuguggggcuguggcaaggagcgcagccucuccgagcugcaguuucacagagaugccgccacucagagagcuuauggguacaauaaagaggaugcuacaaguguaaugaucagcacaacgcuccuaucgguaauuaauuacuuauggucacaucugagaagguaguuaaagccucuuaaagcacacacauauugacuggaccacugaaauggcucaguggguagagguacuugugccaauugugaugaccugaguucacccuugaccucuugagaacagugguguguuggucaagaguguaaccuauggagguaacugcuuaugugcaaauuucugcuacgucagugauuaccugugugaucccagcuacuuagcuucucugugccuuggguuucucuccauaaaacgcagcuauauuauaccuuguaauggggauccguuacauuaacauggcucaaaugcuuagcuagaucugagugucuggcuggcuuugcuguagugucugccuaacauuauuauguucaccuuggcuggaucccuaacuuacugagucacaguaaggaaguuauuuguucucuacaggucucucccuaugacugguggugcaaaagaccugggacagauaaugaguaaugugguauugaucuuuacgauuccugcuccccacgcccccagucccacucaccaaugaugacgccgcaggugagcagggcauagaaggaaguggucuguuugagcagcagguaggagagaagaacguugaacacgguggugagcgagcgucccacguuguagaagggcaccccuacguacuugaggcagagguuauugaagguuaucaugccgauaaagaccacugacagcggcagcacacuucgggccaccuugagguccagguuuaggguggggaagucuaccaugccggggcagcagguggccagagugcugaggcccuugcacagcagugaggucaccaggcauugguagaaggugacaaaaauggggguauccagcugcagggaggggcuguccagcagguacuuguugaggaauaccauggaaauggaggugacccaguagagagagaccaccagcgcgaucugcagagcccggagcagaaauggcuuguucccgcucucugacuccucggagacagcagagacuccagucagcgccaugcgcaggauccuggaccgcuucagaggcgcccuguucaugguggcagaagagcugggucaccuuacggccagaagcagucccuggacuacagggcuucaagcagcuagggucuguggcugcagccuucaacugucacaugggaugaccuaucgguccccuccuucuuggaugaaguucugcuuccggauuugccgaggugcaccgcuccucaucuugcucgcucccggggcgggggagggagguggugucacgaaacaagacccagggaagggagaaggggccuaacuaaggaugugggcuuugacagccauggccaguuugaggacaggggacacgugagucgcagggagaaaggaagcgagagagcgaaggaaggacggagcggaggaggaaauaacuggacgcggaccgcgugggaagcaugggcugcgggaacccccggaagcacccgcagagccgaaaggagggcgugcugcagggagaucaccgaggcucaggaaggcgucucgagggacacggacaggggccugaccggagcaaggcccugcgguugccacgagccgaauucaaguuccggcucagcgacgcgggucccgggccacuuaccgagcagggcgggcccugcgcgcauuuccugacacgccuacgagccgccuuaaagggccagcucgcaggccguugccacuucccgcggccgucaagagcuccccggcaagucugcaccuaugcccacagaccugcccucuucuuccgggaguccccggagaucagggaaggguuugcaagugcuauagccucucccauuuucuggaagguucugucauucuccccuccacccgcacuaucuuuuccccugauaucuucagaucgaccagacucggucaggugcaucuucaccaucuacccagaaaauggaauaccaccuuucugcuuagggagacccccccccucccuccgcccagcccuugcgcccggcuccccaccguugcaccucccucgucccucgagcucaggccacucgggaagaccuuguugcaguccucuccuuuuuuccuaccccuauuuucaccgcuuccagaccuagucaggacaugaagucccggagauccaagcagcacuuccagaggcgagaagccaugucaccuccuccagauaaaguccauucuggaugcccagaccaaagccucugagcuucucaaugcuguauccccuucccggggcccuuucccuuccagaacguaccguccguccacccgacugggcucugguguccuggcugaugcagggaccuggugcucacccucggcggugcccucgggugcaccugcagcaccacccucggcugaacuugcaacgcugcccaagccgcgcccccagua

SEQ ID NO: 930 - RNA, 7778 nt, Mus musculus
uacugggggcgcggcuugggcagcguugcaaguucagccgaggguggugcugcaggugcacccgagggcaccgccgagggugagcaccaggucccugcaucagccaggacaccagagcccagucggguggacggacgguacguucuggaagggaaagggccccgggaaggggauacagcauugagaagcucagaggcuuuggucugggcauccagaauggacuuuaucuggaggaggugacauggcuucucgccucuggaagugcugcuuggaucuccgggacuucauguccugacuaggucuggaagcggugaaaauagggguaggaaaaaaggagaggacugcaacaaggucuucccgaguggccugagcucgagggacgagggaggugcaacgguggggagccgggcgcaagggcugggcggagggagggggggggucucccuaagcagaaaggugguauuccauuuucuggguagauggugaagaugcaccugaccgagucuggucgaucugaagauaucaggggaaaagauagugcggguggaggggagaaugacagaaccuuccagaaaaugggagaggcuauagcacuugcaaacccuucccugaucuccggggacucccggaagaagagggcaggucugugggcauaggugcagacuugccggggagcucuugacggccgcgggaaguggcaacggccugcgagcuggcccuuuaaggcggcucguaggcgugucaggaaaugcgcgcagggcccgcccugcucgguaaguggcccgggacccgcgucgcugagccggaacuugaauucggcucguggcaaccgcagggccuugcuccggucaggccccuguccgugucccucgagacgccuuccugagccucggugaucucccugcagcacgcccuccuuucggcucugcgggugcuuccggggguucccgcagcccaugcuucccacgcgguccgcguccaguuauuuccuccuccgcuccguccuuccuucgcucucucgcuuccuuucucccugcgacucacguguccccuguccucaaacuggccauggcugucaaagcccacauccuuaguuaggccccuucucccuucccugggucuuguuucgugacaccaccucccucccccgccccgggagcgagcaagaugaggagcggugcaccucggcaaauccggaagcagaacuucauccaagaaggaggggaccgauaggucaucccaugugacaguugaaggcugcagccacagacccuagcugcuugaagcccuguaguccagggacugcuucuggccguaaggugacccagcucuucugccaccaugaacagggcgccucugaagcgguccaggauccugcgcauggcgcugacuggagucucugcugucuccgaggagucagagagcgggaacaagccauuucugcuccgggcucugcagaucgcgcugguggucucucucuacugggucaccuccauuuccaugguauuccucaacaaguaccugcuggacagccccucccugcagcuggauacccccauuuuugucaccuucuaccaaugccuggugaccucacugcugugcaagggccucagcacucuggccaccugcugccccggcaugguagacuuccccacccuaaaccuggaccucaagguggcccgaagugugcugccgcugucaguggucuuuaucggcaugauaaccuucaauaaccucugccucaaguacguaggggugcccuucuacaacgugggacgcucgcucaccaccguguucaacguucuucucuccuaccugcugcucaaacagaccacuuccuucuaugcccugcucaccugcggcgucaucauuggugagugggacugggggcguggggagcaggaaucguaaagaucaauaccacauuacucauuaucugucccaggucuuuugcaccaccagucauagggagagaccuguagagaacaaauaacuuccuuacugugacucaguaaguuagggauccagccaaggugaacauaauaauguuaggcagacacuacagcaaagccagccagacacucagaucuagcuaagcauuugagccauguuaauguaacggauccccauuacaagguauaauauagcugcguuuuauggagagaaacccaaggcacagagaagcuaaguagcugggaucacacagguaaucacugacguagcagaaauuugcacauaagcaguuaccuccauagguuacacucuugaccaacacaccacuguucucaagaggucaagggugaacucaggucaucacaauuggcacaaguaccucuacccacugagccauuucagugguccagucaauaugugugugcuuuaagaggcuuuaacuaccuucucagaugugaccauaaguaauuaauuaccgauaggagcguugugcugaucauuacacuuguagcauccucuuuauuguacccauaagcucucugaguggcggcaucucugugaaacugcagcucggagaggcugcgcuccuugccacagccccacaacuaagaagcagauagucugggacgcaguccccaguuggucauacucccuggccuguguuucaagccagucugcuuugcuccugacccuugggaguuagcgcaaugaaaaccaacacuaucacuacagucuaaaugugcuuuuaaaugaaagcccaggaacuuugaagcauccggccccuuaacggcagccacuauguccugauuccgccaacaucuuuucagugcccggcagucacauggagcaagggccucuuggcuuggacagcauguguuagggaacauguuugccacuuugaaugaauuuaguggcugcuggguuacagagaccagggcaucuuuccccucagaguccugaaugaacgaaaagcaaccuucauuuguaccugcucuggauuuuaguucgucuuguuuggccuauuuagaugucccuggugucucugaggcccaggcugggugcucuagauguagggaccaggccaaccuguacugucuucccuagaaacauugcccugguugggcagcuccuggauccaggguuaaggggucugggcggagagaggucagauaguggcaggaugccucccacugcccccacauacauacccuaagagaucugguacuccuccuuccagccuacaagcuaccguggggucccacuucaguccaccagcccugccaacguuagaggggaugggccuccuaguaggagaacuuacaugcaggaagguacagucucuggagaaccugagcccggguccccaaagggacaaguagcugauagugaggcagcugagccccauggcggccugcccaaguggcacgggaaaguggagcucucugcugcccccacuacuggccccaucucuuggcucuccccucccuuccuccuguggagaaggcccaucucuggaaaggccuccuagacaugcggcacuuugcaaagccugucgggcucacagccccucuagggucuaggaccuugagaaugaagaauggagucacuucuagacucuagugguaaccaccaggagguacagggugcucugacugugcagggaaacccaccgugggcucugcugagccaagugccugugaggcuggagagucuggugcccuuguucugagauagcaucuugcuauguugcccucaagucccaggcaacuggggcugcaggagcaccaccuugccucucuccagcuucuugaagacuuguaccuuucuccuagcagucucuaucugcucucacuccauccauugagcagcuauuagcuuguggccaaguauuuuccaggcccuguacugaguuuuaggguacaaguuugagaaaggaagggugggguccuugcuccugguccgugaaugauguugauggcagaaacgauaguuacacuagaugcuaagggcuguggguaucuagagggagcagggagcaugugggauaaccugagcaggccuagcugaaaagucauugcuggcaugagacugcuccaguaguacaggcugggaacacacauuugaauguuuccugaagacaguugggagccacaggaaauauccacuguagaaagauuauuuaguuguaagacagaguaguagauugguuaacauaguagcaaaaacguggccccaguuuuuacagaugaagggaauuggaacucagagagguuaaguaacuucucccaagcagcucagcuacaaaaaucacagaacaggcaggggccugauggcucugaugccugugcuggucccacuauuccauguugcuaauuccugcagcagcaguaaaccucugccuuguggaaaugaggagucuaaauaaagagaccauagcauugccacaagcagguuucuaccaacuggggguggcaaggaaugcuguguuagcagcaggaagcugggaagaggcugaguacuggggggaugaggaagggauccccaggagaggcugacuuuggccuugaagaaugguggagucccuggaaagaugcagauacacagagcucuguggauauacagagaaguggggagcuaaguagguggcuuggggccaucaugugacagaggaagucgggcuagaugcaggaagcccggugcuguggccuagggagccauguagguucuuugagcagggggcgggggggggggggggugacccaggagugacuguaaacaacaucaggccaugagcagcucugaccuaauguucucaccaagggagccagaaccaaggcuuagagcccugucccuuuuuaguguccaaggucacuuuacuggcccucuuccuuuacagcuguuggcccccacaggccaucaggcaccuaugcuauuuuauuuuauagccuucauuacaaugacuacaauuguaauuagagaguugacagggucacaucuguccuuauauauucccccucugcuaaguucugccugggagaauguggaggguauuggugaaauuuggggaaguuauaacccccccaccccugcccccacccccugcuuugcucccuuuaucugcagggcauuucugugcccacuuuagcccauauagcucccaaauaaaugacacagaaaccugguauuuucauuaacaaacugcuggcacucugcugggcagguucugagcuguucuaacccucuaagcugcuaaugcccagauagaugccccaaugcuugccauccgagucuuucucuggcuugcucugcuccaugugugaccucauggugaauccuccugauuuccccacauggccucuccacacuuuuccuucuccccucucucuaccagggacccucucacugggacccgaugucccaucuguacuguccucucccacccagucauaggcugauugagucuuuauuaaccaaucagagaugauggaaaaacaguuuuuacauagcacugaggauggagaugcuugacccuugagaugcuugcccguaaccuguacuguauccagaugucugggcccccaaaucagcaggugaauacacaguacacaggacugacccccaacagagggggaacacagguucucacucugggcuccacgcccucggcccuuucuuagugcagggguuagacuuuguauguguugaugaugagguaagggccauggaacagucagaacgguggugucagaauccugucccucucccuccuguccucaucccuccuuaccgugucacucuucugucuguugcaggugguuucuggcuggguauagaccaagaaggagcugagggaaccuugucccugacgggcaccaucuucggggugcuggccagccucugcgucucccucaaugccaucuauaccaagaaggugcucccugcaguagaccacaguaucuggcgccuaaccuucuauaacaaugucaaugccugcgugcucuucuugccccugaugauagugcugggcgagcuccgugcccuccuggccuucacucaucugagcagugcccacuucuggcucaugaugacgcuggguggccuguuuggcuuugccaucggcuaugugacaggacugcagaucaaauucaccaguccccugacccauaacgugucaggcacggccaaggccugugcacagacagugcuggccgugcucuacuacgaagagauuaagagcuuccugugguggacaagcaaccugauggugcuggguggcuccuccgccuacaccugggucaggggcugggagaugcagaagacccaggaggaccccagcuccaaagauggugagaagagugcuaucagggugugagcuccuucagggagccagggcugagcucggguggggccugcccagcacggaaggcuucccauagagccuacuggguauggcccugagcaauaauguuuacauccuucucagaagaccaucuaagaagagccagguucuuuccugauaaugucagaaagcugccaaaucuccugccugccccaucuucuagucuugggaaagcccuaccaggaguggcacccuuccugccuccuccuggggccugucuaccuccauauggucucugggguuggggccagcugcacucuuugggcacuggacugaugaagugaugucuuacuuucuacacaagggagauggguugugacccuacuauagcuaguugaagggagcuguguaaccccacaucucuggggcccugggcagguagcauaauagcuaggugcuauuaacaucaauaacacuucagacuaccuuuggaggcaguugggagcugagccgagagagagagauggccauucugcccucuucuguguggauggguaugacagaccaacuguccauggggugacugacaccuccacacuucauauuuucaacuuuagaaaagggggagccacacguuuuacagauuaaguggagugaugaaugccucuacagccccuaaccccacuuucccugccuggcuucucuuggcccagaagggccaccauccuguucuccaacaccugacccagcuaucuggcuauacucucuuucuguacucccuuccccuucccccccccauuagccuccuccccaacaccuccaucuucaggcaggaagugggguccacucagccucuguucccaucugcuuggaccccugagccucucaugaagguaggcuuauguucucugaggcuggggccggaggagcgcacugauucucggaguuaucccaucaggcuccugucacaaaauagccuaggccgugugucuaagaacaguggagguuggcuuauaacuguucugggggcagcgaagcccacaucaagguacucauagacccaguauuucugaggaaaccccuguccacauccucacuugguaaaggcacagauaaucucccucaggccucuuguauaggagcacuagcccugggagggcuccgccccaugaccugaucaccccaaagccuucaacagaaggauuccaacaugaauuuggggacagaagcacucagaccacgaugcccagcaccacacccuccuauccucaggguagcugucacuguccuagucccuucuguuuggccuuuuguacccucauuuccuuggcgucauguuugaugucuuugucucuuucgugagaagauggggaaaccaugucagccucugcuuccgacuucccauggguucuaaugaaguugguggggccugaugcccugaguuguaugugauuuaauaaaaaaaaaauuuuuuuaaaaacaaaca

SEQ ID NO: 931 - RNA, 6492 nt, Mus musculus
cggagacagcagagacuccagucagcgccaugcgcaggauccuggaccgcuucagaggcgcccuguucaugguggcagaagagcugggucaccuuacggccagaagcagucccuggacuacagggcuucaagcagcuagggucuguggcugcagccuucaacugucacaugggaugaccuaucgguccccuccuucuuggaugaaguucugcuuccggauuugccgaggugcaccgcuccucaucuugcucgcucccggggcgggggagggagguggugucacgaaacaagacccagggaagggagaaggggccuaacuaaggaugugggcuuugacagccauggccaguuugaggacaggggacacgugagucgcagggagaaaggaagcgagagagcgaaggaaggacggagcggaggaggaaauaacuggacgcggaccgcgugggaagcaugggcugcgggaacccccggaagcacccgcagagccgaaaggagggcgugcugcagggagaucaccgaggcucaggaaggcgucucgagggacacggacaggggccugaccggagcaaggcccugcgguugccacgagccgaauucaaguuccggcucagcgacgcgggucccgggccacuuaccgagcagggcgggcccugcgcgcauuuccugacacgccuacgagccgccuuaaagggccagcucgcaggccguugccacuucccgcggccgucaagagcuccccggcaagucugcaccuaugcccacagaccugcccucuucuuccgggaguccccggagaucagggaaggguuugcaagugcuauagccucucccauuuucuggaagguucugucauucuccccuccacccgcacuaucuuuuccccugauaucuucagaucgaccagacucggucaggugcaucuucaccaucuacccagaaaauggaauaccaccuuucugcuuagggagacccccccccucccuccgcccagcccuugcgcccggcuccccaccguugcaccucccucgucccucgagcucaggccacucgggaagaccuuguugcaguccucuccuuuuuuccuaccccuauuuucaccgcuuccagaccuagucaggacaugaagucccggagauccaagcagcacuuccagaggcgagaagccaugucaccuccuccagauaaaguccauucuggaugcccagaccaaagccucugagcuucucaaugcuguauccccuucccggggcccuuucccuuccagaacguaccguccguccacccgacugggcucugguguccuggcugaugcagggaccuggugcucacccucggcggugcccucgggugcaccugcagcaccacccucggcugaacuugcaacgcugcccaagccgcgcccccaguacgacuuccugccacgucgggcuuugggcaagguggggcgauuacccacgggagcccaucaagaaagccucuuuccuuuaucuaaggucaacgccaucucccacccuccaccccagcuagccugggacuccuccauucuguuacugucguuuggcgcaucccuugacaagaugcaucuuuggcccuauggguccaagcuggugcuuccagaagggcgugguugggagaacugcggaugccgccacuccccuacgagaguacccuucucagucccgggaaccaggcuugagugggccauuagcuccaggucuuuuacaccugggcaucuggaagggcugacuuuucucugguuucucccuagcaccauuguuggacaggcaaguuugcccuagguugagcugguuuuauuauggaaauggcuaacacaguggguuccagacuuauugcuuaugugguugguuauaaagaugucucgcuuaaaguauuucaauuacuauuuuauuaguagggccugaugguaaagggcuuguaaucccaauugagauaggaagaucaaaagcucagccgcgcagugguggcacacgccuuuaaucccagcacuugggaggcagaggcaggcaggcggauuucugaguuugaggccagccuggucuacagagugaguuccaggacagccagagcuacacagagaaacccugucucgaaacaccaaaaccaaaccaaaacaaaaaauguucaaggccugucugaguuacaggauaaaauucaaggccagccugggcaauuuagugagacuuguuucaaaaaggggggcuugggcacacauaccuagacaugaauaaaggguuggagaucaagcucaguguuauauagcucaguguuagagugcuugccugggaugcacaagguccuggguucaauucccaggacagcaagggaagagggguggggaaucaguacugauuugucaaaauauaaaauugaaacacauuuagcuauagauuugcugguuuuaauggacagcuccacuucuaggggagacagugauugucucuuucagagaacauggggggagagcaccuccugugugccugaccaggggcugcaugugagguagcuaagcaaagguauuagaguguuuuugagaucacuguuguuaguauuccgucuaagcuccaccccacaguuaccuggcaauagccagguaggccuggcacacuauaaaaggggcugcuugcccccuccucccucucuugccucuugcucucuugcucccucucauucccuauuuccuucucccucucuccacgccauaauggccggccuguacuucucuacucucucccucucucugccucuacuacccucuuaacucccuuccccauguccugaauaaacucuauucuauacuguacuauuguguggcuggucccucagggggaagggaugccuugacacgggccuggcaaggcaccucuguuccccauacuuaaccacaccccauagaacauagucuuauaucucucuaucuuuuuauaaaugcaucaacugucuuauccacagcauucuguccuuccggagaggcuuuuaaguuacucuggggggccugccgcuggaagagggagcccucacagacaacauugcucaaaggacuuccuacgcucagguugcacggaaguuagacuccagacauaauuuaucagccaucuuaccaaucucauuuggagcauuuuccagaaaggaguucuuacaguuggcuuagacaauuguguugaaauuccugggugucagccagggggagaccaaaccaggagacuaaggggccucugucccugcucaucaguguccucucacuguccucucucaggagcucacauccaagcaucagaaccacaacaggggauugaacaauaggaagacguugguuaaacagaccaggugugugugugugugugugugugugugugugugugugugugugcaagcuggcguuggucuuuaagagaaacuggucuguuuugagauuauuccucgagauugccguuugacugugcagcauucggcccaguugacacugugguuguuucauucguggugagugccaagucagugagcucaaccuggaaauuccagugugaagauagaggcagggggggccauggcuaucaugccaguguggggaguuuuagguaggaggauaguuaguuuuaagccagccuggucuacauagugagaaccugucucaaaaccaaagcaaugggguuagaaagguggcucaguggguaagggugcuuucucugcaagcaugagggugcuagugugaacucccagcuugugcauuaaaaaacugggcacagugucugucauuaaucccagcuuugggggaaggacacauaccaaugggccgacugaugucaugcauucguccacauguguccucgggaugaacugucuucacagcuccugcucagugugguccccacugcuugauucagcucccaacucaaacugcugcaagucugggcucagucugcaucaucuugcauaaagaagcuuuaaaguugggcauaagauaugggaguucuuuaaaagagguuucuggggcugggaagaaguuuacuuuuugcugguacuuugucagauacuacaacuuaucuacuccaggaggauuugcaaguuuuucuguaaaggaucaaagagcaaacauuuuaaacucuggauacuagacuuaacauugcuauuuuaguauuguaaacaaaugggcauaacugcauuuaaauaaaacuuuauuuauaaaaacaagcaguaagccagcuuuagcuuacaggcuacaguuuucuuuccauauuacguuauuugucuucuauauauuuacuaauauuacccauauuuuaaagccauugugcucaucugaacuauuuacuccuagacucucuugcagcuagaggugaccauguguuguugugcuuuuggacaaugaguugaacuguugucuuuauugcuuccucuccuccuuucugccuacacugcagaacugaggucuggaagggcaguaucucccugugaccacaaauuacaggacagcuugaggaaagccaaggauggcauauuagagcauagagaaauccuagccucucagaguuugccuaaacucucuucuuugcucugaacugccuucaguuuauuguaggagauaaauaacucuaucaguuaaagccauuauggggaugauagucuuugcuuuuuuuuuuuuuuuuuuuuuuuuugccaaaacagaggccucauggaaacaguucugggugguucggugcugcuaaccucauuguguugaaggccucaggaaggcuucagauuggaugguuacugggccuggacuguucaguuaucaaagcgugaaccaaagccacagaucuucugguagguggcggacuccagaggcagagcagguguucaaggucagggcaggaaagcugagaucaggagugccugucaacaggaggaguaucagucaaaggaggcaucuuucaggcaaagcugggaaagauccagagauggucaggaagccagcuucucuuuuagucacauuuaugagacaucaucuuuauuuccugggcugacuuggcuuuggacagcaugggccuucuuggguguuuugucuugugucaagagcaguguucccugagacucuccauguaucuaucaaagcaaggaagccauuucagauuagcagcccaacucuggggaucaacagaugucauugcucucggcaagggcacgcccuaacaguuaggguuuauggaaggcugggaucuugccaguuguuuaauagccaguccucacaguaccuugugagguggagccaucaucgucucuggucuacccacaagaauaugaagcccagacaugcaagucuggcucaaggggcccuggaggagaaggcuggacagucuggauuuuaauccuggacaguuugccuucugaggugaaaucaacucacccuuaguuuucugcuugaucucuuuggccccuggaugcugugauuuggauaucccuuguaccccaaagucuaugcacuugagauuuguucccuauuaugauaauaaggaaagugauggggucuuggagaaguggaaccugcugggacauuccuggguccuuagaagggaugaagguaguuuccauggacccccaacaccucaggcagcucuucagagggcuuggugagaaaagcuugagcuggccccgcccaguucuguuucuuccugucccacacuggggacaggaagucuuuaugcuccugugugugcuguugcucuggcuacuuucaugaaggacgggugccacacccuuggaccgcuaagcuggcagcugaagaaacuuguuagguuuauuaacagcugcagcaggcaguuaguugcaucagacuuuagacaugccaggucuaggggguguccugguuuggugguuugacuagguuugagccccauagacucauguuugagugcuuggcccacagggaguggcacuacugggaggaguggucuuguuggaggaagugugucacugugggagugggcuuugaggcuuucuauguucaagcucugcccagugugaaaugagagccuccuccugggugccuuuggaucaagauguagaauucuuggcuccuccagcaccaugucugccuggaugcugccaugcuuccugccaugaugauaauggacuaaaccccugaaacuguaaaccagucccaguuaaauguccuuuaugagaguugccuuggucauggcgucucuucacagcaauggaaacccuaacuaagacaacuugcauugcugcuucuuguccuacuacugaaggauguggcugggcccaaauuguccuagauccuaagauaucugccacaggggcaacuugguagcccugcaguugauccauugucuggucucuuccucuagcucuaccauucaccaguuguaacuuccgccucagcugugguaguagggagugugcuggggacaguggcugaugagcaguuauuggcacugaucacccuguggccucagcacuacacagauuaac

SEQ ID NO: 932 - RNA, 687 nt, Mus musculus
cuuuuuuccccuaucuaagccaacucuguguauuuacccacauggaaauucaacaaauaauuucguucuauaccaucacucccuauuuauugagcucuuacuacaugcuagcugccagagucugcuccaugcagucagggaagaaacugccucccaccuagcccugacucacuaaguccucuccaguucugguccucuuuaugcacacaagccagggccccagaguuaaggagcaggugaacuuggagagggcagcuguguacagcucccuuuucugucauuuggaacuguugaaagccuccaacuuugcaucaggauaagcucguugggagagguggcuggaucgaauagaaagacuauuuggagucucucggaccccaaaaugaaaccugaaagugcuguaugcucugagaucuaggacuugccucuccacuuuugacagucugacucaaaagaaucacuuuucgaaggucuauccucuucuauuuuggccuaguuaaaauguuuugcuugugaaauggaagugaccggacaucacauuuagacgugugaugcucaagccuaaaagacaaaaaaaaguuggucuuccaacaggacuuugaaguaccuccaacacuuaagcuucaaagaauagggucagccuuccuuucuuugucuccuucagcucauccaauguuguuccccauc

SEQ ID NO: 933 - RNA, 848 nt, Mus musculus
uuuuuuuguuuuuuguuuuguuuugguuugguuugguuuuuaaaccagcaauaggcauuugacucuagggcauggguagguaagaaccugggacuaauuagucuggcauaaccagaaugcugguggccaccccuagcgucucucccacccaccaagugacaagguaggagccacugcuguugucaacacagaggcaaggcaacaggauggaaggagucucucggaccccaaaaugaaaccugaaagugcuguaugcucugagaucuaggacuugccucuccacuuuugacagucugacucaaaagaaucacuuuucgaaggucuauccucuucuauuuuggccuaguuaaaauguuuugcuugugaaauggaagugaccagacaucacauuuagacgugugaugcucaagccuaaaagacgaaaaaaaguuggucuuccaacaggacuuugaaguaccuccaacacuuaagcuucaaagaguggggaagcucacuguccacugcucuccggaggccagaucaagaacuuacuggucagcuccccuuucuucagcugucguggaggcuaugucacaaccaugagcuagucauuccucuggacuacacaggaacugcaaagguugggggggugacacacucacacaugaacacacagaauaugacguaucugcucucugagaaaaagagauucugcaauuguugaaucucacuggaacucacaagcacuucugacuuguauuugggucagaacucuuccacaguuccacugaaauucugauuuccuccuagacagaggccauccuccuugagaccccacagcucccacaucauguggagauucaucuuua

SEQ ID NO: 934 - RNA, 17703 nt, Mus musculus
uguuucugcaggguguggucccugaaagugggagcugcuccagggaggacagggccucgaggaagagcuaggaaggaagcagaggccggaagcaggaaggccuggcugcugcugugccugccacugcugcagcccaguguccuggggugaccguggguggcuguggacaggcugcagccucucuggcuaucucugaccucuuuaggaacaguucguagaauccccaggaaaacucaguucugagcaugcaccggcacacacccggaguuuccuguguuuacaacucuagagguaauuuuccaaugccaaaggagaaagcaccgaagcccacuuggacugggaccgcaccucuacccucggaggcuggcgaccucccacaucuucuuugaccccaguuucugcuucuuuaaaaugggcccaggcagcauccacucuccaggaugaugagguggguagagggcucuaaguggcuagggcuuaaggaaugugagucccacugccuccuccucccaccuuccucacuaaaagaaaaucaagugagaggggaggggagccuggaggaagagaaggaaucagggauggagggaagacagggagggagaagagauggagggaggaguaggggggaggggaagagggaggagagauugcuuaagguccugggacuugucagcaggaggcauaggaggagacuuggagcuggcucaucccaggugugagaccacacucuccuuccucucucuauccuuacaggacaagucccagagacucuggaagaggaagggggaggagaccuagagcugcccugacaugcucaguccccuuuucugcuuuguaaaugcuuugguaauuuuauacauggaucaaugcauuuagaucacacaccccacucaguccccacucuccaacuccuccaggguuccuccacuucuccuaacuucauguuccuucuuccuuuccccuccuuuccucuuccuuccccccuuccccucuccuuauacccaccguuguuccuccuuuucaaugaguucaaugaguacuucuuguaugcgcacaggcguggggccaucugcuggagcagggacaaccuaccagugaccacaccaccccacccuucagccuacaguagcucccagucaggagugggggucggggugggggugggggcugagccccuccccauccaugcuugauccuguguggaucuugugccaaucaucacagcuacugugagugcaugaguccagcagcucugucguggcuggaagaugcuccuucacagcaggccccacaguccucuggcucuuacaaucuuucugucuucuacuccauggguuuugaaccuuagagggugguaggaagggauuuccuuuccccucuucuuaggcccauccucucucuccccuccccuccccuccccuccccucccgucccccuccuuucucucucuucucucucucccucucccucucauccccacucauccccacccacucaaucacauaugccucugaauggggucugacuuggagugaauccccaaguacaagugaccuaaccucagcccuccugccggugcuggcaacucuucaucuuuccuuacaacuccucagauuaacccaggcccucagacacaguaguagcucauuggagagucucuaggcuucccaggguguggugucaaccccacucuccacacacaugugagaacaaaaagagaggcugaggcugccuuccucagggcucuaaacugacaauaagccccaaauacuccccauaggauuagcaauuauuaccuaaucuccagggagcaaacuaaacacaaggaaauggaaacaucccuguagagccuucuuucuggcugcugcggggagcugagcccucagcagugaacgccaggugcgugcuccaacuagcagggaaggauuaugggaccagggagacauucgcuggugucucaagcuauuuuccucauuuauuuuaauuaauaaguuagcugugugugugguauauguguguucacaugggggugcaggugcacacagcuguguacuuacacuugaaggcgagaggaggacaucagguguccaggacaucaggugucuuccucccuugagaaaggggcugucaccaugguuuuuuaagccaggauguuggcugucacaucgcagagauccuccuguuacuucccugccacuuccagccuccccccauuacauagccugcacagugaaggucaaggcacuugaauuuugugggagguugcauuagaugcacagagcagcuaccaucgacacaguuaggauggcuucaggaggacacauggccaagaaggggcagggcugggaaauguuauucuaucugacucugaagcuccugucuggaccccuggucugguggcugggccacacacacacacacacacacacacacacacacacacugcuacuuuguuuuguaaagcacauuaaugcuuugaccauggaacucucuaacauugaccuccagugagugggaaucucagacuuguuccaagacccaugaugacccaggcagaccuagcuuggucacaguuccaauucuucuuuuaaaaagauauuuucuuuauuuacauuucaaauucuauucccuuccuucauuuccccucugaaaacccccuauuccaucccccucccccugcucaccagcccauccacuccugcuucccuuucuggcauucuccuacacuagggcaucgagccuucacaagaccaagggccucuccucccauggaugucccacaaggucauccucugcuacauaugcaguugaagccuugagucucuccuuguguacucuuugauuggugguuuagucccugggagcucugggaguccugguuaguucauauugcuguuccucuuauggcgcugcaaacccuuucagcuccuuguguccaugcucuaacuccuccauuggggacccugugcucaguccaauggaugguugugagcauccacuucuguauuugucaggcaguggcagagccucucaggagacagcuauaucaggcuccugucagcaagcacuuguuagcauccacaauagugucuggguuugguaacuguauaugggauggauccccaugugggacagucacuggauggccuuuccuucaguuucugcuccaaauuuugugucuguaucaccucccauugauucccuuucuaagaaggaccaaaguaucaacacuguggucuuccuucuucuugagcuucagguggucugugaauuguaucuuggguauucugcacuucugggcuaauauucacuuaucagugagugcauaccauguguguucuuuugugauuaggucacuucacucaggaugauauuuucuaguuccauccauuugccuaagaaauucaugaauucaucguuuuuaauagcugaguaguacuccauuguguaaauaauguaccacauuucuguauucauuccucuguugaaggacuucuggguucuuuccagcuucuggcuauuauaaauuggaggaacauaguggaguauguguccuuauuacaaguuggagcaucuuuuggguauaugcccaggaaugguauaucugggcccucagguaauacuauguccaauuuucugaggaaccaccaaacugauuaccagagugguuguaccagcuugaaauaccaccagcaauggaggaguguuccucuuucuccacauccucaccagcaucugcugucgccuguguuuuugaucuuagccauuuugacuugugugagguggaauaucaggguuguuuugauaugcauuucccugauaguuaaggauguugaacauuucuuuaggugcuuuucagccauucgauauuccucaguugagaaaucuuuguuuagcucugcacccuauuuuuaauaggguuauuugguucucuggagucuaacuucuugaacuuuuauauauauauauauauauauauauauauauauauauaucuuggauguuagcccucuaucgguuguagaguugguaaagaucuuuucccaaucuguugguugcuguuuugcccuauugacaguguccuuugccuuacagaaacuuugccauuuuaugaggucccauuugucaauucuugaucuuagagcauaagcuauuggugaucugaucaggaaaauuuccccugugcccaugcgcucgaggcucuuccuuccuuucuuuucuauucguuucaguguaucuaguuuuauguggagguccuugaucuacuuggacuugagcuauguacaaggacauaagaacggauugauuggcauuugucuacaugcuaacugccaguugaaccagcaccauuuguugaaaauguugucuuuuuuccucuagauuguuuuaguuccuuugucaaagaucaagugaccauagguguguggguucauuucuggguuuucaauucuauuccauugaucuaccugccugccacaguaccaucaggcauagugauuccaccagaaguucuuuuauuguugagaauaguuuucacuauccuggguuuuugcuuguuuguuuguuuguuuguuuguuuguuuuuguuauuccagaugaauuuggaaauuguucuuucuaacucuaugaagaauugaguuggaauuuugaugggguuuucauugaaucuguauugcuuucagcaagauggccaguuuauauccuaccaauccaugagcaugggagaucucuccaucuucugagaucuucuuugauuucuuucuucagagacuugaaguucuugucauauagaucuuucacuugcuuagagucacaccaagauauuuuauauuauuugugacuauugugaaagguguuguuucccuaauuucuuucucagccuguuuauccucuggguagaggaaggccacugauuuguuugaguuaauuuuaaauccagccacuuugcugaaguuguucaucagguuuaggaguucucugauggaauuuuuugguuacuuaaguauacuaucauaucaucugcaaauagugauaauuugacuuauuucuuuccaauuuguauuccuuugaucuccuuuugcugucuaauugcucuggcuaggacuucaaguacuauauugaacugguagggagaggguggcacaguuccaauucuuacaggccucauugcucacuggcugaggcuugggugccagaucaaguaaguacaaacaggagucaggaaagucuagccccagcucugccucuauuuagcucuggccuuuagggagaggagagagcuaagaacuccaucccugagaugcagugagugccacagaugcgcugggcccuccccauguuugcacaagcuuuuagaaucugaagcauuuccccaacaggcuucaugugggaacacuggcaggcugccugucuaaacaacaucuaggcuccuucccugacuccagccaugagccuguguagcugucagcuauugccacuggcaaugcugcaaaacaaaucuucccccacauuagccacucacagucccagaaauucagccacacauugcuguaccuucaggugacugaccguggugccuccagcccugagcucaugggcagguucagccugcaccucugugggaggcugcaggucacacuuggguuuacuauacaggaugaugaaggauaguuggaggacaucauccugcacagcagcugcuccgggaaagcauauguucucaucacaguguccgggaccagcucuguccguacuaauagaccccuucccagguucuguccuucugcucaaugccaagcccauuggcagaagugcaggagccucauucuuucccauccacguaaggaaggugagcauuggugagccacaaaggaguggaacacagcaggaagaacccagcuuuaauaugcaaauagaaguggcccauuugaguuauuacugacucaggucuccauugccaguccugaguuugaaugcugcagugauugacagagucucagguugugacaggagcucuuauagguaaucagagcaugggaguugauuucuugacauuugauaagcccaaguccucuuggcaccugccucuguaaggcuccuccuguggaggcugguagcccaggccugcccucccuccccacccucuucuggauggcuggagcuguggagugugggcagacagggcugcacugucucacccagcuguugccauugcagcuaacacaccucuccacaagaagagaagcagagagguugucugccuuguggaaaaugguugccucauacccaagcgguagcuuaccauggacagccagcuguuccuaacauggagacaaagguggcaugcgugugacugugggcaguguaagggcuggaggguggugguggcaggagacagagcugggcugggccaguacaguuugugaggucaaaguaacuuccucucuggccucagauucccucccugucuauggugugagugaggggcucuggaagaucuuucuuuuaagcaaagccucuuugguccaaagacuagauucuuaggccuggugugacucaguuagugaagucuguguaccuagaauccuggcuuugauccccugcacuucauaaagacagguggagcgauaaucacugcauucaggaggaucagaaguucagggacauccuaggcuaucuggugaauucaaggcuagccugggauaaauuaaacugucacaaacauaaagaagugagagcaaaaaaaaaaaaaaucaaaacuucucagcccuuuccuucuuucugaucccuucucuccaggugccaguguaugcuaugacccucuccuuucugucagugugugcucuuccuuagcuccaggauugcuguacuagagguggguuccaggcagggcaggcaaggcccucacuccaaguaucucuauacaugagcaagugacgcucccagaugcaggcuccaguggccucccgcuaaggcccuggggaaaggagagacuuuucaagaaaaaggucacccaguaguuuccagacagaggcuguccuucuaccccacauucagcuucaugugcucucuggugcuccacacaccccccccccccccccgccagguagcucaaaugucuacagacagaggagcccucucucucuggauacuggcagccuacucuuugacaaagguucacacuagaaaagcauuuccaggcagggauaugaagaaggcggacuccaucuuccccaccgcccaccgccucagcucacccuuaguuccucaucucugaguguuccuacccuuuguuuaaaccuccuuccagguugguccacugaguucagagaucaguguuguaaccugguuccugcauccaaauugccucccucagccccagaccugcagacaggugguuaaaacaauuggagacacauacccgcagcuuggaaaaaccaagagaaagaagcaguugccagaaacuucagagaccuaugauacauagaaagggauaccuggaggagcugugccuuuagcagagagacccagcccguuagagcccacccggaggcuaauggaaggcgucacaguucccaagccagugagggaugugcaaaucugugcagcacugguguguacagagaccacgggugcauucacacagguggaagccguucugauugccaggacacugaggcaaacaaugugcuuggucaacucagcuacagagugugaggccugcucagaagcaggcuuggaggcaggguagccugggcucugaaagcagugcuucccuccucccuaaaggaagaaugugugaugcaaaggaaggaaggaaggaaggaagaaaggagggagggagggcgggagggaggaaaggaaggagggaaggagggagggagggaaggaaggaaggagggaaggaaggaaggagggaaggagggagggagggaaggaaggaaggagggagggaggaaggaaggaaggaaggaaggaagguagguuaggccuggagguggaagcccuaugacacuugaugcccuuggggaugucacugugugcucugcauagucucuaacucccauaggcagcuccagccuccgccuucuggaucccuggcagcugcuggucuucccagugggaggcugggagcccgaggccugcagggagcccagacagcugcugacaccagaccucaggguggagguagaacaucucaaacgucucucaaagguccagggaagcuguuuauuccagcuuccugccaggauggaggguucgaucacaguccccucuucucugaauuuaaccagcuaagcacauucucaaaccccuccccaugcauggcuccuccugacuugguugggcagccaggucucucagcgaagcuuggaaauggacagagagcccugaagggaccuauggcuucuguacccuccgcagcugggggcccagucuugucuccaaaggagccuugcagaaaggagcuggggaguccaacacucugccauuggugcuuccucggcauccuuugucauggccugcauagcuaguggcaugggaacuucucagucauugagcaaggcucacccuuugccugccuguguguuugagagucgccauuguccagggccauaaaucaaccucuuuaauuaucauccgugacacauuuuggcaggaaguggacuugguucugcugaggauggagugaagggucaacugcaaauaugcuuaaaacagugcccugcccugaggaucagaggucacgcugaguaacauccugugagugacaaagacugggaggaguuacugucacacacaggacucuggcauggguggcacuagagcauuaaaugcaccagcuacaaagaagagggaaaccagccugaaggacaagugggugcuuucuccccaguuccucuccuccacucccuuccucccuugucuccuuccuucuuuccuucauuacuaacuuucucacuucuucugcccccuucuucccuccccauucccuccaccccacuuccuuucucugguaaagaacccugcccuaaauguuuuuguauggcugucccccucuuaauauucagaagcuucgacaugccagacucgugauugggcucagccauagccuggcugugucccuggaagcuuccagucugccugacacaucuggcauuuuggugaggaccgauacugaccacaaacggcugaaguuuguuuggucuuggcucagaguagggagggagggagggagggagguuauaaguggaugucuauuguugacaugggcacagccacgucagggacacuaaugucuuagucccgugggagugaccaagccuucuuugagugaggcucagagggacagcaaaaccucccuuggguccaaguacagaugucgacugugugccagaaaugcuuacaguagauuucuccccguggccugaagacuguuccuacugugauuuagugagccccaaccccuuguucagcuguauauaauaacccugcuuccauguuuagcuguauguaauaaccccaacuccuugcuuaucuguaugcagcaacccugccucccuguucagcuguagauaauaaaugcccugagcauggcuucuccagcacagagcccagcccguucaaucccagcuuuccacacaugugucucugcuucuguccuuucuucauucccuccccacaccagucaggacuguuucggaagcccugcugaguguagcgguugagccucagagaauaccuccucuggccuugcuuguucuuggaaacacuaagcaaccugcaccaggaucuuuccuucacaaacucaccagcccugagccaugaaccauguuaguccuugaaguccccaugcuacucaccuuugucauaucagaccaguaacugcacgguaaggaccagcagccugcaaaagugaccugacauuguccaacaugagucaccugaaucaauuuguauggcccuuccagaccucccuacagaagccacaguguccucccucucuucacccucccucugauccaccaggggagggcauagcguagaugaaccugcauggcugagcaacuuccuuuagaagucaguuucaggaggaagugaacucagcggacuuccuguggccugagcuggugugaaggacacaggauguuaggagagguccuuugagguaagauacaguaucugaaauauuugcugaguucauucauucacucauuuauucacucauugacucauucaucuauguaauuuauccaucauucaucuauucauuuauucacucguucacucauuuacucauucauacauucauacauucauccaccucacuuauccacucacucaucuauucauuaauucauucacucauuuaaucauuuacucauucauacauucacuuauucauuuauccauccauuuaucuguucauucauucauucauucacucacucacuuacucauucauucacucagucauuauguuuuguaugucuaucacauucuguagcaucuugguucucuaucccugaggaguuuagaaucagucagcagagauguccuauaaaugaacaaggaaauaacgaacugucguugagugacaguaucagguagugggagcaggaagauaaggaaacaggucaggcaaaccaaaaaggcucugugccagaggaagacacggcaggacauccaggggaggcuuuuccguguggugacaugaacaccugagugggguggcuguggggugcuggagguacucuggcagagaaaacugcaggugcaaaggccaugcguccagugcgguaggagccugugugguuugcggcagagcagcagagaggcuguggccacagugcugaaagcggguuggggggaaggguagaggaggaggaggcccaugugugguccccuggaacagagggaaguucaggauacaagaugaucugcauggagagaucuggagauggugaggaugaagaaaggggcauggcugaauagucaaacugguacuugaauaugauucauugucagcuuuauggagaagcugugccaagugucacauaaagauggcuagccaagggccagagucccuuaggcauagaguacacggcuuggcaauagagcugguucuugcaugcuuguaaugaauuccaucccccguucacacuugcagcucucugugucucucugucucuguuuuuguauguguguguguguugauguguguguauguguguguguguguguguugaugugugugugugugugcucaugagaauguggagaucaaucucaaguuuaucaaccuucaagagccaggaaccuuuucuuuuuuauuuauuuaaagacaggaucucucacugaccugaaacuggcccaguaggcugggguggcuggccagugagccccagggaucugccugucucuaucuccccaucacugagauuacaaguaugagauaccacauauuuuuuuacacaaugggguuuggcuauggaacucaggcuugcuaaguuaauguaaaucccacaccaguuuccuuggguacaucccagagcaaucaccuggcagaguggcauucucucuccacuucacagauaaacaaaucaagaucuagagacacucauuuauccacucacagucacauagcaaguugaacguaagggaucagaguccgaagaccggcaacuguagcaaagggcucaccuaccaccacaguccaagucauagagguaacagaugcucuuagaguggagguccuaagagaaaauguucacgacagcagggagcacuagggaggacuguggggaccaggcugagcacugccgguggcuggugcuggcuccugcaggagcaucaggggcaggagugggaugcaagcaagggcuguucugaggcgaucuugaccauagaauaaaccucaaaguuuuagcuaaccgcugcuggagccacugagggagucuggguagaggagagacuggggagggggagugggcagugacaggcaggagcugguaaagcacauggcuaagguagggacacgggauaggugugugcucccuaggggagacaagugcugguuuccacagugacagcuugguggggggcacuggcugguuauacauucugucaugcuaugucaccuuacccugauccagccuucccucuucuucucucccucuuccuuccuucuuuuuauuuuauacaaacauuuaaaaauauuuauuuaauguaugugggugcuuugcuuggauguguagccguguguguguguguguguguguauguguguguguguguguguguguguguguguguguuuauguaugcucauaccuaacuguuacggcacacagguggaggucagaggacaaucuguggggguucaucucuucucacaccauguggauucugggcauuggaaucggauggccaggcuuagcugcaagugccugccucugacccaccuugcuggcucuuucuguuuccuuuucuagacagagucucacucugcaggccggugagaaacucaagguccccuuuccucaguggguuugcaggcuguaccauuggccugguccugcugucucucagaaucuccucucaagcacauuugucuugcuuucuugagguuaggaucuuaggaguagaagagagcaauccaguuuggaugagucacuuaauugucuguaccucaguuuccucuucugagaauaggaaaguuaaugaguuaauaauagagauuagcguuuguucugcauggaugcaaggagcgcagcaucucacacuugugcauucuuagcaagugucugccaagaucacuucaaagcagaugggggagauggguaggaggcuggugcuggugaggagggagcagaggacagaugcgagcgcuggccgggagcaggaacggcacagccaggcucagagccugggaagagcccgaagggaagaaugucauugacugcuggguggaggagcaggguuugaggagagagucuaguuuuagagucagggcauguuuaggugccagacagcaugugcagagcugagagagacaaacauggcugcuaccgggcuuggaagcugucuggaaggaggaggagguugcugcugugggaaguaaagagggagguuguguaggucaaaaggaggugaagguguaggggauggaccugugaggugagugcuccagagaaucagagcaagaagaaagggaggggaauccagccuaugagguugccuuucaggggaaaguucugagucuggagucacagcaggccuguaucuuguguuguuguuguuguuuggguuuuguuuuguuguuguuuugguuugguuuuuuugagacaggguuucucuguguagcccaggcuggccuggaacucagaaauccuccugccucugccuccugaguguaugccaccaccaccuggcugcagacuuguuucuagagucugggucacuugaggcagggguucaguacauaugauugacagagaagggggagagaaagggaggaaaagauagggcaggacaaucccaaugggaaguguauaguguaaacuaaaccucucuuacuaguagcucacacucccuuggcuaccgguuuuuuggaccaaggccgagucuccagaugaggagacaacuacgagccauuagcaguuaggacucacaauuucagagauggccucuggcccaacaacauccacaaggccugcugugagcugggcagaacuugaccccucuggacuugaccaaaagaccucuucugggcuaaugaaagcagaccucacccaaaacagacaggagaauuccccuagcaagaaaaggcucaagggacccggaaaguuuccagauuguaccaagggagcacaguaaccuuugaccuucucagacauuuggcuaagcuguggcccagugaaccaaguagaugauggguugcuuacuuuccuguagcugugaucaaauacagaguaacuuacagaaggaaguguuuacuggggcuuauguuuccagaagagucuacagaggcggagagaggccuggcagcaggcacaggacagaaagcugaaagaucucuucucagccacacagaagacacagagaauguaaaccagaagugggguggagcuaugaguacucagagcccaacccuggggacaugcuuccccuagcaaggcuccauagccuccccaaacagcgccauccacuggggaccaaguguuccacuuccucagccuacggggacauucucacucaggccuauaugcacaagacagacaagcaaagucacaaggaaaaacaacagcacccagagcuauuccugcucaggaugcucuugcuucaccagugcccacucuccucaggcaccgaaacccaacagagaacccugaguucagucuaguaccagagccagaccaggcagguuucacucagagcacccaggacagcaugcacugcuuaaccuagcauccccagggccacugacccacacucuggccagcagcucagaaauagacccauuggaccucacaucuuugguuggaguggagagucugcaugcucaggaccuucagccuguugugcuagaaggccaucaagcuauucugguuugagaacugcuuggccugagccagguggugauggcacauaccauuaaucccagcacuuggagagcagagacaggcagauuggagggaagggaagggaaaggaagggaagggaagggaagggaagggaagggaagggaagggaagggaagggaagggaagggaagggaagggaagggaagggaagggaagggaagggaagggaagggaagggaagggaagggaaggaaaggaaaggaaaggaaaggaaaggaaaggaaaggaaagaggaaggaaggaaggaaagaaggaaggaaagaagggagagagagggagagggagagagagagagagagagagagagagagagagagagagagagagagagagagagagagaaugcuuuccccuagucaucuucaggaaagcuccuuugcaccacaggucuaugcuccacugccccuuucucagaaaggccucacccaccaaaaggcaguggaacaagugccugcugacaagcaugagggccugacuucagaucccagcaccugcagaguaaaagcucuaaggcagugagcaucuguaaccccaguucuggggaggugggaauggugucuguccugugggcucaguggccagccagucugaccaaauggagaaccccagauucagugagagacucugucucaaaacaaaagguagagagaugucaaagaacaacaaugcuugcuguugacccugacuuccacuugaucgugcacacacucaaacaugugcacacaugcucacacacauacacacuuaugugcacacuugaaugcagacacaugcacaugaaauguaguacacagaaacacacacauaugcucauucacacaugagugugcauauccauguucacacacauaaaaugagacaaugccuucaugucuccucuagcucuuaccucacucccucuuuguuucacugucaccuggucgugugugugugugugugugugugugugugugugugugugugugugugugucuguguucauguguguaugugcaugugugugcauguguagguacguguguguguucauguguguaugugcaugugugugagugcauguguguguguguaugcauuguggauuuuuuuuuaauaucugugggcugugaucucuguguggguagcagcuuugucauuugccgucccgaauggcagguucauagcacuguccaacaucaguggcuuuguuccuggagcccugugcccugugcccucuacuucugagcuuuugcuucugcuauucccacaggacucacuaacuuuccaccaggccuucuguuguacaugugcaugagacaaaggucacaguaggucugcaaugggggucauagccaaaggaccauaagggaguugagugacuaccugugacaaauggaagccagaacagaaagauaaaaagucacacaucugggaccuggauaccuuguaccccacauccugauaugguucgcugugucucuuuguaguccccugugccgauuuaaaacuaugucugcaguuuuuggacaccuuuuccuucaagaguagggccuauuccuucuccuagacuguggguaggagguggugacuugcuucugaugaauagaauguuguggaaguguccccauguccuucucaggacuauuauaagaccauuagccucuuccuugcucucuuccuugggucacacacgugugcaugcaaacaugcauauacacaugaacacaugcauguacacacucauaaaacgaaacagugccuuuugucccacuaccaccugauccuauggagggggaaggggagccagggauuggugccacaugcuguggcaaucuaagcaucccuaaaagaaaccagugugagauaagcugaggcccaaggucaguagccuccuucauccuguggaguuucccaagaaaugugaagaaugagaggaacaacguugaucauuuuucuuuaucaaagagaagggaauguggaagagucuccacacugcagcugucuaaaggagcugacuggacagaacacauaagagucuagagugugccucagcucacccaaaccgucuccaccccuucuuccucauagggugacuggacuugcagauggguggaggagucagggccguucacagccaucugaccaucccccagcuggggagucuguggguaaagaauggacugaguggucuuccauugcaugucaucaaccucauuccagccagcuuggugaguuuuaccagagacuugaaugaagacacaaaagauguguccagccaaaccucagaagcacacaauguuuugacauagcugauuuaugauccaaaacucucuucccagguggaauugcuagcccaagaucaacacucagaaauuuaaugguaaucaauguaaagucagaucagaaaaaucaaucacuccaggaacaagcccagggcagagcagugccuuggcaggacuccacuggagauuaucugguuauuugcauuugaccucugaggucaauguaagcauaacuugcugaggccuggagaggggucgucucccauccagguucagcccuggccagagggaucuggaccccauacuuauggcacaggacagcaaggccucuugaccuccugugggcaucuugaggaaggaggaagaggacgagaggaugagguugaggagaggcaaguagcguggccguggcugagcuaagccagcagaaccaauuccaggcaagaggcggacugauuuauggcacccaagccuucuucugccucugugcagacaaggcugacuuccaugggaacuucucuauagugacagagucccuggucaggcaagugggaaggugaucagaagagagggacucccuuuguguuacccccuuuauguuguugguguguacacacauguggagagcuuugggugccgauucuaggaaauuggaaagaauauuuaacacgggacaaggacaaggacaaggaaauaagcucaagaaaaauacagccgaagaaugcauccuuguauccugaucaucuugauaaucaagaugauaaucaagaaacggggaccuugguuuaugccuuguu

SEQ ID NO: 935 - RNA, 1583 nt, Mus musculus
gagacagccaugcuccuauuuguaccaugcugcauguucucgacuagcugacccacacucuuugggacaauaccucuauccugccuccacccugaaccuccaucuuucccuuaggauuccagauguuugcuacugcgcccccacccucaaauaugaauucuaggcauuggacucaucaaguaggaauauugccauggguuucuuaacccaguucgucacuguaacuggggguggggguggcuuguggcuucucuugcaguugaucuguaacgacuauggacaauugcuugugacuccucuguuccugcuuccagauuugccucauucuugagaucuuccagccucugccacuugagcaucuccuccuccccguguagcaccaugaucggcacugaagcagaagccguggaggaacucugucugcuggcuugcuccucauggcuggcucagcuugauuucuuacacaacccuggacaaccagccuaggagugacacugcccacaguggacugggcucucccacaccaauuauuuaucaacagaaagucucacagacuugccaaccaauaaucugauggaaacauuucucaauugaaguucuuucuugaugaaucuggauugugucaaauugggaaaaaaaaucugaacagaacaggacaguuacuauuuuuuuuucuuaaauaucauugggaccagauaauguuuucuauaacaacuaucuucuuagaaagcuguugagauuauucucugugaccugaugaggguccuaugaucacaagaaauguggcacauuuauuaauuuuguacauuaaaccugucuaauaaaugacauuauuaaauaucuucuuuaucuaugauaaacaaauauauuugccaccaucuuuccaugugagagauguagucucaaagcaaagguuggguuagggauguucauucacaugugagucuauuauuccagcugucucaaaauagcagucaggagaggggaaggggugugacuaagcaaggaugaccagaaauaaagucagcauaaacguuaugugagaaagaggcuuacaugugacuacuggcucacaguaaugaucagaggaacauacacaggaauccuaacacaguguccaggcaaguaauuguuucuuuuccaaauauacugccaaaaaucucuuaacugcugagguucccaaacagcuuuuaagggaaacauacuuacuagacacuacuucagaugagcaguacagacaaggcugaaacuuccagaaggcaaaucuggggcaccagggucccccacuauucccaccuauccugugugauauccgugccuccucuucagaauggaaguauuuaucaugauuugccuuucccugccuacgauugucuucucggccggugcauggggcacaccaauagccuuuagauccuagguugccguucuuuuucuuuuaagaauugaaaaaaaaaguuauuuuuucauacaguagagccugaucaugcuuuccccuccugagucuccucccagaccccaccccuucucacccacccagcuccaugucuccauucuauuucuguuuagaaaacaggccaaua

SEQ ID NO: 936 - RNA, 55000 nt, Mus musculus
aggaacuacgcgcaacggaggccugugguuggacguugcaggaguuggugccucacucugaagguuccccggcguccagacggcugauuagggucgugucgggaccucugcucagggcccagccagguugguccggggcgcccagcuccuuccuggcuugcuggccgcgagccgggggcaggcgugugaggacugcccgaggguccguuucugggccaucagaaggcuguuagccauuucucuguaccucagccucgagggcgggacugucuccugcuugagggagaggccugaggucagacgguggcguccgcugccacgggguuugcuggcgggacgggauagaucugugcauuccaagcaaguuccugcaccugccagagcccuuguucuuuuuaagguuuucaggcuuggaguuccaggguggcgggaccuuuguuaggaccuauuaaguucugggacuccucgaacugacagcacucaggaagucucagacagcacucuggaauuucuguucaccacuugccuuaaacaagucacgucaaggugagcaggucagaggccuucacugacccccacuagucuuaugccuuuaggucuccgagaauaugauacacgaggguuuccuucacacauucgguaagcccggagaguuggauuugauugugucauuaacuuuuugagggaaucgacaucuucuccaaggcccuaccugguaaaugauaagcacuugauggguugucggugaugagacggggucucaguauuuagcucaggccuccuggaugcugggauuacugguaugugccuguaaaccaucauuucuacguccuaaggagauuuaagcagagcccugagcucuguuggaucggaaggucuaggagacgaggccugggaaccugugguguaagcagucauaugaguggacugucuuugagagcuagaagcuuuccuagacucauaaagaaguggcucgcagguuccgaacaugugaccugacccuuaagaauucuguauuugcuauaggguaaccuuugggcaaaauuauaggggguuugauuagcucaaggcuggaaccugacaagaguugaacuuuucaucaguauugauuuccugagugucucuguaagucacuaaaccuucugaucucuauacauauuagcauaucuuacccuuugcugcuuguuauaaacauagaaauagagucuuuccuaaauuguaguuuuaaaagugguacauggauauuuuagauuuucauuucaaacuuaauuuuaaaguugacaaaucauuguucuuauuuaugguauucugugacauuuugauauaugcuuuugauauagaaugaaugcaucaaauuaauacaucucuuaccucguauaccuuuuugugauggaaauauuuaaaaucuacucuucauaacugagcuauccagugauuugguuuuuuguuuguuuuuuuuuuuuuuuuuuuuuuuuuuucgagacaguuucucuguguagcccuggcuguccugcuguagaccaggcuggccucgaacucagaaauucgccugccucugccucccaagugcugggauuaaaggcaugugccaccauucccagcagugauuugguauuuauggcccuuguucugugcaggaggucaguaaagcuuauuguuauccaagugaaacuuuguacuuuggauccacaguguccuugcccccaccuagcccccuucccuagucauaagcaaucacauucuacucuuaggguucagcuuucuuaaguugcuguguguaaggucacguagcguuuaugucucugugcuucucuacuucauguggccgaaguccuucagguuucucugucauggcugcuuuuaaggcuuccagggaagcuccguacagccggugguaaggagcacugcacuggggagccuggucuuggccgaguuuuccauauucaugcuguggacaaugggaauguuagagcugcaugcauguggucugcucuugggaccaaucuaauaacaugguuuucuguuagaccgccuaugguaaaagggcuugauagccaguaguccaccugauccagcccuugacagagauguaguaaaguagagcagcucuguugcuguuaagccgccucuucugaccgcauuaaagcacguacuuacccuuuacuaggccaggcacgcacugccuuaauaaaacacucgcuucguuuugaaaacagguagccaucccuuggucugaauggggaaugaaaucuucugacaucucagaacagaacgcuuuuucuucaccauggaggacaagagacagcgagcccgagugcagggaggcugggcuacaccuaccaagagccagucugcuacucagccaggcaagaaccugcagagacugugugugugcaugugcacagcugccauccucuuucauuuacaugcuuugguuuaucaugaacucccacuugaguuguuaacaguuguucuguaaaugugacugccauuuugucugcucuguggauggugaacuaaggguaugaacgugguuucuccaguguaguauuuggugagagugcauugaggcuguuuguuguccuugccuauuacaucucgaggucauaagucaucuucacgcaguucuuaucggcucuuguugagacuguucucuccuauuucagcuuccccugcuaggagccgucuuucccagaccgcggggccagccuggaggagcaaggaacagcagcaaugugaccgacaauuuguguucaaagaaccucagcugguaaaugguuguuucuuccucaauaguaacaaagguguaccuauaaaagcuguguuucugagcagguucuccaauaguggcugaauacauuuacuugugaguagcagaacaaaggauucuaguaauaaugaaauguggaauauuuugguugucuuguaugccugaagauuuuuguguucugcuccauuuacuauuuggcuauaucucccuccaaacccucaacuuuuauuuuuuuugucagggaagcucuacuuaagccauggccaccagguuaaggccuugugugggccagcuaagggcuaacagcucuauaaugaugcuuucuucaaaacuguuacagaaauccuugugaaauuucaguuauuauagcaaaaugccugauuuuuagccaccuguaggggcauguaaaaaauagaagauucagguuuggggggacaaggguacugcagggcuggggauggaguccaaucuuauuuuauuuucauguguguguuaugcaaaugcauguucacauguaugggugcacauuuguaugugccugcagagaccagaggaugacaucaggcaucuucaguugauccccgccuuaauugagccagauuaucucgguugaaucuagaacuuugcaauucagcuggucuaaccagccaaauuauccugcaaguuuccugucuuuaccuccugagcucugccauugcagauaagucucugugcccacucagcauuuauguggguguggauuuagccccucaugcuuuuguaucaacugaacuauuuuuucagcuuucacguaaaaaaauaauacaggaaaaauaguuuuaaaauuaggcaucuugguauuguaacgaucauauacauaucagaacuccucuuagaauauaucuuccacuuuuuaaaacaucuccuuuauuaauaaaagggguuugcaucguuucuggccaagaggaaaguugauuagugcuauuguauggccuuuucugucaacuggccagugugacauaguucugggaauugcagacacaaagcucuguugucaggcagggcugacaacaggauagcuuaaaccuauggagcuugacuuggcucgaaauaagaggccaggcucuucuugacccuuggaaccauucuggacuucagaucuaccuguuuccuugcagguuguccgugcagccccagaacccagagugauugaguaaguaagcucuguccacagcgaaguuggugccuggggccauucccuccaccgucuuccauuuuaaagagaauggcccaaugauucuaaauuuuuagugggugugaacaguccuaccuuaaucuuugaacuugguuuuuugaggagacuuucuggguuugcuaguaguauagaaaacagcaagaucucugcacauuaaaguuugccucuagggucgauuuccuggcccugucuguaagaguaaacugaaaaccaaaaaggcuuuuuccuaagucacuggaguuuggcuuggugagaagccugucagcagcauuuccguagcaggccuuguaagagcugcauuaaccuaggucacccuccagccuauuuauuaaaaccgcaagguuguuccugagcaauuuaagcaaugcuaaauguccuucucuuguauugaucugugucugaauguucuccaaagcuggggagagaaucuuuggcuucuuuucuccugccucucacuuuccaccugauguaaauaaaucaucaguaugaacuauccuuuuaugcuagcaguuagcaucaagcagacguucugcucauaaguagucuguuaugcuauuuagauauugguagauuggcuuguacaagaauuugaagcuaacacagauguuaccauagucucaagaaauaucuagucuccucuuugugacaagugagcuauugaacuaguccugaguucuuuccauuucccuaggguuugauuuccuugucuauauguuaaggguuuguauucuaaucauuuaagcccaucuaggucugugugcauaguagcugugcaguauuaccucgaucacugauagagcgaaguuggcaaccugaggaaagucacagcauccaccccuguugguucagccuugcugaaucuaaaguuuuguuugccaguucccagaaaccugccccauguuuaaagugagacaguuuguacauguaugucaguauaucucauuaaaacagaguauucauaccucagggccuguauagagagauggcuucuguagaaaugugucgcuaugaaauaugugcuagccaugcuaauucagcuccuacgagccuagcucaaaggucgugaaccacugacuagaacccuggagagagagaugaaaugaaaaccuguuaaaacaguaagugaccugacuucucuguugcuuuucugcacugaagcuuucacuugcauaucuguaguuuuguaccuuuccacauuugauuaaaaauucagugaucuuuuaucacccauccacugugugcaggcugugagaauaagccauucuuugccccauaaggaacccauagucuagggaauaagauagucaugugaagaacuuguacuucuguauggaagaucuaauacuggcccaggaugugauggugauguuacugguacagauuaauggucaaagaaaguuuaaagggagagcuaagugagauuuuuguaggggagucagagguuuccacuuggccauacuaggaggugagcugauugguagggaaauauuccagcauacggaaacacgggcuagaaacaccuguaguucugugugaaggggguguaagcaguugauacugaggauggugacacugggaguuggcagaggagggucuaggucucagggaccaugaguacaauuauagggacacugaaggcuuuuuacucaggaagaucucacuagacguguaucuuugaaaguaacaagcucaagguuuugagauaugccugcccccuggagaguacuccagacccuccuuuggugauagauuuugauaauguaucagccuaaauugugggugaaaccuaccuggguagaaucagaaguugauuucucccacuucuguuucauggccugaaccugucaggguucuguucccagcgccauugaggaugcacuaccauuucccuugucuagcuguuacagagguggagcuuaugccucccucacaguguuuucuguaggaaaugaauccuggggaaggcagaaaggauagauuguuuuagccucccacuaauauaugcuuuuccucugccucuuuagcagggaggguguguaugaaaucagccugucaccuacuggugugucuagguaagugaauccucauuggaaccugacuggcuaucauuugaguuaccaucucuuuaaacuugucuuauuaaggaacaagacuuggguaaaacuccuuuuuacaaaguauugcuagcaucaaaauauuuucacagcuuccaccaguuacacggacuguugugacugcagugucaugaggaagcgaggcccaagguccuuucucugcaccccaccacucacaguaacucagugccagagcuggcucuagucuuuuuggagugcuucaucauuggugcuacacuucaugaacuauguguauauucaauauguaauauuauauugccacaucaaggauuggcaauuauaagagaauuuccguauaguuaaaucauauauuaaguguaaucacuauuuaaaaauauuuugaaaauaccuuaauacacaaauauauuaucacuguaaaccaaugaguuauuuuuuuaaaaauccauuagaaaugacaaaugaaaauugcuuauaguagcuucugcuggauacgaaguacccugaaaaaaugugacuauuguuuuaaucaccuauaaaaccucucugucuuaguuucuuuuuuuauuccugugauaaaaaccauggccaaaagcaacguggggaggaaaggguuugucuuacagcucucaggucacacucgaucacugagggaagucaggcaggaacagaagcagaggccaugggggaaugcugcuuacuagcuugcucuucuuggcuuacuaugucuguguuguuaaacaccccaggaccaucucaccagggaugauauuacccccuguagacugggcucucucaucucaaucaucagucaagacuugcuggucugaugaaggcaauccuucaguugauauuccuccuuucugaaugaccgugguuuaugucaaguugacaaagauaaaaaagcaaaaccgaaaccaaccaaccaauccagacacuccccuuuaaagcaaacuuugguugagcacaucuuguuuuaacuaaguagcuuuagaugaccucuggaucuuuucagucacaugaaccuucugaggaccugaugcugucaagacugcucaagagagugugggcuuccagaacuuuccuuaggaaagggauacuaacuggcuuuuuucagcugaaacugugucaggauaggauauauuuauguuuauauuuaguaagaugagacaucauuuggguguauuuauuuugaaagccaugauggugucugucuucaaauugguguaguuuuaaaaacagaggcauuaagugccugcccuugguuuugaagccacaccaugcuaaucauuucugccacuugucuccuuggcagaaucuuggaugcuguuugaagcagaacucuauaaaagcuucauacaucucuuguauucucuuaugucuuuagagguaccaugaaaagaguuuauuuuaugugaagcucgcaugggagggagguggugagaugacucucucucuccuuuagagugagggucuaaucaagugauccaacagaaacuacucuaguccaccuucucugugugcuuuagcuauggaugguucuuucugcauuaagggugugcuuauauccuggcuuuguggacuugaaggaagcugacuggaucuuggagcagcuuuguaaggauguccccuggaaacagaggaugggcaucagagaggguaaguaggccucugggguacaguuguugcugccuaguccccauucaaauguuuuugaauucccuauacugcuuaacacagcuggacuccccaaggcacagacaggaagugguaugccaggcagaagccauagccuacagaggcucagaggucagggagaguagacaagagagaggcaagaccucacagagccaaggaagcccuacuagcuggcuugcgacuaacaggccucucccuuucgcuuuaacugccuucucuaguaguucagaugcugccaaguuccuucuucacauaaguuucuagagcuuucuuuuuugcuaauccauuuggcacacauuuuucugaagaccuuuuuacugacuuuguguacuuucuuuccuuccacuggagucagccagucuccuccaguuucagugucugcuccccugagcuuguaaagguacaccagaauugauuagcuuccugagaucugccccucacugcugcucucccaauaccagcaaugccugcgauaccacaaaugaccacuaggaggcaccuuugcugugaccuagacuccauaggacaugcaaagaguuugaacagcuugugaagagacaaaguguauguuaauuggcuuuuuuaaaaauccgggugucagaacaggagccagccuuuuuggggaagccuucucccuacucuagaaguuucuauaauguggcuuugguugcuugcuucaguauuccaagcaauuguuaauuuugagcaaauuauaccucagugacucuguaauucuagauuuucucuaauaggacauaaauuauaagaugcuuguguuaauuaaguaaauuaaauaaugcaugauaucugcuuaacaacgcuggcugauguguguaugucuguguguguguguuuguguuuggccuuuaguaaacauuggcucccccacuccucuuuuggcaguucuagggucaaacccagggucucguggcuuagcaagcacuagcgcugagccacauguacccaaccugggcuugaucuguuguugugacuaacaucuguuggggagagaugguaacucccuaaccucucuaaaacaguuuagauagcaugcgcugugaccaaagcaggcaugugguacaguagcucacacuuuuuagaucaaaagagcaugcgcagugaugcuaggacacaggacuacuggauucucuugcuuucagaugacuuguugguaccauagucuuuuuucaugagguccacuccccauaaucugcuuuuugagacuuuuuggguuuugccaugagugaaacaaacagauggaacuccuucccuccccagagccuuuacccugcugucccugccagcaugccuuauuuccucuguagcccuuccagguucuccuagccaccucccauuuccugucugaggaagggacuggggucaucccuccucuccuuuuguuccccaugcuccucgcacagggcaggcacacaauggcugguagcaggcgcgccucacccagcagcaacugucucaagagcccuguauuuucuuucucagauguaacuuauccgcaaccaagacuuacagcaugguauggagagcuuccuuacacuuacucgagaaucacuauggaaccaaauccucacguauguuacaaugaugucacugcuguggcuuucuagucucaguguccaauacugcaaguaauuccucauagaggcacaugauaguccgaguuucagaaaauccucugggcucaaaacccugcuucugguccucucugugcccaugaucuauagaugggcuuggaggaugggagcaaacugaaacagugaacugggccuggagccucaggucccaggggaaugagcuguuucuuccugaccccuccucugugaacacugcuguguuucauguauagcacaucccuacggcuggcagugagggcagagagccuuuccacuucucagcucugcuguuacuuguauggaaucuggguuuuuuggcuuuauauucguucuguggguacaguuuccagacuugcaacuucuugccccuugggcuuguuucuacugaugccuuuguuuuugaagauuuccaugacagcugagcauaguaauacaugccuguaacccugcaacucaggaagcuaaggcagcggggaucauaaaguucaaggccagacugaacagcagaguaaaauccuaucucauaaaauaaaaaaaaauauccguagccggaugugguggugcacacauuuaaucccagcacuugggaggcagaggcaggcagauuucugaguucgaggccagccuggucuacaaagugaguuccaggacagccagggcuacacagagaaacccugucucuaaaaaccaaaaaaaaaaaaaaaaaaaaaaaaaauucguguagacaaagauauuucaguauauaaaauaagcuuguccaaaggcuagacuuaagguccaagaacuggcucccuguuuaguuccuggacucucgccuugaugaaaauguugugcuuuacugaaagagacguugaagaaauggaguuuugcuuauucauuuggacacaaaaauguggcauguuugagaguccuagcaacauguaaguacaaaaccccugugugccgagguacccagggacaacauggacccaggaggacagggcagacugucacaggaagagcccgcugcuuugaagggcucuacuccuaggguugggugaagccccagaaguggaaaugcccuuuucucugaaguagauuuggagacucugagggaacagaagcugcccugcucugucacagccauguaccugcuugucuguggccacagcagugaagcuggaggcuaagcaggcugugaggagguccuuuuucauuuugucccagcuuaucuuucagucagcuuucucagucagacauugccaugugucuguuggugacaguucuugggcuuaaaaagccauuuuuauaguacacagaaaccauggccuugcucaguauugucuuucacuuucgaggcauauuuguuuuaaacaguuuucaaaagaaaauuuuucaaugacaagccuuuucaauuauagucacagcacuuagaaagagauaagaggacucuagguuugaaauaguuagacccuucccuggaaaaacagaauuggcuuggugauauggcuuaguugaacagugcuuaccuugugugcacaaggcccuggguuuuguuccuagcaccauaaaacauaaaccagccaaccaaaacaaaacccccuaaaaugaauaaaacuuaaaaauugccuauguaugauuuucuuaacuguauauccuuuaaaaaucuuaguaucaguaaauuuaauaccuguauaauauuucauagucuuugaguacaagccucuugcuggaaauuaaaauugucaaaguaggauagagagauugcucagccaauaagugcuugcuacacaaacagaaaacccucaugaguuugagaccucaacuccacaaacccagguaaaacagcauaaggguacauguuuggaaucccagugcugagaauuuugcuggccaguuagacuagccuacuuggugaaguccaggcaaguggacaauccugugucaaaaaaaaauaauaauaauaacaaggaacuagacugcagcucugggaugacacgagaaauugagaaauugucuucuggucucugagcauguacaugugcaaacacauucacacacacucaaaagagccucaaauuacaauugcuauuauggaguauuuucuuucucucucucucucucucucucucucucucucuguguguguguguguguguguguguguguguguguguguguguguuuguguguguacagaguguguauguguuuuauuuuaagauggccuuguuaaauagacuggcaccaaaucucuauagcugaagauggcuucaaacucaaaauccuauuuccccggcuguccacagugauguuacaggcauggccacaaugcccagcuuuaguuguaaguuuugaagcugguuugucuuuguacaaacugagugauaauggaucccauguauaaaauacauuaaaacuuaguugucugcaggucccaccaacaugaccacuuucuguagacccagacccaccucuguggcacugaggccacucuugacacugaagccuguucugugacuuguguguucucacauauucccucagaugucuuuuaaggauagaaugccuucacugaacagcaagaugacgcugaauucuaauuuagacauucgcuucuaaaggaucucuauuuagagaauugguuaaagagucuaaauuaauccuccauuacccacuccauagcucccuuucucuauacuuugcucccaaaaauagccaagaaaaaacauauacccacuuagaaacauaaugcaaacuugauguugucacagugcugagucccaagcaaguccagcaagugcuaaugagauucucaguccuauucuggaaaagccaucuucuuuacacucuuguuuucuuguuagguguguaauucuagcaucucuugucuaucucugaagguaaauuacagcuggaggugggcaggaagcgcagcucacccacgcgguggcugcgauuucauuuugacuuuguucucuugaacaagggccagcuuaauaacauuuuuguuugguuugguuuuauugaccugcucuguuuuuuuuuuuaauccucugcauaguaaaugugaugcugauaaccacaaagagacccagcuuuuguucuggcuucacacuguagaaaagcuuugcugcucuagugcuucuguggcagaaacggggcugggcucaguacugcacuguccuuucugagcacccauccugucucuuccagguggaacacagccguacuucuuaaaggacagcccgcggguccaggaagccuuuguagggacuguguguguuuucacugcugggccaagaguguguguugguagcuguguggcaucuguuccgaugcugcagagcuauacgugguaaauggcaccucagcaucaucagucaaucugccagagaucuccgugcuccucacacugagcacuucacuuagauagagugugcaaaugcagaguuuagcacccgugagaugguucaguggguaaaagcacuugucaguccccaagcuuaauggccugaauuuaaucccaagaacccaggugguggaagagaacugaccccugaaaaugaguccccugaucucugauuucugaugguuuaaauguaacagauaagaaaaaguuugagcuauggucaaauucugaauugagacuaucucaagaaucagcccaggcugagcuuuggaugcacucacagguccugcuaucuguccgacagggcugggcacagauuuuagcaggacaaaugcagacgcggaagagcgugcuguggagacaguguggaguuguaaaacggggccguucucaucccaauuuuguauugaacauaccaaguacacagagugguuguagcauuuuaaacaaauuaccaaagguguguuuauuuaucuugacacaggaccuuaguacauagcccagacugcucuugaacuucuuuccugccucagccucccugccguuauagcaugugcuaccacucucacucuaacuuuaauauaguaaauaucaaaagcuguaaucucuaagaacagagguucaaaccaggcauggugguacucaccagagaggaagaaacaggcagaucucugaguucaaagccagccuggcauacauagcaaguuccaagcuaaccaggacuacauaguaaaacccugauucaaacaacaacaguaaaauucaucaaagguuauuugaggccaucaauaauuuuaauaguauaaaguuugaaaaccacuguucuaaagagcagaugaggcucuuuaaguaagacacagaauuguagagagccaguacacacaaccuguuacugauguuccugugcacguggcugcagaguguaaacuacgucacuaaacuggguguggacagcaagcagugcugugcaguaugauuacauucauaguuuuuuagcucuaagagugguccuguucuacagaaaagaaaagaacacuuguucauugacauaccauagaccaggagagccacaaacuugcuucggccucccaagugcuaggauuucuggcacacaccacuaagucaggcuuugaguucuauuuuuaugaaguuagccucuaaauauuaaauauuucucaagaaaucaauuuuguuguuuagaauaaaauaugaacagaauaggaggcacccaguugagaguucuuuuguucuuuacuugagccuggguguguggauccaugagcuccggcagccccacugccccuuuuagggcagcacuaauguuccagaaccaccgugaacauccuggcauuggcuucuuugugaggacaugcacugcaagagaaacaggagcugguagacagcuccagccuucagacuugcuucagcauagagauagagggagaagacgaagcuacucuucugccuucuguuuauugcauugcccucucagaaacccgcugacuucauauuucuuucugguuuuuuuuguuuguuuguuuuguuuuuuuaauggcugcccauugugucuuguaugccugucccugugcuugcugucaguggcuuccugugcuguggacucugaagagccgcauugaagagaacaccagccacaccuucaacuccuugcuguguaauuuuuaccgggaugagaaggacaguguggacuggcacagcgacgaugaaccaucccuggggagcugccccgucauugcuucccucaguuuuggugccacucggacuuuugagaugaggaagaagcccccaccuguaaguauucucugccauaaacacaggcuuuccuuaccuccuaauccaugaggaguauggcucucccaaaagccgcugccuccauguuagcugguaggaguauaugauauuggugagacgcuuucaaccaguugcuuccuucauaggaaaccuggccuuccaagugccacucaugcauuugcuuauccagcaagaauuucugcccuaugccagguccuguggacccguuaccacugacggaaaggacagacagcccucaccuugugcaaggcauuuauuagagaaagcauuuaaguggcugcaaccaugacucaugcugugacugaagaguuacagagggugacuuggacuagugggagcaagaagggagauuccagaaacuuggaaagauaucccugaaguggcuaucauuuccugugcaccuguguggcaugccacuguucugugagggagcaucaugcagauccuucuucccuucuuagucgccuucugaaaggugugugagccuaugauuucuugagggagagggaagcucaaaccagaccaucaggcaauagugugccuaagcugagguugggaaguggcaacuaaacugacuugaauuucacccuggcucuuguuuaaauuacguuggauuugacucccaagucuagccuuaauguuuugaaucaaaagugaaccuuagaacaaagauggaaaacuggaagaaauuccaagagaggaaacucacuaagucauccugauuucggaguuccuggcuauucagccugcaucauuaaaccaagccccagcaaguguggaaggccagcaggcuguguuuugauuaugaccuaauucaggccucccaccugucucuucugcuucagguacuugcauaagagccgaggcaaguugcuguccugcagugccguugggucuccauucaugcuacuuuauagcacauugacuuauuuggcaccuaugauaucaagcucuauuucuugguguaauuuccauguuuaaacguuugcuuugcuuuuguuuccaccuaaacuuugcuuguugaugguagagcauucucagucacuguguaagaaccugaccacauucuccaggagcuuucuuguggacuagagaguuggaguugagcacuagauugccuggccuuugcuggggucuuuuaggcaugguuauacaucugugcauggauagaaguacuuggaucccauaccgcaugucugaagagauguucuugccuguguaagaauccuauauuacagauagaggaggaacaacuguguaccugaugucugucagacacucuucuuaagccgacagauugaacgucagcucuuuuccaugucgguccugggguuguagaguaagcaaguaaauagguuaggugugccugugaguaagccaagauuccacucuucccucucuggguucuucguaauuauuuguuuugcugccaaauguuuaagucuucagugaccauuauauauauauaugcagcgccaccacccccuuguggaaaaaaguaggggccuauuuauagaugggaacuuaagaauucccaaaguaugcuaucuggguaguuuccauguacaucuaguucccaagugauaaacaugagcaguguguuaguguccagaaauaccccuuccugucuccccucccagcacagaagcccuucauucccucuuagaaagaccugucucagggacugggccuacagcucagcgguacagugcauaugcaaggcccuggguucuuagagcguaacagccaaaccaagccaaagcccgaugcauggugaacaaggaggguuuaugguaaucaccuguuauguuguaggcugguguguggucagcaaacagcacacacagcauuguuucugggugugaguacguggagcaugaagucuauuuuucagaaaccugggaaaguauaggucauggaguagugaaagaggucagguccccucaguaucccuggacuacaacugugccagcuguguuaauggaacauaauucaucucauaagugagaaaauuuaucugaggucuugaaauaaaguuggcugcggaaaugaggucgggaagaaacauaaacagucagugcuccagguuacucugguaaagucugccucacuuuaacugauugaauugggcacaguucucgugcauauucucuauuuugacuuuuguugaagauggagaaacugaauguuauuguguuugagauuauaaucacacauuggugauuacggcuuagaaguuccacucuugaguaaacacaguucguguuuaaacuuuugaggacucacucaguuuucauuaacagauuccaaaauucuggagcccuguaaauguaaccaaaugcagaagccuucuuugaguugacagccauggaaauauuucucaggguauacaucuuauugcaaaugguccuuuccuaaaggauucaagggaacuugcuaggcaaaucuuugucuccuuuuacauuuagguacuaguucagagaguaagccuugugacuccuaacacaaagugaaauuguacauuaaacagaaaagucacuccucugugggccuuagaggacugacucucugaaugucacugcugguuguaguuuuccugacugccaacaaggcagguaagugaguuagugacuguaggagagagucccacaaacucuaggaaggagucucccacacucuaggagggagucccccacacucuagaauggagucccccacacuccuuucagcuuuguucuguugguugagaggcuaucaccugguuucuuaucugaagcagaugaagggcaagagauuuccuguauuuaacguagguguggaguuugaggcaagccuuugggacuacuuucaaagacauugcguuuuuuucagauaggaucucaugucacaaagguugaccuugaacuuaugauucucccgccucuuuucccccagugcuggaaaugcauucacuaccaugcuuggcaagagaaauagucuugcuuuuuauuuuuuuaaaaaacaaauucagauucuuccaccccuguagcagcugcuugcuuugcagucugccaccucugucagucuggcugcugaucuucugaaagcugccccacauucuacacagguuuucacacagucucccccaugcugagaugauaggagagcuuugguccuauccacccucugauugguggagcuaucuggacuaaccguggaaugucgaggugcccuucuuuccuacccugcucucagagccuguggagucucauuuauuuugauuguagaggaaacuacucuuuccucuagagacaguaagguacuaggggcacgggggacuucuuuggucuuguuuuguaccugauccuuucuuuugugugggucaaaucagagacuggccagugccagucuguccuguccuaaaacaagggaaagcuuaccaaauacuugucaacagaucuuuguauccugucagaguggguucaugaaagcuuuucugcacugcuuaucccaagcccaguuguacuuuccaagcuauaucgugucccuguuugcaaagaguagcuugguucguucucccaucuaacucuaauucuauacagaagaacaaacuagaaaaggaacuacaaaagccgcuuggcaggcugcuauuucucugucgguuaccauggaaacagugauggcugggggguuauuagauaauagcaggaaguuugugaugcacuggaggguuagaugccaaaagccuuguuuuuguagcaaauuaccuuggaugagcucuuuuccugaucagcugccucgugccugugggaggggcuucucuccacucccagauaauugaguugaggcaaaaggggcuucugucugagccauuccucuccucagcaccuuaugaagggagugguaguaaaagcaagacuaaugguugagucucugagaacacacuguuaaauaauuuguuauacacuucugggaauacuagaguauuaaaaagucagccugaucauaaauacugacccccucucccacacucaggaguuuugaaagaaggaaaauauugagaucuaaaguguuaugguacugaauggaaacaggccagacuagagcuguagcauucaaaauuagggaugaaucuuccaccucagacaguggcccccugugcuacaguuuucacauccuccuccuuuuaauuguuuugagacagagucuugcuugucuuacccacccuggccucaggcuaacagccuccagagggcuggcauuacaguugaccaccagcuaggcuuccuccuuuuccuuauaccaucugauugcagcgccuggccugagagcuuuccggaaacacuugauaaucguguucucaaacacccuccagugaaagugggaagaucagccuuacuuccugugucugcccugggcuggaaaacagcacuuaccuguacgcuuuaugcuuacucucuucucauaaagggaaaugaccguugguuagggacuugaagggaacauggacaugcuuucccaggaacauaguuggaguaaucagugaguuugagcuguuguaaauggucuguugguugcuuaauccagagccaagaaaggaagugaauggugauaagaauguaguggaaucucgggaacagaggcagucacugggucagagacagugugggguuugaacuccuuggagggugagggugugaaugaggagggugaauguccacaggaguggggaguaaauaaagauacgcaguaagacuuggagcuucaggagagugggaaaucucauuugcuuccuugcuacccuguuccagccagaaucagugcccuguaauguucaggaaguaauuacuucccaaguguguguuugcuuguuuauagagaaucccauuguguagcccaggcuggccuggaauuuuggaucguccugccucaguuucuguauauuugauuagauguacaccaugcccagugagguuccugggauuuaggguuuucuuuuuauucacguuauaugagagugcaugcaucuguguguacaugcauaugauauguguaugugucagagcaugcauguugccacuucacacauggagaucagagggcgacuuauaggauuuguugguucuuuccuucccaccauguggguccuggggaucacacucagaucagcaggcuggauggcaggagccuuuacuugcugagccaucuuuccaaccuuagauuuaguugguuucauuuuauuuaauguuagggaacuuuuguguaugugugugggaaugagagguugacucuggaugaccucuuugaucgauuguucucuaccuaaucuuuugagacaguguuucccacugaacauagaucccacugggaauacaggaggaugcccugggguugcuaaucacucagucuagccaaaucagugagaucuauguucagugggaaacacugucucaaaagauuagguacagucacauggugccaugcccggcuuuuuauguggaugauggaucucaugcuuauauugggcacaaguacauuauugaccgagccacuccuccucucuacuucuggauuuaaaaccacauuuuccaaaauaaugucuuauauuucuguguaugccacugcuaaguauggggauugcuggcaaacuugaccuucaagccuuaugagagcaguagaguuuuuccuacccuuugcaauacucuaagaccuguuccuggggguucugucaccucucuuggaggauggcuagauagcucaggcagaaaaggauuauguauuuuugaagaguuaggaggucccauccuagggcucagugagccagcaugaggagcauaguaggcaaagagaugugaagaugggcaaagcuacauccugcagauacuugggaauuucaaagaggagaaauucagaacaugaaggagccacugaauguguggagcagaagagcuuggccuggguaauucuauaaaagaucaguguuguuccucuguggagccuacgcuagaaagaagcaagggcagagccaggcaccaauuugggggcuaagggaaaagaauacagaggagggcaaacuggaccaccagagcuaaagggagcgugaguuuauaaggaggccugagaacagggaagggaaaggauacucuacuccuacuagauggagaggugaccaucuuccacaugagagggcuccaggggauguucaagcuuguggggacagcuagguuucaguuagcaugaagaggaagagggucccuucagguugaggaauaccaaaggaugugauggaaggugcaggaagaggcgggguguaugugaucagguucugugcacaccugcugcaugugcuuuccucaucuuacaggucuguacugacugguuuugugagucagguuaauacaaaauagagucaucagagaaaggagucucaguugaagaaaugcccccaugagauccagcuaugaggcauuuucucaauuagugaucaguuaguccaggccauuguggguggcaccaucccugggcaggcucagcaagccaugaggagcaagccagcaagcagcacccuccauggccucugcaucggcuccugccuccagguuccagcccuguucaaguuccuguccugguuuucuccagugaugaacuaugaucuggaagugaaagccgaugaauaaacccuuuccuccucaacuugcuuuuuggucaugguguuuugucacagcugacuaagacaaggaugaagggggugcuggugcugcacucuuaggggagcucuuucaugauagcauuuccauuagaguacauuucuaggaaguguguguuacuaaacauggcauccucaucacugaauucggauuugaaggccauauccagggcagcuggaauggcuuugacugugaguguaaagcuggccuucuguugccucaguucauaacuacccaccccauccagcccccaggacuguaccagcaaucagucugaacaaacgccaucagcaaguacuucccucuggauuucauuaacuucuagcauguuuaauugaggagcaaggacagggaucuggcugcuggugugggcuacagugcucugcuuuggugccugaagagaacugugcugcagccaaggacuacccugaccuccagacccucugugugagugagugaggcacugggguuccccuaggaucagugagugugccuggagugcgugauugcaggcacuccccccccccccccuuucugcuuacuuuucucauuuacucaccagaaccuuucaaacccaaugaauaccaaaagccaggggcagggcggggagaugguaaaaauccagaguggcauguagcagaugaaucucacacuguugguuuugaaccacuaagcgcugugguccaaagcucugcuauuuauuccaggucucauuugggagcagcugcuucuguuuuuuuguauuuuuaaauaauguguuucagaucagugcccagggugcugucacuuuauugagggcugagucagcagaauaaccacagagaugauuuugugggaucccagcucucuaccaaguacuucccuuuucaccaccaugaacaagagccccacugcauucagugcuguaggaaccaccucaagcuggagaaugccugcagguugccuggccuuggagcaguguuggucccagacaggugcucacaggcaauacaaacuccacugagggaaaccggcuucaaagagaugauauuguugacaaaaggacauuauuggcauagccaugcauugagagauagggcaaaaaagaacauguggccuuagcauguagcuacauagguagcugcaauuacuuuuaaaacaucauuacaguuguuaaaaagaaaacaagaggaggaagaggaggagaagcagcagcuuuuaguauacuuaucaagcaauuuuaccaguuuucugauccuugggcuagagagcuagggaacaaacaaacaacaaaccaacaaccucccuuguaucuguggucaaguugagaaaacucugcuugcuccugucaguguuccagaauggaugcuaugcuaugcaacaggagugcauggaugcugugcuauauaacagaaggagugcuuggaggcuacgcuauacaacaggaggaguguaaggaugcuaggcuacacaacaggaggagugugggcuuuacucuguucacagugggaaugaauggaggcugggacaugacccuuuccauaucuaaggauaacuguggcccuguguggauagcaauggguaggcaagacaagagacuaccugacgagcaguagcccagcaggaagcugcuaccuugaacuggauguugugagaagaagagaaguaaguggauugaagguauuugagggaaaugaagcuguagaacuugccgguguuucagacauggggcaagaaucaagaaauaacucccacauuuuugucuugagugguugguuggugguagugcuguuaauucagauggcagaggaaagggauuuauugauuugauuuuguccuuuuguaaagagcucuguccuuucucucaaguucuauuuuuauguguugaguguuugcauguguaugcacauacuauuuguauaccaggugugcacauaggccagaaguggucaugggauccccugaaacuugaguuacagacaguugcgagcuaccauguggauguggggaacccagcccagguucucugcaagagugucguauacucuuaaccccugagccgucucucuagccccaggaauucuuuuucugcauguaaaguaggccacugaccauaaaagccuuggccucccccaauuguaauaugggguaauaugucgauagaguaauaacagacaccgucagcuggcugcauaggauggcuuaggaauuacuugcugaauuuaaaguaacaauguauuaaugaauacuggguaaagcuaugggaucggcacauuccuacccaggacaagaaaacagaaggaaaggagcagacccccaggcgugggucuguuucugucaugugguuuaguagucaggagaguccauugcuggugcuagaacagugggccgauggaacccauaaccaggucaucagguguguacauuaucucugucgggccugcacuggguucucacuagccuuuguauggcugcucuauucuccugaauuaucucuuucccugcuuaccacuuccugcuuaacucaaguccugucugggcuuccagggcugcuguagccagugagucuccccugaugccuccagcacagaagcuagcaauugccauguacucagugcuuccugugagcuugggaaaugagaagcagggagcaggugcucacuuuguuucccuugcccuuucugcucaguuauguuuuguuuuuauagcuaucuuaguaacaagauagggguuuucuuaauagcuuuucugaggcucagagagacgcagaggaccaaacacucugcuguuaacugagagaacacagggaagcauauuuuguuuggacagccuuuucugcugugggagagacaaagacugugauaucugaagacacaguagcauguggagcacuggaggggucaggaaugagcagcaaugacagcaguuacaggccagcuggggugacugcgguagagcaggacaguucugcugggaagaccuugagcuggguguagccucaguugcccacaauuaaaacuugaaauuuccuauaaaaaccccacuuagcuccuuccccagaaaagcuaaaggaugagacagcacuggggaccuugacaggaacugcuccugaacaucauucaccccuguauuggccaccucuucuguuccugccugauggcuggucccuugagcaaggcgaaugugccguggcaugaggaggcaguguggugggauugagcagcucaccucacagugcaaucaguauggggaagugguuguggguuugagcacucccaggccugugcucaccagaugcucccuggauagcaucucccuagccauggcuacgugugauguauguagaauccgacaugccaccuucaccaugguuccagcacaguaagccgguccagaagccuagcaggaagccuuccauuaagcacuuaguuguuaugagagaaacauuugggucuagggcaguguucucaaaccaugggggucaaacaacccuuacacaggagccucauauuaaguauucuguguaucagauacuuacauuacaauucauaacauuaguaaaauuacugguguauguuuauguaauacauguauuacaugaaguagcaaggaaaauaauguuuugguuggagguuagcacaacaugaggaacuauauuaaaggguuacguuacaaagguugagaaccacuggucuaggggauggcucagugguagaaugcuugccugccaugaaaccuagucgcccuucccccacccccagagguauggaaaacagacaacucccccaaacaaaacaaaaaugcuguguagacuaaagaguuaaaucugaaaaaugucaacucuuuuuuuuuuaacuaaaggaaauggaguuguauauuuaacuuuccucgggaugggaaaauccuuucuaagcauaaaacccaugaaaggucaaagaaaggucaguggagucaagcccagauauuuuuuauucaacaucaaaugacaguuaaagagcagauaaaaaacaaaagcuguaccucuaagacuuaugcugaagggaauggcuugccagcuuaaugucugaggucaccagugaguuagccaaguguuaauucccacagcauaguggacagagacacagagacagagaccgcagaggaggaaagauugguacugucauccuucccucauggaguuacagacugcuggaggcuuugugaggaccgucacggucagacccuugccccgcauuccagcuuuaauacucgauccaagauguuuguguuuagugaugcuucaccucaagucuacuugcaguaaccucauuccuuuagaaacaacagcaacaaccaaucaggaaucccaguauaucaacaucucagucucagugugaucuuuacugcuagcccccagcacugguacagugucugaaacacagguacucaaacguaccugagauccuaaagaaaaaaaaaugugcucgugcaaagaaauagcgcgugacaauauuuuugaacuauuauguauuuaaaaacacccaagggcugagcuuguauagacggaauacugccugggaacucugggagcagaguauucugggcacuuucuucaguuacuuagcaucugucuacugaugucacagugugucucuaagcagcagccgcauacagccauuccccacugcccugacugugagagcaggaaagcuaaugccuaaaaguuaaaccuguaccauccaugaguucugaugcauccuagagagaagauaggaagguuuugaaguaacgauggguaaccauuuuaggacaggaggggugagcuccugagaaaugcaguagaaugugcauuaccuuuucccgagaaggaaauugccuaguuucuugucugugaugaccguaaugacagcaguaaacauccaguauuuucuccuaaguacugucuuccugaggaaacugaauagcuuagcauuuugguggggugggagcgggagugugcaaagucucagcauucucuaggaacgaguaugugagcaucuggauaggcugcuggacuugagagugaggguagucuucagcccugauagaaaaaccaugccuuuugugauguucuuucuguuuauaagguuucagcaucugcagucaccacucacucccccauagguugacaacaucugcagucaccacucacucccccauagguugacaacaucugcagucaccacucacucccccauagguugacaacaucugcagucaccacucacucccccauagguugacaacaucugcagucaccacucacucccccauagguugacugcugccuuagaagcuucuuuuagcuaggaucagggauacacauuuuuaucuuaagcacuguauugcacacauaugcauacuggaguacgugcguguaugcauguguucaugcgugcauuaaugcaugcauguguuuuuugcuugccugaguacagcagggucacagacaugaacuuugguaauauggccauugguagccaugacugagccuucucagacaguguggccccugcucccuacaucaccuagccuuugcagauagcaggagcuccccuggccuuuuaucugccuccuagguggaaaguuagagugucacugccuccaguugcugcuuugucuuaaggcagauagguccaucagugagcucuaccauugggaggcucccuugccuucuuuaacuguccaucuccugcaauuaggaauguuuucuaagucacugguguuaggagaaaucaauuuacaagccagggagaaacguauuaccucucauaccaugugcuggguaagcaaauucuuuaucuaucccacugcuuagggacaaccugaauugcucacccuuuuggugugguuagcggcuaugcuggauauuaaaugugcaaaauacaucugacauuuucuuucccuugaaaaaucgagaucuuuaugcuucauuuccaccagugcugauacuugccucuugcauguggaacuccuuugugccucucagcuccauugugguuucaugguuccagauggagucacagugcucuccugucccaccucuaccuccccaugggggcuguggguguucuagaucucagaauugcccuugugugcucaugaagucucccucucauugucauuucaccuucauccucgagucgguacaguuuacugauccacgccauguuguccucccugaaagcggagagauccuucugccuacagccaaguuuuagcuugagcugaccagccuucagucuguuaagccuuuauagcccucugaugucauggaggaugggcccccucuuuugauguuuuuccuuagcaaggcguucaucucuucuagcauacuuuuuccaagcacuaacuuuugccuucugaaguagaggugaguguggaggugggugugggccuccgugggcagggucacuucccagugugcucugguuggcugaccagucagaggucaguguuugagugcuuacugauuccuggaagagaaaaggugacagacacaaacaaaacaaaccagccagucagaaguuguuucaaacauugcuuaugucuucugucuguaaaaauucuggcuguccuugacaaagucacugccaagggcugggcccuggaaccuagacuguuuauacaaauuuaguauuguuuugauuuuagauuuuccugggggaaaucguuguaaacaguuaaguucucagaaagaccuuugcagcaauaaacauaagcagauuugcacuacaguaaauccugcaguaacccaaguguaacuuugcaugggaacggaggcagaugaguggauaaacccauugucucugcccacaguggaagugaagaaaacagaaagcucaggucugucccagucucacccagggagcuccuaguggcugagccaggaagccacaaggcuguucacugcacccagcagcucugaggaggagcaacccaucucuugacccaucuuuuugcaggugugcuguggggacaguaucaggcucugagcugagcuguccaggucuaguaucuguccaggucucaguauccaggauuugugaucuguucucuaaagcauaaacaaccaggcuucauagacaaugauggucuagucaagccagagcgccuuucuucgagaaauuccugcuguugcuagaauuccuguuuggaaagagauaggaaugcaucucucaaacacuuagauuagccaagagaagagcugggguuaguucuaaagcaguggcuuccuaccagugaguuguaacccuucgggggucaaacaacccuuucacaggaguugccuacaaccacuggagaacacagaaguuuacauuaugauucauaacauuagacagauuacaguuaugaaguauaauuuuaugguugggggucaccacaacaugaggaacuguauuaaagaguuguagcauuaggaugcuugagaacuacuggucuaaaguaauuaccaauuagugacuuaguguaucauagcaggugaaacaagccuuggaccaaggcuguuuucuuccuaugacguuggcucauagcacuguauaacagagguaggugcgucuuaccccucccaggggacaguaaccgcugacaguuccuccuguugccaguccccacggacugcacacacaucauuugagacacagauuagcccugguuaguagauacugucuuccuugccauguuacaaacaaguguauuaaaaaauagaaagguaaaauagcuggcugaaggccaccgagcuggcaagggacagagcauuaugcaaguucccacagucugccucaggaaugacugccuccagguucuccugcuucaugaccauauaaauaaaaacuucagugggauggccgcuguuuucuaggaagaaaauggagacuauacauauguggagagagugaagauaccauuggaucacgggaccuugcuaaucauggaaggagccacacaagccgacuggcaggugagggcuugcagguagcaccgauuugcucucuggaagcagcuucuauccuggcugaggagucauugcaaaucacacagaagcaagugcuuauacugagcagguagcgguaaaaugaugucaugucuaaggaggugaucaaaacaggccucucagccgagauugaagguuuugugcugauagaggaauccacgacugugccgaccacugagaaagugacugcaaauagccccaguggcuaccauguugggcaucacagcacaacuauucuagaucagugugggugaggucucguuaaguacaaacauuuaaaguaaagcaacaguuagaaaaguagguaugccuugcugccggggcgcuggcccagccugcugggaucggcuggguacucgguucagaggaggagacccuuucucacaggacuguagaccaccuagugagagagauagaauaagacauaaauaaguuguaaaucauguugaacuaaugaaaaaugcacauauauuuaugcuggacaacuauuuauauuuccauuuagcaccgagugcccaaggaauaccacuccagacaaccgagaguaaacuuaaccuuucggaccguuuauccagacccaagaggagccccucggugacacuucuacagaguuaccacugaggggagggcuaugcaccuaacagccccuccccaucucccgcaagcacuuccgugauguggcuguucagaaagcgugguguuugcuucucagguucuacuccuccugaaugagagcugccagcacgucaccuugucaacaugucuacuacaggaacacuuacuuugagacaaaucucuaaaucaagguuaucauuaagcaaauuaaaaauugcucuggcuguacucacagaugauuugauccaaaagcuuuuugccuccugcucugcccccuuuaauuugaagaaauacaaauggccuugugccucuggggaagaucugaacauguuuguuccuuaugacguuagcaaaauggagauauaaauacgugucagugacucuggagccguccacaggcaggcagcugcugaaacccaaacagagguggcuucucugggcuuuguugaagucuuccuugacuccuuaacaucuuggcuuguauguuauuguaauggaaagcugcguguucaggacacuguuuauuuagcugaauuucccagcugucaguuuuccuggggcacacuuagguuacagacuucugaauacagagacagcagcagcucccauccacaccccagacaguucaccugggaccccucguaagaaagacagugcuguauccuggaagcgaguaauaacugagaaugucaggagaaccaggcugaaauuuugguugaagaacagcaaaugcccuguuaguaacugcuguuccaauagauuaguuuccccuggagaauuucuugagucauuuaaacccaggccagauagaaucagagcagcccugcagggaauagcuuggaugaccucauggcucuucuaccuuagauuucagaagccugugacuaaggcucuucugacucaguguucucuuucacugggugccugaguucagggguuagccugugaugucaccaagguuuccaaaacagaaucggguaguugccccuuuuugcaucauaaaaacacaugacucguugaccuugacucaggagcaauguacuagauuaauucaaacccagaggaagaguucaugucaguggaugaaagugggacauggguuagaguuucucccuuguccuugagggaaauuuacugucuugguuuuuaauccuauuuccauuccacucuguaagauggaugguccccaugacauggaacggugccagaggcuggacaagcuuacucaaggcucagauggaaugaguacggaacgaaucugaacagacucucugguuccuugugucagagucugguuuuuaaaaauguguagagcuccuuuuguaagaaauccuaaaucuguauacaauuugagcaucauauuaagccuuccuaggaagaagguaugaaucaccauaaacacacgcccucuauuuaaucucacagcuguucccugguuagagccaagaaaaccuggccaggaugguauggucagccuugauuaggaguuugaugacugaggcuggaaauuccuccucucuuccuuauaaaugagacugacaggugaccccaggucuuccagcaccccacccccauuguagaggcucuucucugccucccugccuuagagcagcgcugcaucucgacacucauuacagcuagucugucagaccacugagaggcugugguuuccaucuggguuucaugggcaaagagcagucauagcuucgguuucuugccuuuacuguagacuuccaugugcaaucagugccggauauuuccaccgcuaggaccccaugccuucucaaguaucaagcagguucuugccauaaagcagaacuacagaguuuagauguaagacaggaagagugauguucagugacugcuccagccugcugcagauccuucccaggaacugacaaaacugugcugacucaaaguacaugaaacagcagugcacagguuugguuuuagucauccucugugaguuuugguucccugcaggcucuguccugugagcuugcauuuaucaccucauugucccaacacugauuccacuauagagaugagaagcugaaucccuaaguauuuuacugcacaugugcuggcagagacaaauuucagaggcugucuuacgguuucuauuccugcacaaacaucacgaccaagaagcaagcuggggaggaaaggguuuauucagcuuacacuuccauacugcuguucaucaccaaggaagucaggacuggaacucaagcaugucaggaagcaggagcugaugcagaggccauggagggauguuacuggcuugcucagccugcucucuuauagaaccaagauuaccagcccagagauggucccacccacaagggaccuuuccccuuugaucacuaauugagaaaaugccuuacaguuggaucucauggaggcacuuccucaacugaagcuccuuucucugugauaacuccagcugugucaaguugacacaaaacuagccaguacagaggcuaacugagguggacucauaacugagguggagccauagccagcagcaggccagcugugugucccccaauuucucacacaucagggcaagugccugcaucuuauagauccuuagccaacaugaagauuuugucagaagcucuguggcccacugaacuagcagugucauuaaacuggggaaacuaauguuggcaaugguuggagguagaauucaguuuacugugaauuuaggaacagucuuggacagcaucccuagcaaguggucccuaagcauagcuaagcagauauguaugccucagaauuuucacagguaggugaauuucucccucugguuucuucuguugucuuacuacaugggaccucuggugaugugcaaacuauguaugaggcaucacuuuuccagucagcaaacagcaggugagcugggcuuuaccccagaaaugcagcuagccuccagccacgaggguuccgguucgcugacauaugugggccacaguucauaugucuggacucccuuguguuaccuccaccgccuugauucugcucuggugcauggcaggucuggcuggaucacaucaguaaggagcccaggcugccaagccauguucuagcaacccuggaagaguuaaguaggcuugcagugagcacaaugccccccucugacuguuucaggggaaacccugacagaugauggguuccugcucugcugggaauauuucuuccuuggguucuggcagcuuuuucuuggccacagaguaucuaagacccacuuugccuuuucuggucauaaacacuuagaguguugaaucugaagucuugauuacuuuauuuuuuaacgguuccguugaaaagccaguuguuuccauagugaugcauucuguuuguuuaaguccuuauauaugauuccacucacaaacuccucccaaggguuuuauuuuccucuuacacacacacggggugugggggugggaggguacugucagauuugaguuacaggaguccauucuuagauaagagcccugaucugguuagacaaaugacuugauguguaucaggguggaaggcuaauggugcuucccccagcuggguuaguagucacaggccugggcuguuacaaagccuuuccuugccugugaucagaacccggaguugggcuaggcuguuuguguagaauuuggggguugggcaguuucagagcacccagcgaggaagcagcacuuguaaccagcaucgucaaaaggaugacuuuugugcugucacauucccucgggggaaugaugaugucacccagcauaggaauagucccguucucaaguggcuuccaggaguauagaugugucacuguucaagcagagccuugguccccaguucgauccauugacuuggcucuguagacgaauccuguagucuaaaagggauggggagcccggggagucuguaugcugcuggccacauuccuucagacccgaggaaaagcaauuccaugaguugcucauuuguuauaagugcucuggggaaguguagcacuuagaggacuuaggggagccuggcuccugucugugugcugggagucaggugacagcagcuccuggggcugcugguccuuacccugggcaugcuaaggaaacucggcgcaggcaagaggaagcgacgggccgcgagagcgcuggagagccgcgugaccggggcugcaauuagccucccaccgcaggaaggccgugggcgugcagugacgagcucgccgcccgccaggguccccaaccagagcacauaauaccuugcccuuccgagaggcugcagcggggaggcggcgccccgccuuccuggccucuuggggcgccagccucaccacuagguagaagaaaagcucgccgcgggagccauucugagaggaagguuguauuagccuuggccgaggagcagcugugggaguuuguguagaguagccucgggcuuuccaaacuggacccagggauguucccacgcacggccacccaagccgacuggagaagagccuacugggguucugccucuuggccugcaggaugucccguccccgugccccccuccccccagccuucagcuucccccucauugucagggagaggggagauuacuagccaccgagguugcugggaggugagacaaagaacagaguuaguccuucauaagaauuuccuucauggccccaaucuugccuggucuagguuagacuacuguccucacugagcaggcuagaagacugaugcagaaagcacaacaggggaacaaggcagcacuggaggugacaagguucauccaacauucccaggaaccuagugaaggaacacacacgccccgaagggaaggggcgcugggccuaugaggcagcccugcaaggauugguguugauagucugcauacugcgcuaaccagguggccucacugcaccuugcaggguaacaagccccucacuccccaccccuuuucggccacagaacugccugcagggcagaaauagggagcaacucgacagaaccacugcagagcucuugggagugagguagagagagcuucggccugagucaugcagaccugggcuuguguccuagcucagcccuuccagaguaacccaggagcagccagccaaucaaccuucgagccccagucuccucagccaugagaugagcacacaagcaagccuccucucaagggucuugaaagggucgacaucugacauuucacaugcccuucuaacccuagccgggacucuuaggaugcgcguggguggucccuuuccgauacaaggcccucugaccaugcccauuccccccguguucccugacccugcacaugcugcugcuguugcagucguugagguugggcgugggaaggcuuuccagaggauggccagaaugaaaaauuguggggcuuaaucauauuaagaacugauuacacuugaauuaaauuccccucagacauucaagcugaagaaagcucucaggugccggaauggccuagcgcugaugcucagcuggccauuggcugcuuuaccacaugcuccccggguaauuuggucuaaggcacaccuauggcuggagcccagaauggaccccacugcuuucuccccgcugggcucacaaacaggucaccacugauuaacuccagaacaaaugcggccccgcccacauuguuuucucuucuccuauuggcuggccuuucuacauccuauacugaagaacuuggcccagagauuaauaaacaagacugcuaggcuuagagguuguguguucacaaccuggcuuuuauguccagagacugucggauguggugguggucagauaaacaaggagaugcaaucucuuucacuacaaauggaagcaaccaaggggaguuggauugucuuuugcaaaaauuaguuuuuuccacuuuugagguaaaccucaaaaggaguguguguucuucguaagaaauuaaaagggugaaaagaaaaccuuuguaacuuuggauaaggcaagcccacauuucucagugcuuuuucugcacaucucuguacuuuacagugaauuuagucuuguaccuuggugugagacauugaguucuugucuccagcauugcugaguggccacacagugcaggggaugggcugugugggauaugucguucucauauaguugcaauguaugggguguguagaucccaggagauauuggugcugucuuuauaaugggucaauuccgauuuggaaacuguugaggauggacacugggaggcaggaugguggcauagcuauagcccaauguuggucuuacugagaucucaguucaaagacgacaauagcagguaacacuuucaccaagcaccuugugaagugcuuugcauguguuaaugcaucacugccauaggugaggugcuguguguguguguguguguguguguguucacaugggucacaugcuuuauauacguuaaccucugacguauucuuucagcagccaugaggugccauuauguguauguguguguauacauauauacacgugcauaugaaggcuagaugucaaccucugguuucauuguccaugaguccuugaucauuuuuuauuuuuaaauuuaaaacaaaaucucucauuaguuguuccgaaggcugcugauuaggcuaggcugaguggccuuugcccaaugaaccuucaugccucuggcuucccggugcugagacucuuuaccaacugagcaucuuucagaauccaagaugcuguuuuuaucaccacuuuccaacaggaaaaaucuagcacaguccuuauccuuaguaucauggcuguguggagccucucgcaaccuuugagcauaucuguaaucgcuccucagaauaaaaauuuuaaagcaggguugcugcuuagacauaggaggcuguguauauuucuaaggcucagaauacauaaugcaagucauuuccagaaagguucacccaccugcuuguucuucuacacaggauuugagucugucuguggcauaagcuccggcggugugcugggucccacccucaguauucuccagcacuuacaugcuugaaggagaggcaucccagccccugaccuuggggacuuaguacaucacagccagcauuaggauggucauugguguacuuugggccacucauggagaaaacaagacccaccguugaagaaccacaaugugaagcagugggcucuggagaccacugcauccauaggcagaagaggcagugggguaguggucauggagaucugucuaguggaggggaugcuuagagaauggggggcagacucuguguaauagcccaaagcucaugagcgggaaagagcucuagguagccugucuagaggacccguguguggagagugucaagcuggaugagguaaugagaggacaagauggaccuggauggggcagagagcuuccuugagcaggggcuuggugauggggagccacugaggacuucaggguacuuuaggagugcaccccucucagaauugaugugguuugacucucauggcucccacagacuguuuugaaugcuuguuccucggaugguggcacuguugggaggcuguggaacuccuagaaaguggcucaagaugucagaaauuacuggggucggucugcuaaggguauaccugccuguuuccuccaccuagugcuuccuggucugccauggguguacaauguuucagucacacccuucgaucaccaugcccuccucacugaaaccaggaccccaaauacaucuuucuucacccaagcugucagguauuuugaugacaggguagcaaaagucacuaagauaaagaugcagugaggugcgggguggggggcgggauacaguaucauguaagaagaucuguggagauugugguaggcagagcuagguaucuguguggccccuggggauggauggagagguaccaggcauccuuccuauggagcaagagaaaaagcagacccaagacuccugccugagguuagaauaucaguguuaguccugagagcauuuggguggggaccucagagucaaacuucaccauccuuuauggaggccacucugcaagcaggcgggcucugccagccacggaaggacugccagcugccccaccaaguccuuggguggaaggcaccuuaaggccugcuucuagaagguggaugacagcucuuuccaggcagcuccuuccucagagaacuucugggagcugaguacuacuuaacgucugugguagcaaguggagaggugggcagagagagcagguucccuauacugcacagagugcuucucccaaaucuacuagcugggagaguuccaaugaagucaggucucagcucccccacguccccaccuccccuuaggacuuggugacuucucuccacguggaccagacuuguugcaagaacugagaaaaacagugcaucuguuuagugccagcaacucuucuguggaucagugagugguguggaggagaaggggcaggguggguggagccuguaaggcucauccucauggaacggcugcuauuuaugcaagucuaggacagacgaggggagcaaggacccaguuuguuggaaagacauugggguggccgcagcaggggccgggggagguacaucauggacaccagagagaaaguggagggaggcuuaaacccgaguguccccacagaagggaaagcaguccugcuaggaagaugcuugagaacagucugucccagcagccaggcuucccucccaccuugucauuaacuccagcccgacuggagucuccccacuuaggucaggaacagcaaagggccacaguuaauagggcagauaguuccuacagaauagacggugagagaucaggccugugacucaccugcaugagcugguaggugaucgucugucucuagcuccucagugaagcuuuuucugaccucagaccucaguuuccccagauggaauagcugcagguccacugcccaagagccuacucucccacccugauucacugucugcugucccugggacuccucagccgucuaccagauggcugccugccaguguugaaugugaaucaauccugugcccauuucuguuaccgugggaaagcaggagugggcauggauggugucuguauaacuccucucccauacacuuaagacuguaggcuguaccacugaaaacacuuucuugcucugagaaaauuacugccaguugauugacaguugagcuucuagaacauuuucuaggcccagugggcucuuuuuuaccucaccuuccacagacucccucccuggggagguccagcugucacaucggauaagacuuucggagcuuacagaccuggguucaaaccuccaacccgccucugcccgacuguguggccucuaggaaguuucccccgucucugauucuguuugaauaaaagcuugaggguaguauucuuuaccugggaggauagacuuggggggacaugauaggcacacacuguucuacacuggaaccagggccugagaucaauacucgggaaaaccaagcauugagauccaaccaaaggacuggcuggagcaacggcaacuguuccugcuugaagaauucaagaagaacguggcuucugcuucaggaguauccauuuccagcuguauccugagaguggccccaugccccaacacaucuuaaagguucagccaccuggccccagcagacuccgcuggcacccacagucugagcagagcacaugcaugccugaggaagaggggcucugggcccccaagaugugccagcagcagagugcaagcaucuaucucauugcagggucagccuagcacaucaugccgcaaggcaucuuuccaaccccaacuugugggcuccauuaagauguauacccuugccgggcaugguggcacacaccuuuaaucccagcacuugggagggaggcagaggcaggcggauuucugaguucaaggccagccuggucuacagagugaguuccaggacagccagggcuacccagagaaacccugucucgaaaaaccaaaaaaaaaaaaaaaaaaaaaaaagaugugcacccuuauaaggacccagguuuauuuuuuuuuauuuuuuuuauuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauaugaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugcuagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuggguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugauuuccauagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugagcauuuuuucaggugcuucucugccauucaguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagagcaagccauugcuguucuguucaggaauuuuuccccuguacccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauggguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuuuacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccaaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcaaccuugucuagucccugauuuuagugggauugcuuccagcuucucuccauuuacuuugauguuggcuacugguuugcuguagauugcuuuuauuauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauuucuuuaauguguucuuggauucgguuagcgagaauuuuauuaaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaauaguuugugcagaacuggaauuagaucuucuuugaaggucugauagaacucugcacuaaacccaucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauaagcuuuuguagaaggaucugaugguguuuuggauuucuucaggaucuguuguuaugucucccuuuucauuucugauuuuguugauuaggauuuugucccuuugcccucuagugagucuagcuaagggcuuaucuaucuuguugauuuucucaaagaaccaacuccucguuugguuaauucuuugaauaguucuucuuguuuccacuugguuaauuucaccccugaguuugauuauuuccugccgucuacuccucuugggugaauuugcuuccuuuuuuucuagagcuuuuagauguguugucaagcugcuaguaugugcucucucccguuucuucuuggagguacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaauguuggcuuuccauucuuaauguuguuauugaagaucagucuuaggccaugguggucugauaggauacaugggacaauuucaauauuuuuguaucuguugaggccuauuuugugaccaauuauauggucaauuuuggagaaggucccgugaggugcugagaagaagguauauccuuuuguuuuaggauuaaauauucuguagauaucugucagguccauuuguuucauaacuucuguuaguuucacugugucccuguuuaguuucuguuuccacgaucuguccauugaugaaagugguguguugaggucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuugauaacuuuggguuggaagucgauuuuauccgauauuagaauggcuacuccagccuguuucuucagaccauuugcuuggaaaauuguuuuccagccuuucacucugagguagugucugucuuuuucccugagauggguuuccuguaagcagcagaauguugaggacccagguuuaaacacaucguguucucauaaauuacccaguuugaucccuauaaacguccugacaaggaugaaacaggcaugaggcgucucagucucuggggagucaagaacauucuagcaagcucuagaaucaggacacacagggagggggucuugagcugcugcugcucauccccaugcuaugacccaggaccacgccuuugaaaguccuguucacuagcgucuacaaggcccuccaugcugccacccuugugcuagagacagcagugggccggaggacaucucugucauccagugacuaugguccaggccugcccucuccagaccucggaaagugguuccuuucugggcuccuggauuaagagccauacccuuacucauauuggcuuuugacagcugcagggccuggggcucugagagccaguugacuugcaaggucccauaguggggacaguggaggcccuuuucaaggcugccauggacaacaggaacuugauucugcuugagagagccucuacagucugccuuuauggucuuggcuccagcugcccucugcuuaaguuugccaagagacuuucaagggacucugccacuuucccucccgcaccucuccuggauccuuucagucagaucucaauguuuuuggaaaacagguuugccccaaccugguggauuggagugacccuucugcuucagccuccugaggagagacuucuuucaucuggagacguaagaaugucaccaggggcuugcuuuauacauauuuuuggcucaugguccaacaacagcagagccuuaggaggcaagggcaugucccagggcuugagccuccccaucugcauaaacaggguggagcuggauggaucuaaugcagagaggcuguguucccaggagacagugggguuugggguaaaggccagagcuagguuucauccucacucugcccuguuuguugugugcguguggcuuuggucuucaccccucuccucucuggacuucucuggcuucaucucagaagauugcuaagaucucuuugccucacugugcuggcugaggagaaaccaugucacgaaguucaagaauguguagcccuucauccuggacacagugauacucagaccugucgggaacagagauguggaccuaggcugaggaccuguggugagaagaugcccuuagcagggacacgaacucccauuucucccucaagcauugcugggcuacaggcugaacaggauuuuuaagagggucucuugggcucccaagaguguccaacucucacccuggaucugcugucccuggggacuccuccugaugggagcagcccugccacacuagccccgaagccuaucagcagcuggugucccauugcccaagggacaguguagcccagauuagagagugcauucaccccugccuggacaaggccugagggucugacuugagaccuucccugccuccucccugccucucugcccucucugccuuuugccuguuccuugcucagugcaugcuaacagcccccccaccccccuuuccuggagcuuugaggauugucauggcaacccuccagccaaauuaucgaagcacuuuuuaugcucccaauuguuccagacgagugcuaauucugggugaagagaagcaguugguaggaugcugaagucaagggcuuugugccaaaggcccgcuguaggguggagucaacaccggugggagaggagggugugagcagaggagauuuggcuguccaaaaccgccugucuguggccugucugcucccuuucccuccucuuaggucccauucacaucauacacacaaacaaaaacacaugcacgugcacacacacaaauauacacaugggcacaaacacacacacacauacacaugggcacacauacacacacacacacacacacacacacacacacacacacacacacaccucaagaggcuggguuagaaauaccccaaguacagacugacucagacagcccaucugaaauagcaccucucacugcauaccuagaucccugagaagcacucugggaagacauuagguuaaguuguggaacuaccgcagcugaucaaagcuauggaucauacuaggucugugccaauauaguacaggagccaguaggagggaccugacauucuuauccacaucaagggaaaccagagcagggaccuaggagaugucacccuguccuuccugcugugauguguccuucaggaccuggcuuuggcuuccugagauaccuucauguccugcugucaaccacccuggggcagcaugcugaggccuccuugaaagagagcuaugagcuagauggagaauugaugacagcuuuuuaaaagccuggcucugcugcccaaaagccacaguggagguggggacaguggaggugguggugccaaaaaccucacccugggcugccaucuucuuacuccaucugcuccguguggacugggccuucccccucagccacagccuggccuacuggccacucuuggcugagagaaagcaccugccucucacaaaugguucucuuuaacccugcacccuccccccccccaucccaggauuacagacuuagaaggguccagagaaucuaggaguggccuccugaccucauagauggguugcugcagcucggggcuacugagaaguaugacagguucaaggccacagguugugagaaacugagcggauucagccauccaggcaucugacuucuggucugguuccgguuccgucagaagggagacuacaggguacaaugggcugcagcaagguccagcagaccugacuuuggguuccugccucaggacuuggguggccauggcaaaacaccaaacuccacuggucacugguguaaagcagguaugguguuaggacccugcagaggaguccaggggguauuuuagugagauuacacacugagcccagagucugcagauagccagcgcucaacugagcacaugucuguggcccucuguauacucauggcugcagcccugaccagaagaugacuauccugcauccucuuuaaugaccaucccccaacccagggccuccaggcaaggccacguguaaaacuggauaaugcccccuccacaaacucagccuagugggcaucaggaauucagugccuaagccgcuccaguaugucuaccccacccccagguucaucuacccuaccauguucaugacagaacagaaggcuuugccagguauggugccacgugccuauaacccuagcacuucggaaacaggaggauggggagucgaaagucauucuuugcuccagcaggcucugagccgaucuagguuggaugagauccuguauggaucucaaaccagaauggacuggagagggcucggccuacaggauaggacccugaggcggcucuccagcauccuuaucaaaagcuuggcacagaggcacaugcgugcaauacagggcagggcagguagagagcaauaccugaacaaacagaaggcacuuucccuuccaccuguggaagauggauagauggggauagaguaaacacuggguuacuguccccagugcccuccugggucuuccuuugggcaagggcaauagaacccaauauacagcccaacaucgagacuuccaccuagaaacccaacuucagcucacuguggcuuaauauggcuucuuugaaacugugagucaggcagggagauacagacacagccccgagaugucccagggacuugggggggggcuucccagaucccugacauuaugcuccaccaaggggugggggaggggagcugggaagacccaggcaugagaucauaagggcaaagagggcuuugacgucaugcuaccacauguuuggaucucugaggaguggcucacuuagaccaucagccccccccccccccccagacucuacauaggcaucccaggugugaauccaagaaucaaagugacagguccauggcagagcagggccuagaaugugguuguauauccuccaaaccugacaggaacccuuggcuggcucugauggguggagcggagaugccaaaaggccaccuuugauggggcugguucuugagccgcuuggagcuggaggugcuuguggaagagaugggucagugcgggucaggugaccaggcagugucagagcucagauuggugguuacguuauucuugccauuugguuagggggggugcuggaaugaagucccauaacucaagcccacugggacaaaaacugcuacugauccacacagcagcccucaguuuuuagagggcaaauuccaucucucuacucucugcucuugcccaggcaaggaggaugaccucguggcuaauuugggcugcuuaccaugaagcacaaacuuccuauucucgcugcccugggccaggaucaggaaauccccauccgagaguggagagggacaguccagggcagcuggcuaggaaguuggagccaggagagcuuccuguuagaaaggaagacuuggcagagacagcauggccugcugggagccccagaaauuggugagcauggcgguuguccauuccaaaagggcuugugcacccugugugugccagaucuguccugugaccgcggcugaaagaccagggagagaaacaacacgcaggacaaagcucugacguggagauggguauauugcaaaggggaccaaggggccgccuugaggaagguaaacaggaagggcuucacacaguguggagguggcaauuggagcugugcguuggccaacaggugacguaucuaaggccacacaguggguucugguagagccaggcuagaaagggccucuggacucucauccugugagaaccucucuuagauucugacauuuccucuuagucucccucauuggucuguagcucauucgguagccuaggcggguuacucaggagcuauccaccuuguuuuauuauuuuuagacagggucuucucucauugaucugccacucaccuauagcugaggccagggaccaggggucaagccugucuccaccucccuagucccgagauugcaagcgcauguuaccauauccaacucguucucaugaguucugucgaucuaauucagggcuucaugcuucaugcuugcacagcaagcaggugacugacugucccccgcccuucuccuaguauaggccugucccagcccucugucugaagagugagucuuuuuccagccuccaaugaaugcuguuggacccgaugaauccugaaaucuucacuccaaccccacaggccuccccuaagccccauucuuucuuggcaucucuacuuggacauuucaugagcccccccucccccccgccaggacaauguugugucaauguaaagacuucaaacuagaaaagcuuuaauauauaguuguguucucauagcucugaggaaaguucaagcugguagacaacucagcucuacuuagccuuugagggaacccagaucaacggugguacuacugccuuuaacguaacguucccgugaucucuucauugcuggucccaccagagggagaggaaagucacagcaggcaguugcucuuggaaagauacaagugacaugcuauugcuggccacaucccacggaaggcaguucagcugaguggucuccuugcuauggggcgggcuagggggagcauugaggaaugugacucagcuguguggguagcuagugggcucugcccaagcauacucuuagaaaccaugggacaaagcucuguguggauggcccuguugcccucuccauccccgaccaagggcugaacuggcaguugguugcccauuuacccuccuuucagaacagucugucuugggcuccuuugcaacuuuguuggugacaucaacucccccagaaccuuagcuggcuucagguuuaucugguucuagacaguuccauguggcuguuaacugcuuuccugacaguuacugucucucuggccaaccggucacuuuucacuauuuuacaaugagagucaccccagggagauccaaaaaugauagauuuggaugacaccuuuaauauacuacuuggcccuagcagugauuuugaagacuuaaucuuuggcauaacaggcaggcuuuaagagacucugggcccuggucugaucacaugcccuuuggaugucuagauggcuuuuccaaccccaaggacaucaguuuucuggacucuauuucugccugccuccucuugcaagccagccaaucucuuucuuguaauaucuugcuaaaagcaacaccaaucaggcaacacgugcaaaaaaaaaauuuuuuuuuggcucuuccuaaccauuuuuucuuugguagaaucuuauaggcucaguaggcauguggucugauuuccaaauagcugucuguacaugauaucagugauaagcauuuuacucugccauaacaaaggucuugggguucuacucucuaguagcugucuaagccagugcuguggauuugaaauuuaucaggaacagcuuucccuucuggguacccauacugauauauggagcauugcuuaaacuccuguuaaaggcaaugcacagagcauugccuaaaguuuuaagaugcaagcucacuguguucucggaccugguauaauucugucgugagcauuucggaucucacacaggcagaaaaugaguuuugguggccagcugacagacuuuacaccugauaguaaauaguacccuugaacgcuuacuggagucaaaugcacaaaaguuagccuugguccccgugaccacaccauaucuucagauacaucacaagucaaaccauuucucugcaucccuaaugagaggcuuuaguggacugagucugaggucaugugacccaaggucaugugaccggaggccacgccaaaguggauacccugcuuuuucccaggcuucucuccucacaauauucagacugaguuuuggaaaacaucaauuggaggaaacuguuucaauaccauacugacguccucguggugaaauucugucccuaugacauggucucacgaccuuacgaagcuguaucuacuucuugucuuccuccccuguucagucacaaaggcugccccaugguugcugcacucaccaaucuuuuuuuuuuaauuauuauuuuuauuggauauuuuauguauuuacauuucaaguguuguccccuuucccagcuucuuaucuguaacccucuauccccgcccccuuccccuguuucuauaaggcugcucccccacccacucacccacucccuccccaccacccuggcauuucccuacacuggggaaucaagccuucacaggaccaagggccucuccucccauugaugccugacaaggccauccucugcugcauaugcagcuggagccaugggacccuccauguauacucuuugguuggugauuuagucccugggagcucgggugauggggggaggguccugguugauguuguucuucauauggggcugcaaaccccuucagcuccuucaguccuuucucuaacuccuccacugggguccccacgcucaguccaaugguuggcugugcacucaccgaucuuauuguugccuuagugaucuguaccugauguccaaacacuuuccuccugccuuggcacccaugugguuuguuccuucaucaccccccaacacacacacacacacacacacacacacauacugcuuaauuuuucacuucagugugguggcuaagagugagcacuugggagccaggaugccuggaucucagcucuacugcugacuacuguuggcaaguugcuuagcucucuugugccuuuguccucucaugagugcacagcggugauagugacucuggcuacccaagguugcugagaagcuagcauagugcacacuugcaauggacgaguugaguugaugcauagccagaacuuacccuagugcguuuggacugcuuggcagugccacccacucucuccuggugacuggcucugcacaccucccucugcauuuccuucaagacuccaguucuuguugauguuuucaugcucccucccacuggagugcaacuuuuaagagggaggcugugggcuccuucugugucucucucccugucuuaacaagcucuccuguagcuuaggcuagcuuggaguucucuauccagccagggcuggcuuugaacuccugauucucuggccuccaucucccaagggcugggauuacagguguauaccaccgcccuguauucaaggacucuuccauugcugcucuuguuuacacccugagugcucacacaaagucuuaauuggcuucuggucguggauauauagggaagccaaaccucacugagacccucuguugccagaggcggugaguauccugggcaaggccucucuccaaagucuugggaaugcuacccuuagcauuagccuccggagucuauccuacccguuuccuucaguuucuaguggacuaguuaauuagcccuuccgagccucccuuuucucgugugaaauugaaggaauacuaauuaucccacccggcuguuaggaggaugaacaagauaauauauguucagggagcuugcuagcaagcuugaauaaaguauaccagaugggagcuauuauuauuguuguuagugcccuauccaagugccacucugcgguucaugaaugggggugccggagggacuugggguggggagaguguggggagaagcaucuagggaauggaagaacuggaguggaauaaugggguguguuuguauucgugcguaaaggcguguguguguguguguguguguguguguguguguguguguguguagagcuuacggagccuggggaggggguggcagaguuucagaagcccucccauuuuucagagaucaagcacugggaguugggcacccuggcuguggagacuggcaggagaaccagcaacugcccuguggccagugugccuggaaagguaccaagggggaagagccugcgccucuggagugauuggagcuggggggugggggaggguggggagcgaucugaaaccucuuggccacucggaucugugcagacuuggggcugggguaaucccagaaccuacagugguggcucgguucuguggguccagaagcagcggggugcucuugcuggaugggccgcggcaggcggggcgcgccuuccggagcguggcuggcgggcggugccggggaagggaccguuacuuucccagaguggcggggagggcgacgucaggcggaagggcgcggggcgcgcacgcuuuaaauggcauucgcugucauccgagcuugcagccgugugggcagaggcgggcuauauaagcggcuaggcgggccgccgcgggguacacggcgacagcgacagcgaccgcgacaggggcggcagggagccucucgaagcaucgccgagcagcgcagcgcagccccgcgccccccgacgggcccgcccgcccgcuaucccucuccagcagcgucggcucgggccagcgaggcccgccgccaccccgcagcagauuuggaucccccgcccggagagccccaggcugucgccucccgggggaccccggagccgcggccgcccccggagagcccgggcgccccgccaccccccggcuccgcacccgccgacggcgccauggcggccgccaagcccggcgagcucaugggcaucugcuccagcuaccaagcggugaugccacacuucgugugccugaccgaugaguucccgcagccggugcggcccgccaagcugcccaagggcaagggccggcugcggcggccacgccagucccgcuucaagacgcagccggugaccuucgacgagauccaggagguggaggaggaggggguguccccgauggaggaggagaaggccaagaagucguuccugcagagcuuggagugccugcgccgcagcacgcagagccugucgcugcagagggagccgcucggcagcugcaaacugaggaacagccuggacuccagcgacuccgacucggcccugugaggcgguagcccgcuuggggacuugcuccaccgccaagcgccgggaaacagagggagcauccggaggggacccgcuccccaggcggccccgaccacccggggucagcuccccucacuccuugggacuguagcccggcugcggacccaccggggucccgaagagcguucggggacgccagggaggggagucgcuuucuuugcccuuguaaauguuuauuuuuuaacucuuucccaguccgaacucugcugugagugugcgcgggaggcggcuccgcugagucggcucgucgccgggggucgccgaugcaauucggauucugcacaccgcuccacugugccccaccuccagcgcacacccguucacacucacgccgacacuuucgcugaacacuuuuuauaauuguugggcuaacugaggggacuuggggcgcagcgcggcugcugcugcagccgaggauugauauuuauuuuugcauugcaauagcugaaggcguuuuauuuaacggucuuuuuaccuggauguugucugugaggagucuaaauggacacaaauaaagccaauauauuuacacugugcac

SEQ ID NO: 937 - RNA, 125278 nt, Mus musculus
cuucgccgucacggcggcaccgccuccucgucccauucauucuuuuuuuuuuuuuccuuccccauucaccguaguagugaggccuagucacgagccauggagugcgcucccccggcggccggcuuccuguacugggugggcgcgagcaccauugccuaccuggcccugcgagccucguacucgcucuucagggccuuccagguguggugcgugggcaacgaggccuuggucgguccgcgacucggagaaugggcaggugaguggaaccacaagccgcgaccacgcuguggcccuuguuccccugucgcucgcgcucagcgagcccgcucuggagcgcggaaacuucuccagacccugagcgcacuggcggggugggugaucugaccugcugcugccuggugggcacggaggagaccuuucuuaacuccccggacuuguccuguuggagcccuccugggcaggcggccggagucaggcgcauuguccgcugugucccuugcaguguuuauuuauuuuuuaaaauaaaguuuuucacuuggcuugaaaacuggcccugugcuauggaugagagcauaggugaagauaggaagaaggguugcagggacaacgauuucagaaguuaggaucuugggaaacuugauucuccaguuacuugaauuggguuuguuucauguaauuuaacaaguccuuuuggggaggggggagguggaggcggugucggaggaaaucuugguaaauuauucuggaguuucaaugacuaagaagcgcuguucugggaaaacaaagucuuccuaucguauucaguacuuuuugcaagaguuugcggaaaaugucuuuacaaaaagugaccaaaacacgcgaaccuucuucuuuucaguugacagauuuuaaaaaugagaacgaaggucguaucagagaaguugagaaaauccuaguucagcccucucaccuuuguuucuauuuuuugagagaagggcuuuaaaacaaacacccauguaaucaugauguauguguggcucucugguguuuuguaacucacuguucacgacucaaacauuuuauagaauauuggggugcgguugccuacggacuaaacacaggacagaaaucauguuacuuuucagguuuguucuguucauuaaagaacauuuaaacgacuuagaaaagacaugacaguuaaucuuuugggacaacacccuaauaauaggagaaaauauuucaaguagaaaugaguuugugagccccuuuccuugauguggggcaaacagugauuuuauacaacuuuccaaaaucacuuuucauagucccugggggaaaaagugcucgcugugauuaagauucagaugauauaauuucacaauugacuuggucaguuucuuuguugucagcuuggaaaaaguuguuuguuggcuuauuuuuauuuuuuuuuaagucaaugcaacaguaaucccauaggaaaucaguuauccaauaaaaugaaacuugcaaagaaagcccaguguugcuuuagcuuuauuauuguaaauuguuugcacagucuaaaacgcagagugaaagucaaggguuugccacguucaagguagguuuggcuccauccagacaaagggaaacugguaaaaauuaggaaagcauuucuggcagauuuagaaaagaaauuugaccuagaacauugggauaugaaagagaacuguggugucauauggaagugaaguauaguuggggucaauuguuugggguuuugguuuuuuuuuuuuuuuuuuuuuuuuuuuuuuuaaugcuuaagcaaaagaaaugauaagcaagauggcuuagcagguaacggcaccuggccuacacuugacagccugauuuccaugcucaggauuauccacagaggagagacugacuucucuccacaugaaugcuuugguacagauagcaccuccccagauaaaacagcaccccucccccgaggaaauguaaacuaaguccucacuuguaacucauaaacauauguauguaaccuacaucuuuaaacacuuucuuacucuucaaauucagauauuucagaacuaggauucagaugaguucuuccuuggcagcgguugggugggaguagcauacuauguagaagacagacuagcagaggcagcaccuggggucccgguaagcugugguuaggcauugagcuggggagaguugggauaguaggguuaaugcuaauauguaggcagcauuguuuucucccuuacaggauugcugucucaaucuugagugcucauuccugggugaucuguaaauacaugcuagugggaagcauucuuagggugcucuaauuucaguccgugauguuaauuuaucuucuucucuauagacaguuaaauaguuuauucuguagaaauuaguagugguucaguuuuugucaacuuggcauaagccugggucaucugggaggaggacauuuaaguugagaaaaugcacucaucagauuggccuguaggcaggucugugagggcauucugccuauuagggauugauguaggcuggaccaucccuggacccuggacuguauaaaacacuuagucaagaagagcaagugagcauuccugcauggccucugcuucaguuucugccuccagguuccugcuuugcauccuacucugacuuucuuccauggucugugaucuuucucuaaguuguuuuuggucauggucuuuaucauaguaguugaaagcaaacuaggacauaauuguugaauuaauaggauaauaaaauuauuaaguuuagauuguauaagcaaauaaauuaguguagaucgguuccaaugccacuaaaugcuauuuguagauaaggauacauuuggaaaguuacuauuuuauuuugcuucuuuuuucuuguucuuaguuugguauaacacuauuggguggggccauggaucuuaugcuaguaaucuagugugauuuuuuuuagggcaaaaaaaccccugcucuaagccgaguggugguggcacacgccuuuaaucccagcacuugggaggcagaggcaggcagaucccugaguucgaggccagccuggucuacaaagugaguuccaggacagccagggcuaaacagagaaacccugucucgaaaaacaaaaaacaagcaacaaacaacaacaacaaaaaaccugcuggcagcuucuucaggcugggcucagcuaccuguuuccaaguaauggugaaaauggaggaaagguuacugcaguuggccacguugggagaggaacagagaaagagucccgugaucccaaguguguguucagccaaaacuuuagauuaaaucagggagaaauugggcaaguggugugcauaauuaagcagcuguggucaggguguggucuugaccccuacugacucuuccuugucucaccuuuguuccuuugagcuggcaugagaaguuccucucugucauccuguccuaguugugauucucugaagggaccauuuugguugcuacaggcugaucagugacacacugaucagaaaugucuguuccaggauguucucugcccuugugaacaguggccaacaccugggcuggaagguuuauuccuugcccuuccuggaauuucagaauguacaguuuauaugauuucagcagccaaggacaggcacagaaagacggaagaaaugccaagcuucccucuggcauuugguugccacgugggcccaaguggggagccagugcuguuuagucaaagcaguuucugagugucuguuugaguaagggccagugagauggcaaaugggcagcuccugagcagauuguggugggaaagcagugugcuuagugcuccgggagcuugggagggacaucggagcugucucugaaagugauuccccagcggagcucucaagcgucugcccgagauagccuggugaagaguggcagaacgcagaggcaagaacagcuggcagauagcguuuuucucuggggaaaggaaaaaugaaggcacuguggucugagaauucuguuagcagggucugagugaucagcuuguugaguggcccagugcuggguuauuauugucucaaggaaucccguaauaccacagugugaauagaaaagccucucucagaaagauagcuuuguuugaguuucugauuuuuguuuuuucucccuaggaaaacaagguaaauugugucuucucuccagcugggaauuugauacucugcuuucuaaaaaguuacuuguaccaccauuaagugauguuacuauuucaauaaccuagucauaggaggaauggagggaaggcuagacaaucuaagaacuuuaacaaugaggaccucucaaggguguuauguuguaauaugguuaacagauuggcuuuagagucaucugggcaaagguaaacuuuuuugcucacuaagugaccuugaacaaagauagcuaaccuccaaguauaacuucaucuuuuaagugagauaaauauguuucuaauguagucuuguacauuuucauggguaauaagcaaucuuuaucauauuauauucauacaaagcacauauauuugauuaguggggauuguuggaaugaagagacauagccaacuucaugcuaacaaucugaaguuauaaaaggaucauugggagguaaugagccuggccacaggagaauucugugcuuaguaaaaucuuaccaggcaguucuuugugucuagcucccuucaguaaggaaaagcuaggauagacuuagacagauucaguugugugcaguuuuucaaguacauuugaaaaaccuugaggucaucuuugauccuucuccaaauauaaucuguuaggaaauuccuuugacucaaauuucaagguauacagaggcucucauuucuaagccuuacaaauucuucugugugcuuucccaguggcuccucuccagacgggccguggaaagcuugugcccacugucaucaccaguccacuucugcugcuuguuccuaggagaugggaagcauuagcagggacgggccgugggcaucuaucuccugagccuucaguguuacugacucaguaccugcugcugguguagcucaagguuaugguacaggcacauucaacucuuccugcuacaguccuggacuucagggauugguccugucagcugucagugcauggcuccucagcacgagagcauuagagcuagugauucucaguggugucuggagcuugcagcaacugcuguguuggcucuucacagcucuuguuuuccuacagccucagcacugcagucucugcuccuggcugcagucugggauucuucagcuuccuucuaacugucucuguuaacacaccucugcugaguaugccuagggcugagaugccuaggaggugccugcuuuguguuaccugcucagacucuuccaccacgguaaugaucuagagccaaugagaaugcugcucguccaaaucucuccaaucuccugaguguucuagcuguuaugggugggggaggugcuccucuccagccagaguaaggacaguaagaucagggugucugugggugguccagucaucuaagggucaucugaagcuuucauaacucaagacuccuggagcaauagccaugacaaucagggguucuggcaacuggcuucauggcucucugggcuuacugggggcuugaguuuucuuugggugucaaaggcuggauuacauucccccuagacugguggaauauuuaacauacccagagcugccaugaugucaguuugaggauccgagaaggagugacugcuuuauggauagcucuggggggguucccugaaauagcugaagcugcaauuguuacagaguccauggacccucagcauuuuaucauguccuguagaccagauguggccugcuggauuugccugucacuuagcaucaccuuucagcaaugcucuuuacaagaagucuuauucaaaauuuucuguggaccagucaacaguagccaguuugcuuccuauauucaguugcuagaauuaugcuuuccuuguagcaucuggacuagagauugcuagcucuuacugaaccugccaugcagucccucuuuaucaguguuaccugggugccucuuuacagaacacuuuguacaagucuacuguggcauaaaaccccacagucaaauuucuccuuauacuugcacagaauuuagcuucagaauaucaaguuauuggcauauuuugaucugcuuuguauauuucugacaucucuuuaugaauucuuuaaaauagauugaggauuggagagauggcucagcaauuaagaacgcuggcuacucuuccagaggaccuaguucuguucccaccacccauaugguggcucacaaccaucacuaacucaagggcaucugcccuccuugggcaccaggcacacacaugauacccauacacauaaaauaaaauacaaucuguaugccuguauucuguaugccugugugugugugugugugugugugagagagagagagagagagagcgcacaagcaagagcgagagagugcacagugcacgagcaagagcgcacgagugagagcgcacacgcgcaggugcuagaaacccaacccauaucuucuggacgaacagucaauguucuuaaccacuuaguuaccuuuccaggcucggugcaugcuuucuugacuuuaucuaugcaugguuuacuauguaccaaauuuaaccagguguugaauauugauuuuguugucugagauggucuuucuucuauuucacacucaucuucacacuuucugcuuauaaauucaguccacuuuuuagagcauugugauuuuuuucuuucaaggucuauacauauagaagucacugcacauuuuagagcugugacaaugcuuuguguguguguuugccuauuugucaccuuaguugugugugcaugggcuuguauauguuacaugugcacacccaggugaaugagauaugucauuuguucuaaacuguaagcccuuccggaguucauuagaauuuuauuuagugaauauuguguuauguuuggaaguggguguucagcuuuauuuuugcauuuugcagaguaauuuguauaucucccccucuugguuuuaaaacuccaaguaucacauaccucugaaaagcuagauugaaauuaaucaaggcuguucagacaaagacugguuacaaaauuaugacagugagaaaucuaugggacauuuucuuaauuaguuauugauaugggagggcucagcucacuguuuuugcugugaccccugggcagguaguucuggguuguauaaguaugaggagcaagccaguaagcagcauuucuccuagggccuauguuuuaguuccugucucggcuuccucugauaaugaacugugaccugagagccaaaucuuuccccuccagcaugcuuuuggucauaguguuuaucacagcauuagaaagcacacuaagacaugguugcccacuggggcauugacagccaucaaaggcugcauuccugaagaaaacugauucccccuuuccuaucaauuccuaguaguuuuucagcaaaugaacuggaauguugguuggcuagauuuuguguaggugugaauguaguuggaacugcagggguuggucuguguuuuguggcccuguugugcaccaguccuccacuaccucugacucugugaguuuugaaagugaaauauagucagucaguccuugaguggcaugaugacaggcuaagcuuucuucaucugugguuuaggagauagacacugcccccauuuaaauacuuaaauauuaauagcaucuugguagcaccuuuauuugugcucauaucuuccuuguaaaaauguucuggauagguuuuuuuagcuagaaagguuucuccuugccccccaauuaaagugaauaaaaucuugcuaauugggaaagcuaagauggauuuguagaaauugaaauucuaacauauuuagccaaaauaguuucuuuaaaaauuugaguuucugaugaaauaaauccaagccuucuagaaccuucagcuccuuuuaaaagaaauucguuuuguuuggaucucauauagccaaggcugacuuugaacccacuauguagccaaggaugcucuugcccuuuggaucuuuccacccccacaucucaaauguugggauugcagguuuguguaaucaugccugguguaacuuuuauuuuaaaauacuggaaacagcuccagauuucuuagaaaaauucuuuaguaguaaagacauauauacagaaacagcaacugguucuugucaggucauagcaaggaaaauaaacuacauaaucaagauuaugcaugucuagggaaaggccaggugagcuggauguugaguguccaaaggcagacgguugguuacagcucuguagaguaagagcacuaacuagggcucggacagcugauugugaugguggaguagugaagaaagcgcuugggggugcauuagaggaaaagagcagagaugauuuguagugcccagaaagccuccccaaucugaaauguacccuaaauucagugccccuaaguauguggcacccacaaaaauuuagauuggggagcuuaugauuuuagauuugucgcuuaguacucagcugcuuacguuuaugcaaauguuccaaacuuuaaagaauucuaacaaauccugaaacacgguccuguacauuuuggauagccaaucuguaacaaugagauugcuggugagaacacauuuuauuaugcauuccuccaauuuguaugaggaaaaagaugguccucugugcaagagccugaagauguaaagaaagcauaggaaccucuagcucuggagggcaccauuaugucacucacuucguggacccuccuacacauuaagaguggugcauugggaggggcggagcgcuuguuuauuuuguguaguguugcaagcuaaguuaguggauccaagaucucuagggucucacucagcugugcucauaaccuugauuuuacugauucuguugaugacaaugaauugccaaagaaauauugcguagauuuaguguaugcuucucaaggcggucaggaaaggguacaguuucuuuuagaaauuuaaauaaccaauuuuaaaguucccuuagcauuuacaacauguggaaaacucuuucucuagauugguuuuucucuaaugacuggcauuaacugcucacaguuaagcuagcuucaaguagaaauacugccauccaagcucaaaugacagccgagacuccaguccugucacauaaacagugcuggugcaguaaacaagcucccuaauccugcacaagcaauccuagaauuuugggaugcacaggagcuuacauaugucccagugccuagcauugccuguccugugagaggaggcagugaugcccauaggcaacgugaacagagagagaaccagcgguuccacgucaggcugggcagcaacauucucacauucuggacuacacggcacugacuucaugagauguuauuguaacggugacauuugcagaguccuuuuugaguauucucaaaugauuccaugucaacccugugaggcagguuagcacugguuugcuguuuccacaaaauauaccguuaccagggagcaaaacagcaguagguguaaguaagguuuauacagcaagcaaaugucagaaaaauugaaucuugguuucuuucuuuuccuuuuuuuuuuaaacuuuaaauucuacacucuuuccaauuuacucugagaguuucucaguaagggugauuuuaaggcaaucuggaauacaugcacaagagcucacaguugaaacauuccucaaauguugcuuaaaugugaaagguccauucaugucauggcuagaucuaaacuagcaggacuuacaagaaucaugugugcuuguucaaaguagguucuaggacuucuacagaccuacuuguccaaagcucuaaaaaaagaaugugaaguguguguguguguguguguguguucauucuccccuucuccacuuucucccuguguagccgaggcaaacuuggaacucauuaggugauccaugcugaucuuaaacucagccuccuguugagacacugggauuacaaagguguuaccuccacuguccagaaauuuuauuuuuaaucaauaaagauuucuuuaaaaaaaaaccaacaaacuaguacauuuauuuauuuggggccagaguacacacaugacacagugugccuguggaaaucaggaacuugaaagagccaguucucuucuuucacugugggaguccugccuugucaggcuugacagcagcugcauuuaaugcauuuaccugcuuagccaucuugucacagauaaaaauucuuaaggauuaaagagggguuagcagcuaagagcaccugcucuguaaucggaagaucccaacacccauguaauaagcuggauguucccacagauaccugcaaccccagcuauugggguggggucaguggagaccacuuucacuggguuacugggcuucgaaccuagcugagaaagcaggagagaaucuuccucagaaagaacuggacucugcaugugcauaggaguaagcauccacauaugcacacaugcaugcauucaccucacacacauauauacacauguaugcauucaacucgcacacauaaacacauauacacacaugcaugcauucaccucacacacauuuacauacauauacacauaugcaugcauucaacucacacacauuuacacacauauacacauauaugcaugcucacuugcucccuuccuccccuccccaccaaaaaaaagaauucuuaagaugccauccuuuuaugaaccuauuauggucagcuuccucaauccauguagacuuucuuguauccauuuuugagagcagggcuugauuuuugacgguguuaaaacuuucaguguuucuguauuuaauauguaccuuuaacuuugacaauucaauggagauucucuuauuggccaauucuguguuuguguguuugaaauagauuaaagacagaggaaaacauuugggucucaguauauugcucugugcucagagcuucaggagcaccucugcugucucccaguugucccugguuggaagcugggauugaggacagaggaguugggcaaauagaauuuuuuaauuuugcuuuuuuagguaggucuauagaaauguagcugaaagcuuugaaaauuuaacagcaaagagcugagaaaaucguguuuguuauuuuuuucuauuggugauugauuuuuauuggcucaauauucuuaguuuauuuuuucuuauacuuagggaaaagaaacuuuuaagucuguuuucuuauaaguagguuuuuaccucuuuuuuguguguguguguggggcuagagaaauggcucagugguuaagagugcuuccuguucuuccagaggacuugaguuugguucccagcagccacauggaguagaucauaauuacuuaacaucugcaggggauccaguucuucucugggcacugcauucuugugcacacuccaccaacauaaaacuaaaaguguaaauguuuuaaaaggucauuuucuacauuaguuugaguuccuucuuagugaagcuucuuuuuuucuguauuuuauuuuucuuucuauuuauuuuugaggaaaguuucuccaaguggcguuagcuguuguagaucaggcuggccccugccucuggaauguugccacugauuaccuuguuuuauuuuuuaaagacauauuuacuguugcccaagcuggccuuugaacuuucgaucuuucuguuucagccuucugagggcuaggauuucuugaugacucuuguggaugcagguguguguacauguauguuuuuugagacauggucuuguauuggucuagggcucaccaaguagaguauggugguuggcuaggaaguucuagguauuuccuuguuuaccuccuuggcacugggauuauaguguguaccacccucuuagcuuuuuaaauguggguuuuguuaauuaaauucggguccaucaguuuaccaacugaauggaacgaucuccccaaauugucauggugauucuuuaaacaaaaauuauuuuuuagauuuaguuuauguguaugaguguuugacuugcauauaugaauguguaccauguauauuuguauauuccuggugcuucuacacaacaaaagaagaaaccaaguccccuggaacuggaguuacagaagccaacuugugggugcugguaaccaaacacacuguucuguaagaagaguauauauacuaaacugcugaaccaccucuggaccguuuagaauggcccuuuaaagagucaguauggaggguagaaguaggaggauccgaagcuuaacauuauccuuggcuacauaguaaauuugaggccauccugggcugcaugaggugcuauauaaaaaacaacaaccaaaaaacaaacaaaaaugcaguagauugaauaggagagcucuguugguggcauuaaaaauauuuucccuuuagacuuuauuuauuuuguuuguucauuuguuagguuaguuguuuuuucaagacacgguuucucuguguauuccucacuauccaggaacacucuuuguagaacagccugaccuugagcuaacacacacacacacacacacacacacacacacacacacucucucuugaaugcauacagacugaccuugaacucugccucucaucugcugggauuaagugagcuaccacgguccugcuaguuuuguuuuuuaaaguuuuuaggagacuaaaggugaaucccaggagauuguaggauagugguguccacuaaaggaggaggguggggacugaguaaggaagucagaugagagagaguggaagcaaagaccauaagccuuuucuuuuuuuaaaaguaaauauauguucauggagguaagagaacucugaaguuuuggaggucugugcauugacaaauaugaaaagaagaagcaggcauugagaaaacaaguacugcucuuucagguuauauagccacguaaucguaccauaggucaacaccaggcugagcucagugcuuuacguucugugugugaguccuuuggcucaacagucgguguccgacuuguaugcuguaguuuacagucagaagagaguuuagaggcucaggauguaauguuuuaggaaagggagagagagcauugguuuugaucagucugaguauaucucccaaagcacuuuguacuguauguugauaaaucaguuuacccuuuccuucuuggacaggaaguauauauagggaaaugaaagcgcugaaucaauaucccacauuuacauuuuggucaacugcucuuugucucccuccguccccucaguuuuguuugucuaaaacccucaccuuguauaucuucugagauguuugacaucaaacaucuugacagcacuguagacuauaagcauuaugcagccucuggacuucaggccuuuuccccucuuccauuuucaauuagauaccuaaaaauagaauugucccaugauucaaucaaacugugugagauucagaucacugcaagguuuauuuuggguucugcugcagcuuugucaugaucaacacuugauucucuuuuugaugugauuaucuaauauaugucaauuuuagaagauaacuaaaauagacuucuccccuacaauuuuguuaacguaagcucuauuucugaauuaaaaguucaguuaguuuaaucacaguguuaaagacuuaaccuuaagcuuugaucuuaauaagcauaagaaguauggaaaugaauuaaggauauaguaaaauuauuacuaaugcagugacauuucaacuguuauauaauuagaagauuuugugcuugacauaacuccuauuauuuuauuauagacauuagucuaagagacuguuacaaguucaugucauuucuccuucaguaucccacuguucccaucucaggcuaaggggaaauuucuuuguuaagauuuuuauucuuauuucaaaauuagauucuuuuagaauuaugcuauuaugaccuaacaguacuuauuuauagcugaaguaaacucuuuggaccagagauuuagcucagugguagauuaacaugaaugaauuccuagguucagguccuagaaggacaaagaaagaauaaaguaauaucuuugaaaugagauaauuuucaaaauuugcuuagauuuuuuuuuaagucauaagguuaggauuauauaugaagauuaucaaaccuuuuagauauauuuacuucacaauauauuuguuggagauugugaauucuuuuuuuaguacacacuauuuauuaauaugacugugaaugaaauauuuuuuuuacuuucuguguuuuggauucuacuagaagcaguuuuugagacagcuaguugauuugcaugauaauucuaugaagcacuaaguacacgguagcugucuucagacacaccagaagagggcaucagaucucauuauaggugguugugagccacuaugugguugcugggauuugaacucggaaccuucggaagagcagucaguguucuuaccugcugagccaucuccagccccgccaccuuacuuuugacaaaaggaauaaacagcauauguuggagaaaauguuacugaaaaaccugguuuccauguguagaaaaaugaaacuagauucuuaucuucaaaagucaucucaaaaugaaucaaaaaccuuaaaaagaucuaaaacuuggagacugcuagagaaauugcuaggugaaacaauuaaaaauugagaaggacuugaaaaggggcucaaauaccacaggauuaauccccaaaauugacagagcggcugaugacauuaagaagcuucugaacaguaaugaaauaacguugcuggccaugauggggcaugccuuuaaucccagcacucgggaggcagagcugcguggucucugugagcucaagccuggccuucacaaaugaguuucagaccagccagaguuacaggugagacuccaaauaaauaaagaaguaaaguaagaaaggaagagccaucagagugaggaaacagcccacucacuggggugcgggaguuugcccacuauacaucaggcaaggcagucauaucuagaauauauaagcaacugcaaguccauaccaaaaaaaccaaauuaauaagugugcuaaggcauugaauagacaguucucaaaggaaacuuuaaagaugggcagcaaauacucgaaauuguucgucauuucuagccaccaucgaaaugcaaagugaaccuacuuugagauuucauccaacacucagugcuuaccaucaagaaagcaaauacgaaacgcaggcuaguuuguauaaaggagagagcucuuagucacugcuaguagaugggcaaaugcaugacgccacuacagaaaucucucagagaaacuaaacauagaacuaucaaauaacccaccaauaagucauuguaccacagagacacuuccauccuguguuugauacuguguuacucacaguagcugggaaaugcaaccagccuggagugcggccaugcucuuuuucccuagugauguuugaaugcagugagugcguuagagauccugcucucuauuccugacaucccuucuguugccugcauaagccacgccaguuggugaugcuuuccacugugguuugauuuuuauuugauucauugaguucuuaaguuuaguuguaucuaggucagauuuuuuguuuuuugguuuuuuuuuguuuguuuguuuuaauuuccuugcuguuuuucuuuuauauuacugacucaccaauuaugcugauuuuucaugcauuugauucauacccuuguuuguguacucuuuauuuuuaaauuaaguauaugaaugugucugaaugaacauuuguccagugccacggaggccaagagggaagcuagaguuagaggugguugugagccaccugaugugaguugaauuuugguccucuggaagagcacaugcuuaacugcugagaucuccuuucagguugcugauaauuuuuaccaguuaacuuuugcaauacucaucuggcauuuucucugauuaaguauuuuugaguucaguaacugaguucagaauaugagguuuugaaggacucccauuaauuacauuuccuuuucagguuucuuggacuucuguguugugguuuauguaucuauagccuugacugucucuucugguuuuauuugagcagcuuauucuuuuuaaaaauuauuuuauuuugauuuauauggauguuuugccugcauguuuguuugugcaccacacacguuacuggugacuaagggggucagaagagaacaucagaucucuugagacugaaauuacagugaaccuccauuugagugcagagaacugaacuuagguccucaggaagagcagccaguucccuuaacuguugagcccucuccaucucugagcagccuauuccugaacacuugauucccagcaaggcggaggcagagugcuuggaauucagccggaucugggcucagugcauugcuguccuguacuuuucagcugcccuuugaccugccuugugacuccugaagcuucucuucuuggcucuauguuuucuuguucacauucuuuccuucagcugccacggaugucacuucuagcccaccaucucucccccuuccccuuccuuuguaaauagauucuuuucucacauaauauauuuugauuaugguuuccccucucucuacuccuuccaguuccuucccaccucccuucccuuccagauccacucucauuagaaaagagcagacuucuaagagauaauaaaauaaaacaaaaauaaaauauaauagaauaagagggcuggugagauggcucaguggguaagagcacccgacugcucuuccgaagguccagaguucaaaucccagcaaccacaugguggcucacaaccaucuguaacaagaucugacgccuucuucuggagugucugaagacagcuacaguguacuuacauauaauaaauaaauaaaucuuuaaaaaaaaagacuaagaacugucacaucguuuuggacaagagaaacggaagagaugaagagaagucacagggaucagggaugcauuuguucacacacucagggguuccauagaaacacuaaccuggaagcuauaauauguaccaguauuugauugcuuuuggugcgucauauuuugcaguauggugugauuauagcauugaacaaauggacagagaguuuguucucauauaucuuacaucuugauugagaaagucagaccauaaaauaguuggcaagucuagugagacguaguaaaagaaaaauucaucaugguagagauagcguaauggggaggguggaaggagaguuugcaucccugcuauuuuccauagggaugcagccuuucccauucaggugacaccuaaacugagaucugaauggaacuuucuucaccccuuuccaaccauaugggacucauuauuguucuaaugaauuuguagcacaaauuaacuuuuguauuugcuuauuccucugccugggguacucuuaauagguagccaugauuuaaauaaauguguguggggggagggucagcagagagauuacagucagcuguuaucaggcaaauagaauucuucuagaagugcaaaggaugaaacugacugcuucugaguuacauagauaaucccaauugagaccuuuguguuucuuugauaaauaauuuuaaaauaaugcaucuaaauugaggcccaucacaugcauauacaugguacuuggaucucuuugaagacugagcccacugaaauuauuauugcuucuucacaaaaauuaauuuggacuaacuguaagaaaaaacuaaaucaucuucagcuugggcuaaauuaacagaacacuuuagccuggauggucucaagagcagacauuuaucuuccaguucugaagacaugaaagcacaagaucaaggcagaugaugucaggugagggcaugcuucccagugugcaaauggccaucuucuuguguccuuacucacgguguauuauguaaggacaccagccccauucagggguuacuaccucauaaucuccccaagucccaucccuagaugucaucacauuucagauuuaggcuucaguauacgaacuuauagagagaugaaaucacaaauuguaacauuuuguccauuggacuauaaagcccaguauucuaucacauuaccuauauuacaaagaaaaguugggaaaauuuugugguuaaguagaagucuagaaacaguuuuauucuuuuuuuuuuuuuuuaacaguuuuauucuaaagcaggguguuguuguuguuguuguuuguuuguuuguuuguuuugagacaggaucacuauguagccuuagcugguuuggaacuugcuaaguagaccaggcuggccuugaacucacagauucaccugcuucugccucacaugcaagagucaccaagcccacccucuaaaguaauuuaaaaaagaagaagaaaaggguauaccguugccuaagcuucuuuaaaaacugcacauuuauugacuguauaugaguauaguguuuaugugcuuagcuacugaucuuuuccuaaguauggaagauauuuuacacuguacauuuccuuauaaaucaaauugauuugguuuauaaggaaacauagcucugaaguacugagcagcaaacugcugguguaacucuaaaaugauuauacagaaaaauaaaaguaaaccuuauuuuugcugagcacgccacaugacuucaugagaaaaugaagcuguucagcaccacccacucugagcuaugccuuucuggcacagcugcaucugcuaacagaucugcuacuugcagauuugguguucucgaugccugacaugggucauuuccaccauaguguuucuccuucuuuguuucccucauccuuuauuuacauucauuuucuagaaaaugaugcuuggaacauaauuggucuagccaguuaaagaucaccuuuugcagugguuuucaagaacagaacagaaaugaaauucuuaaguaauacugagacaucuuccccaacagcagagcuaaccuuuuuuauccaucuuuccugagaugauggaacagauuagccaaguuuucuuuaagcucacugugcccuccaguggagaaaacauaggcacugaaacaguugaggugacaagugcugggaagacaaguacgaaacacauucacacaccagccaagcaggugacuauuuucugcauccuggaauaggaugguaggucuuuugugguuuguuaagucccaaagagggacugauagucagugcuuugacuugcauagugcauuguggccuuuuguccuguguuacaacacaguuuaugaaagaguaguuuacucuaauaggaggagaaaggguuuuccccuucaacagugaacucauaugauagcuuuaguaaccauggaaaauccugcuuuuauuuaguggcuauaaaaaagaaacauuuugcauuuugcuacacuucuguguuuuuucaaagcauccagaguaugggcauuuggcuacuacucuucccaguucugaaaauaaagagcugagcugucugcuaugaugugauuggugcaugguccgugacgguggacuuauugaugugaacaaugucugcaggugauugagucccugacagaaucagcucuagcacacaugcagcuaugguucaaggaugcugaauucuacagaaugguugugugagcguugugucuucuagaagggagagagaacuggcucacuaaaggaggcuugaaguaaaaguuucuggauaugucuugagccuauagagacucacuaugacugguuucaguuacaaaauguucuuuaccuguauuuuuauucacaugaugaauuuuguuaagauugggugaacuaugguaauacacucuaaagagugcuguugauuaugggagacuguuagaaauuaugcugaugaugacuucuauuuagaugaagcuuuuaaagauuuuuagcuaguauuuagaaauaaacauauuuuacucucacaaaaggcucagcacaaagauacuuuuaaaaaauugaacaaguuaccucuguccuuugaaauucuuuaauuuguggaauuuccaugaaccgucuuuuguccuagcuaguuuuguuaacuugacacaaguuagagucaucugaaaggaaagaaccucaauugagaaaauuccuucagagggagggcccagcccauuguggguggugguaucuaccccugggcuugugguccuggguucuguaagaagcaggcagaaccagccaugaugagaaagccaguaauuagcacuuuuccauggccuuugcaucagcucuugcugccagguuucugaccuauuugaguuccuguucugacuuucuucagugauagacuacaauauggaagugucaaccaaauaaacccuuucuucaccaauuuguuauuacucauagggucauugaagcaguagaaacccuaacucuaagacaucuuuuaaucuuuuugaaagcaucuaauauuucauagcaauuuucugguuuuaaaauacaacucuuaguaauagagucauauaccuuuuaaauuuaguuuuucagagauuuuugucuucauaaaaaagcuacgaaaguuugcacugcaguuagaugcuaugaaauuaguauauagcucuuagcgucccaaguaacauaugugauaaauuuagcagguugaauacuuuuaaaacuaaggugugguguauuaauuugaaguaaauauucaggcuuuuaaaauggguaaaaaaaaaauuguguucuuaacucggacugcagagguggugaugcuaaggaugcccacugagcuuaggcccagggcaaggcuaaugcugagcauugagcccggcccaggaagcugugguucucagcugcagcgcuggaggagugggaugagagaaaagucuguugcaguugagaaauacaauggguugucuuuaauuagaguauuagucauuucacuggaguuuaguagaagccacauucaaucaaguuaugaaaaacugauguauuuccagacuuuguuuuuugugaaauaccacaguuuuucuuauugcaggcagaaagccauuuuugaguucucucaguaauuugauaugaagacaguuccauucacugaaggcacuauuggccaauaggacuuuuaguggugaugaaaauucuggcucuguguuggacagguaguuaggaaccacugagcacuuggagugugaguagugugauuuuuguuuguuuguuuuuguuuuuguuuuuuugagacaagguuucuguguauagcccuggcuguccugaaacucacuuuguagaccaggcuggccucgaacucagaaaucugccugccucugccucccaagugcugagauuaaaggcgugugccaccacugcccagagauuuuuuuuuguaauuuuuaauuuugacuaaaaauuaaguugauagucacaaaugucuuauggcuacuauauuggacaauuuagaguuuaagccuuucuacaaagguccuguguucaucagggaucaaauuacgaccaugaaaagcugugagcauuuuccuucuacucucuacaguuaaaaugguucuguucuaaauaacuagaguguccugggaauuuguugggaacaaaaagggggcccuggggaagagaggggaggaagacccacaccccgccagaguuuuaccuauucucuggucugucaggcaugggagggcugcugucuaccuuucacucauccccggaugggcaucuaagucucugacccacucuucggggguuggcaaggggcagccguaccugggauuccuggagcuauuuugcuaaagccacagggguuaugggagagaggaaugggggaagagguucccaacacugaugagagugagugcaguggaucuugacuggagcagagacugucuaagguuuuagagcuuuauuauagaaaggcagggagaaagagagaagggggggagagagugagagagagagagaaagagaaggcuagagagaaagagaguaagagugagagaggagaggagaagacaggagagaggagagauggagugagagugagggguaagaaguaagagugagugccccuucuuagaauugggaacaaaacacccauggaaggaguuacagagacaaaguuuggagcugugacgaaaggauggaccaucuagagacugccauauccagggauccaccccauaaucagcuuccaaacgcugacaccauugcuuacacuagcaagauuuugcugaaaggucccagauauagcaguuucuagugagacuaugccggggccuagcaaacacagaaguggaugcucacagucagcuauuggauggaucacagggcccucaauggaggagcuagagaaaguacccaaggagcuaaagggaucugcaacccuauagguggaacaacauuaugaacuaaccaguaccccggagcucuugacucuagcugcauauguagcagaagauggccuaguccgccaucacugggaagagaggcccauuggacacacaaacuuuauaugccccauuacaggggaacaccagggccaaaauaugggaaugggugggcagggaagugggggggaggguaugggggacuuuugggagagcauuggaaauguaauugaggaaaauacguaauaauaaaaaaaaagaaguaagagugagaaguaagagguaagagagcaagcgagguggggcugaacagccccucuuauggucuuuacuguugcuagguaacuggggaggaguuuagccugaaggucaaaagcuugggccauugccugcaagacuacugaccaugcuucucuuguggagguuguggggggcgggggcugauaacuuaggcaggagccagaguuccaggagcaugagggaaugccuaccuuguuguguaggugaauuaucacccuucgggguucagaccucagcucaacuggagaccagccuguagcccaaguucccacaggaaucaguugguauguuugauuuauagacuccuaagacuuaaagaccuauauagauuguguuugcucuuugguaaccuagaacccuggagguuugcuuuuguccuuuugaguuaaaauauagauagauuaugacaaacgauaggcguucaagugaccaaugacaauaugguaaaaacaucagugaaacaguacccaacccacauauacccaacccagauguucuuaaauguagcaagcagaucuucauacucuaagaguaacuugacuauuaacaggaaacaguuugugcauguaucugguaaauaaugauaaaauagugcuuuuugcuuucagaggaaguuauaauuccauuuucuuguguuauacauuuuauugaugaaucaugcuguaaucaagguuuuaagguuccucuagagaacaaacauuuguugaucacuuaaaauuguauguagacuuuuauguuguguuggaagaauaguuccuugcccgguggaacuaauaaucuaguggggacacuuaaacaauggaacacaaaacuagaauacaguguacugaugaugcaggcgagcagggagaccugguguggcagugagacccgagggggucaggaguucucagguagagaagguagggguaagcacacugcauuucuuaagagaagguaugggaagagaggauaguguguuccacguaagcagaggcaacaguuagagcagagaugaugccugaagacucaggugcaccacauuucucaguggucuuauaucauccugaccuuguuuuucuuuuugcucagucugaagaaaaagcugaacuaaaaauagcuucuggcacagugaugaagcauccaagugacaauuucaaggagaaaauuuaaaccagauuuaguugcuuggaaaacacuaacucuuagaauauuggaaaauuggaaaaagcaucuuauucaccaaagcagaucaauaguggucuacccuuauuucccucaugaaaauggaaacuccgggagcucuacccuuguuuuucacucuuguuuucucaggaccugaagagugcuuaguaccuaucuggaacucaguauauauuuagugaaagugaaugaaaggauggauccuagauuauucuucuaaaagucacugugagggucaagaauucagacauuuuguucuuuagauugguuuuucuuagugucucagcuuccuauugcugcauaacaaguggucccaaaauauaguguuuaaaaacaaucaccuguagucuuacuuagaauuuuauagcucaugaauuugugacucaggagaagacacuuucccuagucucuuugcuaggauagccccucuugggcugcagacucauguuggcaucagccccauuaaagguguuguaacuagugaacuuggagcugucuaguuucuucucauuuacuaggccagauagcauccuuaugcgguauugagacucuuggcaaagggugaaaacaaaaguuguaaaguaucuuaagguuuugguuuuagacgcuauagcauaguucugcuacaucuuuuuuuaguuagcuaaaguucuucuuugacaguuucacauguaguuaaugcauuaccugacugucucacccaccauccucuucuaucucccuacugcccaucuaccugcuucuauaaaucucucuuacauucauuucuauuuguuauguuuugaaauccacuaaguuuaaucagugucugcugaauggggcugucuuguuggagucuggugagcucagcaguuggaacacaugugaagacaagauucccccucucccaagaaccaaauuugucaauagccaaaaucucggcaguaaugguaggguccuguaaauccuuuuccagcuaugacugauagguaauagggccaauuugggccaacucagcgcagguaaccauaguuguugagaguucuugauugcagugacugugcugagugaguguagagccuuucagcuguagcuucugguucuuaaauacuucccacagugcucucugaacuucagagggauugcuguggugcagauaccuuguuuagggcugaacccucaaacagcacguauuuucagcauuuggagcagccaugggucucugcauucaucgccacucacuggugcaggcacggggccgaagccaguucuacuacauucuguaggauggagacagaaucaaccaagucuaaauggauagaaagauaccaccuuuugauaggacugaugggauaaugacagauucucacagugaagugggaaaagaugcauauuacuguuacagccaucuuuggaaaugguuugcuacagucugcucauacuucucccgugugcauacuuccacucccuuaggagucuuaguacauuaugauguccgaguggagucuaaucaucuaagugaaauccaggugcagauggggguucuuagagacuuauaugaugcaguuucuuaccuagucagaacuaaagccaacuuaccccauccaccauacagcggggaggcaggaacaagaaaguaguugacaguucaacugaagaagaacgggaagcacccagcuaucauuggucuacagcaauuuugaaauccacggggccuuugccagugguucucccacucuaguuaccaagaaugccccuccgucagugcccugcuuuccuccugggaguguuccuuagcuuaguguuguuuucugagacuguuaacucuuccaugugggcuuccugcuuugccgaugcuuuucuuuuucaugaaaaaugggugcauuuccaauguuuuugccucuaggaagcaauacguuuugaugccugaaguuuuuguuguucgguuuguaaucauuugaaaugcuucugucccaaugaaagcugggaguacuuuuagugacacacuucugugaauuuuauugggaguugauuauauguccccaaacucacaucccuaauuccuuuccaagacugauggcuguuuggauuuguuagucuguuguagaaggccuaaagauucuuagaagucagauguagaugaauaaguucuaggcagcaccuaaguccuuccagguuuucaacaagaaacuguaauggacaaacucggguuuuacugggaaugcuuuucuuguugagaaucuuugccaguugaagagauuauccacagcaccugcacuuucucuuaagucugcuuagaaauuaaggcucucuuuuuucauugacuucucucucccuguuuuuauguauagcuaaaauaagccaauugccacuuucaguguucuguauggaauaaacaucccagguggguagguauuccaccuuggaguagucuugccugacuccugcugccaugugcuauaugaccugugcuuucuguuuuagcagaaguuuuuuaugauuuuguuggcuuuugcuaacaauguguuuaccauuuuuccagugucucuugguuauuaggucuuaaaguuugauacuucauauuucaagugauuggaauuuuuuggccuugaaacuagguauguagcugaagcuagcuuugaauucaggauccuccugauuccaucucuaaaguccugggguuauaaggaugugcuauuacgccugacuagguggugauuuuggcaccucacacuuauuuagauauuauuuucugucucaguuacugcuacugaaaaacaaacuacacuuacaaugugauugcuuaaaguaacaaccacuucauugcaaggcagugggucaaaaaaaugggcagggcucacagagaugccucacccgugugccauauaggaucagcaaagaugguuuugcugaggcaggaaaggacccuacuuuuguggggccuauuucugacuuauuuauaucugaaauuuugacuucccuccucaaggcuucucauuuaauagguuuggcuuaugagacaacaucuuacuguguagccagguuugccagaguucaugguaauacuucugccccagccuccucguuguugagauuacaggccugagccaccaugcccaacuuuauucaguugcuuugaaagagggguuuuguuuuguuuuguuuuguuuugccucuuaaagccuggaccagacuaggggaaccaaaacuuugaucaaagcaaguuacauaucuaaggagaaucgauucugucuuuugaugggagggcguguggaggggggggguuguuaugguuaucccuagaguaaucucuugcaccaaauaaguauaaacuauggggguuuggugagaaguuaauaaaugagacgcuagaugaggugccucucaucuaucuaccucauagaugugcuuuguuuggcuuguauaggguuuuaccuauacaaauacaauuaccagugccuuuucaauuaaacaguuggaaaauuucauccuggagguugugugccuuuccucuuuagaaaaaugcuaaucuuuuguuugggccugcauuaccaucuaacuagaaauugccugcuuuguauacucucauuaccaugcugaucacugugauaucuuaguuuucacucuuugcugcuguaagggauuagauugaacacauuagcuguguuagguaagacaaaguagggagauggacaguggucaacuagaugaacaagugauagaauuagagaugaaacaaagcaaagaucuugauaagaaauaacugguaugugaugguagaguugagguuuuaaaacugugagcagggaggccuuucugaagaguuguugaguagaacccuuagaugggaggaagagccauucauuagacacagucuggucacagcauuugagaagguaggacagugaaaagaguuacaagugggacugggcguaguguauuugggccugugaugcaaacaaguggagagugaugguaaaagcuacaaggugggcauaggcagagcugugaaggagcauguaagaggcaugcaaccuuuggguuuauucugaguauuggaagucacuugaaagaucccaggaggcacagugaugugguccuuuauuuuacuuacuuaucuuuugcugcuauauugugaguagacuguacugucugaaggagugguacuuugagucugaugcugugagggugagacguuguacacugugagaaggugagaggauauagacaggucuuaugguggauggauuggauaugacaugggaacaagagucaaggacagcuuugggacuauugacuaguguagaugguugaguucuccuauagcauguuuuggcagcuugaagugggaucuugaucauuauuaacuuugcagacuucuacacaaauaagauaaacaguaagaacucacaaagaaguuguuuauuuuauaacccuuaauguguuuucuuaccuuagcaaacugcaguauggaaguagagaaagcacauggcuguauuuuggaggauauguuuauauuuaaugcacagcuguuuacuguugagcauuauuaggacuuaggaagggcuuuuuauucuauuggccaggccuggcacgguacuuucuaucuauuucaguuggauaugauuauaaagugucaaauacuauucaguauuuguauuuuguguuguuauggagaguuaauucaguuuuguuauuaaaaaugguugccuacacaugugugccuguggucccaaguacuugggagauugagacagaaaaaaaugacuuaaaccaguuugagaccagcaaaggcaacguucaagccaccauuuaacuaagaccagaaucauaacugugagacggguugaaugaauuuugugaaugaauauucugcuugugacgucuuaguuacauuuguauuuuagccauuagauguuuauuguaaauuugguacaaaaugagauacuagauuuuuuuuuuggccuccuuuuagaggaggcuuagaaauaauuuauaucuuuaaguuccuauuuuaaaaggauauuaucacgagauggagauaauacuagucuauuuuauuauaaugggacugggaggaaauaaucuuuuauaaaaggugaguuaagaguuuauaauugcuuucaccauuuauuuuaccuaguuuuagaaaaugaaaagcauuuaaacuuaaauuuaguauauguuacauagaaaacguaaccgauuuaaaaacacauauacauuuugcuagcaaaaugauugauuuuuucuucuucuucuucuuugugaaggaagcugugaguuaaaguguccuggugagugagguguuuguauuccagagguguagcugaaccagacaggucugcagcacacuggucuauuuuuagaccuggguugccauuuuuauccugcagaaauauucaucaguaucucgcugacaggccaucaguuuuauaaaugugccauccagaccagauugugcucuucagcucacugcagcuccucuuuucucuucgauuuguucauacagcuguuuggagaagagguuuuuauuucaguucauuauuagauacuugaauucagagauuuucagccucacacaguccauucauguugcugcugcugcuuacucauugcugcuuaucguuuaguaugggaagcugucgcagaugauucuggaagccaggaagagggcuguguacagaaggggcucucucuggcugcaggcagcucuuggcuaccuucuucaaacguguugcuuuauguauagauguauauguucauuuaucucguugucucccacuuggccuuggcauuagcucaguuugcuuucuaauggugcugagggucagaucaagauccuuguacaugcuaggcaggcacuguccuaggcaguuucugcugcccuuagauugagcacaagucuaucuucaucuugauugggcuagaauucaacaaaagacuacuacaaacugauuggcuuagaaacacaaacuuacuucccaccauucuaaaggcuguggggucaugaaagucauggugucugucaagguccuggauccugggucauaggugugccuuccuggccugcauuuugacucacagaggauaucucaguguccucacaugaaagaagcagcagaugagugagcuccuuugucucuucucuucauucauuccuaagagcuuugcuugaugucuucauucccuuccuaagggcuaccucugaacacucucaccacaagaauggacauuuuaacauacaugcaaacuugcaaagacacagagcauugagacccuagagaauugaauuuugguucuagauacuugagugauauaauaaauaauaagacauaaggcaaucucugcaaccaagagaaggcaaugggcacauccucuuaaauauagcuguuuauuauuauuaucauuauuauuugagauguggucucacuguguagccuacauuggauuggugcuuauuauauaggccaagcuggccgcacacugaguagaguaguucugcuuccucagccuccuagcugcuggguuuauaggugcgagcaaccauauccagcucaccaucucauuuuuauaaaaguucagauuuccaauuuaggauugggguucacuuaccuguuuaacauauaucuacugaauaguaacuuaagggccauguuacuaguugcuuuggaugcaguggcuugggaaacaggacuccugacuuacagagcacacagcuauuuugagaagcaaagacuuagaugugauauuuuacauuggugauaguauagcauucuauacuaucagacugugggcuuuaaaguuuguaacuuggccacccauccucuagcuuuauuaccuugggcaaauuuguuagauuuucugagacccaccuguaaauuuucaucgauaaaacugauagauaauuuuaaaguuauuguaaaaaagaaagaguguugcuuauuuagcaaugugcagaaaauaccuaauguuagccagguugcacaacugcaaucccagaggugggaggaucaugaguucaagaccaaccugagauauguacugagacucugacucaaaaucaaaucuguacaccucuaaacaaacagaaaacaccaccccugccuccaccgggccaugaccacuuuuaguaccuggaacagugagcacauuacauuucgggacaguggcaacacugggggggauaguagguguccugagucuucuguaaugcuucagcacucaggaauuucccaguucuaaguugggacagcugacugguggcuuaaacagauaagaauuuaugcaucaucagagaaaccaggguaggccuggugaauguugguuauucaauauucauugauaaugugcuuggcaguuacuauucaaagcacagaggauucaucugugaguaaaagcacaacucugccucuuucaugaaauuuaugaucuaguuagagagauuaaaaaaaaacauaaaaauauugcugugagccgggcggugguggcccacgccuuuaaucccagcauuugggaggcagagacaggccgauuucugaguucgaggccagccuggucuacaaagugaguuccaggacauccagggcuauacagagaaacugucucgaaaaaacaaaacaaagaaacaaacaaaaauguauugcuguguuagaagguguacuuguagaaagcuuuguacaggaggaccuauuuaaguuagacugugaccaaauagcaugguuuuagaguguggguuagguggcacaagacuaacaaagaaaguuauaaaaaaagaauggcguuaccaucucaaacgacuuuuaaugaguuguuaagcagucacgagccacauaucuacaauucuugauaaaauuugauuauuaaaaauuuuguuucuuuacgacaacagauauuguaauaaauauugauaguaauguauaguaugcaguucuaaauguauaaagaugauaaaaaaaucacacuguccuguggcggugaccauaggacuacuguagagcagaacagggugagaggggauggggguggccucaugggccacugcagaucagaauacucaagaugagaguggacagugacuacaggacucacgggacggcagaacacucagggugagaguggacagucauuauagaacuugugcagaacacuaaaggugagcguagacgguggucacagagaccauuauacauacuauauauuauagguagucuauacuguuucuaaagcuguguacaacaaauagcugacugcagaagagagcauuuccccuugagcuggaguuacagguaguuguaagcugccugauguagguauugggaacugaacucagguccugaaaaagaguagcaaguguuguguacugcuguguucucucucucuaguucccuggacagcuuucuugagguccuccccccccaccccccguucggugauugacaggcccauggaaggggcagugguauaucuuuguccuuuaucagagagcuuuaugccagguaguaaucuuguaagguuuggauaguugccaauuaaugaucuuccaagcagcucagcaugucacaucuccucccaggccacagaaaggacucaggucccauuucauccuuuuggucauucauaaagaguccugacauucuaggucugaguuuggcaaguuguggacuaugagagagaacuacacuucaugguccucuaauucugcugauacuuuuugcccaacacuaucacuguucuccucuuauagacuuagguuagggaaguaacuuagaccagaguuauuugucuguaaggacaagaaagagagacagcuggugaaaugguauuucagucuggaacaaaacccuggaaucuuucuugcuagaaacuaugaacuucugacuuugguccacaaaguaacuaugugaguggcaguauguaaucauuaagauucagugggagacucugguucugggggucuuccugucuuugccucccuagcacuaagauuacaauagcacacccagcugaggugaaaacucggaacuuuugaccaccauuuuaccaaaugagcugucaucccagcuccagcacauuuuaugauguaauuaaugauuaguguaaagaaccagacuagcaaguuagagaacuugugugugucuauuuugaaugagaacacauuauuuagucucuccuauuaggaaguuaauuagggauuggaauucuagaaaccacaucugaugauuguugugguccauaaagcuuagaaguucaaguuauuaaaagugguugguauggauggagaauaaagaagaaugugucugucaguuugaggaauagcaggcacacauggagcugacucccuguuguguuccauuugggaaacagggagcaguuuggccggagggaagcugguuuaggacuagaaaaacauaaagugggauuuagcaucauuagauuaaugagaaagacauuggagcauucauguaaguauaguugcuaaauccaucugugcagguucauaaggcaaauuuccuaguauaggagauucauguucuagugaugagauuugguacaguauggcuuuuggcaaguuguuuaacuucugagauaguucaucaauaaaauuagauauuaucacaacccccuucccuccuuucuuuuuuugcuuuucaugguguugucugggcaguucgcaauuacauccugugggcugcugaaacaacuuguuaagauggcauuuguaaaguguuugcuacugauugacacauguuagacacuuaggaaacuccagcuuauguaaaaggccuauucuagcugugagagcaguccaaguacagacuucacaguauggaguagugucgagugagugaugcagugacugguuuacugcuaacuuaugggaccgugaagcaagauuaauagcgauuuccuugagaaaaggaguauuaauaguaauuuuccuuuuuaucuuuucuccucuuuuaauauuccucauuucauuucauuuacugcgucuagguacuauggcaaacacaugauauauauugcucucuuuaauauuuuccuaguauaguauggugguuacucaauaguuguugaaucuuuagcaggauucugugugauagacaauguuaacuuuacaaaucaaaaaaccaacagaauuugggguuuugaaccuggcauuauuguucaugagcuuagugauuuauuuucugaguauguauuaaaauaacagaagccuaagccuuuugcauauggugucuuaauaugguguccugugacucaaaggugauaacuauuaagaccccugcucucugcagccuccucugcucugcccucauguuuuggguaaggagagcuaugaacaauuuggcuuuaugaaaucacauggcuccaugaggauugauagccuuuuaauucuuacauaguguuugcauuuuuaaagaagacaugccauuaacuggaaugaaucauugcuuggaaaggacuucaguuaaccacgcaaagugacaaucaggcagcaaucuugaagcuggccggcgauucaccucuguuagaggauuccacuuuucaguucuugucucuguucugaaccgaugggugcaguagugcgaggugcuuggguauuuucuguuugcuuguuugaguuuggucuguguuuuaaaauggcacacuauaaauggcucaguaucuuguuggcucagacagagguagugaaaacuagagugggagacggaugcuugggggaacuguaagaacugcuugagagacaaggaagaauauauugcuuuaggacuguaguaaaguggauaucuauauucuauaguuaggaaagaaauggauaugaccccaaacuggaguuauggaaaauguccaugugucuugguuuaguccuaaauuuacuuuuuccuaaaaauaauaauuuuuaacuaaauuaugacuagggauaaaaaguuccuacugccuguucuuauuuuauaucacuuucacuauucucuuuuuaauaaaaaugcaggaaguuacugguguuuuaugaacuugcacccugcaugcuucucuucuuuguucuuuguuaaauacgagcuggcauauguuagacuacguuagcauuugcucugagggacuucagugcuuucuaaauucagcucugcucagccuguagacuguuugccugaaucaauggagacugcuauuuuuagcaacaaaagggaauugaaauagcaauuuucuucccaugcaauagauccccaggaggaauacugaugcaagcaagccuucugucauuuucuaucccucccaccaccccaagcacuugggaaaggcagcugucaugguuuguggcaguauuaaucuuuaaucagucgaguguuuucuucauuuagguguugcaggggaguggggagucacaaaaggaagcugcuuggaaauaaguaagcucuuaggcaugggcucugcagucagaguuuagugggcagagacagggaaaagauggagagcuaaaaauagcacgcuugcuuccaguguuucucuagucuauuuuugauguuugauuuugauaagguugauugggcucuuacuaaaaauaucuguuccuagcaaguugaggacaaaaagaguagaauauuuuuaaccuauacaagcuaaaguacuuuuuguugacuguauaaaaucuggaagaagaacuggucaguugccaguauuuuauguaaucuguaacaagcgaaacacuucuggaugccaaguugggauauucucuauaguugucaguucucaucuucucagacgcuugcaaaugugggucuugcuguuauauuuaucugugcagacaugagccuuuuaaaaguccccuuuccccaucuccucuucuuucucaccucggucuacucauggccauccuuuguauuuccccaacacacaagggagcuuuuuuguguaucacguggaaaguugucuaaauguauccccuuauuccauagcaaaaugggauccgaggauacccacuguuaacccaagaagcaaaucuuagggaugagaauagugaacuuggaauccuuuacuaaucuaaaauggguacuuuuccuuucuaauucuguuugggaugggucacugcagaccagcuccuuucaaggaaauccauagacuccuuugaaaguauauaucuaacaaguucauuauaaacaaguuaagcgucuugaaauuacauuuuuuaaaaaaaucucauuuuagaugguagauucuugugugauguugagaggaggugcaguguguuauuuccaaauaaggagugaaugaaacagugagucuuguugcaagaagccagcuuuccauucagaaucuuuuucauucauucauucauguauccuucuauucuucagcaaagccucaagaaucaucuuguuaagauaauuuuaugucuguguuuugcuugcauguauguguguauuauauacauauauauauauacacacacauauauauacauacacauguauguguauauguguguguauauauauguauauauguguaugccuguccauugaggucagaaaagggaauuggguucccuggaacuggaauuguacaugguuuauaaaucaucauguugguucugggaccaaacucagauugucuguaagagucacaagugcucuuaaccauugagcugucuuuccagccuaaauuaucuuuugcuuuucuuuuuuaaaccagugacuguccuaucaguuaaauucuggagacccagacagacccaguccuguggaacccuaaguuacuaaugucauaaggagaauuauagagaauugugagaucuugauagucugguuguuaaggaaggggcaaggauguucaagugaaaaccuccaagauggaagcagaacucuugcugugaauggcucaguccauuugaucugccagaguagcugcagaaauuuagaaagccagaaaccuaaguccucauggugcuucaugcuggaaaguccaagaucaaggugccaacaagcuugcuuguacuaugaaaguguucuccaguccaaugacuugcuguaccucaggaauacaguucuuugcauggcaagggcacagggcagagaggcuuaauuauggcugcaggcuucugugaagcccugaugaauuccaugcaaaaagguauuguccucaugacauaaacacuucuuaaaggccccauguuggccuacuaucauauuggacauucaauuucaacaccucaauuuuacaaagaucaaauuuaaaccauagcauaauauagauugagaauaaagaggaucguguuugugaagagaguguuaccuugcaggaaguggacacauuccagcaugauuggugugagguuaagggaaacaugucaaggacuuuguaaaggauaaggguaaggggaguucacucauucauucauucauucauucauucacucauucauccuuaaaacguuacuaaucaucuccuuuugaagucgcuggcuugccaguuugacuguggggacagacagacaugacugacagguuuuaggcaggaaagugacauuuggauuuguacuguggaaugaucacuugagcccaggagagugacuaagggaggaauaagaaaaaaacgagaugcagaugcacuagaaguuguuuuaggagauccugggagagaugaaugguagcuuugcuaacuuuauaugcguauuaguaaagagccuugcuuuuuggaaaggcaaugccugcacaugacugaaaaauuuaacaguaaaaagaauuaaaaagaaaaaccuuucucuaauucuguagaagcugcugccagccgacucuugauuuaaagugaugauuugguuagcuuccuaaauuucacaguggaguuuaacuguccugacagugaguauaucaaaucuucuuaguaagaaccacaguguuauuuauauaaaaauacaacuuaaaacucacucauuaugagguuguagcuuuaaagcgaaacaggacauugucacccuucuucaaaucauguauucauuuuccccuacauucaucagaugauuuuuuucuuugauugacuaagaauuacuuguuuguguuguauauuaugaaaaguauacuauugaguuuauguccugaaaaacugaacccccccaauugucugaccaucguauaacacuaauuauugcagagcugaggugcauaaaagaggcucaccacuuccaguuucuuugucucacacacacacacacacacacacacacacacacacacacacacaauuuuuuuuuaauuaaugaaagauaaguaaaaccauugauuuucaucguaacauaaggaagaugcuaaggaacuguaaucuuauucuggaugguauacuaagacagaaaacagacauucugugacaagcaagaaaguuugacuaaaguauggaguguaggugccauguuguugguuuauggguuguggcaaguguaacauaaucauguaggguguuaacaggagaacugagacuaagcauagaggcucuaaaucuuuguacuaguucacuuuuuaaaaaugugcaucuaaagcuaucugaaaaauagaaaaauuuauuuuaaaaaucuuuaaaauguuuaucaaagugacuccauguguuuuuuccuugggaaguuacugucaagucuacuaucagacugagacaggaaagccuggucuaaaaaccugagcuucagcacaggagggaggcaggcaggaaaaguucaagauggugucccaaguaagucauuuauagagugcagguagaaaggagagcgcaaaugcucugggaagccauuccuaagagcugaaauggaguccauuguguggagaauuguaucaagauguuguuaaaacaggaauguauuuaucuauaauguauguauagauucaaggaugagaaagaagguccucccauauggcgggaggccaguugcgguuacaugagacccuguuguaaagaagcaggcaacaguaaaagugagggacuucuaggaaucuaagaggauuuaaaaagccauacaaaggggaagggacaaauuuguauucagaaaagauagaaaguugacugggaaguaaaauguaauuacagucuagaguuugguuuuauauggauauuuaacuauaauaauugugcaacaaagacuuugucugguuuuguuuccagggaggggggugguagagaaggagagggagggagaaagagggugggaggaugaggagauggaggaaaggccauaugugagccuacuccuaaguccuuuuguuacuccaggugagucuuuggcaguugaggcuaaugaacuacuguucaugccagaaagacucugucauuagagguugaagaucugagccuagugguaauggcccaaccugccaaucucuaguuuggggaggagaguuaaagauuggguucccuccuguguauuuauaguaaaaccugaacuugaauggaaguccuaguugggaaagccaugcaugcucugggaggcugugucccauuuauacuagucuaaguucugccauguggcuagugaccuccccucaguuucauucaucugacuuccucagugucugucucaguggcaaaucuuugguaucucacucuuucccagaguuccucuuuauguccagaaaucccaccuuacuguuuugccuuucgcuauaguguauagacuauuuuaaccaaucagaaggugccuuaggcagacaaggaaggacaaagacacaucuucaaacaguauacaaaaaccucacuccaacacauagacauacaaauacauuuuuaaaaauaaaaucuaaaaucugagaugagagggugugguuguauagauggaguaagauuaaucugaaguugaucauugcuucaccauagauagguacauaaagauuuguuccccuuauuuuuuauuuuauuuuauuuuuuacuuuucuaaaaaguuuuuaaaacucuggaaagaugguggcugaacagguaucucauaaauguacauuucuuugaguggcacuaagaaacaaauaucuuuuuuucacuuaccguaaugucacauuuaguauuauauauauaucacaguucauuuaaauacuguuaauuauacguuguaugucuauacauuaguuuacuuauucuucuauagauuaauauuuaggcuuuacuagcauauagcaaaaacacaaagcuaccacugacaucuuuuugguagaucuuacuuaggcacucuucucuugaagaucgcuggcuuguaagacaaacaucucuaaauauauugacaaauaguuuuuccaaaaugauugugucagucugauacuacuggcaugguaugaagcucuugugagcuuccguuuccuuauaucuucgccaacgcuugguauuucauucuuuucaauuugaguuguuguguuagauagguaguucuaaacuagaauacugguguugcuuauuuauguauguauuuauuucgcugggaguugagucuggggccucaugcauggaaaguucaguguccuaucacuaagcugcacacccagcccuggauauugcucuuucauaucaaauauuguacugguguucuugggugucauuggugggcucuagcuggacguguaguucucaaacuaaacuauuuuucuuguaucucaguuguuacagguggcacugauggaauuggaaaagcauaugcagaagagguaggugauuuucagaacuuguuuuaaaaauaagaaaaauagaauaaucuguuucaauaguuuugauugaaauuuuauuacauuuauuuuguuuuauuuauuuacuuuagacagggucucacuauguagcccuggcuagccuagaacuauaggcggaccaggcuggcuuuaaacucaacagagauccuuugccuccuauguauauauauguuuuuaaagacuuugagagagagagagagagagagagagagagagagagagaguaugugugugugugugcgugugcgugugcguguguguguguguuugcaccacacaggagaccagaagaggguauugaaucccuuggagcuggaguuacagggaguugugaguagccugacuugguugcugggaacuggauuuggguccucugcaagaacagaggcucuuaacugcuaagccaucucucuaguccacauuuauuuauuuguguauguguguuuguagaugcaugcauaccauaacaugcaugugaagaucagaggacagcuuguggggagagucaauucucucauuacaacauguggguccuggggaucaaauucaagucuugcuagcgaaagucccuuuacucacugagccguccugcugaccucagucccugugcuagggaggaaggagccuuacuaguggcauauacucuuucagcuccuuacaaaaguggcacuuugagaaaugcaagucaguuguuuugcagacaaaauugaauuugucucaagauuagauucagcguaaacauuuuuaacagaaaugguaauaaaagugauauuaauccucuugaccucauccuaucaagaggcaguagucaccaugugcuccauuacugaugauguaaaggcaaacaauuuauuaauauguuguuuaacaaaacucuucauuauaaaaguaauagggguauaugacauauuugggggacuauauauacccuauuuucuagcuaauuuuuagucuaauuuuuuuuauacccauugacgauuuugccugaauuacuguaccauaauuuaaguaguguuuuucuaauuuaucucuuccucuguagccuaagcuagacuauaucuaacacauuauguauguagcucaggcucaccucaagcucauggcagucuucccucuagaauuauagucuugaacuaccaugcuugguugguguuuucuauaaauaagagcuuuuccuggccuuccuccuuuguuaauguguuucucuuuuuuucuuaaaguaucaauauaggcuaauggauucuuuaguguuuuuauagcagauuaauuuagcaaauuaccaggccuuguuauuuuuauaaaaaaugaucuuccacagccucauuugcaauauuacuuguuacuuaauaaaagcugacuuuaggauuuauaacugggaauuaguuuacugaaucacuuauacuucacaucauccaggguguugcucauuuguaaauugucuguucguucaguacaaaguguuaagccuauuaauguuuuucucuaccucuuuauuugugugucuaugacaagaacacguugcugugaauguuugucacucugcaacauuacauaguauuguguguauauguauguagauuugcuucaagaaauucuucauuaauuuuuucauuaacaaugguuaauguacuuuauuuugguugcccuuuaauuuuaaugcccguguuauuuacuacuguggcagaagcaaccuaaggccggcuuaguuugacuuccagucuugugcucagcuuuuuaacagugaucccaggagcccaugggaugaagcucauguuuagugugggucuucucuccuuaguuaaacuuuccuagagucauucucauagacacacucgcaaguguguuuuccagucaacagugaagauuaaccacaagucccaaaugcaaauuuuuaagagugauguaggaauugcuaauguuuuaacuguaguuuucuuuuuuuggcccacugauauuuguucuguguaucuagccuaugacaacuuuuuaaauccuaaacuugaaaugacagaauucuuagauguauaacaauauaaaaaagucuauaccauguagauaggccuaauauaaaaaguagaagccaccauccuuccaaagugguuugagauuuaaaugcuugguuagacacuuaagguucugggcaaucucuugaaaacuguucauuuuagaucuuguguguguguguguguauguguguguguguguguguguguguguguaugauuuaucaccuagugagguuuuucuuaaaaugggaguucaucuaauuuauguuuuagaauaaacuucagagguguaauucaggucucucauuguuugcaguuagcaaaacguggaaugaagauuguccugaucagcaggucccaagauaaacugaaucagguuuccaacaacaucaguaaguuuguacauuuuaaaccuauaucaccaaaauaacuacucuaagucauguuuuaagcagugccguggcacauuccuuugauguuaaguaaaugcugaaacuaccuuucauauugcuaauggcacaucugagaaacagaagucauuaaagcaugaaucacagucagaaaaaggcauuguaacaacuuaacuuaaaccaacuacaaaugcaagucagucauuccuccucuuuggaggguccaggccuugucuugagaguggaucuuggcuuccuuacccagaugccauuucuagauucaguuucaguucuuuaaaggcaccaaaaccaaaaccaaaaacaagggggaaugcgauaggggguguagaagauuaacuaggaaaggcgauaucauuugaaauguaaacgaauaaagugauuaauuaaaaaaaaaaaggaaaacaacaacaacgaaaaccacagcaugguaugacacaacaggaaaccaaauuucaguauuuuauacguaaucuuaguuaugacaacugccucauucuugaguacuuacuuauguauuaaucacuuucagaagagugggauguauagaaauuuaguuuuaauaaaagcaccugcugguuguuacaaauaaagguucauagucagaaaauagaagcuuugauuaaauauaauuuugaaauguuaauaggagugaauuccuuuucuuuggaagcaaggaaagcuaccuuagggcagucuuaggaaguaugccagccauguagaguuugagugaaucuggagauacgaguugaugauauuuguaaauuugguuaacuuacaguuugagaugacaugaauuuugggccaaaugugauucuguuuaaguauuuucauggaaaaaagacauucauugacuugaccuuuauuaaaauagaaguuauagcaccagaccauaagauuauaauauauauauauauauauauugcagggaauuuagaaauacuuuuuugagauaaugcuucauauauuuuaggcuggccuagugcucccaggauaguuaagggugcuccuccugucaccaucucaugaaugcuaggauuacuguuggucucacacccagugaaagugguucuaggaacugaacccaggcccaaguacaugcuaggcaaauacucuuccaacugagcuacacuccuaguccuaugcauuugaaucuucuguuugggaggaugauauuuuuaugaguguguuaguuccagaagaauagagggaccaggaccauguauugacaaugacagacaaacuguguuucuuugguuauacuuugaagcucucuuauugaaugccuauaguaagcaguugagacacagugaugaacaaauaguccuuguguguucuagugaaagaggcauugaaaacaaaugauuuaacaaccaccaccacaacaacaaaaaaccuaaauaaauaaacaccaaacggauaaguaaguaaccuguacuaagugccugagaaagcaaagguacuaguaagagaaggccagaaaaguuacuuuguauggugaguuuugugacugucaggauaccugauucccuagacuaacaugcaguaaaugacagcgaugccuuagugauggaggcauccccugggcccuucuggggguauauugauagcaggauuauauaugcauaaggugcacauaguaagucaacuucaucauucugauuuucuugaggcuucugguccaugccucuaucuuacgccauuaaaugcagccgucauagcacccauguuucagucugcccacaaggauaacaagacccuuccauguauaugagcuaaccaucaaauccuaguucucuccuaagugagucauacaaagaauguuggcucauucugauuuuccuaguguaacauuaagaauccauuucauacauauuucuuguucuacuuauacaaaggaauaacguuuucucuguguauaaauuauuagccuaugccuuaaacuuaagaaugugucaccccccccccccccacccccaggaaugcugcaaccuagccauuuuaguuauggaggugagagauggcugaguugaaucaugagaagaauucucucauaagaaaaccacccacgccauuaauauguggauacuaccuucaaacagggaaucccaaucucagaggccuaaagaggccauuugugucagcacugucauggguugggguaggagucagauaacuuuagcuuugagagucucagguuccugacauucuccauucacucauacauuccuuucacacaugagacauauucaucuuauauuguaauccuucaacuggaacauuuaagucucuuguuaaccagaugaguguuguagcaauaagacacaaaagccuuuccagcauagaaacuuuugaaaauuaugacuugaaaguucaguggcucaccuuaucauuuccuccuguaaguguuacagugcaccaggaaaacgcuguagcaugccacagggcuugugcauugcaucucuacccaaugcaaauauggcacugccuuguccccuaaguaguccuagcuagcuucuuuguucccacugaggagcucugcucuauguucagaggacacagcagcucucuccuguugcugauucucuuaucagucacucaaguuaaacaaggccuguacacucaguccagugagacuugccucaggagagaaggggaggugugugugugcucuucuucucucugucuauccuccauuaccacacagacuugguguguauaccuucagaagcaguucuuuguggaugugaaggcaguuuuucagcaguuguaaagcuuaguuggaaaggacuacagauaucuccaggaaacggaccuauuucagagccaugauuguguaauauucuuauuucauuaucauugugagccaggauuauuuauuuguuagccauuuucucuaguuugaauuugucaaagaaaaaguccuagcaauguuuugaugcugagcuagguuuguauuuauaauaaagcgcaucacagagaccagugacagagccugagcucagcaguuggagcugguggcauuuacagcuccggugauucuguggcagucaguucuucugauuggaugcacuuuaaucagcuuugaugaaacacaaacaaaggcgauuuuguuguuguuuuguaauuuaucuccuaguugaagcuuuaggaugguucugauuccaugacuucaucucuccacugcaaaccuuuucuagucaacacaggaauaagcuuaaguguuaauuucccuuuuuuuaguccuuauuugucauuauaucagugcaacuaagauguagauuugacaaaaaaguuuaacaguuuuaaaaacacauuuguguguguguguguguguguguguguguguguguguguguguacaugugcuaucauuguaaauguaugaagguguaaggacaaccugcaggaagucaguucucacccacuacugugugggcuccugucaucaagcuuggugguacacuccucugugugacaagcuaucuugaaagcucuaaauuauauuuguuuaaaaaaauauucucucacauuaauuauuuaauuuggugugugcaugugagaaaauaagaggacagccugugggaguuggugcucuccccagucauguuuguucuggagcucaaacccaggccaucagugccgaccgacagcagugcccuuaccugucaucucagcacaguuccagaauacuuugauguagcaacagguuaauuaauuugauguccuauuacauuuugccuguuuuguuuacauaagggcaacaagaggcagcagugagcacauaaagcccuucauaguuuauguuuaguguaacucgaagcccacggugcgaggaaacacacaugcccaagagcuguucucaaaucaccucugcaaugccaggaauauacaguucaaggcuaggaaucagauccauccauuuugacuccacuuguuuuguuaguguacuuaaagcuguggugguacuuacuucuuaaaucuccuaaugugucaguuuucuggcuuuccagaaaguggaguucccuucaagacugauucuuuacacuucuccuagcaugggauccacauaugggacugaaauccuuuuucuuuaccaguggacuuguaccaauagagauuugacacuaaauggauguuucuggcaugauccugguuauaaauuuuucuagcuaauuauguucuggauauguucuggaagauagauuccuucuagccaaugcaaauaaauacguugccauguucagucaagugacucaauagagauauauuaugucauauuuggcuguugcucuccuugguuuugcagaucaagccaguggauauauuauuuucuacacaaucugaucuucuuuauacccacauacugguuuaccauuuuaugucucaguaucacuacauaacaaaacaccuuaaguuuaacuauaguaaaucaggcacuguucaggugcugguugaguccugcuacuuaggauuuugccagcauuaaggugggugauucucuuguuccuggugcucagugcugugcagcuggugcauggucuaguaugcaaaugauaacguccuucacacgucugaugccauggcaggauguuguuggaaggcuugacuguugucuagagugcaugcagcauggucagcuggguaauuggauuucuuauauagugcaugcuucaggaggaccagauagauaguaccugucuuuuuaugaccuagucgcaaaaugcauauaguuauauucuguucaucaaacagucaugagacacucuaccccuuuccucauugcugggguggggguaggggucaacuccagagucucauucacaaguaaaagaugcuuuacugcugagcuaugccacaguuuuucuuuaugaaaucuaaauucauuuauuuuuaagguuuuauacauuuguguugaguguacacugcuguacccugccaacccugcagcuguauucccuacccuucuguuucuugcucccucccuuccucccugucucauuagauuccacuugaugcugagugaguaacuuccauauaguguggagagcugcagaaaguaccaucugagcuugagauuacagccugcugcugcuugggagcuaugcuauaguuucucaaagaguguuuguguggaauuagaaggaaucuagaggaacacaacacucacagaauuuaguucagcuugcucaaauauaacuagcuguuauucugugagaguuagugaaaaauuaagaaacaaaaguaaaauuugcucauuagguccauuuggucuugcaaagugucugacuuuggaauauacucucuuaaauauugauucagugucuugguguugucuaucuaguguucucuucuuggugccaacuuuguguuacacuggguagaaaaucugaucuaggaguucauucccugcagcaucaagccugacuuagaguacugauucaucuuuuacuaguacuauucuuaaauauaugucauguguauguaugucuguguuuguggguggugguggugcagaagagguauuggguccccuggagcucgaguuuacagguaguuguaagcagccuaacauggaugcugagaauggaauuguggaccuuggaaauaauaguuaaggguuucuauccacugaacuauuucucauguuuauuccuggaacucgguuuuuuuuuuuuuuuuuuuuuuaaccucuagcaugggcuuaggggagguaggaaccacuuaacguucaaguuuuauuauuguaauuagcacagucaggguggaauauaaugcagaacaaauuaguaugauuuagucaaugguuauccuaagggcacgagccuucaauggauaccaaugguacugaaaacucuuuagacuucuauaaaguauguuuuuaaauuguugcuguauaacaagaguacacuauauauagggacaggaccacagauacgguuuuauccaucuuacgaagugugacauguuaaauuguauuaauuauuaguuacaccuugccuacauguaauugacuaggauguugaccaucuuucaucgacuuaauagagcagcucccagcagagcugagccaaagagaaguauggagaaugcacugcauauguggguauccugcucaguggugcugccugaugcccgucuaggaagaaaccauauuucuuggucuaaaauauauccuaacaguaauuuuauucuuagcucgaggcucagauuugugaggacauuuuaaaaacauaaagaguuggggcucagugguuaagagcacuaacuguucuuucaaagguccugaguucaauucccagcaaccacauggcaggucaccaccaucuguaaugggauccaaugccaucuucugaugugucugaagacagcuuauaguguacucauauaaguaaauacauaaauaaauaaaaacuuuaaaaauauuaaaaaaaaaaaacaguugucaggaaacuaguuauaucaaaagguaagucauagguggccaagacaagaaauggcuucaggccuaguuaagagugaagcgacggaauuaaaagaaagcauagcugcaagaaacaacuguuguuagcagacuucuuccgaaacaaauuuuuuaaaaauauuaacagcaagaaauagaaaacaaaauaaaagcucaaaaaaguuaguagacaguuuuggaagggaguguucuggggaaaucggaagcuuuugccugccaggguagguaaugaagagacaggacaguauauuagauucucagagaucaauuuuuccuucaacagcugguuccaggcuauuuauuuaauucaugagcauuuuuuuaaaauuucaaugucuuacuucccagguuuauguaacuuuagacagguuaguacuuccaauuucgccuuacaguauugcuguaagccgguacaccuggcacaucgaguuugccauccuaguuggaguuuuguuuauaaacuuuuuuuuuuuuuuccauuuuuuauuagguauuuaacucauuuacauuuccaaugcuauaccaaaagucccccauauccacccacccccacuccccugcccacccacucccccuuuuuggcccuggaauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguauaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauuguaauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaaauggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacuuguuuauaaacuuuaaucuuuacaauuuguucacauaaccaugaugcuucauuauuuaacuaugaugugugcaauauuucauagucacucaggaaccuuagagauguauugaaguugacauuacagagcagcagaauccucauuggcaccaacuuugucagccagaugagauuugauuucuccacagguugugaaaguuacccacuuucagugauuuguggcacuggaauuuagagucagcugauaaguuagggugugauagcuuaucccuguaauuccagcacuugagagaggcagaggcgggaagaccagagguucagggccagccugggcaacacgcagguauaagguagucaaggucaucuguuucuauaaagaaugauuucucugaauuugcaagcccauuucaagcaucagaauuguugauucugucugauaauucucauuuucuuuuauuaguuuuaaguaagcauauaacuaguuucuaaaaacuauucagauucucuuuuacauauaaaggagccaauaaucugaauuuaagccugcuggguuacagucuaucagucugcuuaucauguucuuuacucucaauuucauuuuuuucuaccuguguuucuaauuaacuauaugcuuuuuauuauuucaucgcuaguucauuagcuguaauauuguugauuucaguaaggagucucauggaucaucccuugcuuucuuaccuggaucacugccaguauuuuuuguggguuguuuugugaaauucuguacuuuuuggaaggcaaauuuuuuuucaaucuggguaaaaauaucuagcuugacaggaauguggcucuauuugucagcauuucauguugauuccauguuucuaacgacuuuaacaaaaauaccugccauccuuacuguuuugccacuuugagucugcaaaaaccuccacucccucugcucucuguaauuggcuuacuuuuuguaauuucuucuucuuagugucguuuucuuucuguuugucuugcuuauaguuuguuaagcuuaugauuuucauaaucauugggaaaauauggaaccuuaguucuuuaaauauuuuuauuugauacugaaguuuucaaugauggcauaguuaauauuuuacuuguuuuuuuuucuaugauuuguuuuuagcuaauacuacugauaggaauuuauauucaugcauuuuuuucuacagugacuaauguguuuuugcaacagugaguuuuuuauccagacauuguauuuuuucuuuuucuuuuuuuuucuuuuuuuuuguuuuuguuuuuguuuuuguuuuuuuccagacaggguuucucuguguagcccuggcuguccuggaacucacuuuguagaccaggcugaccucaaacucagaaauccgccugccucugccuccugagugcugggaucaaaggugugcaccgccgcgcccggcuguauuuuuucuuguacacaaaaauuuauuuuauaauuuuuaauagaucuuuauuuuuucuuaaauguucaucuaccuccuuagacauauaaaauaucuguaaugacuuuaaaauuuuuguguaccguuuccucaguucaggagggagagcuaggcucugaauuuuucuucacuucuucaccccuaagaaucugcaggcugugacgaggacaguuguagggcucacccacuuguucccuuucucaauggaagcacugccuuguguugucuuuuaucacaugugaaaaucauugcuucauauguuucaauuuuuucaguuggaagcaaaaagaauaauaguuuuggucucaaguuguagaaggcagaagauguaucuacugucucccucuuuuuguuuuuguuuuuuggguuuuguuuguuugguuugguuuuguuuggcuugguuuuuuaaccauucacagguucuuuuuuccuuuucugauaacugcaguguuugcuuugcacagggaugcauguguuuacaucagaugaagagagaggccccauuucuucugcaguuuuugcagcaggcuugaccucacucagaggaaagugaccacuucucaaguguauguugcugacccuguugcucuuguggugcucauugcuucuuaaauuuucacaggaagaugcuuugcuauuuauuucguuguguucuaauuugggcauacaugaucuaguuguccaagcuagugugagacccugcccgaguggucgcucucacuaaggguaagcuuauuucagcuucauuaauguuuguuaccaguccugugcuccuauagagaacaacaucuguaacauggguggguauuuuguuagaaaugugcauaccuaccaauuaguuggcccagccaaauuagaaugugcuaguuugcauuuccaauuaagucagcuguuugaauguugcuuuucuacagcuggcaugaggcaugugggagugcccuguaccauggccagacacuagcuguaccucuuaauuaaaauguuugccucuguuucuauaaaacagugaguggucuuugcaauuggauuauugaugguucugugacuuuuguauuaaaggcccucauuugggggguugggaagugugggaccaagguacccugaagugacuaugcaccauuuuaaguggaugguugguauucuccucccaccuguaggcugcugguuuauguccucaguggauaauuguaauuguauggucucuaccuaaaaagaauuuguagaaaggcauauucuuugaaauguuccuagaauuuaguaguuuuauguggggcuugcuuaauuuuuaaaaagaaaaagaaaguacuuugaaacuuuuauggaagugggucacuuuaaaaugaaauuauauaugaucuuggcaauuaccaguuguccugguaaucucauuugccuguuacuuauuaaauguuuuugcuacauacuaaucuuaaaaucaguuauugagaugauuuaaagaacuaguccaguaugcaauacuacaaagaguuggauucucuaaaaccacgagaaccguucauacauuugcuugaguuccuucucauuuauaaacagcuaguuaaaccugagcaguacagacacagaacaggcuuucacugugcucccuuccaguucacgcaagagaaaggucagcucugaagcagagccacuggcgggucugaaagaguacuaagcuacaaugugacuaucuccccacugcagaauauccacuguacacacauguaguuugggaaacauucucaucacaugauuauaaauacuuuuugaaauuguuauuugugagaauauacauacaugucugggggacagagaacaacuuagggggcauuggucucuuccaccauguaggcuccagggucaaucucaggucagcagaccuaacagucugacacgauuuuuuuuuuuaaagauuuacuuauuuauuuuauauaggaguauauuuuagcugucuuuagauaccccagaagagggcaucggaucccuuacagaugguugugaaccaccauguuugcugggaauugaacucagaaccucuggaagagcagucagugcucuuaaccacugagccaucucuccagccccuccucgcauaauuuuuaaaaaucucuguuuuaggaacuucugauugguaauuuauuuuguauauccagaaaccaggucugaaagaccaaguuaguggcaaaauucucuauuucuugcuucuuguuaugcaguguuguuacaaaaacuaaaaaugugguagcuggauaagugguaacuuuugcaagguacagucuaaacugaaacaucaagaggagaaugcauucugacuuguuccugagagugucauugcauccuuaagaaccagauacacccugauuagaaugaaucacuugacucugucuugucauuuugaauuaguaaauaaaaucuaaagacaacuugaugucuauuacacuuuugguaaaagcaaaugguuuugcacuaacauuugccucauuuccuaaucuauagugaaaugaucaucuauguuuuaauccucaggaaaacuaugaagacacagacuuguaccacucacccaggaccacuuagcaggcuggaaagcuucaggcacagaugcuucagucacagaccauguagcuccagguccaguuuuccuguuugugacgggucuuccaacccucccauuuaugauguuaggcuagaauccaaaagcucauuuaguacguauuuuguuuucuaaccuugucauuuaagucagagcucagagcuuuguuuuguuuuguuuuguuguuuuuuguuuuucgagacaggguuucucuguauagcccuggcuguccuggaacucacuuuguagaccaggcuggccucaaacucagaaauucgccugccucugccucccgagugcugggauuaaaggcaugcaccaccacacccggcuuaagucagagcuuuuauuucugguuucagaauuaaugagggaugcugcucucacuggcccuugcuaggaagucuguguuagucuuuauguacuauuuaauaauaguugcauaaugauggaccagcaacauggcacaucuccuggcuagggcucuguauuucuuacuccauuacaguugaucacuuuguuugaucuacagguucugaaacugcagguugagcccucuguacugugcuugucccugacuguccugcagcucugacauaguaauauaguaaaggacuaaggguuaggcagcgugcacauacaucauggaucugcuggacaaagggcugaggcaugaccuagacaggauagaaccuauggcaugagguuugaucaggauacucacauggucuaugauuuaaaacuugagaacuguuuauuuuugaaacuuugcacucaguguauucugacugaacuugacaguggugacugaaucucagccacauggagacuaugcugaaggugcuguguugauguucacauccuuuugaaaacuagccuguugcagggauguucagaagccauugcuauggauagcuccccacaucucugucauugcuuccuuuggcaaggaucugcuuuucuuccacauguaucugugugguucuuacccuuucccccuucucagagaaagucaugucugcuucucuagaaagccagccuauuguuggcaccucaguccuaucuccuaccugguuccuucgggacuugcuauaucacugacuaauacucaguaaauggcuugccuuuuguuuaaaucagguaauuuauuuccuuacaugaauauuaauuuauacuuuucucuugaaaauguaaagagaauuccugagugggcccaacauuccugcagagugacuaucagcuagagauaugaugaagugaucguucagaugagaugaucacuuccuguuuccuguagcuccucauacuuacuauuacucaauaacuacuugggcccagaagacauugaguacgcagccucuuauccauugaggucucuuagcauacauagaaagaaauucagcauugcuuacaaggcaguguacagcauuugcauggcaugaacauuugaggggauuuaccuuauuuuuagugagauguauuucuucuguaauugaacuuggggucgcuaccuguguuacuagucagauccaaccacccauccuuaauaagccaaucaaaagaaccaaauuaacagcagaaagaaaaaaagauuuuuuuucaauauggcuauauuggaaagcgggaccaagagaucuguugaauccuccaaguccuuaaaugagaugaaaguuuaaauagagggaccaauaaacuuaacuguuuaaaguauaugcacauagacucuaagaagcuugccaagguguggucccaaccauuacugacccaucauucuuuugauuucagucucauucauucauucauuucuuuuuuuuaaaaagauuuauuuauuuauuuacuuacuuacuuuauguauaugagugcacuguggcuguacugaugguugugagccaucauguguuugcuggaaaugaagguugcucacuccagucggcccugcucacucuggccuaaagauuuauuuaucauuauaucaaaguacaguguagcugucuucaaacauaccagaagaggacaucagaucucauugcagaugguugggagccguaguuguugagauuugagcucaggaccuuuggaagagcagucaguguucuuaacugugagccacuucggcccaaguuugccauuucuuugaguuccauuacuuaaauagucugagucagauuuggcuacacuucugguaggguacguaggggcauggugcuacuagguguggcuuuguugaaggaagugugucagugugcgggugggcuuuaaggucuccuaugcccacucguguucugaucaauauguagaacucuggcucuucuaacaacaugucugccugcacacuaccauguuuccugccaagaugauaauggacuaagucacugaaacuguaagccagccuguauuaaauguuucccuuuuuaagaauugccuuggucauggugucucuucacagcaaugaaacccuaagauagguauguuaauauaguauacauauuguccauuaauuuugccuuugugucauaauagggacauuccuggaaauguuaauacaaauacccuaugugcuuagaguaacaguagaccuguggaauucauauguguaggccagucacugaagaguuguagauggcagccucuuccuagacaucacuccugucuuccccaaguuuggcuucaacaagaaguauguuucugaaaauuuccauaucuucacauguagcuauaguuauuuauuuuacucacuuuacagauaggccauaauugaguuggauuucuuuuugccaacauuugaguuuaucucagugugauacuguuaacagcaacagucauauggucaggagcagcucguuaaguucuguuggaucucacuucaccuaagaguagacucgugcucuugaggcucagugagagcagcuuucuuaugcaugugcugcugcuguuucucuuggguucuuugguacacaggugacaaagcagcgcaaggacagcaguagagcugaacuacuucuuacauuaaaccucccuguguagucaccuuaaagcagaaccacaugcaaccaugaugucugaggcuaccuccaugucuucugguacuuuuugugaauuucagacccaucaagauauagauauuugaaaagcucacagcuagccucuuuaaauuuucauccucuaaaguuccuucgaguugguucacagggaugccuuccuuuguuuggcaugguucuaagugcugagucaccaaacagcaaggagacuuagaaauacaucuuaaagaguauauuaaccacaagagauugaauauggugcacauugcugcauuaacuggaaaaauuagccauccuuuaaucuccuuugucccacuccauuuugcacuuaaaaguucauucuugaaaaugucauagaacagaugcguguugauagaaguuggcacauauaucuuaaacaaaucgugaguuauaauauuuuuuauuuuuuuauuuuuuggcauugcuuucuuuccagcauucauucuguuaggucugaaggaaaacuccaaguacuccaaaaugguagcccacuggcucgguccaaaauggcaauauuggcucagcuuaugauagacgauaggauugcugguaaauacuuucagcauuccucaggaaccugugaaacaauuucagucacccaggaaaagccacuucucccuucuucuucuaagggcucacuccugacaugucuccucugcaaacgucaggugucucuuuacuuguacuugcuaugcaucucaaagcccacacaagcaacuuggcccuucucacuuccuccuagacccuaaacucccaggcuguuucaguuuagaggcuucccuccugcagcuacucauccuccuuauaacuuguaugauuccucucaccaccgugcuugcuauuuucuuucuugcuguucucugcuauucucucaucuccucucuugaagauaguucuggccauguccagccugcugcugcugcuguuucuccucuuccuccucuucuuccuccuccucuuccuccucuucuuccuccuccuccuccuccuccuccuccuccuccucuuccaccuccaccucuuucuccuccuugacuguuauugacucuuccagaugccucugucuauucuuuuucuuaccuacaauaaaaaacuuuccccugauggagugcccauuuccacaguuuccuuacugugucuucacuuacauguuaauauacaguacuaugcuauuaauuuaaauuuucuuguucugauuauaaacugacuucaucuaaaagggcuaagugaucauuuaacauagcaagguauucucugggacuuuugugcaaggaaacugcucauggcagaugagcaaggaaacugcuuauggcagaugagggauauaaaguacugcuguacaaaaucugaaggauggaaauguaucuaagagguaagugcccauaaugcuaguuugugacccucuaaggauggaaauaaaucugugguaguaauuacuauuucuuggauagaacaaagccccauggcaagauaggcuauuucuaauugggaaggaaaauaagacucuccuaaucuuuugagaaaagcuuuguggagaaaguuuuguuuuaguagacuuaaagaauuuuuuuaaugaaaaaacaaacaaaaaaacaaaaccaaauaaaggaggacaugagugcuccuagcuaugaugaaggagguuuauuguagauaugagggugagcaucgcuagaggcaccuggaagaguccagagugaaugugacccuaaacuaagcuauaugaagagaggggagggaaaaggggugagcccggaggcagagaggucuaaagaaaaaggguaaccggauccaaauggcugaauuauauagggaauaacaguuggaggaaggguaauccagguccuagacuaaagaguucagaguaggaggcuggguauaagagccaggaggaccggguaacaggagagacugagggaugcugggagaaccuggcagucaggucagcuuugauauguuaauaggcaucucagcugguuguccuggguuugagaccuaacaaguuuccuauguauguauuuuuaaaauaggcguuuuuuuuuuuuuuuaagaaaaguuugaauccacagaaaaauugcauaaaagguacagagaucuaccacauuauuggugcccuucaaucuagaucuacaugcuugguacucccuuccccagucuagauccaugucuggugcucccauucccagucuagguccacaugccugaugcucucccgaagucuagaucuggaugaguacugacugaugagcuugugcggcaugcaugccauuaucaccugagauccccagcugagccucagugcacagcaagcacucagcaagggauaaauuuagaucuuaaguuuuguuccaugcacuacuuaugucugcauuugauuaauuaguucagccuuugacugagccaaaacaguauuuuacauuuuacccuuuuauuucuguaaguuuagcuuuaaaugucuucaaaacuauauuuuccuacaugugccuaucuuuuacuucugugcacuaggcaugaguugaaagacccauuuagaucauggucaugaguguaagaaaugaaccauggagccaaagugcaaauauuuauuuagacuuuuauccauauaaauaaagcuauugcuuauuaaguuacuagccuguuuucaccacguaaaaaaucaguuuaugacuuuguuauuuagacuguauuuccaaggggcagccccaaaucuaaucaucauaucuuuaguuacucuuggggaccccaguuaaugucuuagcaauuauuggcuugaggggccacccaguguguccugugucauggcagaagaugagaguuagaucuuauacguuguugggaagagguggcauccuaaucacagugagcaggcucaacaccugcaucuugugcucuuggcacuguuucccaguuaaugaaccaggacgagagagagagagagagagagagagagagagagagagagagagagagagagagagagagauugagagagagauugagagagagauugcuacuuuccaugcuaggauaagaagaaccuggaauaucucauuaugacaaaaaacaguaaaggaaauccaaagaaugaugacaauguaucagaaagacacagcuugaaggggaccccaccagccaagucuggacaaauugagcauuaaaauggaaaugauagagcaaauuauaauucaucagauaagcaagugaaaucauuaaccauauacuaauaacuuuuuaccucucuaaaggugggugggaccugggggaauggagccuaaaaaugaggcagacuaugaagucucaugucauaaccaauuuuacucagagcaucagacaauuuauauucugaggguuaaauagagucacauaaauaaaguauacuaucauaagagcaagccacaugcagcaaguacuugguuuccauagagauauaaaaccaaauagcaaacucuaaagaaacucauuucuaucugcuacaacugggagagguaugaaagcacaucucaagaacaacuaacucuguuuuuguuuuguuuuuaaaaaacugaggucacaagaacucuuaccuuguuuucuuggaguuuucucacaagcacuaagaauuccccuuguacaacucuauuuguggacguguuuugacaaauaaugaguugaaauuuuaaggcagaauuagacuucagacaguggcaaaucccacaaaaugucaaaauucuugugaauuaaaaagagaaaaccaacaaguuugcagugggaagaagaugacaagccucccuuuauaagaggguagaguaaugaaugggacaaguuaaaauuccauguuaccugguggaauacagugcgaacacaacauggcuucugugcuguuucugccaaauguacagggccugaaucuuacaugagaaaugcacuucuaaaucaagggcauugaaggugcuuggccugugaucucuagaaugucagagcaugaaaaucccaaacaguggacaaaacuguuccagauugugcuucuggguucugccucuccucccagggugucuggucacugccagacuuggcgaacuacugcuugccaguccagaagugggaggcagaaucuaggauggauguuauuguucuucaucuccugcuuucucccucucuguuugggcucuuauagaugaggccugcucugaagaucuuuaaugaagcaauuugaaugcauacacuuuauucagggugaaccaaaggguuuuggguugagacuauccauggugggaaaaggucauugacuggaagcuaagguacaagaagccucauuagcauggagaagcauugcaguugcuggguacugacuaccuguggccgccuacuuggagucaccugauuaugugcucugaggcaccacagaaacagggagagagcuuguuccacuccugcuggucucagguuuugagauuuuuggggguuugaacgugcucugccuuaccaguucucuuguggcaggguccaugugccccacaccagauuggaugaggcuauucucauuacuuacacuaugaaggccacuguugggaaaguugauaaauacugaauagauuuugaugauuagaacacaguacugcauuggguuucauuucuugacuugguugguuuuauugggggacuaucuucacguacauacuaagcaaccauuuucaaaugcuauauauagucuuuggaucucuuuacuguaauuucuaaaaauuuauugaggauccaaaagcuuguguuugugcaguacagcuauuaauguuuauuaucuuuagucagaugggagauuuaaaagcauucauuuaaaauaauaacaguaaaucuauuauauguaugaaaaacacugggggaauaacuuuugaaauaagauugagugaguagaauacuacguguauacauaucugcaagucucuuuagugucuuacuuaauaaaagauggugguuggcugugcuuauccacagcuacaguuuguuaguuagaagaagaaaaucuaccuuuaaauagauagguagcaaaaguuuuuaguagccucuuucgaguaauuaauuguggguauucuuuauauacauaaaagguggccuguggguuacaaagccugaugaccugaguucaaacccaggcugcacagaguagaaagcaagaacucacucccacaguuguccucugacuugcacaaccacucugugaacacauauguucacacaucuauacacauguuuaagucugucuagguggaguaucugacaagugucuuccauuaugaggcuagaaaugaaaucuucguacuuggucacauuaaaauuuauugucuacucauaccuagaauaggucuugguaucuggcaagauuuucucucuuuaggcucugggaaauguuaguuugggaguuuuauagauugcuccagaauguuaauacauauggauugucacaaauguuaauaucaaccccauucuuaucaggaaaucuuuuuuucucagauuuguggugguagguauaaaucuucuaaaauugugcuuuuuauuuaaacacucaaauuuuaucuuggacaacaaauagcguugcuuccuuuucuugaaguggcagauucauucauucauuuuugauacaguaccuaccaaaucugcauaaauacaguuuguuguucuuacaauuaaaucauguuuagaugaaaagggagucaguucagcacgugagcagcacuugcagccauuguauuaaauaugcagaaaaaauguauauaguacauuuuguugcacagagcuuuaaaaauaaguauacaaaggacagucauguaguaaaauuaauaacguuacugcuugaucaggagcauuauuaagugaaacugacuuuuguuuuuuugcuacgagcucuugaaggaugcggugaccuccagagcagugcacaucgcugcucugauuugccuuuguuaaccagggaaggcagcacugagugccuugcuuaggguuuggacuuucauagauuuucguuggcuauggaucuugaaggaugcuguauucacaaaguaguuacggaugcugaacaucauagcagucucuguacauuacuuuaauuugagauuauuuuaaaaauacauaaauagcgguuugucaaacauugaaaauuauauuuaugagaauaaucauuugcaaacuuuagaaauauuccaguaagucuuguacagaaugaaugacauaauguucuuggcacauaguuaauuugagguaacugauugcuguaauauuacuguucugguaguaggauauuaacuuuagccccaugcauuuuacaugguacaguguguccuuuagggcauccugugaucacaaaugacgugugccaaguucguauucuugguauugaagaaugagacuucaucaacuaccuuugcuuucaguuugcuuuccuauaugaaagcagugcucuuaacaguguaaaggaggaugggcauuggguaugcucuguguugaccagaaggugguucagcucuuggcaaaauaucagugaaauggcucugcagguaaggguacuugccccaaacaucaugacuugaguucagucuccaaaagucuuauaguggaaagagagaacugauuugugcaaauugcccucuucucaaggccauacaugaaguuaauaaauauacaaaaagauuuuuuuuuuugguuuuuugacacaggguuucucuguauagcccuggcuguccuggaacucacuuuguagaccaggcuggccucgaacucagagauccaccugccucugcuucccgagugcugggauuaaaggcgugcaccaccaugcccggcuaagauuuauuuuuuaauuuuaaaaaaguguugauuuauuuuuuuaauuuuaaaaaaguauuaauuauauacuuagaggcaggagcaggaagacugugcauucaagaucaacuggauguggugguaaauggcuuuaauucuagcacucaagaagagcagucaggucucugaguucaaggccauccuggucugcauauggaguuccaggucagccaaagcuacauagugugacccaucucagaaagucagaaguaggagaguaaucaaggucuuucuuggcuacacagugaauucaaagacaccuugagcuacuuagaauuacaugauguuuaaagaaaaauauucuaaaacugaguucauuguaauaggauaauuaauacuugguuuaacuuugugauuuugauuaaauuuauuuccuucuaaaguuucuuuaauaagaaaagaacugacucugagaucugccugccucugucuccugagugcugggauuaaacagagcuacacagagaaaccuguugucaaaaaccaaaaccaaacaaacacacaaaaaagcaauuguuuagcaucuuauuucugaaugccucgguaagauuagaaauuuaaucuagaguauagucuuugccaaguccuagguucuauucucccaacccccaucccguacacuguaaagaaaauaaccucuuaacuaaccaaucccccaaaccaaagcgacagauucagaucuugaaaagcauauccccaggcaagauuucacaaaaccagaauggaaccuuucacaaacaaaaugauacuaaaagacaacguacuuuuagaaacauuagagccagcaguuucagaagaauggugcuguggguaucugacuucuaugcuuaucaguccuuaagcuuacaaaaacaacuguuauugccuucuaacuugauuuuauuuaguucaguuauccugcauggcucacaucucaucucauuuuucaggccaacaaagagaaggaaaaacucaaucuacuauaacauaacagaaacauuguauuauaugauuuaagaaaacacugagauacaaucacaguaucuguaagaggacuauuuuagcuggaagauaugauaauaaccagcuuccugaagcaaagaaauggauaaaacucucucccuaaagcugggcagcuaauaauguggaauccugcaagcaccuugcacuggccccucuccuguccccacugcugucucugcgcauaucccuccucucuggguacuaaugaaucaggugauuaguccuuucucugccaccuguugcuuuuuauaauaagcuguggguccucuacucugccacaccaugucccuccugaaagcagguguggucugaucacuuccuagcuuacaaguuagaacauacuggaugcuaagugcucacaacccugguaaauguuaccuugccacaggacgaucuucuagguacauaugagagguguguuuguacagggcccauucuuguuuaaugaucugcugucacuaccuugaaaauaacauagauugcuacaugauuuuccaccgaguuuugcaaauucugaagcagcucugccuguuauccugacaucuacaugaucuuuuucuucuuuuaaccuuccaggucucccugugcaccacaugguauccacaggaguucucauaacauguuuccugccacuccccucuaguuuaugccucuuucuacuuucuguauggcuaguuuuugguuuuucuuuuuaaaaaccuugaugcaaaugcuauguccuauuuaaaaauugcacucagcaugagcauguugcuuucucugcaucuauccccauccccaauugaaggcauugccuguuguccucagaugaagccugccaugugggugccacucaguauguuucuugccuugccuuuauucagccagaguucauguuacaugcagcagguucuguuggacccugagugacaaagaugaagcaacagccacaaaaccaaggcacuccugcccuuauacugcaggcugggagcaggcgcuuugcuggccacacaugccucuuguagauaugagugauagccugucuuuaauuucaagucauggcuguaacaggcaucuucugcuuccuucaucgguggugaugguagccacuuaaggcucugagauguccagagucuugcauuugggaucuguucuuagugaugucuuguggaugugagcaaugucuuggacuucuuucaucagauaugagacacuguugaugacaaagcagucaugaaacuuacaagcacuuuggugguuugaauaagaauguccucauaggcucauauuuuugaaugcuuagucauuagggagaacuguuugaaaggauuaagaaguguggaguugguggaggaggugugucacuggugguggacucuaagguuucaaaagcccaagucagguccagucacucugucucugucucucugccucccccucccccaccucucucucucugagcuccuucucccaucauaccugucugcugccauguuuguuccacgaugguaauggauaaaaccucugaaacuacaagcaauccccaguuaaaugcuuucuuuuauaagugguaugucuuaucacagcaauagaacagugacuaagacaaacacuaaggaagaaaucuugccaucaggaaaaguuauaucaaguguaagacucugauucuaaagaucaaaagugaauuaaaauauacuuuuuggacuauaaauauaaugauuccaaaagauaguauaaagcaaacugagacaaagcauuaguuggacauuaguuuagaaagcucaaaauagaaugcugugacauggauuccaugggugauaacauaacaaauaaaucacuuuaaaaaguagagucugauguucauggcuagcaugggggaugagguaagcuguuacagaguuacagcgcaaguaauaccuauagcagccuguguuaguaaggaagaaagaacacauuagaccaccaucuuuguagacauuggcaucaucuuauguagacacaagaaugcacuugaccuuaagaguuucauaaggcauauucaauaugcuaucacagggcaucuuuucaggaacuguacaggguggacagcaccaccugcacuucacaggccaagagauggagugaaagcuaaacccucuguucaccaccaauggaacaggacucagcuccugcuuccaugggcgccccauucccucccagugagcucuguuucugugcuccugacauaucaucuuuuaaccugaagcacaguaaugggauuuucuuuuucaguuuucuuuuuuuaaucuccuuuccaaacaaacaaauaaauaauucaaguguuuccauuggcagauuaguuuuuagguggagaaaauaagcaucuuuuucagaaaaugucuuuaagggggcguaagcagcguagagcucagcuuucagagaaugaagacaucccugccgggagggugggggagcccgugugagucuucauuguccgcacuccuucucaucauaggcgcuagaauaaguagaauacugugagcuugacuucaaauaaagaaaugcuuauuuggggaugaaauccuaaugagccgugguuaaauuuuuuuugggggggggggguugacugaaagugggucuuuucacagagauuaaaaguaucaugagcaguuuuuuucaaggccaaugaaaagaacagaccauuauuuguacaauaucccugaucauuuuaaccaaaugagucuucuagcaugacgucagaucaguucacucucuacugggugcauucaccuuuccuccagagccaugaaaggcaggcccucucuguggggagacaugcagauucucacccagagaugaggcuggggaaugugaucaggucugaagguaaaaaaaaggagcuaggaauaaggauuuuggucaagggccucuuuauucuuuguuuucccuuaaaaacagaaauaguacaaaaacuaauuuuuucacaucucuaaauauauaagauauguaauuuugugugaaaaugaaguuucuuuuaaacauacauuuguacuuaaaugaaacuugauaaauucagaccuaaaauuggugaucacugacuguugccacucuguacaggacugggguagggagacuacccaugacaaauagccucaaccuuccuguccaagcccugagucaagucuuggcugauuucuaagggauaugaagguucaaauauuuuugaguuuaugggaagauuacaaggagaagaauugaauugucuuaaguuuaucuccuacuuuaagaugucuaauagacuauguuacuauguuuuaagugaguggucccuaccaaccaauuuacuucuguaggggaaaaucaagaaguaucaagaagauggcuucgugcaccagcuaugcugaccuccacacccuuuccgcuuccauagcacagaucucuguugcaugccagguaucccacuagguccugugaaaacaaagauaaaaauguucccuguuugguaagaaguagauuuaguuuuguacuuggccucagacucauucaggauacucugaaacggcaaccuggcugcagcaucagaauaccccugcuuacaucaguacccauacuuacagagcuguuacagaguuacagcgcagguaauaccuauagcagccuguguuaguaaggaagaaagaacuauacauuagaccaccaucuuuguagacauuggcaucaucuuauguagacacaagaaugcacuugaccuuaagaguuucauaaggcauauucaauaugcuaucacagggcaucuuuucaggaacuguacaggguggacagcaccaccugcccugguguagguguagucauaggauggcuguagcaucagagaacccauuuagccaccgcccagccuccccaauggaauuucaauuuuuuuuccucuuagaaucuacaagauuuuucuaggagccauuuauaaaacacaaggauugccuucuggcugaacuacugugguuuggacaacaagaauuuccuuguugaagcaaccagcauggcucaucucauguccacagcaguuuccacauucucuuguguguuuauccuguucaccuguuuccuauugaguuuauucuacaauagcuccuacuguuaagagguuggcagaagcuaugucauucuuugagccccggaaggaugagagagggcaaggaugagaacggcccagcacucugaggcuuugggguaguuguuacucuuccccagcagauggcuaccgcugagcuggguguagaugguagccuugggaaauacuuggguuagggagguggaaaaguaaagguagcaucaaggguuacuuguauuuuguaggucuacagugguagcuguuucucuuccagguacuuacucuacccuuugcuguuuaacguuagcuaauucuugcccauuauugucuuguugguggugucagaagaaaaguugggauuaagggaaugaugugcccagccuggaauuauuuucuuaguuuccuaaaaaacuagccacucuguaguggauauaucuacaaaacaacucaacuccugcaccuaaggcucagggaacauuguagaagggggggggggugaaaacguggaucagagagcuugcugugagauugugucuacuaaugaugucagaagcuacuuauaaagucucaccaacaugacugccuacacagugguuuaacaaggacaacagcaauaggcgcacacacauuagcuuauuuuuaaaaauaccuuggcaaccucaaagucugggcacuccuaaacuuuccccugcuaccccaggcccaauuggggaaguagccaguggcauuuggcaucguuauugauccaucaaaagccaauuggggacaaggaccuucagagucugcacaugcagauucccgauugaaucagagcauuagaaccaaucuucaauaaaugaauuugaaagaaagcaaagagggauauauggaaggguuuggagggagaaagacggaaggagaaaaugaugucaauauuuuauagucucaaaaaauaaaagaaauaagcaugguagccacuaagcacaucagucuuuuaggauguccgcacuuccuugcuaucugauugcuuaggcacaguuccugucugggucugaugcugcacugcucuuuccccuucccacacucccacagcgugggagacggaggacccagucaugaaauccccaagaccuaucagugggucugguccaaaauaugauccucagaaaggaaaugugauagaugucuucaggagucuucugaaaagauauuccugucaaugaaggggauuuaacacagaaauguccauuuucuuccacuggguguugucaugagcacgcgauacugggaguggccccgacugacucagggagggagggaguauaaggaaaugagaugggagcuccuugaucaugugugucaaaacagggccuaguauuugucuucucucaguaaaacucgguucuacugggggcagagagacaagcaaguacuuacuuuauuaaaaacaaaggugucagagguucaaaaacuaggcaagucaggcuucucugagaagcuaauauuugcucaaggacccaacaagagacggggaauuuagaagaacauuccagauagggggaaaggaggaacaaaugaaaugcccugaauguauuuggaacacuguguucaaggagcugugaggagccuuguccuagaacuggggagcaguaggaagaacagcuggagaugagccgagagaaguagcaggcuacuugccaaggacuuucaacucuuacuacaagugagauggaaauguguagagccuuagaggaaagggaggagggggacuauaggagaggcaguggaaaauaccuaaagggaauaagaagcugugcuuuccugaccugaacaugauuugaaauuuaaagacuuaauuaucuugaguaucuaguagcaggagccauguugcuuguuccaugcgugaacacaaagaaagcuucauguauucuucacuccagaaccuucuuuccagaaguccaucaaauugauuuuugcaccauguguauccagugauguaaacuaaugcaagugucuuccucagauccugugugauaugaagccugagugagagguuuaggggcuuuugguuuuugacauaguuacaaaguacucaguguucauguggagagaaugcauuguucaaaucaaauagccaaagguaucuuauucucacgaaacauuuuacauugaauacaagcuaacuuucagucuuuuguuuaggggcuuguuuuuccauguuaauaugggauuguuuuaaaaucaguguuacuacauagaguagggaauucugaggcauuuucuaguaagacauaguuggcccagcaauaagugaccguucuucaauacaugaacacacauuacugacuguacaggaacagucuuuaccuuuaacaccggggaaggcauuucuuggucaauucuucucuccagguuaugcaugaauuucuauguagagucgauacuuuucaucgacucuuaaguaaaagucaaaucugucacaagccagcucuagguuuagcuacaaauccuuucagaucaagaauggacacuuccugugaagauuaaucaugaaaacugcaugaugaguuuacagugacuuccacugaagaaagguuuauuuugggaagcuggauuuuuuuaagugaauucuuuugaauuauccuaaguuccaaggaagagcauccuuagccuguugugguagaggagggagaggccuagcauuugugaagugccuccuguacccguggucaucaccugagccuaaaccuaagcuggguaauaguuacuucguugucacaagaacaugcugaggcuucuacaugaugucugucuugcucauggccauucuauaaagaaggaugaaaaugagauuagcaccuaugucugggugaccucaaaucccacacuuuucaaaggguggaagguggaaguggccauuguaugcugaccguggagagaguggcucccccgguucuucccucagaagcucuuacuucccuccccagcucuuuggaccuuaauagucuugagaaaaggagagcaucaaggucuuucccaugucacuuuguguauuuauuacugugcacuuuguguggcucuuuaaaugcagugacuuaacuguuaaccaggcuagaaacugcagugagaucacauuccacauucauuuuuaccaugaugaauuuuguuucuuuuaauguaucacacacuuuacaacagcuaagagcauuggcugcucuuccagaggacauggacucaaugccuagcauccacauggcaacucacagcugucucuaacuccacugccaggugaucuggcauccucauacagacacacaugaaggcaaaacagcagugcacauccuaaauaggaaggggggggggugugauacuguugccugguuuugggauccuuuuccuccuacuggguuaccucauccagccuugaugcgaggggaggugccuaggcuuagugcaacuugauagcccuggaagaccugcccuuuucugaagggaaauggaggaggaguagauugggagggggauaagggaggaaggacuggagcagaguggggaggggaaacugugggcaggauggaauauauaagagaauaaauugauaauaaaaaagcuacuuuacaaauauaaagacuucuuccugagauuaagugauaucaauuugcaauuaaaaucacaaaggcagugauauuuagagaguauauaguauuaugauaugaaucauguuuuguuacuugggccugagucugaaaaaguaguuaucauuauugauuuacaagggauaauugacagggugcucucaggcagcugggugacggugaugggacuuuuuauucugaacuauuguuuuguugacucucuaucgucucuuagagauacucucaugauugcuuacaauuauccugcucuaaaugucauaucaaauuggggggagaaaguuugaaaggauaauguuauccagagauuuaaucauaauugccauguauuaauuuucccuuuugcucaucauuugucuuuuuuuuuucuucuuccagaagaaaaauucaacguugaaacaaggaccauugcugucgacuuuucauuggaugauauuuaugauaaaauuaagacaggccugucuggucuugagauuggcguuuuagguuuguauuuuugccucauuuaugacucauuuuguucauucuuuggcuuuuacugggucuuuacuuucucucuggagguuagguguuuagugauaagauugucacugauccaguuguuggucaguagcaaauacuaaccuguguguucuugaagcuuugccuuguagaucagugacuuuaaagggguuucucccccuugcuugcuuuacuucagucccagucucucuguauacauuauugacaaugaaaggcugggcuugguagugacaccuauaaucccagcacucggaaggugaaugauacugaacauucauggcuaaggagauggaggccugggaaaguuaacucuuguucccugcagagcuuuuguauguagauaauacuaacagacucagccccaugaaauguuaacaccacggaaaggugguuuucaucuaugcuuuccacaaaaaaggaagaacucuuccacauaugcuuuaugguuuguuccuuuggacauauaaauguccacugaaaauacgugaugucaagagacuugggauuuuuuuugucuaaagcaacagaaggacugaggggcagucugaguugucuguuuucucuaagucuauuacuguguuuuauuauaccucagcugcuuguucuuacaggagaaucaaauguuuuugcugaaauaaugggaauauuugaacuguguuuuugaaaaaaaaaaucagaagauccugauggaguaauaaggaagauaaaauaucacauguuuuucuuucauauguggaaucugugugcauauagauauauaauagacauacgcacacacaaacacaugacauuauaguagaaagagaauaacuauuuaugagaaagaaaggaaccaguguaccagugugaggugacggaaaagggauggaagaggacacagggcauggggagguggguaggacaugaaaaucaugagauacuguguuugugugcagaugcaugugaaggccagaagucaaacuugggcuucucuguucccuguccacuuugucuuuaaagaugaccuaucccuguggagguuaggcuaagcugaccauagagauccccaugcuggaauuacaguugugcaccaccgugccugucuuuuuacugaaugcugggaauugaacuugguugcuuaugcuuacaagacagacacuuuaauaacugaccacucuucccagucuccauagaagaccuuuuuaaacuuuuuuuguuauuuuguuuuuguuuuuugagacagggcuuuucuguguaacagcccugacuauccuggaauuugcuuuguagaccaggcuggccuugaacucauagagauccaucugccucugccugggauuaaagguuuaugcuauaacacccugccugucuccuuuuuagaacuucuaaauaaggcaguguguaaggucaguuacccgaguauaaucccacucaguguuuguggacuguagcgagccuggccugucuagucuauaccaugcaaccucaugcuugugccgucuguagggauuccacuccugccucacuguagaaccagugggcaaaagauaaaucaaaacacagaacuagcuuuugccuuugugucuacauguucuuuuaucaauauauacauugggaagagucuucaaaaguucuucucccuuacccuagaugaccaggguaucagggggcaaaguucugauuguuucuaagcuuccaagauagcaguuauaacuugcuugucaauagaaaugcuguuaugguuuaucccauggccuucuccaccuguggacuagugacggacuagggaaugacaaaggccgucuuaggcaggaaggugguugauaauucccaaugaaaggagacuggggaacaguccuuacauugugaaagaauagcuuacuuuuaggaguaguuuguguuuucaugacuguucuuuauagaccucagcuacuuuucaaugaguaaaugugaaacaguagauacucuaggaucauggaaucugagaugggagauguuggguaugggguugguacaggacugggggauuguugggaacuuaacuauauccagaacauuaacacuugggagcuuguaacuaguauaaacauuauagagcuagggucagcaagaugguuugguggauaaaagugcuuccuauggaaaccuagugacaugagugugacuaucgaaucccaugauggaaggagaaagcagaccucugaaagcuguccuucaucuccauauguacacugugacacuugcaugcccacauuaagauucacaccuaauaaucaguagaauacguuuguuuuuuaaauuacugaaguaguuugcauucuuuuaaaugcuaaaucuuuauaaucuuaaauaaauugaaagcaguguacuucaauucuuuuuucuuucuuccuuucuuuuucuuccuuucuuccuuucucucuuucucucuuucucucuuucucuuucucucucucucucucucucucucucucucucucucucccucccucccucccucccucccucccucccucccucccucucucucucucucucucucucucucucucucucucucucucucucuuugguuucgagacaggguuucucuguguagcccuggcuguccuggaacucacucuguugaccaggcuggccucaaacucagaaauccgccugccucugccucccaacgugccaggauuaaagacgugagccaccacugcccagcaguguauuucaauucuuaguauuucaauucuuaaugugacuaauggcuguuauacaaggcauucaagcuaccaguuaccauguuuuuuucucaguuuauaaugggagucaaaauugcaaccucuagguuuuucuuaugguuguagagcuguugcugucaguuaaagcaauguuuagccugucugauugccacuucaacauaaggaaagaacaguucuguugacucuuaguaggucaagcucaaggaugccauugagcuuacugcauaguacagcguguagaagacaccaucucacaacaagacagacuggccuaaaaugucaguagagcugaggccaagaaacccugauuuaauguuacucucagggcuggagaaauggcucaguggguaaaacauugcaugauccugagggccugagagcagcuccucagaacugcuguaaaguuagauuugguaguuugcauuuguaaucccagaauuucuacugugagauggaagguggagacaggagacucucugggagcucaugggccaguuagccucacaggugcagcaucuaaggagacccuguuugaaacaaggugcaagguaaggauggacaccugaggugcccucugacccccacauguaugcaugcacucacacgaaugaacauacacacagcaagaaguaaaguugcuguuugaauuguuaaaaugaaauacagcuuugauugguaguugaacucagaucaguacuaaaaguaauuggagcugauguugccauaaucacugaacgcucauuguagcgccuacccacacauugucuuacuagcugggcucugcuuucaguuugcuuugcauucuguauucuaccacaacugucuuguuggucauugacccuucagaacaaauauguuaccuguauauuacacuguaaguuugaagucacuaucaaagcaccuuuguaagcuggauuuuaucuuacaagcucuagagcuugugagguaagacucauuuuauguuuucuaucucaugauggccuaguuuucuuagcacuuugcacuuucuuccuuuuucucaccucucucacauacuccuccucugucuaguaaagcccaaguccucucaugugaucgccuuucuguucauacagcugucaccuugauagcauccuuuaagauauuccaaguaucgauugauuucuaauaagaagcaguaauuguucacgugcauguauguauucgugguauggggugguugugccuuccucuugcuuuuaccuuacucuuugacacagggucuguuacugacuuugguguucaccuggucaccaaaucucuuguuucugccuuccaauacuaggauggaaggccugugcagcuguaccuaggguucuuguuuguuguuuaaugugggugauggauaucgaacucaguccuccugcuuacauggcaagaacuuuaccauugagcaucucccagcccccaauuaauauuagguuacaggaaagguuuuuuuccuacugaguauuaauuauaauuaguaauaguagaauguaaauaucaauagcauauacucuauuugaauagcauuaagcauaaaacuauaaucaaugccuaauaaggaaaauuaauauuuucaaaauuacaaaagaaaaugcuaaagcuuuugucaugaaagaaacauuaagucuucaauaagauaaauggaaagaaaacagcuuugaaccuugcaaauuuauacugaaaugucaccauaaacugacaagacucuaaauguucuauaggcugaggaguuagauccauaaucuguuauguaaaaaauuaagcaggugcuguugucuugcaggaaaaugcaaacaaaugcagaugccagcaagcuuguaaaaaugucacuauuucgagaaaaucucguccuuuuuuccuuggcuaagaaagcaguugguucuucuugaguuucaugcguuuagcaaauuguaucuuauaucuuggguauccuaaguuucugggcuaauacccacuuaucagugaguacauauugugcgaguucuuuugugauuggguuaccucacucaggaugaugcccuccagguccauccauuugccuaggaauuucauaaauucauucuuuuuaauagcugaguaguacuccauuguguaaauauaccauauuuucuguauccauuccucuguugaggggcaucuggguucuuuccagcuccuggcuauuauaaauaaggcugcuaugaacauaguagagcauguguccuucuuaucgguuggaacaucuucuggauauaugcccaggaaagguauugugggauccucugguaguacuauguccacuuugccccuucuuagaauugggaacaaaacacccauggaaggaguuacagagacaaaguuuggagcugagacgaaaggauggaccaucuagagacugccauauccagggauccaucccauaaucagcuuccaaacgcugacaccauugcauacacuagcaagauuuugcugaaaggacccagauauggcugucucuugugagacuaugccggggccuggcaaacacagaaguggaugcucacagucagcuauuggauggaucacagggcccccaauggaggagcuagagaaaguacccaaggaggugaaggggucugcagcccuauagguggaacaacaauaugaacuaaccaauacccccacucccaccccgagcucgugucucuagcugcauaugaaucagaagauggccuagucggccaucaguggaaagagaggcccauuggucgugcaaacuuuauaugccuccguacaggggaaugccaggaccaagaaguaggagugggugggggagggugugggggacuuuugggauagcauuggaaauguaaaugaaauaaauacccccccccaaaaaaagaacauauugaaacuccaaaaaaaaaaaaaaaccagcaguugguuaacaaacucugauuccuguaaugcuuacuugaucuggaggagguucucauauguguuccuaaucgguucgguggucucugcacaaaacaucucagauguguaauuugccaaggucaagggaguaucccuggaucugaaacauaucauagacaauauuuuuucuuucaaauuccaccacuaugacuucuuuaacuuuauaaaagugagauucuuuauucugcaaaggcaaggaaaggcccuuuggggaaaaucuaguuauucggugguucagauacuguggccuuugaguguccuagacaagacuucccucaugacaaauauuuucagacuccugucuauccauggcacuaugguuuguguaagcucuacauggaguuaaagccaucugguacaaguaggugugucauccuugcuuaguugguguuuaaagcugugguaucuauaacacccauugacagugaguccuauuuauauaccuggccccuauuuuaagugaccucauuuuaauaacaauauauagcgauaguagagcuggacugaaccuuauucuuucccuaugccuuuuauaagugaauacuuacucuacuaauguaggugaugcuuuuuuauagauagcuuucauuuuaauuuuuugacaauuucauacauguaaaugauauauuuugaacauauaccuucucgugucacuuucuuuuaaauccccuuucccagcuauccuccuucuacuguaaugucuuugugugugugagagagagcuaaagauagacccagacccauugacuuuaguuaggauugcuugcaugaacacaguuguguuauaugaguuauuuguuaguguuuuaaccuuccagucaacugaaugcaugcuuaaaaauaaauucuuaccugaagccgguaccuccaauuaaaccauacaaauuuaagaaguaaccacauagccgggugugguagugcacaccuuuaaucccagcacucaggagguagaggcaggcagauuucugaguucgaggccagccuggucuacagagugaguuccaggacagucagggcuauacagagaaacccugucucagaaaaaaaaaaaaaaaaaagaaguaaccaccucccaauauucucccucagagccccuauuuccuaaacuguucugggauagucaaauauuaauguucuauuuaccaaaccaaaaggcaguuugaaaagaaauauccaacagguuaguaucagucaguucugucuguauuucuaagcuuucuaaguuucuuaacauaaaaccagaguacuuacuuaguuaacuucugaaaagcaacuuguagguggagauggcuuucaguccccagaacauuaaaggacuauacauaggaagcaagaggaugcagaguguguuggagaaagcuguagaauugcauaggaggaugggaguuagagccacauaggaaauuaggacucuauaguccuaguuugaugaaggaagacuagaaaagucuuaacuuguuuagaggauuuagaaaucgauauauacauauauauacacacacauauacguacauacauacauacauacauauguggauauacacacauauacauauauauacauguguguguguguguguguguguguagccugucuuuccuggucuucuugggaacuuuaaaauacuguuuucauugucuuuugaaguguacauaccugcagaaguccaguggugcuugccauuugcaccucauugggauuaguuacucacuuuauuacuucuguacuuuuuagcuauauguuacuguuuuauugcuguggagacacccuuggccaugguaacacuuauaauagaaaacguuuaauugggggcuggcuuacuguuucaaagcuuuaauccauugucaucauggugggagcaugauggagagagagagagagaaacucuggguuugguauggguuuugaaaccucaaaacccaccccaagugccauacuuccuccagcaaagccauaccuccuauccuucuagaaucccuugaguugugucacucccuggugacuaggcauucaaauauauggcugagguuuaagaaagaacaggagcucugagcugaagggugcaggacaggagugcagggaaggaacacaggaguguaacaggaacucugggagggggaagaaacaggguuaguuuuguaucauuuuguaucauugcuaagauuucagcuuucuuuucuagggauaaggacagaugacacuucccuucuguagugcugcagucccacccugucaccagccccgcagcaccagcauagucauccccaacauucuuuccugacagaugccaacugcaagcuggcccucucuaggccaguugugugacaauugccuauaaauucuaggucccuguggcucacucaggucucagcugucaaguuaucucacaaccauccauaacucuaguucucggaaguccagugcccccuucugaccucugcagguaccaggcauuacaugauauacauauaugcaggcaaagcacucauacacauaaaauacaauaaucuaaaaaauaaauguuauuuuuaaaaagcuagguaauaucuauauuauguaauauccuuuccuuauauuuaaaacauauuuuuggauacauaauaucuuauuuaacauauuuaacaucucauuuaucuuauggaacauauuugcuucuuauaugcaagaaaaaugugugaugauauaaucagaguaauugguaauucugucaucucaaaccuuuauuauuacuuuguguuaggaacacugaaaaucuuauuaguuauacuaaaauauacuacugaaaguuguaaguuauagccacccugcuaugcuguagaccacugcaaguuaucccuccuauucagcugcacuccuguuuguucucuccauugguccuuaccuuuagcuaaccaucauuugguucucucugccuguuugcuaauugauucauuugaccaguuagauguuaauuuguuaaacuguuaauauucuagagcaauaucaguagacaagacaggaaaacacaucaucacguucaugagagauagcuauugagcgagugguugagacagagggagcuguugagacaguuaauaugcaucacacauggucucccugagaaaggaauguuuaaauugaaaccaaaggacaagaaaagaggugugggaaggguuuccagguaaaggaauagcaugugucuugaugucuauaugcuuggcauuuuggaggacaugaaagaugaugaucuuuaaaccaagagcaaggauuuuagaggguacuguagcaaaagaguggugauuagagccagaucuuaaagacuuagaaagccagcuucaugaauauggagccaagaaagaaaaacuuuuagaugaaauacacuuaacaguguagaagaaccauucgcaccucaggccaccuugcgaacacaaagaggcucacaguucugucgugugaugugggcagguagaacuucgggucagaaaauggaggugagguacagagguggcuuguuuucucugccaaguuuguuuuguuugagcauggucauagccacugcuggccugggauugaguuggcuguuguguuaacacucauccugucucagaaguguguuccuaagauguauaaaaugaggcuaugacugcuccaaggugugguugaggagguuuuaauuuuagauaugaggaagagcacacccagaggcaccugggcaugcagagaagguaguagaguagacaugaccagaggacuauacuggacugagaagggagagcaaggaccaagagagaagggcaagacagagguggggguggggacaagguggggugauggacuaaaagaguacuuggcuggaauggcaggguuaucuaggaaugagaugcuaggggaaggcuagcccacaagcuggagaacuuuaggcuaggggguagggugagaagagcugagaaggggccgcagcaccagcaaggacucuguaacaggcacuugcuaucaugagacagccuggaggucagccugggcuucaugguaaugggcacuacacuuagccauucaacaccuguuucuuuugggcuugauauaaguuagaucuacaguuaguuuacuugcaaaguaaaauuguaguuuguuaaguaggaauaaaagcaaucauggauccucaggccaaauuuaguuuaacagacuuuggggggaagucacaguagaaauuuaaguacaaacugacaacauuuuuuuuuaaguccuucugacuuccaaguggaagaaggcaagaagugugaggaagccaauaaggcuauuccaagauggugagcgcuuauuaggauggcagcagcgaaggauggaaugcccgagaggagaaagccgagcacucugugccccaggcugggcagaauggugcaugcuuuuauucccaggacuugguagguagaggcaggcgauucuccaugaguauacggccagccuggucuacauagagacuucuaggacagccagggcuacauagggagacccuuccugaaugaaugaaccaaguauucugcccauuuuacagacaaggaacaaauacaaagagguuaaaugcauuauuuacaauuagauagccacucaauagcaacuuucaaguuuuaucuggaaaaaacaggggcacauuuuucuacaaaacucugucaagcaaaguaaugucuucaucuggagccuuccuggcuugagaaguugagagaaauuccaugcagauccaaguaaccagugggaugacuggcaagaauccccuccuuuuccagcagugacccuuugcacuggagguagaggccugcuaaagggcucuauggaagcucauuuauuuagggacacucugcaggaacaucuucgagagugccuuuccaucaaucacacuaaauacggugacugagauuggauuucuaaagugagcacaagacuguuaaaauucagauuuacuuucuuucacuccaacaccacuaauggcauuaauuaaagcagaaccuuuagcuuaaaucuguguaauuaguucuaugauuucagaaacguaaauagaaauugauaaauauccccuauuagcuaacguugaaccaccaaccuuguggcguucuuuuugcugcauccucacuuuugauuuuuuuuccucacuuuugauuuuauguaugccaaaucuuaacuaauuuuguaaugagcaucagucacguggcaguuuguaauuaaacagagaaaggugucugcuguugccuuugauucaaucuuaauuuuucaauuucugauuaaaggcacugcaaauuuaaagccuuauaaacucucuuuuauuuggaaauugcuacuuacaaguguaugaaaacuguaaaguuugcaaaauguuuuacaucauguuccaaauaucaucugucaguguaugaacaugugcuagcuccagcaauauguuaagacggcaaaaaaggaaauuucuuugcaucucugucacuaucucucuaugacugugagacuaggucuacugaaugcagugaagagggcacaggaaguacuggauaaaucuagccaguaugaaccugagcccugccuucuguuuguauagauacuggucauauauaauaaaagcaagauucuugguauugggcucagaguaggaaggcaguaaauauguguuggauagauggccacauaacagcaucuucuucuucauuuacugacauuuuaaccugcuuccaacaguggauuugugacuauauccuuuguugaaaugauuguuccuauuucacauaugaagaauagugaggaaacaggcuuauuuuaugucccaguuguagcagcagcaaugauugauuagggcugaacucuggcucugcugaauucugaggucuguagccuuuuccagauguacuuuuauaaugcuggagguugaacucagagcgcgcgcgcacacacacacacacacacacacacacacacacacacacacacacacacacacgacaggcaaacacucuaccauggaggucaaaccccaaccauuuuacaaaaauguaagacagaguguguuauuccccaacacacacacacacucaugcacacuccccgagucuuugauacauucacuauuccagaaguccacauuaaaaaacaaaacagaaacaaaguuuauuuuaaaagacaaugacaucauuguucggaacagccuuuccuagugaguucucagugcgggauuggauuccuauguauaauugugaaugugagggagguguaagcuuaccuuuucugccuuguugucaggagaaggagacuucaugucaugugauuuguauuuggaagcccagccauuaggcaaaguauuuuuaaacugcauuaauuucuuauguuucugcuuaauguaaaaaaugaagccagucggaaguggucuguguggaguuagugcaugaauggauucucauuuucuaguaauuuauuguugugugcuccaccgucaugcccagcccacaucccagaagucugcuuuucuagugacaucauucucucucuagcaacuggcugugauagugaauucuauccauggggaucguagcacaugaccuuugacggaacaaaaucuuguuuuguuuuagagaaugaaauguggaaaugauuuuaaguauuagaucauuuaaaauauuaauaaaacacccagaauuauucuggauuuuuccaagucuucuuucucaguguagcaucacguugacaguaguauucuucgugguuccgaauggacccucagagugcagcuaagugagcucccugucaguccuccugcagucacccacuccauagguucaugagcuuggcaucucugcccaccaccaacgccugucaguuucccuguucuugcucugcuguacuucuguucucucucagucccagcuguuccacugggcucugagaugguugguuucaacugccaacuugaugggauccagaaucauccagaagagaagcugacaagccuacucuuaaagguuuauuuagccucugggcacucuugggggggugguuaauugaggugggaggagucaucugaaaguggguggcuugauuuccuggggcaggguccuugacugcuuaggagagagagugaggugagaugagcucaccgugcugcuuccuaccugcaugcaguauggacagcggccuccagcucuccugccugugcucaguuuccuggugcuggaaaugaccuaaaacagugagcugaagugcaucuuuuccccccuuaaguugcuuuuuucagggaguuuuaucacagcaaagggacaaaaauaaagggagagagggagggacagagcggggaggaaagaaagauagguuucugcaguuuuagaaccucauggagugcugggaaaguucucuguucaaggccuugugcugauuacuggcagagugagaauucugaaguuacucaguugugcuuugcuuucugaaugagaugauguguucauuacuaaaagaguuuugaaggcccuagggguaggagcagcaaugguuucuggaggaaaaagcuacaaaacucacuagcagugcaguuuuaaugcugauuaaagauacuacccguuagaagagauggucaacuuucagaauaaagucagaacaacuugugagauuguuucucuggauccuauacaguaauacguacauaaagcaaugacacugcucacacccauccuuaaugagauuaagcuguaaugggagugcugccaucuuucacuccuacucacagcacgcgcucccucucccuucagacagucccuggaagcuucugaucugcuauuugccuauugcugucaccugcugucucaaaauaaaacugcaaugggcuugccuuucuucaagaaauucccaguguugugcacuuauggaaaacagugauugaagaguauaguugaaauguucugguuaugucaugugauacaaacccacauguuuugcugaagcaagacccgugggaggucccgugauguuuggaaagaguauaaauagaauguguuuguuuucccugaucuucauuucauugagaaaggcauggcagagaacuucuggcauccuggccgguccugguugcuccagcugacuaauucgaauuugguggaggccuggcgguuucugcuggauugugcuacuacugcugauuuguguuugguguucugacacuacuaaacuugacugcuggcaucuugacaaauggauauuggaauugccaagaaagaaaaacuacuucuaaacaggcccacauccccuuguccuauuuaccaucuuuuauccccugccuuuggacagugggcuagaaggaggguuaaaauguuuuaaaaacccuuauuuaaaguaguuuuaaaaaacaacaacaacaaaacaaaacaaaucuaagccuacauguauuggcacucaaacuuucccucagaagacuuaauaguagagucugcuaaaaugaccugauaauaaaaguagcuggagaaauggcagacagauuuguuaacucacacauguacaucaagagccacaaguaagcaaucaaagucagaugguuaaaccucauacccuccccacaugacaagcguguaggaagagcacagguaguuguagagagagggagcggugcaaacgaucuuagaagugauuaguacagagaagagauaauggcuugugauaaaaucccuccagcuauaggcaugaugccugauuucuagucucaucugugauuggagcuuucaguaagaagguagaaggugacccugcccacuuuaguggauuaacucuuuagugacuucagugcaaaacuucauccagaaucugccaguuccaaagugccuugaauauagaauuucagccuccaaaggugcugucauuggaguugcuaugugcucagagcuaagaggagcagcaguuguccacagcacagaacugauuacucccugugaaugacagcuagccuggauccugcagcagaagaugcacucaggaaagcagacagggcuggaguguccuggugcccacugugcauuugccagcuugagucugaccucucauuuuacucauccauuucaucagcuuagacuugaugcucugaaguccuguucuagcuuucacaguuuuuauuagccacuaaacaccaucuccguacaugagaguuuauugcuuuggacuaagagagcuguguuuuuuucuuauguggcucuguuggauagauauccccauuuucauugugugagcagacagcauuccuaguuucauuugcucacuuagaggcaaaucagaaagcugucuacuuuaauacuuuauccaaaguaucacuccccagcuugcugaguuauuugugugcuuccucaguucaauuuugugcuuauaguacaugcuaagaucacagaucagcuguucuacuuuaaaaguucuagauuucagaacaauaauaaaaauagcccaccaguuugggcucuuaaaagauuuauaauuaacuauuuaauaauuacaaacugauuaaauuagagucaacugaacuuaaggccuuaccuuugguuauuugguuuaaauuuuaacaucuuuuaucaaugugauugcugagacacucgguagugggcaggauaagaucaaaauaaaucuagaccugcuguuacuagcuguuuagauguuuucccucuucgggggagcuugaaaccugugauuggcuuuccuguuuuaagaugaguuuuagugagcugcugaaaccauccucacugaaauuuugcaaggaaaaccugaagacucagggucaagugacagacuacugaaacuuuuuuccuagugcuuugguuugguuagacaaauugcuauuaguguuuuauuauuguuacuacugaucacuuuggaagugauaugagaaugcuuuucuuucuucccagaugaagguauauagcaguuuuagugauuagaguugaggcucuucugaguuugaauuucagcaugauuugucccguggucuugggcuccuuuuaagugcuuuggauuuuaguuucuagggcauaauuuagaaauuaccuauucggcuuguugcggcaguuaaguguacauuaauagauaaugcaguuuguuaguuaauuaguuuguguaaagucagggauguuuuauccauuugggaauguuccuuauuuucuguuucuuugucuuucugggucuggagaaacugccuauaauggaguauucaaauauaaaccuaaucuguauaaguguaucagugccaagcugagguuaaaugauuaugcagggaggguucaaaguaagcuaagcuaugaccucagcauuccacagaucauuuaucggagguacuuggucucaccugcccuccaggcuaccccaagaaagccuuaaagucuggcucucuaggaguagacuguccugacucugggcauucuauuaugaauauugauuguuuggauuggaaaccuuuuucuuccuaguagauaguaaauccugugaugugagaaccuuucccuuuccuuccuucuagcagugcauguuugaccuacaagcauguggcaaauauuugucacaugacugaguaaacucuuacauuagcaguuaacaggcugagacauaaacuggacaugacugauuuaggucacacauuuuaugccaugucuauaacuaaaacccaaguuuccagucuccugcacuauacgcucuguguucuuucuacuaccacauggaggagugauuggcaguaucaguagaugacuaguguagaggaagaacacacauuccagagggcuaguguggacagggaaggcgugcgggugguaaguacugaaaggcuccaugaaggaaaagcauuuaaacuggaguaauaaggacuugagauagaaagcucugggaaggucacaccuucgccaggaauuauauuuuaugcgguuauauauaucauuuuagucucaguagguauaucucaacauuucaguccaucauuaaaauaaaugugcuagcuaaucaucuugucuuauuucagugaacaacgugggcaugucauacgaguauccggaauacuuucuggaaauucccgacuuggacaacgugagucuuucuuuguuuauuaugguagcauagugaaagcauggccaugucaguaaggcuggaagagugauucuaacugagggucagaguccagcugucugcaguucagagcuggcuccugugaggacgaaccuaauccgagcuaguuuguuuauucacccuuacauaugaacuaggcagcuucauaggaaggcugggaggacugaaggcagcaauguuuaugaugaugucauuuaaacagugccagggucaauaauagcucuaauuucauuuuuauuguuuuuguuugauuaagauagcucuauuuuaaguauuggggcaucagaaauuaguuuaaaaacucauaaauauguuaauguguagcagcauaguugauucaaguacccuagcuuuaccaaaaugagagcuacagccuuaauacaugcauaauccuuuaaugaaagcuaagaaguuacaucucugaaggaccaugucaguguuuuaaaucaacugaagcucuuaguuucagucauuuccacuuucucuauuaguugagaggaaauuccuaaguguuuuauuuuggauuuaaugugucucuucacguucaaauuugacuugcacaucugccuuauguuuuucauauucauauuaguuacugcuuucauuacaaauacaacacugagaaaaagcugaccucuaccccucaaccucagcucuauugcauuucuaauuccuugcaauaucuguagaaacuucaggugugucacccuaaaguauauuuguaacaucauuacuuucuuagugaacuuaaauuauccaacuuuuuugcagaccaucaagaaacugauaaauauuaaugugcuuuccguuugcaagguaagcagcuucguuauaaaucugucaucuuuuuuggcucuuucuaccuaaaaacacugauauagacucuguuggcucauuucugucagcucuuauuuaccauguguauuucaaaugaauguggucuaucuccuugucuccaagaaguagaaagagcugaccaccaaacauacuugucuuagcuuacuuuucuaagaauguaacaaacaagucucuuaugucuucuauguacauucaacaugguggguaacaggacuacaaaaccccgcucagguuaaaggcugacugacuugagccauuugcugcucauggcugauuuguuuccauuuugacauacguaguaauucacuguuauauggcaaggcaagauucuagaagccaacgagaguaauuuuuauuagccauaccuaauaaccagccagaauagcuuggcaugguggcagacgucuuucaucucagaauucaggaggcagagguaggcagggcucugugaguucuaggccagccaggacugcagauugagacccugucucaaaaaacaagugaacaaagaaacaacaacaaaaaacaagagcaauacaaacgcaucuggcuuguucauuauuugcuaaauauguguuguauuuguguuacucguguauaacacaagauuacaugaugacucugcugaaaggagcaauagcuggauaguagaugcaucuaagcucugcuugauugugagcuuuagaaguuacugcugaggacagaacaaaccauggggaaggauugcuagaagcugaauccccauacacagugucagacacuuuaaauaugaaaauucuugcagaaagccacugcacuuuuaagaacuccuuuauacacgagcuuguuuaaggaaauaagaaauagcauaagucagaacucuucaaaauaaauauaaauuaauaagauaaauuauacauuagauguuuaaauaagaacuagauguuucacuuuguguugggcuccugguguuuuucucuauuauggauuuucaagagaaacuaucccuaugucuuucuguucugagagaaauaaaggaugacccuuacauggcugguucaaguccaagaaccuaguacacuggccugguuuuuucaugucuggcuuugcuuuucccuggguaauguaacuaacuauuuagauguguuaauucagugcuuacagauagaaaacauuggcuagcuuguuacuuaaaagccaccucaaauguauuauguaauaaaauggcaaauauuuuugucaaauaaauaauuacuacacuguaucuuccuccuuguuaugaaucaagguaucugugguuccccuccucccuccucccucccucccucccucucucccucucucccuucucucucucuccuucuucucccucucucccuucucccucucucccuucucucucucucucucucucucucucucucucucucuccccucuguguauuguuuggcuuuggcuuuuauauaaacugaaguuuaagugagcugaggagucaccaguggagaugugaguagauacagagcauccacauuugugaaacugauguuuuuaauguagcuaauaggaauauauuguauaguuuuaaggucauuucuuuaccagauuuguauaaauguucagccucuaacacuauuuaucggauuucaggcuaauuaagaaacuaccauuuucuagccauuuuagucuugggguaaauuacuuuucacuuuacuuuucaucuguaaauugaagauauuucucuuuaccucagugacuuguuugaaugaaacaagguaaucucuauaaaacucaagaguugggaaugcagcucagcaaguagagugcuuaguaggcaugaagcccuagguucaauccuuagaacuguguaacgcuaggcaugaucaugugugccauaggaaguggaagaaaaggcaagaggaccagaaauucaggaucaugcuuguccaggcuguacuaccugagauccaggguagagggucagagaggagaaaagagacacacagggggaaaaggaggaagggaggggaggaagagaggcucuaaaaauguuauuauugcuauuaaauuuaaaguugauaaaaauguuuuacuaaauacaugcaauaaugauuuuauuuuuagauaauaaagguuuuaaauaaagauuaauguaaauucuguuguauaucuuaaauuuccuuuuaaaaugaacgauuuuacuguuacucugauuuuuuuuucugguguaucuggccaaaaugcuugaaaauaaugaguguuaagacagugagguguuucacaauauguuguccuaacuuagugagaaaaccuuguucaagugcuuaaguuuuauguuguugaguuguuaauacuagcuguagguuugucuccuucuaacucccauucuucaucaggucggcuguguaggguuuuacucuggauccuagucuuuucucuuacaguccugcuugccaacacuucauuguuggccuugcuuuaaaaugcuggccuccuguuucccgcaacaugaauuuuuggcuggccaucuguagaauacuaaacuaaugauaaaaggccaagguccugucuuuaauccuagagcuuguccuguuccauggccacagaccguguccuucucacagccucuuagcacagaucagcaugugauccaucucauccuugcuuaaagaccaaauagugcuggugugugugugucauggauaagauagcacaaaccccacagcucugcgaaguagcuagcccauugggaaauugaagcagaagaaucaggaguuugaggccggcuugagcuacauacugagccccugucucaagaaaagaguagagaggggugugugugugugaauaagaaugagauacuguuccuaauaucuuaguguaucauacagcuuaccucccccucuucauucuuccgccuccccuuucucucuuugaauugguguuuauaaacuuguuccuauuagcuggcuucauggacauagaugcucauuuuuuaaguacuuugagacauaccaaagggacauaucacccguagaauauuugaauguaugcuuaaaaguuauacaggccuuugguagaccaaauccuauuuuaaaagcacuaagggauucuacucuuuaaaacauuucuucaguaaguugaauaagcauccuuuagucauucuuaagcauggaucuaaauuuacuuguaucauuguaauguaaauuuugaauggaaaagcaauucagaauuucugguucaugaugucaucagcccuuagagcauggugcacaauugguuugguuugauguacuguggguaggaucaauaacaugaccucugaggcaccaugcagaugugaaaaugguuuagagcagugagaguggucgauaaacugugguuaaccaaugggcagaagacgccgugaggucaggguuguacaggaacuugaguguucagcauauagagaacgguagagagccugcagaacccgguaugugugugagacaguacuagaggaagaacaacauggcagucgguauucuguagcauguguguucuguagcauucuaugcacguagcuuaugucuccugaggagaggcauuccccucggugaagcuuuaugugugauauuccugaguuuaagcuuuucugaugugauuugucccagacaguauuuugaugacuugcaccuaucauucuuuaacugauugcauuuuguugccaaagccagaaccacauuuucaguagcagugauugcugggaaccuugggguaauaaagggagauggaagcuggucuggcuacaggaccuuagguuuuaugguaguuggacaucaggggaacugagacacaggugucuaaccugaaguuccaguaaauguauuaagauuuuauaagaaggggagcagucucucuuuacccuuagguucaccugauguaugucuucaccaaaugacaugcuggagagucagaaguguaccaggagaugguggugagaucagccugcccugugaguuaggguccugcucacaauuaaaggucgagccucagcaucuugguggaaguccaugugcuucuucccugugugagcaggccagggguuuguaaaaggcaugaaagccccacauuauaauaguaaaauaauccugaaugcaaaggguuaucacagauaaagagaugauccaggagaauguuagggaagaaauauuaaucagagcaguuguguccucagacucuugguuuuuaaauguaaacagguuucucaagguauucaacaaucugguucuagcugaauaguucacuuucaaaagauuuauuuugggggauguguguguguguguguguguguguguguguguguguguguguguguauguauguuugugucucugcacauguaccucaugaguguauguguaccuuaugagugcaguaaccaacagaggcuggaagaggguaucagauccccucgcacugaaauuauggaugguuguaagcaaccaaccauguggaugcuaggaacuagaccuacaucuucugcaagagugguaaguggucuuauucacugagagccucucuccagcccugguugcuucacuuuugaaucuuguccaguggcuuggacuuuuuuuuucccaugugccaaacuucaugcaugacuagaaaucuagucuuagaguagaucaggcuuggaauccugugggcccauggcauauuacauggcuucccuucacuuugcaguucuuaguguagaacugucuacacagagugggcaccaugaauguugacacuuguccccugccuuaucccaagugcacacugauggcuuuucuacaaacagaugaaugcauuuuaaaaauuaaaacuugucguucuuuaaaaucacagugauucuaaguguggcccuacaaugguaaauguggauuaguugaaguaaauugggagaauuccuuaggucagaaguuacagaucuguggcuggauaaggacuaccagcuuguguuggucaguucuguuuuuaaaagaugaaaguuucacauucagauuuauagcuucucuugggaaaaaucugaaaaucaugugauacagaccuaaggaacugaaaagcagcugaguaugugagccugggcucucuagccccugcugcucucugcuguuugagcagugcuucuagauaucugagugugaguuccucaccaggugauuccaagucuuuggucuacuugaacuuagugagcuugaaagauuggauugguuuggaccaagucagccuccugugucucaguccauuugcagcuaaugugacaaaaguaccucggacugucggauauaaagaaccaacaagcaucucucucagugugggaggaugaagaguucaggauccagggggcuguccucauagcuggugccuggugccugcaguguuucuucacauggugaaggggaaugaacagcuuuaucagaucccuguccuuguggggucauugaucaucucccaacgucuccaccuuuagugugcuauugggguuuccaccuaugagcuuuguggggcacaagcauucagaucaucucccauucucgguauucucugaaauccacauagaaccuugagagauggcucucuuuuuuagaugagugcugucaaaacaauauugcuugaucugccugcuacccucaaagcacuuauugcauacuuuuaaaaagccaaguuuucuccuucuguaucacugugccuucauuguaggugguuagcaaaagugcuuaaugcugugccaugcccacggugugaauguuuggaugaauagucaacagguagaaaguaccaaagcauucauuuucucuuucuugcauggauaugccucuggcaggugacacgguaccagcagggggagccuuguguuagcuuggaaaucuacggggagaguuuuguuccucaguuuaauuguauuuaauuuaggaacuugcuagaaagguauccucauauucugcuuccacaauuuaaguuaacuucaggaaacuaagaaaucccaaguaggauguguccuucaacaccgauuugcccaucuacugcuuuucugggugagaauauucgaaguuaauauuuagucaguucauuuugaaacuaggacuaccaguacauguugucgccugcuacuaaagcuuuucaaguaugcaguacauucagcccuuagggauggcaauagcaggcugccucagacccagcagaggcaaacuauuuccaaacacgggccagcacuucuuccacgccuucuucugaaaauaaagacacccuuguugauuggguuugggguucuuuuuagcucauagugaaccuaguuuauaggaaaaugucuuucauaugugugaaaacaugacagggacuugaucuuuaggaauuguuuucucuuuucaacaucugucacuuuuaaggaauugucacuuuguuuuagggggaaaagauaauaggagcacuugaaauacucaaacauuguaccauggaaacaccggaugauacucuguucauuccucuuaauaaucuuugcuuggaauguauaaaucaggggcuuagguuuggcaucguuaauuucuguguucuagaaaguuuuuucuuuucauuauauuauuuuaauauggaucaaaguagaauguauuggacaaggaaaagcuuuauuuguggccuggggcaacauuccaaucuaaaagaacucuugaacuuccucaaugaccuaagcaccaugaaaaggcaaagucaaauaacauuguaagaucucagagcucucaaaacuaugucuaauuaaguuuuccacccuugugcaauaaauacuguuagcuauacaggugagauucuaagaacuucuaauuaagcuauguucucacuuccucaccuccuugcagcucaaauuauacuguuugccaaaggaagugugugcugugucauucugguguggcuuccaguaguuucucaaaagaugggggagaggccauuguagaacauuauuguuacuuuucacaucuauacuaugauugauuuuaagaugucuuuauuucaguugaacacuuguuucagauuuucauguuucagauuuuguaagaaacugguuccuucuaaacuauauuggcuccacuucucaguugccuaaaucuagacuugauugauuucaguauguuucuuugaggucugaauuagggcaaaggugaaccuauuggccauaagagauauucugacauugcucaugaaaaaccugguuucuggaagcugagccuagauucugggguggcuuguucuguuuacuucgcuagucacaaauaguagugacacagaucuuauugaaucaaguaucuuaaguuugacugauucaucauuuucuugagauaaguccuuguuauauaguuugggcuggcauggaaccugguguggaccaucgaacucauaauccuccuaacuccuaacugaguacugugacuaaaggaaugcagagccuugucuggcucuuuucacuagagccuuagagcauuauagcaguguuggaacagaugaccaaguaccagaaguuaugugauaaaguaauguguguuauaucaauuuucauaccaaagaguagaaacaccuagauagguaccuggguuccuucugucagcagugacugccacugcagaaguagagauacccagaguaggcuuugacaguuuuguuucuguuucugguuuuguuuuuuuguuuuuguuuuuuaaagaaauaaguuuguaagggcuuuacuaauuauaaaagcauugcaagauuguugccaaagauauuugaaaacuauaugagcacuaagaagaaaauaaauucuguguaauccuggcaacagauggcuacauuuuaauacauuuucaaguauuuucuaggccaggaagucuauuuuuaaugauuuaauaauacugauugugauuuuguaugagguaaaugaacuucauauuuuuucuaacuagaauauacauaucuguaccaguaaaucuaccugaaaauggguaugugguuuccuccaaggaauucugauuucagcuguuaugaagccauucaugugucuguguacauuuauguacuguaggccagcuugccuaugaaguguuacuagagcuacaugugagauaacaauguagauuaacuuuuuagacuuuaaagugucuucguuuuugugguguggauuaaugaaaacauuacuaaaaaaaaaaaaaacuuguuuuuugcugcaaacuuugaaagucucauuaugauaaaaguucuguuguggugucuuugaccuaccugggggaaaacugucuuaguuacuuuucuguugcuacgauaagacaccaugacuaagauaguauuagggccuaugguuccagaggauuaagaauccauuauggugggaaaguguggcuuauagcugcaggccuaggacuggagcagugaacucuuagccuaagaguucacaucuuguaccacacccagagcaaacuggaaaugacgggaguauuuaagcccucaaagcugcuuacagugucauacuuccuccaacaaggccaucccuccuaaaccucaaacagcagcaccaccugggaagcagguauucagugcaggagccuaugggggacauucuccuucaagccaccacaaaaaggagugaaaguugcuuacuacgcacuuguggaggcugucugucucaggggagaggaaacaaguguagagcucauguuuauuacuacuaccuaccuaauauucucaaccaccaaccucacaaguuguaauaauaucauuuuaggaaauauguaaagagaaacaacaaacuuccuggcauaguaauuaucaccugcacauggccuaaaauuagcauaugaauuagcuccagaaacaccaugugagcugugagaugcagugcagaugcacagugaaaguucauggcaguacuugguaucugaguauuaauacccagauaucaagagccuaaucaauaaauacacagugaaaugggacuuaacaacuuaguuuaaaugucccauguaaguaugaugcuaaagagaauuuaaugucagcacagggaagucugucuacuuauauguugaauauuuuaaaaugauguguaacacaugcccaaauacagauggccuggaguuggauuuaagacuuagaauuugauuaucaggaaagguauuaaugaaaaccuuaguuguuuguauaaaaacaugaagaguucaacuuaacuuccuguggcuuuucaguguuguuccuggcugacuuuuuaauucuuuuaaaugaacuuccacuuccuugcauccagaaguaaauaugagaauagugagccuucagaagaaccaucaaucacuuuuaccuguaaagguuguaucuuugcuggugugcugucuggucauuagguagucaguauguacuuuuggcucuuuaacaaugagcuacccaaagcacuguuauucuuuugccuugaguuucucaaaccuuucauuuuaauuuauauuuagaaagaauauauuugguuaugucaguacauauuaauuaaucaaaaaggcauuuaagucuuaacauguuccugauauaauuuuuaaauauaauuaaguaucaugugaaguuucaugaugucuaaacauuuucuggauaauuuuucacccagagcagaaacaugguguggcauaauggaaaauauaagcuucugguuuauauuuccccaguauuucagccaaaaguuaaauugugguuauacuugcuugaauucuccaggucaaauugguaccuacaaaucucguucauucuccucuuuguguaggaaagcuacuacaagcgcuaaccagcugcucuucugagcuccacuuagcuacucuucguuaacaggucuuacuuccuuaauacagauggauacacauguaagggcacacacaugcaugcauguaugcacacacgagaaagcacacuuuuaaaguucaucuucauuuuccucacuucuguuucuggugaacucggggcuuugggaaacugaguaauaauaacuucuaugaaaauguuuggagacaauuuccuaauauuuuagcuaagcauuacgguccccuagugaaaugugcaaauagagccccuuucagauacaguugcuugcugguuaccuugguuagucagaguguaaugcucauaaauacagaccauuuucagauacucuuaagguugcauucguccuuugcagugaaauacuccacaguaugccugugugaaugacuugugugaaugucugacccugaugucuucuacagaugcagguuacaugaugcaucuaaccaguuguacauauuuuucuuacaucucuuuauuuuuuuaauacaucaaacaaagaagucuaguaauucaauagaaaauauuuauuccuucaugguuugcuuuuuugcauuuguuccuucuggcauuuauuuacugucaagugaucuccuguuuaugcuuuuauaacuuaaccaaaacagucugugaagcucugccuggcuucuagcucuaagugcuccuuucccuaagcacuagugcccccugucugcucauagaagcaucucauuauggguccugaguucuucccucccaaccuaguggcugcagauaaaacagaaggauagcuccuuacucaaagcuguugcuuccaguucucaguugauaugcagaaauuauuuuuaugccuuuuuaccuccugaguuuuguaaacuaugauuucaguuccuugaacuagccacauauuauauagagaggucucuuaaagcauuaugaauuuguaaaacucuccugcuuugaguguucagguuuuguuucuuugcuuguuuggggguaaauauaaagaguuuuaaucaucauuacagccuaaucuuaagagcuuuuacaguaccccaagaagaucacaaaugaaacauuuuaaaauaaugaaagaauuauccaaaaacuuauguaugguuaguuaaaauggaugaccucaaaauuuauugcuguucuuggcucaaaauugugggacauacccugcuuaagggaagcauugaagacucgguugugcuacauccuaaaaggauagugggaacacgagugucccuucagaagucucugaugucccaugugugggaugacacacacacacacacacacacacacacacacacacacacacaccuaccuaccuucauuccaaguuaagaaaguaauaacauauaauguagaucuucauuuaacauacugacuucagaaaaaaagaaccuagcucagagucccacugccauaggaaggccugaaacuagaacuguggugagugcgucccacaguggccuuacaucacuggguaugaauuaaacagcugcuguuugccucuggaaagacaaagcuugggaaauaaauuagcaaaguugaaauuaguauuaacuugaagaggagagagagguaacuguuggaaagauagacugugacauuaccuuuacuuugacuugguuucaucacauugaauuugaagcccagaacuguaaaauauuuaaccuauugcuuguggaauucucuuuuuggggagaagagugaacaugggucagucuuuaucagcauaaaugguuaaucuuacuaguuagaauuuuugguuaaaagguugggcaguggccuauaccugcuuaauaugggcaaaaacccucaagguucaugcccaacacugcaaaacaaacaaaaagaauauugauuauauccuauaacagagauacaaucacaaguuaaagucaaaaugggucaguuagucagggugcugaggggagcagggcugaggguacuacacagugacuccuuuaucaguaaguauccuccccuuaucccuccugccacccuacaguauaucacguuccccuuggggucaaacaaaggcuccuucucucuacuacauucugccuacaaagaagagggaaaacauaagcuguuuuccucuucucgaguccacaaccaagacauuguauguccuacuucuuauaaacuagauaguuguaggccaugugcaguugucagagaaauuguaauacauuuuuuuuuuaugggagguaccaagaaugggaaaaagguugugugcucuagaccuucaucugcaaggaaagagcaaaugcuggaggacagcuggcugccugcuucgucacccuaugaggaugaguuauguaaaaauacagauguguguaaagaggagggaugcgaugcgggaagcuucacccuaugcuugcucuuacaguuucuccuuuuuaucugggccagaagauuuggucgaaucuuuacuucuacugaaguacuuccccgaaacucugaggauauucuuuuacuuugaaauuggagaugugucagcccacacuguuuuacugauacggugacaacuuacacugacaagugcaugcaccaccuuggacucagacauccacaucgcacacuuugcugcagaaagucuucaugaucuuuugcuucugaauauuuccaucaaaaacaaucuuuuaucaaaaugcuaucauuuuaauuggugguugauaguauucaaaauaaaaggcuuagaaugucuauacuuagcaagcauuucaacuucuuguguuguuuagagagccgaaacaagcugaaccaagacuuguuuaacugaggucuucuugacaaagauugcacuucuaacuugucuugaagaauaguaucucccaagaguuucguggccgccuguguugacaucgugucuuuggccggugauuaugaaguugcuaaauuccacacaucaccuuucauggucggucacuagaggccacagaugguuucgguguguuuugcucauaacuguggaccucagaagaaaugaaugcacuuggcauuuacucacaucucaccugcuggcauccucuucccccgaagccuucagaaaagaugacuugaguccuuaagaugagaucacuuacaucagcuugguaggcaggaugcuguuacgggugauaacguuccgacuuuucugggaaggacugaagagaugcccacuucccauagagcccuaguuauuugaaggcgcccaugccagccuuacuuuucaggcaaggcuaaucuuagccacguucacuuugccacagcauucucuuaaugaacuccuaacacgguauaagauaagccucucucuauagaaugguggcuggcuucgugaguuccuuuucuuuggcaugugugggugucuuucacucuuuuguggcuuguguccucagccaucacuaauguuuuguuuucucuuuugcaggugacacgcuuggugcugccuggcaugguagaaaggugagucacacgcucacacacaaacaccgugcuugcagagcucauuauuauuuauagggagaauccuuucuuugagaauuucauuaaagugacuaaugagccuaacucucugucuuagcaccaggcgagucacacaguggagcaugagucauugguggcggaggccuuuuccacuagacuuuuuuauuucccucucuaggguuguggugguuccuuuagaucaggauuaaaaagccagccugagucaccaucacuaacucaauugccugcuauucugaggggguggauagaguuccugggauauuccuaggaaugccuccuuaaagcuauagcuacuuagagccuaauucgguagaauguccugaaacuauauaccuuccucugguguucucauucuugcugggggaauggauacaugagaggcuaaucaugaugugaagugaccaacugucaaacuaacucuaggaggaaagggccaguuggaauugggugcaguagaauaccccaaaugucuucauuuuauugagaaauuugugguugcguuucuacaugugagacagcacugaguguaaaauauaacuaaacuucucagucuccuucucagaagaaucuagauauugcuuaggccuucaaagaaaaccugccaaagagaguuggguuugaauguuggaccaauuuguuacuuuaauuucaagcuccaucaaagcuuugauagaggaggaaucaaauauccacuucuguuaacagaccgggaggaaugcaguuuaugcuacugacuccaccuauauguucugcuucauucuagcauguggcugugagggaauggggcucagaaguccauuuuuuugaucauguacaauaauugggaaacuuuuucagcaaaauuaguuguaguuguauuuuacauguauugauuuguauauucuaguugccuuauuuuaguaaaguuucccuuuaaagccuucaaguggaguauugacuggggcaggguaugcgccgaugauaggacaugaaauuggcagugggcaagccaguggucaugccagaacucuagaaccaggacagaguagaguccaauaaggaugauauuugggucacugucuuaaucugaguuuugacaucugcaaaugguguuauaaagaaaucuuuggacuugggguagguguucaguauuacaucauuugccuagcaagccauguauuccaucuucaccaauuaaacaaaacaaggccaucaaaauuguaagccauagaaguauuaugaaagaauuuuuuuuuaaguuuguuggugaaaacuauguaaaaggaaaugauggcgaugaacucauuuccaggagcaaaaaguauuggauucauagaaugcuuggcccagugcacuggguuaguugaaaguagccccauccccccaccccaccccaccccaccccaccccaccccaccccuuuagcuuagugagaugagaugcugugaagugcauggugcagagguagagcuagagaccuauggccaucgcuagacccagcagcagcacccggucagagcugacacuggguaugaaggaauagugugaaggggaauucaugcuuauccagcagaacccagcuuggagaauccacaugaguucaguccuugugguucaagaaauuaaguuggguugagaaaugaccugguagaaagccaucagaagcuguggaaagcuagagucauagaaaaauggggguugggcggaggcuuacuaaggacuaguuagacauguauguagaguuuauuaaucaguacuuuguauuagaacgggcaucuauguccaauggagcuuuaggaguuauuagguauauucgucaaggugugcuaacuacacuaauagauuaaucccuaccuacauggcuuaucagguuaaagauuuauuuuccccuuuuuucuccaccuuguccuugaggaaucucaggcucccuccaucuaugggcucuggcauaaaucuuuaaggucuuaucuuaagaaagaguuuuucacccagcuaacagguaaaggaagagaaucagaauaauguuaggggaggcuucaugggucagcucuggaaggaguguauaucacauucugcuguccagaacuccaccuguaauaagcugcaacuuacugcaaaggagagcagcaguguuaguuguuugccagaaggaaggaaaagcuccaggugaacagauguccagaaguggucucccuuacaccuguaaguggcuucacucuagccacucucgacaccuccccacggugaccuauuucugugguuguuuccauaggauugguauucucauugaguaacagcaguguccuuuagaaagagccuuuguuacugguuucuucucccuccucccuuucagugguucugucauugauguaugagauuuuuccaaacauucuagaacuauagccaacugacuaucacuaaacaaauaccaauaaucagacuaagguauuaucaccguacauauagaaaaugcauaauuacauuaucgggaaacuugcucucuacuucucuggaauuauaaacauuguguacagcuggagccaggaggugguugccauaacaaccauggaaaggcuaaaaauagccucuuucauauuguacugcuuaagguggaauuaugacauguuauggcguuguagggcagguaauucuuucuugugcuaaauguuugcaaacuuuauucaacaaagcaauauuuguauagugugagaauuugauugcugguucuaauuguaugccugacccuguauuccaugauuccuucucugacauugaacacuguuuugauaguuucucuguguucuuaggagucaauuagagaacugucuacaccaauuuccguuuuccaucuaagccuagaaaacucucuaaugacccugcaagagugcacuucagucgucucuccuguguagugggaauguaaagagcugggauggagucuguaugucacagcccugucugguuagcacucugcacugacugacuucuggcuccucucucuucucuccucugcugcaugcaggguggggcgaugcuaagguuuccugagucaggccagaaucagugacuucuuucaaaagacacuauuauucccccaaggcaacaguauuuuuauagaggugaggacagggaugcuacaagagcccugcagaauagugaggcauuugcagagcaaaaacuuggcaauuuuaaaaaauccaagugacaauuaaagggagucucauggggaguuguccaaaucuaagggaguccuagagagcauagcuguaaggaaucuguaaaugaaagcugcuggcuuucacagggcugaaccagccuauggauuggcuucugggaggacaaauaaaggaugugacuggaggugaagaggcguguccugaaguggagcucaucauucugcuuuguuucugcagcauuuuaguucugguagauccucaguaaucugucccuccaagucaccaucccgugauggcuagcaaguaagcagugagaucagcuacaaauacagaaaauguugcuuuguuuguugaucugauguugucgcaacaaacuaggaaaugugcugaauucugagcaacaugggucuucaauaacagaacuucagcagaaauucuuaauaugcucccauuguucucaagccuccagaaaaugagagguuaaccagcuuggcuuauguuugucucugugugcaauuaagcauagccuauuuugcccuucugcuugauauaacagaguugucaugagccuggcugugccauggaaacuguuugacgucacuaauucugcuuagauggaggauuacagcuagacaaaguaguugauuguaaagaugaauccuuuguggccccagguccaaauguucacccuauuuccacuuaaggagauauauuauagggauuauugcagggcaugcuaguguucaauuugggauacagacaaaauagaguauuuuuuccuuagagaagauaggucugaaugcuauuacaggaggggucauggaaaggucuuugauagacacauauguguguucucaacagugggacagauugguagguggggcguuuuaucuguugccaguuagauacgguuaaaaguguucucauuuuacauagcacuuugacagucuuaaauuuuauguuuugguguauuuugaaauauaaguacuuuguuuuuuauaaaguacuuaaaauuguugacuuagcucuaucuacuaguaauuucuucugucuucuucuuuuggauucuuauuuauuuuuaauuuacauguaaggauaugcuuccuguauguaagccuguacaccccauguacccugaaaaggcaucgauucuuuaggacuggaguuacagauagcugugagcugccauguggucucugucagaacaaccaguaugcaauuucucuggcuucuagaaauuuucagucaagaguagaauauuugagaaauaaagaucuuuguuaccucagaaguaaauaaauaaaagaacgacugcaucauugugacauauuggauuguugacauuauucuguaaaaugagaaaagagcuuuuauuaucucuaagugacuuuuccucuguugaagucauagcacuaaacuuuagccuuuaccuucaauuuuauauuucauuugugaauagcagaaagaaaacugugacuuuuguucaagggcauaugcagccacuccacuuaguaggauuguaguggaacagagucuggcucuaagcagugguggcaggcugcagcuucagacacagcaucgccugcaucuaccuuagacaggcucucucuguucuuacacuugacaguagagcagcuccuggcuaaugguuaauguggagugauugugagguuggaauugcuccuuaggaagcuugcuuugccagaguagccacaacccugugcauccaccucauuggguguucuaaugggcuguuaggugcccuaaaggcuguguguuguaauaaaaacagaguuucuuguauuuugcagacuuguuagcuuauuuuacaugcuguaaacuacacaccugucuaaauugugcaguucagucauuuucaacauauguagagcuagacagcugucaguacaguuuaauuggggaauauuuuuggcauucuaaaaugauaauuuuuuugaugugguuuuuauucaguuuuuacuaaaggaacacuccuugauuucaauaaaagauuguucuguuucacuuucaucaaagaaauuuuuauagguguagaagaugaaaugacgagguguuuauugcuaauuuaccuuuuuuuuuuuaaucuaaaagggcuggguucuaacucuugauaaaaauuauuaauuuuuugccuuaggaaaaaagauaccaauauaaagaugauguagcuaauguuagccacuucuaacuuuaaauuuucuuuaauuuugaaauuuuauuuugaucaucaagauguugguguguuucacuacuuuggaaaguguguauucuguuuuauaaacaacugauuagacuccugugauagccaugaagcagagggcccagacuucccuuugguuacaguaggcaucucucagaaaggcuggcagauggaaagauggccauagagugcugugucuuuucagauuuauuucuaaaauaacucauaugccauuuagucauguuuccuggucuguguucuuucuccuucccuaaauagugaaaaacaaacaacaaaacaggacuuaggaaccaaaauccagaaggagaaugacaacagacugugcagaaggagacgagguugaggagugacccaggggugccugggccagauuuuaguauuugggaaggagggcugugcugggguguaggucaguaguagagcacuugccugguguaagacccugcacuccauucccagugcuguuaaaacagaaaaagugauagugugucuugagaagcaugaacucgagagaacaaggagguaccuaguuuucuaaagucauaauuccacacccugcugaaccucuguaugcuugcuaaaacuuagguguuuacugcauugcuuuucacaaacugauuuuuauuuauuucugguacuucccugaguucaguaaucucuaaaagucacaggaaaaaguugaacuuuguuuuuuggcagucuaauaguuaaugaaguacagacugguguaauuuucaagucauuucuuuccccaaauccacacaacccagggaaguuauaaggaugguaccccauugcuaugaagguuuaugaaagacuugacugcaugugaacaaaggugggcucuggugucuagaggcucaggacuguguuaagagggaaguguuuacacacacuguuggaguggacagcgggaugaugagucagagcagacgugucuaugugggggggggggguucuucagcuuuugcucugcagacauugacugcagugccuugcacauaugaggcaagcauuauaugaggcaagcauucuaccucugaaauauauccccaccaucuacauagggauuucugauguuguggccacagaggaaccuagaaaguacagagacaacuaaaggagacuagcuagcugauccagucaugcauuggauuacuaagacuggaaaaugagcucaucguaaagaagagcuauuuuuaguucauugaauuacgcuucauucaccggccagacauaccaacugcucaugagaagcagggagaugcguguuagaucagcugcccuguugcucuguuuccaucuugacugcauuucacaagcaaugugcauauaauuucccucaguuugugugauguguuuucaauuccagaucuaaaggggugauucucaacaucuccucagccaguggcaugcucccaguuccauuguugacaaucuacucugcaaccaaggugacuaacgaacacugcaguaaauuaugucaacauaagacggggagcugauuuucagucuggguguuaacuuuguugaaaugcuauacuugguaguuuguauccaacugagggggcagguaggugacccacauggguuucuggagugucacagauggaaauagauuuacaaguggagugccagugugucacagccacggauggucugauuuuuggucccugguaguuuauugauuuuaacagggacacuaaugcuuuccauagaaaccuagccucagccaguccacccaguugguuagaaucugauacuaaugagccuaaggugggacugucgguaacauaaacauggccuucacauagccaggagguacauccuggcaguaccacagccaugcucagcagacaagaaagagaucuauggagagugaaugucugccaccuuaucuagaauucccgaacacugucaugucuagagugugacaggaauuucccagaacucuaugucaucauacaacaccguuacucacaucuucacauuacugcuaggauaguaauucagacugaaucuucuccugucugugggccagucacuccaaguucaguuacuucacugaggcguggaaauauuucugaggaaugaccauuuuaguuauugaaauuaagcaagccuuuauggaaaaauaaguaaaucguaaugcauaauaggaucauauaguaugucugagaaggaaaagugcaaaauacaacuuuucacugagaaaacucaguacuuacugucuuccaaguccugcacagccccacagcccucugaucuaccugcuuucuuaguggcugaaacacacugucagcauguuuaaucaacaucuugugcuagaauuccaguaucuggaaaucuccauggcgguccugccaguggagaccuuccauuggggugucauugaacuuggccuuuuaagccugauacaaggcugcaugguuuccaggcaguuuacaguuucguuaucagauggacucucacccucacuucucagacccagcucacaggacccagcagcaaaacagagcugcacagaauucacucugggucucucuuggaguggcaaauagaaagugaaauuaaauccuuuguuacauaauaaaagaauuuuuuuuucuuuccuuuggaaaauaauuuggaggaggcuuuucucauuaagucaaaaauuggcaaauguuauuuuugguaagauaaugucauuuguagcagaaaaaccuccugagguuuuaaaguguuuuuuaucucuucugcauuugaaaugaaaggaaugacuagaaacaguaguguuaaaugguuaauuuauuauuuuguuguuuccauggcuacacucuaggcagacugauguaauagauguauuuucuuucucacccccaccucccucccaggccuuuguagauuucuucucucagugccuccaugaggaguauaagagcaagggcaucuuugugcagguaaguggaguuuguuucaguuaaguaucccugguuuugugugguuuccacagcaacagucgcugucuuggcaacgaaagaaaaucgcauuccucaguaagcgauugugacgugagcacucccuuagagacaugguuucuuuccccuccugcucuuaggucuagauuuuuaaaaauuagccucucuaauuuuuaacuagguuaccugaacuagaacuaaauguaaacaguugaagcaucauuauuguaaauguucauaguuuauuuuaagacagucugacucuuuaaaauugugguagaaaaauacauaacagaacuuagauugucgauuaucugcaugcagcucaggggcaugaguguacucaccguugcacagucacugcuaccauucuucugggaguuuccuucaccuccccaaacugaaacugagcaccauuaaaugcuaacuuucccuucucuuuccccagccccuggcagugaccauucuguuuucugucuccccacaguugccuguucuuaguccauccugugaauagaaucauucaauguuuggucugugaucagaucacuuaguauaguaucuuaggcucuuuuggcacaauguggggauuaggguucagacaguuaacccauuuucccaggcugauccgagacucaaaucuagguccguuugcuauuagaacacuugcuccuaucccuaggcuacugaacucacugugcucaggaaauaaugaagccaaaaguaccaggcuguucgugaccacucuagucuauacauggagauaaucaagauggggcuaaggguuaucuagcuguauuuucuaagucuuuucauuuuuaauaguauuggagcuaagucacuuaccacaaggaaggguaagguaaguguucccucaucuuuaggguccacgaaaagccugcuucuuccaagcccuuuccuuugcuuacuuccuaggaguaucuacugaccacuuacuugaaauuguuuaauuuucagcucccuguauauauaggcuacauguggggagacaggguuuuguagaaucuuguauuuuaugccuaugauaccaggaaucccccuuagauuggauuuugguaacaaggaagccagguaacacugguaggagguaaggcuccugugccacucaguguuacacuguugucuuucugguaaaucuguuauuaugccccagugugguucagcgggcacucuaaaguccacuggaagguacccgggaggcuuuggcuggaaacugccuguguuucagugccaugaaguagcuagcguugcugugugaacacagacagcaguccugguaguauccaagccugucccuucucucauuugcacagccuguuuuccucaaagguaguuuucuuggauucucugccugauauuaaccugauaugacuagaaaccaccccaaagcacauuaguauuugccuucugaaauauguuauuuugaugagcuuguaccguuuacaucaguaaauuuuaaauuauuuaauuucauccaucauugucuucauuacuaagauucacuugaggucuaaacuuagaaugaauuacuaagaaaaggaaaauucauauuuaugaagaaaaacguggcugucccacugugaaaauaaauccccggauacugaguagagcagagagcccauguuaagcugaaacguagcugcuuuucucugggugguguuucugucuucuagguuacggacugggggauugagugccuugcugcaccuucuauuccaucccauguuucuugggucaucucguuaacacacagaucaagugaccucguuaacacagagaucgguacugcuggcgucucucacuggcuauaccugaagcuuaguauugaauucagaccccacaaggcaucagugcucuugcuacuuauuuauguugaggcuagagcaaacuguggaauguccucuguguucucugcccugugaagugcccaugacucauuuuaacgccucuuuccucgaagcuaguuuccuuagauucucugccugauaggaaucuaauauggcuagaaaccaccccacaucaccucuucaggacugucucacacugccgccaagcuccuucugucccugagcucuggacaaaaggcucagguuccagugcaucuucccugagucccuaucucaggccuuagacacuuggauuuuccuucuucccggagccucacaugccucugucugcugcugggccugcucaccaagugguuuuuuuguuuguuucuuuucuugagaaaguguauuauaguauagaccaggcuggccuugaacuuacaaagcaccugccucugccuccugccugcuggguaaaagccauacaccagcacucccagguugcaauguguuccugagcaaagcuguuugcuaccucgguguugcuaauguucucccccugcccccuaucuuucaacaacugaagaccgauggggaggagcaaaaggaacuugugcauacauccuucaaagaacaaaacucacgugaaaucuaagugaggagauaggcgcuggucugcccugugcucacuaguaaaugcugagugagugaggaauagccagggccaccucagcucccacaguccucuugguuuccuuccuaagucauuuuuauuaagagauaauuuuaaagcuauuuacaaaaaaaaaaaaaaaguggagcugggcagugguaguacacgcuuaaauaauuaacuccagcacuuggaaggcagaggcggguugaucucagaguucaaggccagccuggucuacaaagcaaguuucaggacagccagggcuauacagagaaaccuugugucaagaagcuaaaaagaaaacaaaacaaagccaguuguaggcauagacaguaccaagaagagcagccuggucuguuugcccagcuuuccccuuuguuacugucugacuccaccuagagccauuagagaggccuuagacaggaagucgggugugcucuuucgcuucgccucagcuucuuagugcacaucugacaaguuaaguucuuagauaacuacagcaacacuaaaugugagguugaaugcugguguaacguuauugauuagaugaucuguguucacuguuuuaccucuucucuuguuuauucuuuuucauuuugguugguugguuggggggggguuguuuuuguuuuuguuuuguuuguuuguuuuuugacacaagggcucacuauguagcccaggcuagccuugaacucaguccuccugccuuugccucuggaaugcuggaauuuccagcaugcaucaccacacccuguaacacucuuuucaguuuccuuuuguuuucuggugcuggggguugacuguagcaccccuaggcaaguacuagaccagugcucugccacugaccuauguucccagccaucuuuacaguaauguuugauucuccagaaaagcauuuggucuagaauccgguauuccauucuccuguuucuuguguuucuuucucucuggacucuuuuaugccacugauguuuuggaagagcacagcacuccuccccacucuucugucuugagcauaccucauuuaggcuuaucugacacagcuuguaguuaucggguuaugcuuuuaugccuacagcaggaaggauauacugcugaauccuucucagguugucacaugggaagacaggagucucugucuguugcacuaguugccaucaguggggagaccccuuaaaacaugcaaauaucuuacuuccuuagacaguuugccuuaaguuguuaaauuuauauguuaacccuauauaauauauauaauuuauguguuaacccuauaugcuugcuucacaaacuugccauaugaagagauagccuaucuggauuuuaguccaggugaaagcauggagacgucaauaaguccuccccugguccagucuaguuuugugcagaccucauugccugugugcuuagagauagugaggaacagacacuaagcucagcgucaccagaccaagauuaugaguucugcucucaccccucaguggucaucugaccuguacaagauuucucuguggcuuugcuccuuaauuuuugacuccuaaaggcaaacgaggugacuaaugugacauauauaaaggcaucagaaacugggaagugauaguauguauagagaagagagaugaaaaacagaagcagugugcauuuauggaaccccuacagugugccccaugcucacucacuguuaccaagaagcagugugcauuuauggaaccccuacagugagccccaugcucacucacuguuaccaaguuugagcuugaugcuaaccugaccccaugucccagacuggaaaauaaaaauuaagguguaucuccauuugucaggaguggggcaacaaaagacucaagaucccugacucaaggcacacagauauuuaaacacacuaccaaucaguggacccuaaaugagaggccuguguauuauguuucacauaucuccagucaggaaguauguagaguguaguauuggguaugguaguugggaauaugguagcaagaaaaacaggcagugaacaagaaaacaugaguacaaugacccccuauagcgauagugcuguacaucucagcagguggagaaaguauagggaaauuuacugauccaggcuuauauaacuccaaggcaaaaggucugcagucuguugaucacagagcacuaaaucaagucuauucugaagauguguccagucuggcugcaucucacgacacuacugccauugcaucuuacuuuggaccaucucucuauuuggccuccugggcuagauaagcagcuuuccaugugacuccucuagagucacuuggaaagaaggagccucaguugagaaaacacccccaccagauuggccuguagggcauuuucuugauugauggggucagggaggagggccgagcaaaugaugagaagcaagccaauaggcaguguucuuccauggcuuaugcgucaguuccugacuucaggcuccugcacuguugggcuucuuauccugacuuccccagauaaugaaccgacuauaacuguaagcugaaauaaacccuuuacuccccaaguuacuuauggccaugguguuuaacacagcaauagauucacuaacuagaacaccccacuacugcuaucuuugcugauaagauagugucuguucaccguagccagaguugguaaagcaaacuccagucauuucacuucccugcuuaaaauuccaccaaagcuucucaugucuucagaguaaaacucuugaguuguaugacccauggugcuuugauuuccacacucagcuguuccucaguuuacaagggucugcaaucagauaucucugggcuagcuuccaucccuugugugagagcauugcuuauauaugaccuuaucuaagccuaauugcagaaauagucuaucaucaauacucugcccacaucccucuguaaaaucagggucuguuuuuuacaugguuguaucacagguaccuaaacaucuucuaggauacauucagauaaauuacuagauugggggggggggucaguucccccccccguaaauauuaacauacacauuucauauguuaaaggcaaguucuuuguaggauuaguagucacucaaagaauucuuguaaccccugaguuaaucaggaggcuuuuauggaaagacugauagucugcaaguagagaacggcaagcagccaagcuauacuguacguguuuaguuagccaugugcuugggaggacuucagauccuaaaugaagauaaaugaagacacagacuuaagugaaguuucccaaaacucauagagccacagccuuugccuuaagaauguguccaggcuggagagagagcccagucagugugaagagaagcugugcauuaugccuccaacuccagcucuggagaaggagggaaaaccaagcagguucccgaagccuguuggccagcuucaggcucaacaagucccaaaaauagaaaaaaaguuuaauguccuaaaauaauaaagguggagaguaaucaaagaaagacuccugaaaacagagccaucuaacuaguacaugcauaacacacacacacacacacacacacacacacacacacacaccccuuggaaaagaaagaagacaaagcaaacagcugugugcugacuauugucagccuaaugcugaaacugcccuggaguuggcuuucccuugcucuuuacuuggcuggaccagaaggaagauggggaagcggggagggaccaagugaaucuagagaagggcacauuaacaagauuaggugccacagguagaaccuugcucaaaauggaaaggucugaucguuuuuagguuugagaaggauauuuaguuccuagcuggcucugccaugcgaaguuuugagacucgguguuugguucuuucgugucugccaugugucuugucuuccagcauccaguuguccaguuguagugccuugucuugccuugucuugccuuuccccuuuccccuuuccccuuucccuuuuccccuuuccccuuuccccuuuccccuuuccccuuuucuucccuuuccuuuccugaaucgggacucccuccgcagcacaugcucuaugaagaccauagucuaaguagucuauucuaguggauacgaggauaacaacauaccaacugugaucuguuuuauuuaauaaguugagcacacacauagcaucaucaccuuuugcccuauggccuaacuaauuauuuccaguugaagauucuaaauuuggaaaucaagauacuugcccacagcuguggcugucagggucagguuguuucugagggggcaaaacuuauaauggugacuuguuggguguaaguggccuuuaaguuuuauugcuuugaaaacuuucuguaaaaguauagauguauuucugauuuguuucucauaauccuuuccugcaaaggcggaagauggauuaauuauuguuucuugggcauuuauuuacuuugauggcuuuugacauaaaagauuaacuuacauuucacauauuccuuuuaauacccuucacagcuagaucaguagauuugcuuucuugaggcagaugaucuuccuuaagcuucagaauguuuagauugcuggcucagugggaagguccuuagugcugcuuggugcucugcaucugaauugccaggccacacugccuucaguccacacugccuucacuccccugccucaguccacacugccuucacuccccugccucaguccacacugccuucacuccccugccucaguccacacugccuucacuccccugccucaguccacacugccuucacuccccuacuaccucaguccacacugccuucacuccccugccucaguccacacugccuucacuccccuacuaccucaguccacacugccuucacuccccuacuaccucaguccacacugccuucacuccccugccucaguccacacugccuucacuccccuaccucaguccacacugccuucacuccccugcguaccucgugcuauucucagcacugagaauggaggugacaugacugucuucuugagcuuguguucaagaacaugccuagugcuugaacuaacuuucuuuuggacuauaccaaauuccuugcagucccugaaaaugccuugcuccucacagcuccucucuacccguguuguuccuuuacguuguuguaccuagcugacuccucaacugucuuuaggacuuacccacaaagcccugccucacucgccucugaagccaucguacuucaaauaggccacuguuggacaccuugauuuuauauccaggguacagguacauagccuuccagcuuagaauuuccauguuuuaguugggaaaauauaacuugacuaggaacucccaaggacgcaugucuuucuccacccccaguagcuggaggcuccuucagaaccccaccacaagccagcugaacccuaaagccaugaguuaucuuguggugccaccaugugguucagucaggcagugcaacugaaugcugcaguaucaaaauagucccuuguaugcugcuuaugcuuucugaacgagcagaacaauggaugaaagaacagugcaaugcauucuucacaagugaaaggcauaguuacagacuggcuccaucucgggagcucagggcuucccagaacuccuuguagacuguguccucuggaaaggccuucuugggcuuccauauaaccaggaagcauacagcaaaaaagaugaggaaagcugugcacgugcaugguguuaccugaugucagaguuuacacaggucuguccugcccugcucuuuagguagugaacaaacaacguaacaauuggaccccacaguucaguuugucaaccugagacuuccccagucugccuaaauacugaugagacaaaguggacuaaagacuugacaagacaucuuucucauuaaagagugauguauacuaauaguucuaauaaauaaauccucagaagucagaagucagagucacuccaacugcuggugugcucuagugacugcugacucaguggacuugccuccuauagguggggaagguggaggacggccccagguagacugaauagauggguugcaggcucagcucccacaguaagggugguaagcuguauucuuugacuuacacuugguagugagaagaauacaaaauuaugugugaaaaaauacacguguaaacaaauccccaaagagauguggggcuguuccuuccagucuuugcaguaaagaaauccaaaguguggagagaccucagcauuauuuguagugugaguuuuuggugguguuuguuuguuuguuuguuuguuuguuuguuuguuuguuucauuuuagccacauauugaacuguuacuuuuucuuaaauagcaaugccagcggacuucaccccuucuuuucacccuugugagaggaacaacgguuuggugggcuacuguacaccuggaucuuuuguuucacaggaggaccucucucaucaugacucccagaacuuauuauaacgaggguucuuuguguuccauguugugucauggccaaaauacagggggcauaugcaguagagaacaucacauuugugaaaugccuggaaaagcucauguuucgauucaccaccacaucuguccugucaggugacuucucgucacccaggcuguugucuuauuuucuuuucaucucuuccccaaacagaagagggcaaaaaagauauggucccaucuuaacauuagcaguuuauaaaacuucaggagcaggacguuaaaacaccggggaagagaaguggugaccaaaggccaggaaaguggauuuucaucugugaaggacuaaagcucauagaacaaguguaauuccucaggcgugguggcgcagaguugucccagugagacauuagaaaccucacgcugcuugacugcacagcagagucccucuugaccuggauaggaaggacauccugagccucagccccucagguuucugccauuccuuuccuuuuaaagauucagaaaugcuggcuuguguuuuguuucauuuuaucccggccuccaauucuauuuuacccauaggucaucacuguauugcaguucauguuuuugguauuauauguucugugaaguuggcuuuagauagcaugucucucccacugcucuaaagaugugaacuccagauaucaugaggaugcuucugcuaucaucagcagucaggcagguaucacacucaguuuuguagccuuccuaaucaauggcauguguugucuuuucucuuuuuguaugugguggauucuagagugucaugccauaccuuguagcuacaaaacuggcaaaaauacagaagccgacuuuggauaagcccucugcagagacauuugugaagucugcaauuaaaacaguagguuugcagacccgaaccacuggauaugugauccacucucucaugguauguacauuuccaaaucuuaaacauauuuuccaguuugggcuuuucuuucuauaugauuucuuagcaucaagacauauacuuugacaaagugguacacaucuuuaauccuaaaaaagauauuuauauuucaaacuauauaccuaagaauuuuuaaaucucuguaaauaauaauguagagaauuagaagguggcagauaggcuuuucuuaaguuuuacucaguugugagcugugcuuauauaucucccccauuucuuucccuagggcucaauaaacucaaucaugccucguuggauguauuuuaaaauaaucauggguuucagcaagucuuugcggaaucgcuaccugaagaaaaggaagaagaacuaagugcugcugaguuauugggccccuuggccagguguuugaccugugccuauacacugggcaccugccuguccccagagucuucacuguugucucaguaauuacuaacauggcauaguuggcagaaaacaaauuccuuuuagaggcuccuaacauauauucuggauacaaccaggaguaauuugaaguuuaauguaaauguucuuggcaaauguauguuccuuugacaaaaaggaacaaaucccagaaugacagcgguagacacagacccaucuggcccacagugccaaugaccacauuauauuuggucuggaagcuacuauaaagugcauuuuuuauuuuagcauuagagggaacagggcucgauuaauuuguuaugggcagauucaguguaguuuacaucgaguucugugagcuuuucuaaguguaugucccagcuucguauuuauguggcacuggucuucucaaagguggcuaagacauaaaaagagaauugaaacauggaguucuuucuaacacguaaguccacaaaauguuauucuuggaccacacaucaugucugcucuguucaaauguauguaaauacugaaugcuauauagugugcccggaauguagagguaagugggccaaaguguacaucaagaccaacaacauccugugguaccgcaggauccaggaaagcagccuguguggacacacagcauucguugugucugcacugcacccggauacuugccuaggauggcagacuccuucuggggugggugguggggucauggaaacauguucuuucuaagauggugucucauauuuagaauucauauaucugcuuuuaauaaaagaugauguaacugugguguugaaaugaaag

SEQ ID NO: 938 - RNA, 105971 nt, Mus musculus
cuccccaagauggcggaccgcaaggagucgcuuccgcuuccggugugagcagcccggccgggggggcaagauggcggcggcaauagggguccgcggccgguucgagcugcuaccucgcuccggcccggguuggcuucucagccuuuccgcuuugcugagcgugguggcucgaggggccuuggccacuacgcacugggucgucacggaggacgggaagauccaacagcagguagcggccagggugcccccucucugcccgcgcccgaucagggggaaucccggagccgggccccuggguggcuccgcgcggccccgcccccagcuuggcuucccacggucccggcccacgggccgaggcuuccugcgcuccgaccuggcgccgcccccuccccucugguccccucgccccggcuccgccguggggaacuucucagccuuccaccuuggggccgcgcgccgucccggaaccgaccccggggagcugagacuugagcucccggguuaggagucacggauucaucauuaguucugccuuuggagccgcuggaccaggacccgcgcgccaccaccucuccccgaggaaguagaaagcagguggcagugccggggagugugcgcgucccaggccggugacagccaggguggcauuagugaauggauggaucuuuuaaugcgccuccuccagccuugucucccacugaugggauuuguuucgcgauguggugguuugaggcugugccguuagccaggucauuaggggcucuuuaaagacaacccauucuugcuccuucugaaggaaugccagaagaugcaugccucugguggcggugcccgcaucauucaguucuuaagugcccucauuucccgguguauuuuacauugcuuccuaguuccuuugacccagcccggcacucagcauuugcaguuuacuagauuaccuaugcuugaacugauuucucagaggagugaccgcuuuucuuauauaacuuucugaugccugcaucugcauuugcuuucauacugcugaugcuuuaaggacugcgugugugugugugugugugugugcgugugugugugugugugugugugugugugugugugcgcgcgugcucgcgcgcgugcuucaccacagaaucuuguaaacuuaaugacuuccagcgcuugacaacaaucaggaaauguccaggagccauuuaaaaagugaaguguguaccccuugcaauuuaagcauacugacucauguuuuaaccaaaggcgagagagagaaacugauccuuuugauuaacuguagaaacacaucgcaugguuuauauuuaagaugagacauuucacaaugcagcaaaccuaaacaaaauuuuuaaaaugcccacacuuuguguuuccaguguacucuuuccucgaguguauuuauaucaaacucccgauuuaaaggauuucuuuuucauggauauuaaguucaagauccaaguuaauuuucauuagccuccaacugagaguuuaaaaaugucagaaccccuagaaaaauacaguaaggcugccuuuccaacguaagauuggaaauccugcaccaucccuguuuucaucuuuugauugcuguuggugguuugcugagguccgcgugaagggaggcauugaauucagucacuuaugcugcaauuuggggagcccuucucccauuggcuccuucgcuauauuguuucuggccacagcuauuuauacucgaugacauugacuucuccuucccauuuugguggccugccacucagccggaaaagaaauccaucugaaaagugaagguuaauuaacggaaauggaucauuuauauguugaauauuacagugggaagguaagaucggauuuguuuuuguucuuuaaaaaaaaaaaaugccuucuuuuacauauuggaucuacaucuuagaggggaauauauggguauuaguaccuugccagaucuucugaaucucugccaaguucucucuucaguaaguaauuagacuuaaagauaagaaagcacacccuuuuuuauaacagcccuucccauugacuuuuuccaguucuucauugcacguuaacaguugcagcacuggguucuggcagccaugaacuuuuacucuauaacaaauaaaguugaugccaauguguaacaacuggcgggggaaggguguuagaaguaaaguggugguguuaaucuaagaggagacagguacaaaugaauaaaauaggaauuggauaaggugggcagcauuugaguuggacuccaguaacugcauaacuccuguguccuuuccuggcaauaaauggaauuugggcaaaaucuaauaaacauuguuuagauugcagucaguggucacauuaggguacucauuaguacgucaguuuguggauaccguaguucuguuuguaaauuuggaaccauaguuaggauuggacuaauaucgaauuaguaucuuaauuucugcugcuugguucuugguucuguuacuugauuaagaaaagaaguaugguuccauuuuuaaaauacccuaacagcaaggaggaucuguggacaaacuucaguagaacauuagacugauaaaugucuuucuaaucauuugaauucuaaaacuuuuaaaaauuauaugugucaugauuuuccacagcauacugcaucauuuuccacagcaaauauggaaauacuuauaugaauuaaaagugagaauuagagacaacuguggugacacacaacuuuaaucccagcacugaggggacagaaacaggugacucucugagcuugaagccagccaacauggcuuacuuacauagcaacuuccaguccagucagcgcuacauagugagauacugucuuucagagaaaaaaaaaaaaucaaaauugcccaaagugcacauuuaaauaggggcauuuccacuauuauagugaaaguacagcauggaaucuuuaccaggacaagugcauauucguuggguuuuuguaccacaagccuuagcagacccuaaagguagucacacugguucuagacuucaggcuugugaauaugcaaacuuagaaacccucugaccuuagguggguucugcaggggcuucuuucagacugaucucuauuccugcaggcagcuucuuugcauucaaagcuggaguugcugcuggcaacagcagguguccagugcaugccuuggaaaaucagaguuucuuuccauggcuccugccucagcuaagaaacaucccuccuaccacugaauucccaagaaugcugucuagggaguccuggagccggagugggaagaaagaaaacauuuucuauguuucuuucccaccauagacagagaaagguuaagaaaaaggcugucuacaauugcgagcuuuuucucagcuuucgguucuggaauaccucuuuauaauucauuaccuccacucuccccauaccaggaaaucagaaagaccaucugucuucauuuucuuuccuguugcugugcuaagauacccugacaaagacaccuuaagagggaaagguucauuuagcuuaccauuccaaguuacaucauaggcaaguggggagaggugaggggagcaggaacuuagagccgccaguuugaagcagcuacucacauuacaguuagaaagagcacgagguagcacgcauauacccgugcucagcucacuuucuccacuuuuauacaguccaggccccaaacccagggaauagugcugcccacaguggaugggucuucccaucucaguuaacaacaucaagacaugccaugcccacuggcuaauuuaaucuagauaaucccuuauggagacuccccagugguucuagauugaguucaacugucaaaacuagugaucccaacuucuaucucacuuuauacaaggaaggguccuuagcuuggagucagucugugaacuagaugacuguguguuauuaaccaguuagcaugaggcucugcuguguaauuaggccaagaaacccuuacaucauccuugguguugaaauggggcuucaguuuaguguugcgugucuguaaucccagcacucagaauguggaggcaggaaggugaguaguuguuauacuugacuauauacauauucauauacauguacauauagcaaaguuauggccagucugggcuacaugagacucucucugucucuaaacacacacacacaacacacacacacacuucugaauagucugguaggaagcuuccucauaaucagagcuaagguguugcugguuggauuuguaaagaauaagcuucuagacaauauuuucaaauauuuuuauuuuuaauuuaaauauaaucacaucaccaucagacuacaaccaaguucacauccacuucuaaccuacugagggacaggccaugggacuuuggccuuuugucaauuccacgugguuuaucacgucuuuaggcaaggguuacugaaagucacucagcaagcaugcuuugccaagggaugcuuucgugcagccuaggcuuuccucaguugcuauguaaccgaggcuggccuugaacuucuugagcauucggucaccaccugucaaguguuaagauuauaggaaugcccaacaggaccggguaguguuuguuuguuuguuuccaaaguaccugcuaauucgcuugcugcugagguuaaguaaauuuuggaauuagccugcaacccucaguacucgcuagcauucuguuucuuuagguuuucuguuugguugguugguuuuugguuuugauuggggggggggggggguguuuguucucauuucuguuuguuuguuuguuuguuuguuuguuuguuuuggaaagguucucauguaucucaagcuaacuucagacucacuauguaggaugacuuugaacuuuauaaugccuggcuguaucaucucuuaucagaugaacucuuggaaucuugcagcuauuaguguguaggcuucuggcaccaaguacagugccucuggauccucucuucagaaauggagggcucagcuuucaguaagaaucacuguuguuacccacagucucauaacauuguaacauuuauuuucuuagccacuguuuccuucuccucuaaaguuagaaccaucaaguuuuaaauuuaggggaaaagaguauuuucuguagggaagggauucuuaaagcauauuguuacaacuuaguagccucuagucuacagcuaaugaguagcacuuaguaauggcaauaauuauaagcauauuaaucuacaguggcaugcauuuggugugguacauuuugaagugcauguuuuucuucucauuacacuaguaaguggaggaauagaaggaaacagaagagcaaauguggaaauaaugaaggcucagccaauccauuuucuuccaauuuagauuuuuuuuucuuccaauuaaguauuucauaguaaauuuagaucaggugacagugggaggugaggggacucaaauaagccugaguuuauuuggugguugugugaucguuugccuauagccaggcagaugucuggggaacacagaugcuucccaucacagugagguuccugguggugcugaugcaugaaagcaucgcuuggcaaagcaugcuugcugagugacuuucagcgacucuugcccaaagaagagauaccacauggaacugacaaggaggccaaagucccauugcacugcucuuuauuagguuagaaguggaagugcuacuugguuuuggucugaugguggguaauuuggcagaucugagaagguuugcacaugcacaaugacuaagcucaguuccuguacuuuuaagaaacaucaccuggugaugucagguuucacuagagucacagaacuuauaauggaaugucucuauauauuaagggaauuuguugugaugauuuacagacuguaguacaacuaccccaacaauggucaucugugacugggaaguccaagaaucuaguaguugcucagucccacgaggcuaguuguuucagcuggucuucuguagaguagguucccacagacgugcuggcaaguaaaugcaagcaggugaagaagagugagucuuccuucuuccaauguccuuaugugggccuccagcagaagguguggcccagauaaaaggcuuguaccaccaccccagggucuggaacuuguuuugucccaggcugaccuugaacucagagaucuccuugccuuagucuccugggauuaaaggccuguacuaccuugucagggccuaagcuuuucauagccacuaugccucaaaaucuccaugucaagauccaggucagaaacuugugucuuucagccucaagaucuggcucauaagugagcccucuaauucuggguuguaguucauuccagauauacucaaguuaacuaccaugaauaaccauuacaccugauuauggugugcacaggauaugacccaaauucuuccauaacuucuaaccuaacccuuccuucucucuagcuuuuaucuggucuuccuugauaccuaauccuuaguccagcaucucacacacacagagacauagacacagacacaguccagcaucucacacacagagacauagacacaguccagcaucacacacacacagagacauagacacacacaguccagcaucacacacacacagagacauagacacacacaguccagcaucacacacacacagagacauagacacacacacaguccagcaucucacacacacagagacauagacacagacacaguccagcaucacacacacagagacacagacacaguccagcaucucacacacacagagacacagacacaguccagcaucacacacacacagagacauagacacacacaguccagcaucacacacacacagagacauagacacagacauaguccagcaucucacacacagagacauagacacaguccagcaucucacacacauagacacacacacaguccagcaucacacacacacagagacauagacacacacacaguccagcaucucacacacacagagacauagacacaguccagcaucucacacacagagagacauagacacacacaguccagcaucacacacacacauacacacacucaugcacuagugcucacauugcucucuuuguuguaagcaucccuagguaugcuguguucucucuugcuucuauccuuugcacacguuccucucagguacccucaucugacuaacucagacuugacaacuuuuaugucauuuccuauguuuauguauuuaaagcagaugaauuucuuucugaaagcauuugcugacucauguugugaccauuuauaccuuagugcacucuagaccacugcauagcuccaaagagagcucuacaacuucagcaucucucacacuguccaaacacacaggcaacagcauaucauuaacugucgauuggcugaugcaagcagaugugauaaguggguuuggcgucuuagacauuuacuguaugaagccaguguucucuaauuugauugucaucuggagaugaccuguaggaagcuucagacuuguggggaaaaaaaucgaagguucaagugacucguccaucaaucaccccuuugacucucagaaggggcuuaggacaguugcaaagggcuguaaucucagggaccacucuggccugugugugcucaucagguuaugcucugcaagggacagcauccucucugucacugguguuauacacagaggaucaguuuuacugcccagacaugugaauauguagagaagugaugagaaaaauaaugaacaagaaaggugaaaaaggaagaacgacuaagccaggcaguauagacagggcugauggccccacugcugagcagggguuacaaucagcugugggcccagcagcuguugcaguuuggaggcagccuugcuggaagugaacagaaggcgagcuggcagugagaaggaugagggcuugccagcaggccaaggcaaaaauuagcgcagcuuugcacucccaaauguggagagcagugccuaugucucaguuacacaacccugauggcagaaguuaaaacugaagcuccugugugugguucuauagccagggacucaagucaagugugugcugacuuccauuccuccugcucucuaaaagccaguccagucggcccuucaccccuacagcacucgucaggacacccagggcuucccucauugccaaacucaguccucagugaucucagcucagccucuuagcaaccuaguggcaaccucgcacuuuacugaacuauuuacuuugauggcugccaagacacagaugcuguuuuucuucugagccccuagccaugacuuuucccuuuuucucugcuggacacuucuuuuucuugcugacuuccuggcugcugugcugucuccacccacacaggauaaucucaugcagccuccugccauaaacuugaccuguuggccuuccacgccucaucugcgcuccaugacuccugggcccuccacucagaauggcuucacaugggcagcagcuucugcacccaucugcaccccagacuucuuccacucaccaaauacuggugugugucuucacucuuuuauucucuauuucauacccagccuaaagauaaucuaucuccuuuacuuccagagugcuucccaguugagcugugucuuucccgacuaacugccucagccccgcucugaugccagcucuuaacuggucuucuugcuucacuugugccccagauaauguguucucccagaaacacugaaaauguuuuguuuuguuuugucuuuaaacacauguggccauaucauucacucuaggauaugugggaagcagagaacaugagagcaccuuccaugcucucccgucacacaugaagaugaaaaucuagguuuuguaucauacaaggccagaaagaccugagaacuagccaccucuccagccucgggccccacucuccuucuuagaugacaggcuguguuucugccuuuggacaucccucuacagaugaauucauagcucaaacggccucuccuuuuaggucuguucacaugacuccucuuuuuacaugucuaaaaggucaucucuuccugcacuguauucuuccucugcuuuguucuucguagugaucgcugcugguacuguauuauagcauuuacauuacacuuccucucagugugagaaggcagcagcuuuuuuuucuucaaucaaguaaccucagaaccaaaaacaguguugauacaugguguauuuacucgggaauacugaauaagugaaaauagugugugugcacauacauuaucuuaccugcaaugugacuucugucagcauacucaaaggccaccaucauuuuaguggucuaaagcagagacacucugcuuacuugaagguuacaagagaauucguugauucucccuguuacaacugaaaagcuaggacaagcuaaguccucuuuagaaauacggugucucugaacaagcguagaagauguugccuggccacaucacagcgaauauucauccucagaguuccuguguauuugaaaacauuuuuaugaguuucuuuuguaaacauacaacugggaacauuguaucugaugacuaacgugcuagcuuaaaaccuaggcaucuguccacaauagaaaaaauugccucccugguuaagucaauuguauggcuauucuauaguguauuuaaacaguguguuuagauucuccagaguuuuuuuuguuuuguuuuguucugguuuuuuuuuuuccugucaauacuguggcaagugaucguauguauaucuuugcaucuaucaaugaguauuuguaagaggaauucuuagaaaugaagauaacuggguuaaaguauuuauucuccuuaguuuuccuaaguauuggaaaauuguugugcuaaaggauuaugucagaauuugaaaauguucggcaauauuugggauguguaaaaccuuuguucauaaucugacaucagcaaaagaccuugcguugcccuugguuaaacagcacaguggccaucagugggagcagcagcaagcuguaaagagcaaccuucaguuucauuuccauggcuuccuagaaauguuaaaccuuuaucuaucguuaauguggguuuccuacugguugggauugcgguaaaggaaagcagucauguugcauccccugagcaguggguagacuacauccuuugccucccauuagggcagggauuuccagcacaagcuagcaaagucauccccaaacauugggcuuccugucgccucggucacagcacggcccagugccuuguacugauuguagugucuucucuaguugaguaauccaguuaucacuaggaauuuuaaagcucaugccugguguucuaucuggacuuagugagugcuuuugcuauuuucuauugcugcuauaaaaaaaaauaaaauaaaauaaaaucacacacacaaacauaaugguuuaaaacaacccagauguguuacucuucagguaacuagauaaggagacacaaguccauccugaaacacacaagcauagugcagagaagagcacugcugcguaccuuccuuccuggaggccgugggcaaaggccaccuuuucuaaugcuuuccuaagggcugcaguauuccuuggcuccugggccacuuucauugcaucuucaaaaucagcacuaguucauccuacugaccucauucucucucccugucugccccgaccccaacuguguguguguguguguguguguguguguguguguguguguguuuucccuggucaauauaauuacucuguauacaccugauauccaagcuguguucucugucuuaauuaagacggucugauuagcaaccauucaucagguugacaucuucauucucauuugccauagagcguaauuuauucacaagguuagggaucagagcaugguuaccuugguugggucauuauucugccugcugcugugcucuguacuuauuuacugcuaaaugaauugaagucagucugagguacagauaaaacagcuaucuuuacuauaaacagcaauuaggagggagaagcaggaaaucagagguucauguucaaccuuagcuacauaggaguuugaggccagcccgucacaaagagggauaaaaauagcaacagaaccagcuacauuguuuccauccauguuuacaagaguuucuugacaaauacagaaauuauccaugacucuugucaucuccuccaacaucuuauuuuuguuguaaacguuguagacguuacaaauagucuaucugaaaguguauugucuacauauguucccuguggcauaaauucuaaaauauaguuuaagacuuauguauuugcuguuuauguuggaaauagucuuacuugucagucagaaagacauuguuugacaugaauguucuuacaaauuggcuacaacauuaugaacauucaaaucuagauaauagcuauacacuuuauaugucugaauuauacaggaauaagcaguuuugcaaccaugguuucuagaaacuguaauaacgagaaaauaaaaucuaguugaggauaaacuucaaauaauaguaaccaugaaguucaugugaugggcaggguucaguacuguguuuaaguuuaauuugaugcuugauaauucuucaaacugagacuggcuuuaacuuucuuauuaaaauauuauacaacuuuucuaguggcaaaaauuacagcaaaacaguugucuuaaaguguaugcucaaaggcuagaaagaugacuccauccauaaaaugcaugccaaguguggucccuagcacccauguaaaagccaggcaugguggcacacacuuguaaucccaguguccagagggcagagacaggaaaaacccuggagcugccagccagccuagccucaucggugagagacugucucacaaaacaaaggcgauggcuguccuuaggaacagcaccagauugaccucugccugccaauaugcacaugcauucaaguguuccugcagaagcacucagacacacacacacacacacacacacacacacacacacacacacacacguuuucacaguuauagccaggaaucuaugaugacacucugaugagggaaaucuggacugauauuuugaacuuggaguucucuaaaccugaaagaagauggaaguccaugauggccuagcuuggaggaagaguuggguggacaguauugacaacagccacucugccugccucagcccaucccuuuaaaacucaugcugauuuccauuguauugugcauggcuauaaucauaggugcaaaggugccuuggccaguucuuuggcaauaguaauaaauugcaauuaaauuucagaugagauuugaagagaaagguauaugguccagaaaagucacuagcugaacauuuauuuauuuauuuauuuauuuauuuauuuauuuauuauauggaaguacauuguagcugucuucagacacuccagaagagggagucagaucucguuacgaaugguugugagccaccaugugguugcugggauuugaacucaggaccuucggaagaacagucaggugcucuuacccacugagccaucucaccagcccgcugaacauuuuuugaugucuucaucuuggacccacaucugugacaagaacugucuuuaugaauaccuaagagaaagcuguuaggcuauucuucugccagagaguuugcuugucauuacaguuuguuuaaaauugaauaaaacaaauuuguuucucaguccucucaaguuugauguuuacaaagauaacauucuuuuagguagacauuuucuuuauaaauuuagguaauauguacucauuguugaaaagacuggaaauauaaauaaccaaaugaccuagagccccacuaacuagaaccaugcuuuaaaaauguugaagauagccuaucaaauuuagagugaggcaggagaaauauuuuuaaguauaaaaggccaauauagaagcccacaaagagauuuaaauguauucacagcuauucucuuuuuuuuguuguuguuuuuguuuucuuuuuucuuuuguuuuuugguuuuugguuuucgagacaggguuuuucuguauagcccuggcuguccuggaacucauucuguagaccaggcuggccucaaacucagaaauccgccugccucugccuccugagugcugggaucaaaggugugcgccaccacgcccggcuuauucucauguuucuaaaggcuuguggacacucacuguugguaggaauuuaaguugauucaacuauuuuggagaaaauuaaccaaaaacauaaagugcauguccugugacuuagacaugcucuucaaagggaagaacauauccagacagcuguacagagagcaucacacuauuuuuuaaguaaaauaaugaauaacauaaauuuuaguaauaaaauagggcuuuacuaaccauaagcuaaguguaguuacuuaaaauauaaaccaccaaaauugagcuugaacuggauauacaacucuguugguggaaagcuuguauccaucccaacacuacauaaacuggaugugaugacccaccugugucauccuugcaguuuggaaguauauuagaauguuaaugucaugcucaacuucacagggaccagccugggcuacaugagaccuuguaucaaaacuaagaguuuggagagauggcuucauaaguaaaguguuuucugugcagucccggagacccacagaagagcccaggugcaacagcaggggaguacccagcacuggggcagcaugaacccugcugcagcccaucuagacgagugagcugaagggucaucgagagacucaaaaagucagguggaaagcaguggacagggacaccugacguggagcuucuggccuugguacaaguaugaucauacgcguacagagaggaggaaaagaaagggagagaugaaagagagaugagagugauagcuaugaggaccuaaauucgguccccagcacccacauaaaaagccaaguguaguagcacauggcaugcuguaaucccagcacuguagaaauuccagaggcagaaacaggagaaucccuggaacucagugacuaaccagacuagccuaaugugcaaaucgcaaauuaaguaagagacccugucucagaaaauaagguggcuauuacaugaagagugauuccugaaggugcccucaggucuucacaugcacaugaacacaaaugcacauagcugcauagacacagcauaaguaagauuaaugauccaucuauauuuacuggcagaggcauccagugaagucggcagaggacugggcuagggaaagguguaauacacuaguuauuauucccauuuuuaaaaaugauugcauugauugacuggcuguguuggagagugccuugcauggauuauguucguguggagagcagaggaaaacuuuccagagcagguuuucucauccuacugugucgguggccagugcuggaacccaguucaucaguguuggcgagugacucaugcgaugaagcucaugccugauucuuguaaagauaugcacauagcaguggggcggguagaaguuaucaugacauaucuaacaguagauaacuccgaaagugagauucuuuuccccauccugucuauauuguuuauauuugaaguacaauacuuaguuauaaucaggggggauacgcuugaacuuuguuagcauuaaaaacccaugcagcuagagaaggcucagcagcuaaaagcacugcauggcccugcagagugcuuagguucuaauucccagcacccacauagcagcccacaaccauuccuaacuucagguccagggagucccaugcccuccucuggccuccuuggguaccaggcauacaugcagugcaagauauacaugcacgcaaaauaacccauguaccuaauuaagagcuguacgacagagagcuuugcaugauauaaugaacuacuacuuagaaauagccacugcgccgggcagugguggcacaugccuuuaaucccagcacuugggcggcagagacagguagauuucugaguucgaggccaaccuggucuacaaagugaguuccaggacagcuagagcuauacagagaaauccugugugugugugggggggggggggggggagaaaagacaaaaaaagaaauagccacugcuuaauuggagcaaaugaacaguuuaacaaaaaguaggggugugugugucugucugucuguguguaugugugugcaugugugcauacgcaugcaugugugggaggguuacaugugaaagucacagucuccaguuuuguuccucgguugccaucaccuuuuguuuuucuagacaggguuucuuccaaggcuuucugcuugcaagccccgaggaucuacuuguuucuacuuugccaguacacaccaccacucccugguuucuuuauauagcuuggagcuugcuuucaggacugaaugcuucuugcgcgugcucgacuggccaggaagaacgacgcugcaacaggauccuucugcacacguuuauugggagagcuugauuguagaggcgaaaagacuucgagcccagaacuggugcugcuuuuauaggccuaggagaggcgugucucacaccuggauugguuaugcacuacgccucauuugcauguuccucaucugauuggcuacuaucucucaguaccucacagagccucauuaucauaccucauuugcaugucucacaucugauugguuauacucucaguaccuuacagaaccucauuaucauaccucauuugcaugucucacaucugauugguuauacucucaguaccuuacagaaccucauuaucaugccugggccaggcaguaucuuugcaaaaaacuuuacugcauauguacacauugguuguuuguccaaucuuaugcgugguggccagcaguagucagugccacucagcaacggcacauguggcuucccacaaaugcuugcauggcaagcacuucaguaccagaagaaacuuucaacugcaacucuguaaaucacccuugcuccaggcaaguaaagauuauaugggcaaguagaaaauagggcagauauggcagucucauggguuggaauaguauguuuuuugguuuugguuuugguuugaguuuggguuuugguuuguuuauuuguuuguuuguuuuuguucagggaugaaagucaggcugguaaaaaaauaugacagagguaggguuaaaaauuuagaagaaccuggaaguuaccuaauuguguuucuucagcugauagggaaaguagcucaggcaggaagauaaguuaauuaaaugagucaugggauguagugucagggacagacuuauucucaccuauggagacuuagccacugcaccuccaggagagcauggagcaaauguggcaucgagacagucaggaauguguugacuguaaugcuugauacaggaguguguaugcacguaaugcuugaugauacaggaguguauccauguaauacuugaugauacaagaauguguagccauauaaugcuugacuauacaggaguguguaugcaugugaugcuugaugauacaggaguauauauguauguaaugccugaugauacaggcguauauauguauauaaugcuugacuauacaggaguguguauguaugugaugauacaggaguauauauguauguaaugccugaugauacaggcguauauauguauauaaugcuugacuauacaggaguguguauguaugugaugcuugacuguacaggagagucuauacagucucugauggaagaucaaguggaggauaguuggcuucacaaaagaaaugucauuuauuugguucagucaucuagccccugucaaaagcauaagugugugccagcaccaugugcaauggcacagaagauuugguuuaguugggauuucgauugcugugauacaauacugaccaaaagcaacuugggaaggaaaggguuuguuucaucuuacacuuugggaucacagcccaucacugagagaagucagggcaggaacuuaagcagggcaggagcucacgcagaaggcauggaagagcacugcucacuggcuugcuccuccugaacuacgcagccuacuuuugauagcauccaguaccagcugucuagggauggcuccacuauaaugggcccuacagucuugccuacauccccaucuuaugaaggcauuuucucuauuaugguuuccuccucucucucucucucucucucucucucucucucacccacacaguggaaagaaccucugaucuccaccuauagggcacauguguggaccccuacacacugaauuaauuaauuaaaauguaauaagguuagcaaaacauuugggguaacacaaacacuuucugaauuauaaacguuucauuggcaugucggacaaacuucaggugcuauaggugugguuuguuccagggcguaagcaaggguuuucugcuucuucagccccauccucaggcuuccccaaaagacacucugauaagagccucugucguaccaccugaccucccuuaggaaucugagcucagaaauaaccacugugacuaauagacaagaacgcacugcccaaggcugcccguggggaagaggaagucagggacguaguugugauaaagaagggaagucugggcacugaccaacaaagacuagaccuagacagcaaguggugccauugcugauuuacacagagagaaacgauagugucuuaguguuucaguguguuauacuagccaugacccugucguaacuuaaaauucugaauuaaaaaauacucuguuucaaguucuuaaggggaauauauuuuuuaaugagugcauccuacaugucagcuuuuauacugcugccagaagaguggguuuuccguguuguuuucauauguuaaaaugaauaucauugcagauaguacaauugauguauaugaaugaguugucuaugaggcuugaacuaaacgucacuacagaaauguaccauagccugcucuaaaggaccauugaugauugacucagacuuaccuuccuagaacaucacacauggcucuacacuuaaauuaauuauuuuguuuaaaugcucaccuuuaucuaacuuggcagugaggugguuuccaucugcugcugaauggauuuacugaauccacuaucucagggcucucgcuggagauguggcuuugaacagugucucaauuuggaacugguucagcaguuaagagcacuggcugcucuuccaaaggacucagguuaaauucucaggauucacaugauggcccacagccauguauagcuccaguuacaggauacaacauucacacacacauacacauagauaaaccaccaaugcauauaaaauaaaaauaaaucauuaaaaaaaaaucaaugucuugauuaguuagagaaagcacaaguggaaucuauaaaagucacucgauaggaguaaaguguuuacugcccuuuuauauaauuggaugcauguacccauauaauguacucgaaggaaaauacaguugaauugucuggcacaugccaucgccuuuagugaagugaguugcugcagaacagugaacugucagcuggaggcccggaggaugcacccuuccagaugacagaguucaguccgcagucacauuuccaaugccagcucaccuuucccuguguagcacuacucuaaauauaguucuuaguucuuuucuuaaauagagcaagugaaagcaauucugccuuuccuuugugacucagggcugaugcgcacuuacugcacugucaggaaauugagccugguggcauucggcacuggaugaaaaguuaaagugaacuuugagaucuuagugugcaguacauucucuucuguuuguuugguugucaguugguuuuauuuuuuugagacagggucucaauauguagcccagagacuugugucaaacucacaauccugcccuugagggcuggggcuaaacugccucucucuaguaccucuuggcuuugcuccugagcaacuucacacgcuaaacaucaugacaucgcaucacuucuuuacacauuuuacagagagaacguaggagucuauaaaguccaaguaauaaguggguggagcaggccuagagagacuccuaagcauguauggguagaguggauacugugguauuuacaagguugucaaguagacacuuuaguaauauuuugaggagagguacucagaaggaaaggaauccaugcuggcauuugccaagguaauuaccguagcauuuuagaacuuaagaccuggaaauuaccgcacuaaagauauguggcaggucauaacucuuccuuuaucuggcaaagcuccgugccauuugcugucaccucaaaaagagaaagccaucggucaguagcuacccuuccuaucagcuaauaacuuuauccugauggcucuguuagcugcuccauccuugcuaaaccaaaggcuucaaggagacacaauacacuucucuuccagugggaugugaagaaaguccugcagccuuggcuaugugagcauucuuaaucuacaaguaagauuauucucuagcuccaaauguugccuucaucuguccuauucuuccugcaagcccuucgaauagcagguaaacagugggcuuggguguuggagacagaaagagacucuucucucacguccgcccucuggguucuugguuuucuggaaacuccauugaauuucugcugcuugaggucuggacaagaugcaaguaaucagauauucuuuguuuucuaugugaagcuuucuauacuugggccgcuagcuguagcuuucacauuuucuacuuugucugguugcaugagccagccagugucucuauugcuucauugaugacguuaaguaucuaauaucuguuuagcuaaaaaugugguggugacuauccuuguuuguagguuugucucccuguuuaagaaugcuguaguguccuagaguuuguuucacuaagugaaguaucauguacuagugaugaauauuuuauuagcaaacguuguaaauaauccuacagauaugagagcaaaucucuaaguuugcugccaguaugugaggcucaucuuuauauugcagaugaacaucauagucaccugacccguugaucagagaacaugcacauguaauaaauguauagcugaucuuacaucaucuuugauuuaugauuuuuuccaaauggccuuucaaauguauuuuuaauauuuucuuuuuuaucauuuccaagucuauuuaacuaugaaacaugccgucaaaacuaagcaaucugguaucuuuugcuauuauaaguauggaaaguauauaagaaguuuauuucauugucuguuaccgacgacuucuccugaguucacuagacgagcuagaaaaccuuaggaugcuguaccugcugugcucuuacugagcagcccccagcccucccuaucugcagucccguucgaauugccccuuaccgacagccaacaugagcuagaauggugaugggcuagcaauugaaaucaguaaaugaagcuuuguuccuccaaggagacacuaaugaagugggguuuaauugacuuauauauugcuuucuuguagguggacucaccaaugaacuugaagcauccccaugaccuagucauauuaaugagacaagaaacaacaguuaacuaccucaaagaacuggaggugaggccacugaugugugcugugcagccgaagcgucugccucccgggagcugguuguggucagaggacagcuagaguauaucguuaacuccaguucggugacguguagaagguuugagaucuugcuuugagacagggccuuucaaauuauuuggucaaaguggaguauguguguauuuguuuucuuaauuaaauuuguuccuagaguuuacacauguauguaauaauacugacuacucucacguccaccucccuacaccaucuacaccauccucuccaccaaaggaagugcccuggaguagguagcaaccuaaugcucuccucacuuaacccuacaauagguucugugucguccugucaucgucccccacccacccaccuguuagaaugugucucagguauggucugagaagaacauguguaaaauauaaaaagaaagaaaggagcuggacuuggucacucagaggcagagaggcagguggauuucugugacuuugaggcuacccugguuuguauaaauaguuccaggacuauacagaccuugugucaaaaaaaagucaggagaaacgagcugggcaagaggcacacaccaucaucccagcccgugcaguccaggccaauccaggauacagugagguacuagcuacaaaaaagaggaaaagagguuuucguaaaaccuaaaaauuauacuuuucauucauucugaaggaguaaaaaccagggucucaguaucaucuucucucaugguuaagucaaaaagucuuaaccaguuuguuccaggaaaacuugaaacuuauauguggaaaaaguaaaauacaacuuuuguuuaaugaacaaaccaagcagcauuuuuagacacugguuuugucauaucuaugagcuggauuugcucaauaacauguagugauaggaaaaaaaacuagacauaaacuguguacuuaaaguuauaguauaaauaauauccaagauucuggaccguaacccucgcuugcaauggcugcgucuuuggucgggaagaagaucguguuugugacgggaaacgccaagaaacuggaggaggucauucagauucucggagauaauuuuccaugcacuuuggaggcucagaaaauugaccugccugaguaccagggagaaccggaugagauuuccauacagaagugucgggaggcagcucgacaggugcagggcccuguccugguggaagauaccugucugugcuuuaacgcacuugggggacugccuggccccuacauaaaaugguuccuacagaagcugaagccugaaggucuccaccagcuccuggccggcuuugaagacaaaucggccuaugcacucugcacauucgcucucagcacuggggacccaagccagccagugcuccuguucagaggccagaccucgggacagauugugaugccacgaggcagccgggacuuuggcugggaucccugcuuucagccugauggauaugagcaaacguaugcagagaugccaaagucugagaagaacaccauuucucaucgguuccgggcccugcacaagcuacaagaguacuuuaguguggcugcuggggcuggugaccacuagcaccauggguaggggcuagugcagaacuccccaggaggcaggcacuccugugaggcuuucucuggguuccccucugccaggagauccaggcagcaucaggagccaguucuuggaagagcaguuggcucugcauaggggaacucugggccaguugauacuaaacucuugccccuuggauucaagaguuuccuuugaccaggcauggcagugcacacuuuuaaucccagaauuugggaggcagaggcaaacagaucuuugugagcucagggccagccugguuuacauagugaauuccuggauagccagagcuacguagugagaccuugucucaaaaacaaagaaaccaaaacaacaacaacaaaaaguuguucuuguagccucuggcucugggauccugggaaaauuuugguuguuuguucuuaucugguugaggguuuugcaaagaaacacacaacuuuugguuuuagaauauagcaaauuuaaauucuagaagacuuuccaaaauaaauggugugucuguuuugaaaaaaaaaaaaauaauauccaaaauuuuaaggaaacugaauuacagaaagaugccaguuucuuauugggaauaagcgggaguaaugaguguagacuaaagagccuucgagcagaaaggauccuaaggaccaucuccacuuacaaggaggaaacggaccugaagacuagacccacgacccgcccgggcucucagacucucggggcagacauggcagaacuggaggcaaaguucucaaggcuuguucuuugguuuugguuugaggagguuuuguuccuuucucucuuacuuuggcuucuauuaaaaacaauauggccaaauuuggagaacauggguuuauuuggcuuauguguccccaucacauuccaucaggaagggaagucagagcagggaccuaggggcaggaacugaagcagagacguuggcucauggugagcugucuuuuuuuauaacucccagaacugccuugccagggcuggcacccaucacagugggcuaagccuuccaaccucaagucauuuaaucaagaaaguucccuuacagacuuagcuaugggccagucugauggagacauuuuuucaguuaaaguucaccacuucacaggugacugagcuugugucaaguugccaaaagaaaaaaaacaaauaugaaaaaccccagaaagcaaaaacaaacaaaccaacaacaacaaaacccucacuaguacaauuuugugagcacugaacccagagcaugcuguacaaccacuguaccacugagcuggcuacuacuguuuuuuuuauuuauuuuauauaucugaguacacuauagcugucuucagacccaccagaagagggcauuggaucccauuacagacgguugugagccaccaugugguugcugagaauugaacucacgaccucuagaagaauagucagugcucuuaaccacugagccaucucucuagccucugcuauuacuuuuuuagugacauaaauaaagcauucaguuuaaugauaugugauuaauucauccaauaauugaaaugcaaagaaaaagcauuggauccaccaauuuuggaguaaguuuagugugaggauuuaugcuuacuucauauagacaggagaaauaggugagaugcaaauacaaacauaaaaacaaauggugaagccuaaaagcaauggcaggaagccuacagaagcagaaagaaauagcagcacgaauggggagcauagccauggccauucagcucuguggcgcuaagacacuggccguacucuggguaagauaaggggcagguucauggcuccaguguggguacaaccaaguuuugcucaguucaggagcuguacccucauuucagcugcaugucagggacauggaguagaaacuccaccaugcuaaguaagaucuggugcugacuggagcuggguagacccuggaagccacgucaggacaggagucugcuguggaggacuuagagauggauaggguaaagcaauacuggagaguuuuggccugauuaauuacaaaaugaagauguuuucuggcauacaaacagcaggcuuucuaaccccagaccgucacuugagugaaaauaugaaggauguacuaugaagaagaaauaaauugaauagaaguauauagcauauacaguggggauauuagagccuuggaaaagcugcuaaauuuauucauuuaugguguccuaacagauuaaacugugugaauguauaacaauauguaguuggagugggacauaguuaaacaguuuauguuauuguauaauguucaggaggaaaugaacgggaaucccauuggauauuuucagcacauauauuaaaaaugugggaagagcuccaugcucaaguagucuugccaaaaauguaauuaaaccacaacaucaaucauuuuccuaccaccaguuuccuucucguuguuccuuuaccuguuuaaaauacugagagaagccugcagacuucaucagacuguaagaaaucugugacauggacagguucuuagccaggguccccuuucaguacuuagagagauccagagggcgaugcucaggaacuaagggaacuucaauuaaaacgguccagaagccuagcagauucuguagaacaaauagccugauucuuuaaacaaauuguauggagaagcaagauggagaaguaaugugcuaacuacuaaauaggaacagacuuaaacaaacaauuguauuguggacuucauuguauucuuuuuuaaaacuuuauuuuugaaauuuuuauauauuuuuuaaaaaucauauaaugaaauauguaccuacucuccuauuucccucuccaacuccucucauauacccugacauuucucccuccaagcuucauguugguuuuuuaauaacuacuaagucauuuucaugcugccaauauguucaugggugugggaccauccacuguagccugaacaacccacuguggaccaucugucuccucaguauaagauaggacuuugacaucaucugugcccugucugugcugggacucuggcugccugagcuucuauaggugaacacagcuccucugaggugaugauuguggucucaggucauguccagaagaugcuauuucacagcaccgcccuguccucuucucuuccacucccccugccuccucuugauugauguaguggcccugaucccugcuguggugagcuuuacacugguguuucauguagggcugagcucugagucucccauucucagcuucuuagaccugucuccauugagugcugcccacugcaggaagcagcuucccucagcaaggccgagaguagcccaggccugucuguugggcacuaggcugcccuggcuagcuggauucugauucaagcaaggauauaaaacuggauuucagaaagagggaagagaaauaguuggguacuugaacaugaacuauuaauauuaagagauuguuauuuuaaauaugugacaaugguaucauaguuuuaggcuucuaauuuauuuucuuucaaaaacaaaaguauuuacugauaaaaaauuaaaauggagggugagguggggugggcaagagauggcucagcaguuagggguacuugcugcccuuccagaagaccaggauacaauuccuggcaccuacauggugacacacacacaauaaaugaaucuuaaaaguuaaaaagucucaugaaggaaagguagaaacucaaggaagaacacccaaguaauccgaaugagccugucuacaguuuugacugacugguuggcucaguggccuaguggguaaaagugccugcuacacaagcugaacacuagaauuggaucccuaggauccacuguggaaccaacuccaaaaguuauccucugacguacaugccaauggaggcacuuauauacacaauaauaaauaaaauuuaaaauuuuuuagguaaaaaauuucugaaaaauuacaugucuauucacauuccauugcccagagauggucacauggcuaagcuuguuacacacauuagaaagagaguggguugggagagaccauuugaaacagauuguaggacauaggaugugcucuuuuuuaauaggaaaaucauuuuuagauauuuauuuuuaauuuuauuuuuuagcuguguaugaacauguaugucuuuguggggaugugugcacaugagugcagcccccgagaagaggacaucagauccccaggagcaguuucaggaguuugugagcuccugcuaggcaugcuagcgacugaacucagcuccucugggagaugagcaagugcucuucacuacugagccaucucuccagccccuaagguuuuguugugucucugucaugucuggaggacgguuucacagucucugcugccccaggcucuuaggcucuuucuaccuccucuucugaggggagagccuuggagugggauacugaugucuccacagggcugagcacucucuccacagcgucugguucucugcaccuuuaccauggugacugcagcucaccauccauagcagaaagaagugucucugaugaaggucgagagaugcugagcuacagagaugaguguuuacauuuuaagcuaaauucugguccuggguuuuccucuaggaccuuugaccuauccagauacaaguuuuugucccagugauugggucauuaaaaaagauuuguguaugugugccagguaugugcaugugagugucgguguucuugaggaccagaggagggcaucaaaucccuuacaguuggaauuacaggcuguugugagccaccugaugugaaugcuagguuuugguuuguuuuuauaguaaagaaaaaaguuuagagaagcaacuuaaguauugaaaaaaauaauuuauaugguuuuauauacacauuuguguggaaauguacagcuauaauggcugauauaugcaauauuaaaauaaaguguuaagcagccgaguguggugacggauuucugaguucgaggccagccuggucuacaaugugaguuccaggacagccagagcuauacagagaaacccugucucaaaaaacaaacaaacaaaaaaaaaguguuaaguuuagcgacuuagaguaguacaucagcauaaaaccauguaugcauagaauugagggguuuuuuggaucaauauauaaucaaaauaauauuuuaagagaauaacagagcaaaugaaucuuucacauggguaccauucagagaaagagguguaacuaaagacauuccagaaucuucgucuuucuagacagggucagcgcucauuaaauucuccuuugguuucagugucaucuagcugaaauauuuuuuaauccauuuuuuucuuuuagcuuauauuugugugugcaugcgugucugugugugugcgcacucgugugcaugugcgugugucugugcgcgcgcaugugcaugugucugugugugugcgugcgugugugugugcgugugugugcgugugugugugugugugugugugugagcacuagcgcaagcauaaauucaugguaguugaaaagcagcuugucggaaguucugcugugaguucuaggacugaugagauccucaggcucggcagccugugccuuucccgcugagccagcucacugcucccccuggcuuugauuuucuuaacagaaacagcuaguugcucagaaaauucacauagaggagaaugaggacagagacacgggccuggaacagagacacaauaaagaagaccccgacuguaucaaggccaaagugccuuugggagaccuggaccuuuaugauggcacauauauaacucuggagagcaaggacaucagguaaagccguucuccuuccaaagguaaaguuguccugaaucaguaagaagagguuccugaacaauguuucaucaccgauggguuuauuaaaauuugaaaguucaaagcacauaguauauagaaagcuugcaaaccaauuagcuguuuuuauaccaugauuuaaaacugagcuauuuacaguaaaaaauaaaacucaaaugccuaguaaacauguggaaauauuucucagaauuuaucauaugaguacaaacuaaaacaguuuuaucuaucauacuacaaaaaguucuuaagauccguagcuacucagagcaugggagggcauugagugacauuucuagaaagaauuuaacaguuauuuagcagucuuugaaagacuaccaucuuggcuccuauuauuuucugauucuucauuuaucucuuuuaauuugaauuccuuaaauauuugacuucuucuggcaguuguguggaaagccacaaguguuggcuauguacuguugugacgcagggagagcaugagaaaguuagcugucucucaaagcgcuguuuuuaccucugucauucaccugcugccucuugauuuuaggccugaggauuucauagacacagaaucuccugucccuccagacccagagcaaccugacuguacuaaaauccuagagcuuccauauaguauacaugcuuuucagcacuugcgaguaagugggaaacuuugggggauggaggguacuuuuugguuguuuggggguguuuuggguuuuuugguauuuuguuguuauuguuguuuuggccucaugcuuauuauuaaaaguauuuuccuuccugcaggccaccuuauaauucuaccuacucuuguuagaucuuaaaaauauuuuaaaauaaaugcuacaggauacugaguuucuuaugacauagccucuauauuuuuuaacuguuuuugaaauucccuccuccuuuaggguguacaagagagaguuaaucucucugccccucucuuaccuaaagaagauccaaucuucacauauuugucuaaacgcuuaggaaggaguaucgacgacauaggucaucucauucacgaaggccuacagaaggugagucacccagcagcucgcugagcuaggauguucugcgugcccaggcacgugguccucucagggugcuuguuguuugcuuguccccauaaaggaagaugcagagcuaugugauuacauugguacagaguauagcacucaauaggaaggaggcauggguagagccauucccuuuaccaggaaaagauacugaaaagauguauuuaaacuaauuuaaaaaaaacaauuaguagaaguaauggagguauaaacuagguucuaucaguuacaucuguaagaaagcuaacuguggaugcaucugcauccagugcacauuacagcuguucuuuucccuagacacuuaccacuguauucaucuguaauuuucucacaagaauuucuaccugguagugugugccuguagucucggcuacccugaggcugaguugggagauuuuccuaaacccaccagcucaagacgagcauaggcaacacagagagacucuaucuccagaaacuaaaggaagaaaaaaaaaaggggggggggggggaguagggaauuacauagcaugaaccaagacuguagacgugccaugcaggcaaguguggaaauuuaggagguacuuguugcucucuccuucccuguuccuaagaugcacaggcugagggugucucucaguugcuguagugcuugccuagcccuuuggggcccugacuuccagcuucaccauugcauaaaccuggugugaugacuggugcaugcuuauaaguccauauucuggagacagaggcaggagcaucaaacauucacagucauccuugacuacauagcaaguuugaagccagcuaaggcuacgugagaccuugucucaagaagaaaauacaguucugucucuaagcaguacaauuauagugguauuagauauuauuauaacacuuauguauaguuuauucacauacagaacuguauaucaagagaugauuuuugaauucaagaaaaaaguuuuguuuucaagagcguuuuccaauuauuuuuaaagugaaguuaccccuccacugugucuuuccaaagguguguuuguauucacagagcguaaagaaucgggaaaauugggcugggguguucacccucugaucaugacagcacuuuguguauguucauuauguguuuauuugcuugcuuguuugcuucugagagauagguucucacugugagguccugucuggccuggaacucacugucuguagcacagacuagccucaaagucauggugauccuccugccucagucuuccaccauggcgcuauaaggaucuuuggagcagugcagugguuuucggcuguauccccguguucuuauugcuuucuuuaucuugaguuucagaagagccagugucuuaauugugcagauuuugaaauccucagucaaaaaaaacaaaccugucuuugauuauacuugacuauuuuuuuguuucucucuagaaugcuuccuccuggguacuguauaaccuggcuucauuuuacuggagaauaaaaaaugagccauaucagguaguggagugugccaugcgagcgcuucacuucucuuccagguaagauuucucuucuucgggccuccagaucagccgcaccaaugaggacuguuaaagaguaacacauaggaaaccacaaaaagcaguguugucuugucgucacacacuucuccgucucuuaaucagagacaucauuagucuugucaagagaaaggaucacgggugucaguaaguucaaauugaaagcuguguaccuaacauucauuaaggagaaaaauacguaagguagauaggcugucguucaccugagauguuagugccaggacauacacuggaggaauuagcaagaguugagcccaccuuuccuuggauguguguaggugggugugcugugugugugcaggcaugcucaugagugccuguacccacgcauugcauguguagaggccagagggcuucaucagaugacuucuucuguugcucuccaccuuauguuuaagacggucucucacugagccugaaguugacauguuugcuagauuagccaguuggucagcaagcuccuguaauccuguggugacaguggcaccaccacuccagacuuuucugugagugcugaagguccacgcucugagccaccuucccagcccuaauaucgaugacuucucuuaaagcaaauaugaacuguaaaugaauuuuuaaaucauaaaauuucugccagaucucauuuuuguggcaacacuuguaacugugaaguugagggaagaugaucaguaauuuaaaaaugagacaagaaacaugaacagguucacagacucaugacgugugcgcucugaccucuagccgcaguuccucucuucuaggcacaauaaagacauugcucuggucaauuuggccaauguucuacacagagcgcauuucucugcggaugcugccgucgugguccaugcagcucuggaugacagugacuucuucaccagcuauuacacacuggggaauauauaugcaguaaauacaacuuucuuguuuguugagauagaacaguugcuagaggggggugagcuugguuuguuuuuuucauuuugguuuuuucucagacuguuuccuucccauuuugucugaacaauggaaauaaaguaauuggugggaaggggauaaaacagcucaauaaugugucauaacacucugagcuuuugaacagaguaaauagauaaacugaaauuguaaacugcagaauaaaucucuuaaagauuguaggccuuuccagcuauaguauuucuugguguuguggggauugaucaaaacaguucucacuacagaaugagguagcugugacuugauaaauccugagggcuuuggccagaugcagccagccaugguuaacauuucuucccuguguguauguaugugugcguguguuuugucuccccagaugcucggggaguacaaccauucggugcucuguuacgaccaugcuuugcaagccaaaccuggguuugagcaagcuauaaagaggaagcaugcuguccugugucagcaaaaacuggagcagaagcuagaggcucagcauagguaacuggaagcaaaaauuucccugaagcacuagcaccacagacccuuggguuagaacgaagucaagaggcaucaccuuaacauggucaaaacaauuaaaggaaacuuucacaccacacauccaucccuguucaaguuccgugacagggcagcugacuccccagcaucaucagugcuaggcacuagagagcauuuguaauuacaagcucucaaauuagaucuguacaaguuguuuguacauuuguuuuaagacacaguuucauuccauaacccagugucuuaguuacuuuucuuuugcuaugaagagacagcauggccacagcaacugauaaaaagagaggguuuaauuggggcuggcuuacaguuuuaaaggguuaguucauaaacauugugucaaagaacuuggcagcagacagacaaauauguacauucuacuggagcaauagcugagaacuuacauuugauccacaaguacuagucagaaaaaaagugagacugagccuaguguggacuuuuaaacccccaaugagccgccuccuccaacaaggcugcaccuccuaacccuucucaaaacagugccaugaacuguagccccaagucuucuuguuaaaaccaccaugcacagccuaaccuagaauucacuauggaaccacuguguagcaaugagcucucagcaauccugucuuagccucccaagugcuagcuaggaucacaggugugaggcaccagccccaaccuuuugauguucugugacucucaugacacuuagagcucuugagaagucucuggaucugcaggaauucugcugauuacaaccuuaguuuuaacggaguacagugugucaguaaagucacuuguacaugcaguauuugaucuucuucacaccuuuggaucugacauugccuuuggccggcaucuucuuuggguauguauuagguuggacagcagugggacucuuuuauacuugauauuaucaagauuccuagcaaaacauguuuguuucccuagguaauaaagccagcuaagaaauuugauacaauucaaaagagaaaauuuuuauuccucaaaauuagccuucaucuuuugguuauuaaagaggauuuuagaauucauuaaacguguguauuugaucguuuccuaaucuguuuaaaguauuauguagugaggcagaaggaagggcagcuugcuuuucuguaacaggcuucugucccacuggaucaaaaugugcccuggcugagcauccuccaguguuguucucuuagaacucgagcucacucccucaccgucucuguagguaucaauuauccagguuacaguacaguguauaauaaagccuugguguuuaaauguaaucaccaucucauugaaaucagauggcgaggaacaaugucucucuguuuuaaggaacuagaauaugagaccaguauacuaugacccuaacuccuuuucuaucuuuaggcggaaugaaagugggaaggagaaaggggaucuagaaggguuuugcccacguggcaguggaauauacauugcugcgauaaacaccaugaccaaaagcaauuugggcaggaaagacuuuauugcaucuuagagcuuacugucuaacauugggaaagucagagcaggaacugguacagaggacacaggagugcuaccugugugguuucucagccugcuuucuuagagcaccuaggacccucacucccuggacagcacugcccucuauggcaugagcauaucauuauaucauuccucaaucaagaaaaugcuccacaggcuugccucaagcucgagcuuauggaagcauuuucucaauuguagcuccucuucuuagaugacucuagcuugugucagguugacauaaaacuagcagcacaaauacaguuuuuaauuauuuauguauuuuaauauguacuuguguauuuguaugauacaagguaucgaaccccaugacuuguacauucuaggcaaguucucugucguauccucaacccuaaccuuacuguaggugauuuauaaagacaugaaggugugcauauuuauaggguccuaugugaaaggucacugcaugcauccauugucuggguccugcugucugucuacccuaaggagauguagaucccugagaugcagugucuucagcucaggcggcuggguggguggcaguacuguuauucuguggagaaagggaagagaaggggaagagcgcauuuuacggauaaccccguucuguugggaaaggcccgcagcaggcucacugcagauggcucugcucugcccugcucucagcccuggcucaggcugggaagauagggcaguugaguccuucuguuuugaaaccuuucagguucuaauaccagcacaucauuugauuuugaggcaauguauuuaagaaaaggccuuugcauuuaugguuuuucucaaguaauaauuuaaauuucaauguucucaaguauuauauuuagacaguagcuuuuauuuagcacuguuauucuugaauuuguggcauagaguucuuauuaguaucagcuauugcugcuaaucauaaaguuaauauauauaagcaaguuuuuaaaaaugacaauuuucaaggucuggcuuuucuacuauggaaacuguucaggucccuucagagaacgcugaacgaguugaaggaguaccagaaacagcaugaccacuaccuccggcagcaggagauccuggagaagcacaagcugauucaggaggagcagauccugcgcaacaucauccacgagacgcagauggcaaaagaggcgcagcugggugaguaggggccuggcugcacgcaggucgcacguccuuccagcaugcuugaguggagccuugaggcaguaugaaguuguacuuaagacuuuucuagaucuuuuuaaaaauuguguguguguauguguguguguacacaugugagugugcugcagugcaugagcccucagggcaugaguagagaucagggaaguccguucucuucuucuaccaugcgggaucuacgucgggcuuggcagcaaacaccguuaccuaaugggccguuucucggccugacuuucuuauaucuuuuugcuuauuuguuuauuuuaauuuuaguuuauguguauaugugugugccuguuuguguacugugugcuugcagguacaugcagaggcuaaaaugggcaugggaucuccuagagccagaguuacaggcaguugugagccaccuaguguggaugcuaggaaccacaucuggguugccggcugcgagaacagcaaaugcuacuagccacugagccaucuuuccagagccucagaacuaacuuucuuuuuuuuuuuuuugagacagaguuucccuguguagcccuggcuguccuggaacucacuuuguagaccaggcuggccuugaacucagaaauccgccugucucugccucccaagugcugggauuaaagacaugcgccaccaccacccggcaccccagaacuuucuuaaaucucaaaaccaagaguaaccacaguuguuguaccaggagaccugggagaugcuuucagcaacuuuuauucccauuuugacauaaaaaccaaucugcauauucuuagauuucuuauauuuccagcauuaauauacacaucauucucccagagaucuugguaugguuccaauucugcugcaggaugugugagguggggccugagcuugugccaucauaaccaacccugcacagcaggcugcaaggccguccucugagccagugguucucaaccuuucuaauacuaugcugugacucuaauacaguuccucaugcuguggugaccccagccauacagaucuuuuccuugcuacuuaacuguaauuuuccuacuguuaugaauugugaugcacauaucugaaacucaggguaguugauauauaaccccucugaaaggaucauuuagccuccaaaggugucaugacccacagguuaagaacaugcauacucugccagagcaaaugccuuugucccucuugcuguccuaaacacaaagacuauuuuagaaauaggacuauagacuagaauuaguagacucuuccacucagguaggaaaucuuaguuuagucaggaucuacuaguugcaagggaguucuggaaucguuuccauagucguacacagaauuguucaugugcauuauugcuugguugguugguuuuucagagaagguaaugcauagcuuuuauuaacauuucuugaagcccauuuccccucccaccgccccccccaaaaaaagaacuacuaaucuagaggaacuuagguuagcaagaaaucgaugauuuaauuguauacagacuauuuugauugugauuaaaguccaagggaacagaucugacaacucagccauagagaauaaaguccucgaaugccuuauuuugaugagugaguggacacuggagcauugcaccuucgcugugacgucuguccauuuaaaguccuauuaguuuaucuucgccauuuugagaauaaagauuauauucauauuguaguauauauauauauauauuuuuuuuuuagugauggagcucuuacauaggcgugugaaacaaaauugggaacuauagagagcaaauucucucuguagaaauagauggucagagucucuccagaccauguaaucaagacagaaccuaacuacuagaauggucaauuaguggaguuaaucucuccuugccuuauacagagaaaaauuggaacuuuaaagaugcauuuauaauucuguguagggggggugggguauugcagcacaugaauacaguugucaucaucggccagaggugucagauccaccuggagcugggcuuauagugguugggagccaccuguuaugagugucaagaaccaaacccagguccucugaaagagcaguaugugcucuuaacuacuuaaccgucucaccagugccaacugggaauucuuuaaugaguucauuuaauuaacuauuaaugaguguuucucuguguagcucuaagaaaagaggcauaagauuaaaacugaguggcauaacacuaagaaaaagcauccuguugcugcaugacuuugcuaaucauuuguauaacuuuuucuugccccaggaaaucaucagauaugccggcuggucaaccagcagcauagcuugcacugccaaugggaccaaccugugcgcuaccaucgaggagauaucuuugaaaauguggacuauguucaggucucuucuaguucuuacugucacucgugugucaauaauuucaugcuuuauuccuuugacuucuuguaaauugaauugcuaaagugugugacuauuauugcuuuuaagauuuuuauugucuguuguguguaugcuagcagauguuguuaucaaugaucaguugcaugaauagcaauucguuucccaaaguacuagcacugugucuacacacauguacauuugauucuuuuccccauugcuaugggagccaaaacugagcuguuacuacuauuuaacucaguuuuaauuuauucuuuuaaaccuuccuaaugcucuaacccuuuaauacaguuccucauauugugguaaccauaaaauuacuuuauucuacuuuauaacuauaauuuugccacuguuauauaucauaauauaaaugucugacaugcagccccuaagggguuaugacccacagacugagauccgcuauucuaaggaggaagagagaacgaucucuuuuaaaaagucucauuauguugccccuccagaaauaugaacaaaauuauguuacacuaaaaaaacaaaaagauacuuaauaaguaccauugcuaggcacaugcguuuucuuacugacuauaagcauauguacagaacacacauagucgugcacacacacaugcccaugcagccauucuugguugucuguuuugaaggaagaauauguaaauacaguuauacugagagcuauaaaacuuuugcugggugaaugauacuggaagcgugcacaaccaggucaacaaucauaaaaaaagauaucaaaugcaaaaccagcauuuacuguaucuuucauaagacccacugugcacugaucuagagaauuuccuagagucaaacuguuaagagucaagaaggcauuucuaaggaaacaagccauaaggaaauuugagcuaauuuucaaagauuuuuuuuaauguucuuuuuuuaauuggguauuuauuucauuuacauuuccagugcuaucccaaaagucccccacacacucccccaaccacucccccacucacccacucccacuucuugucccugucguucccuuguacugaggcauauaaaguuugcacgaccaaugggccucucuuuccacugaaggccgacuaggccaucuucuaauucauaugcagcuagagucaaagauuuauuuuauguauaugaguauucuaucugcauguuugccugcaugccagaagaggcaucagaucccauuguagaucauugugagccaugaugugguugccaagaauugaacucagaaccuuggaaagagcagccaguacccuuaaucucugagccagcucucucuagcccaaaauuugagcccuuuaauuugaaaaaccccagacaauaguaauaguaagaaacaaagacaaacaggccuuucaggaggggcagcagcaguguggggcagaugcuccucugacuuccauggaccaguugcuagcauucacccaugguuggcuuucaagacaacucacaccaccaaagcauguagcucccugucauaagcccaagcauucugaggaggaaagaggaagguuuagaaauauagcugaaauccaguaugacuuuggauguccuguugguuuggggacuguuauggaccagugucguuucaguuaucuugagucugcguagcagaagaguguguuucuauucauaagaccuagagcugcaaauucagcaugcuuaugucuuucucucauguccuuucuuuuccauuccucccaugguccuuuucucauucucuguauaaccaauagaaaugugguauccuauaaguguugcaaauguuuuaucuugguuuggaggaaggguguguguaucugucugucugucugucugucugcuuguauguguguguguguguguguguguguguguguguguguguuguguuccuuuuauuuuucuuguuuccucucuagcucuaaagguuauauuugcaauuggcaauagucagccaaauaagacccauaaaaauacuuuaaauuuuuucuuguuauuuuucauguguaugaguguuuugccuguauauacauauuuugcaucauaugugugccuggugccugcagagacaaagaagaugugagauacccuaaaacuagagauacagaggauugugagcuaccaugugggugcugggacccuaacuagguccucuucaagagcagaaaguacuauuaaauucccaguugucucuccagccccuaagaauuuuuucuucaucuuccuuaguucuaaccacaguacuaauuuuauagaauaauaaccaauucaguuuugacagggggaagaauaaaucaccuaauuaguuuaucacugaaucuaaacuaggaaaaccauggaaaggaguuaaaaggacaggaaagcagcccguguuucuucucgcccucuauggcagcgcugaguggaagcuguuaacuacacugcauauccacaggacaauaacugugggacacaguucuaagaaguaaaugauccuauugcuucugaccugcuuucugaguuucuauuagacugcugaugaauguuuacuagguuucaguuaaaguaaaauccuccucaugacuacauuuugagucacaauuggauuaaacuuuucauuuucuaguuuggugaugauucgucaaccuccaguaugauguccgugaacuucgauguuccuacaaaucagagugaugucagcgagucugucaggucuucuccuguagcccauucuguucucugggucuggggccgugacucugaugcguauaggguaaguguguagagacugaugaaggcauuuucuccagcagacacagucuaauacagcaguggcccugcacugcacugauuaaugugacccuacgauauugagccuagugcagugcacauugaauaaaauugcuauuaaauggaagacauucuauuaaggaauuaugggucaguaagcucuucccuuaauuccucacagucaacugggacagauaaaagcccugauuccaguucugcaugcuggguuuaauuacucgccugcaucuuccucacugacauagucaguacucaauacuaggcugacacuaggaaguacuagauaagcuucauucccuauugaagcuuugugguaauggaagaugcauacagugaauacagcgguaaaugcauuucuaggcuaccaugaagguguuguauguucacuagguuguaugcuagggcaugaggacagaaauguguacuuuuuauuuaccauuaaaauuuuuaaauuuaauuggauauauauauauauacauauauauauauaaacauauaauucagccauuggagcuaauuauuauacaaauuccuuaaaguaugauagcuucaaaauauuaguacaguuauuuauaugaagaugaacauuuuaugaauugcuaaagaaauuguuggaaagcugagacaagagaauuucuugagcauuggaauuuccuuacuaaacagauuauuaauuuuuggcauuuagccaaagaauuuuuguugggauuuguccaaagauaagguaaauuucaggcucaagugacccaaguggccagugacauuuaccagugacuuauuuccuuccccucuuauggugucaagcauauuauugguuccaucuggaaacuugaugggcuccuucuagauaacuggacagcaggcccuuuuguucauauggacugagacuugcuucucuucccaguaaugccacucguaugccuuguguuucacugacccagcuaacauaaaccugcccugcaccuggccagugugcagcgaaucgaaaagacuaagucauacuaagaauugguagaagaaauauuguaagucagguagagucuucauacuuaccugaaaauauuacuuucuguucagucauucuuguauacugucuuaguugguguuaccaugaccaaggcaacucuuaugaaagaaagcguuuuauugagggggggggggugcuuacauuuucagauguuuaguccauuaucaugggagagcacuuggcagcaggcauggcaggcacggugcuaaaaaaguauuugaguguuacauacugauccucagggagagcgaaagacacugggcuucccauggaccuuuugaaaccucaaagcccaccccuacugacacacuucuuccauaaaggucauaaguucuaauccuucuaauccuuucaaauagagccacucccuggugacuaagcauucgaauauaugagccuauggggccauucauacuccagccacuacaaauagcuguaauuuuuuuaaacauuuagauuuauuuaucauauuuuguguguauuaauguuuuccugcauguauuacaugcaugaaguaccuauguaggccagaagauggcauuggauccuguggaacuagaguuagaaacaguuauaaccugccauguggguucugggaauggaaccugggucuucuagaagaacagucagugcucuuaaccucgcagccgucacuccaaccccuaguauaccuaaauauacccuaauaugucuaaauucucuuaacgguucauuuaaaaugauaguguugaaucuaaaguaaucuaugagaagacuuauuucuuucauaggacaaacaacauauucuuuggccuaaaagagcagauuguacagacagcuaucccagaguuccccuugguggagaauugccaacauacuuucugccuccggagaacaaaggacucaggcaagugcagauggauguggcagagcuccugauucugcaugauugucuccuggcaccagccuuggacuugaaagguuaagucuuugucuugaacucacccaaacuuggaaaauaugaaucuuguuccuuuuucuugugccaggauccacgaacugaccagugaugauuauucuucagaagaggaggcccaacccccugacuguuccauaacugacuacagaaaaagccacacucuguccuacuuagucaaagaauuagagguccgcauggaucugaaagccaaaauacccgaugaccaugcacgcaaaguaaggcucacuuaggcugcucuuucuugccguccauucugggugacuucagaagccucuuagauggaacagaaacuugacggaagguuuucagugagaagcuaaaguagcguaagaauugacaaggugacugagaugucagccacgcuucucaucaacacagccucaggcagcucugugggcugcagugugcagaguccagccaggcacuguaagugccuccgacccagagaguucugucuaaagaaggccguccugacugcuucaguuuagcuuuguaccuucugagccuccacaggcuuauguaauuagaccuugaaaguuuuccugcuccggccuugucagccuugcuuuggcucugugugagagccuuaggagucuauuaguuugauagccacccaggaaauuauaaguaaauucuauuaauacuguuuccuuugguuccuauuaguuguguaugacuaagaguacuuuauuaauauagauaucuagauauguacuccagagauaauauguagacuaccauauuuugacaaauauaucuacucuaaaacuacaaaugaaaccauauuuaucuuuuuauaggaaaacagaccauggcaacuaauuugucuguuguuguuauuuucaacugaguauaauuagacuacuuaguucccauucacuaaagcaagaaaauggccauuucccagguacuguuguggguucuuagaacacaaagaugauuaaggcacgauuuuucuuuagaguugcucacaguuacacaaacacuacagaagauaaaguagcugaauugagggcuggugcuuuccagcuugggaagagugcagaguguuaguauauccgauauuccauguuauugauucuggaugggguggaguauauuacaggacagacagacagacagacaggggaaagagaaagaauguaugugcgucuuuaauuuuuauaguugaaggaaacuagagcaugucugugaaccagugaauacuuguguuaguguguuaauauacuuauauaguauauaugauuauacgugaguaauuguucuuagggauauugagaugucucaguggguuaaauguuugccacagaagcuugggcaccugaauucagauuccugcccugugugaaaaagcugaacaagguagucaguguuuauaaucucccguuugcuaagcauggguggaggcaggaggacuucuggcauuuacuggccagcugcccuagccagucagaaaguuccaaguucagugagagacugugucucaaaaaauaaaguagggagugacaggggagacacccagcacucaaccucugacuuccauaugucauauacacacagguauacacaggaacacaaacaaaacacauacaugcacaaaaaucaauucugaggcacucacauaaggacugcauuuuagagauucuucuaagcgucuuccuuguuauuuucaauugagucauuauuucuuuugauauuuucagauuuuacuuucccguauuaaaaacuauacugucccagaagaagaaauugggucuuucuuguuucaugcuauuaacaagguaagucauuuguuugggaccucuaaaacuuaaauccuuccuaagagcaacuaaaguuuuuaauguguuuguuaaagauuccauuuaggaccagcacucuacuuuauaccuaauggaacugcuuuauauuuucagccaaaugcuccugucuggcucauucugaaugaagcaggccuguacuggagagcaguaggaaacagcaccuuugcuaucgccugccuccagagggcuuugaauuuagcuccaguucaauaccaggacauuccucuugucaaccuggccaaccuuuugauucauuacggccuucaucuugaugcuacaaaguugcugcugcaagccguggcugucaacagcucugagguaaggcucuccacucaccuguucacagucauugcuguggugggaauagcuugacuguacaguaagcuuugagucugucuaggaauauuguggaugccaacaagagcuggcugacaggagccugauauuacugucuccugagaggcucugccagugccugaccaauacagaaguggaugcucacagccauccauuggacggagcacaggguccccgaugaaggagcuagagaaaguacccaaggagcugaagggguuugcagccccauaggaggaacaacaauaugaaguaaccaguaucuccagagcucccugggacuaaaccaccaaccaaagaaaacacaugguggaauucauggcucuagcuguauauguagcagaagauggccuagucgaucaucaaugggaggaaaggccuuugguccuaugaagguucaugccccaggauaggggaaugccagggccaggaagcaggagugggugaguuagggagcagggggaggugggaggggauaggggguuuuugaagaggaaaccaugaaaggggauaacauuugaaauguaaauaaagaaaauaucuaauuaaaagaaaaaaagaaaaugucguuuucuuuaaagaguagaauuugcauacuucaagaaaaaaacaaauauuuuauuuugauuauuuauauaucuugagacagcaucaggcuuuguaaccagagcuccccucaauucauaauucuccugccucagacuccugacccaagauuacauacauguaccacugugcuagcucuuuucagauuugaaugaguaaaacuaacaauucucauuucucuucuucaaaacuuacauauaaauagaaauuguacagcuaugaaaauaugcugugacucucuaugucugccugcaacagcuggcucucacucucccacucauuauugaaugcauuguguuuaguauuauauuauuuuauagauauaguauuuaauuuauagauauaguuacaccaucugaugcacaguuaaacaguuguuguaguaagaaacaauaacaggggaccgggacuguaacugugguaaugugaacagcaccuagguucagugccaaggggccagauaaugugcugccaugccuagcguaacugcuuugugagucuuagucccuauuuuuaagguucuacuuuagguuugcagaaauacaguuauaauaguuacccaauuaaguugcccuuaaccucaccccggaaugauuauauauuuuaccuccagagaauccuuuauaagagaugggugugaauagcuuagguuuguuuaagagaccauaaaacuaaauuuuaaauauaauaaaauauugcccauuaagaguucaaaaaaugacaauuuuuaagcauaauuguguaaugucuacacuuuccagcagaccuagcugcuaguaagucuaucagcuccagugcuugcucugugcaaacacggugcagugagagcagaugaugagauugaacaugacgugagcacgcccugcccaugggaggcccagugcuuccuguguuccccugcugcugcugcagcuaaggcagcugaagaaggaagagcugggcucucagagaugcuugucuuccuguauuuacaguguaguuacauuuaguugcaaaggucuguggcacugauaaaagauaaaaagagaagucagugaguugaggugagugaagcagaaguggaaacgcacuguaaccaacacugccuccccagcugucacuggcuagaaguaccugggaccaggaagucuucaagcauuucagagugaccuugaaaagccuauacuacauuuaaaaacugcuacuagauaguuuuaagaccauuagcuuaaaugguuauguaauccauagauugucaugccaugucuuuagguagcugauauuccuuuuuuuuuuuuuuuuuugguuuuucaagaccagauuucuuuguguagcccuggcuguccaggaacucacucuguagaccaggcuggccucaaacucagaaaucugccugccucugccuccgaagugcuaggauuaaaggcaugugccaccacugcccagugguagcugacauccuuaauaacuauuaucaauaaugguuucuaccagagccuuuucuauauuacagauaacuaucuuagcacuaaagauaguaagaauuuugauagcucugguaccuuucccugcuggacaguccagcaaaaaguuugggccaggacauagcaagagcugcagaucaucacugcuccuggucgucaucuuaggcauacauuucauugguuuuccuucacugaauucuuuuaacuagaucuagacaccaucugguguuuuacaaaaguaucaccaaaucaaacaaauguuuuacaacagcacagcaagaucaucaaaccgcugauuucaucagcagauaggcuuuuucccaugaucgaugaguugaguacacacagacuaaaaggcaucagaacguacaagccuagauuuggacuugaggguacugaccguaaagcucgcacucuuuuuuuuuuuaaagauuuauuuauuguuauauguaaacacuauagcugucuucagacagaccagagaacagagaagggugucagaucucauuauggaugguugugagccaccaugugguugcugggauuugaacucgggaccuuuggaaaagcagucagugcucuuaaccgcugagccaucucuccagccccaagcucgcacucuuuuaaugccccuaaacuaacacuucauaaaaccagguugcuuauuuuaaaaugcaacuucuuuguuuuaacauuucuuagucuuuuauuuuaagaauguuugguuuucuauguucucacugugauaguucaaacuggccucaaagcucuuggugguccucugccucucaagagcugggaucacaggcauggaccacaugauccagguuaggagcaugaacugaugcuagacuaagucaaggaagcuacaaaaguucauguuauaugugcaccuuagagacgucgcuguuugauuccacuccugugagcuuugugaagagcaaaguuaguguguggugguagaagucacacuguaucaacacugcugcuauggagauaggacugagaaccucugggcuacugcaaacauucucauugucuuauauuuggggcugaguagcacuuacaaggauauguucauauguaauaauucacugaguuacauacuuaaaacuaguuacacguuuuaguggguuuugaucuuuauaauagcugguguaaauaaaaggaacuaguuagcaguaaccuuuacagagcaaccuaagaagagcucacagaagaauacuguaaagguuucaugcuucccggaccagcaguucauuuauauucugcugacuucuuuuucccuucuuuucagccccugaccuuuuugagccugggaaaugcuuaccuugcucugaagaaugucagcggggcacuugaagccuucagacaggccuugaagcuaagcaccaaaugcccagagugugagagcagccugaagcugauccgcugcaugcaguucuacccguuccuguacaacgccaccucuucugucuguggcgguaagcaccuaauaaacgccacaagcucacccggcuuugcugccguaacccaagcaacacagagaugguuuggggaacuuccuccaggguuuuaaaaagcuaacccuagcuguauagcagagaaauccauucauuaauuacuggaauuaguaguuaacguugauuuccagaccuuagcuaagaaauacugacuaauguauacagugaaauuguauuuuccagaguuugucaugggaguauuuucucucccauaaauuuguuuaacccugacuaauaaucacgguaaaggaaauucaugaagccguaugugucaugagcacagcccuacauacuuaccccugaaaacagcucccugccuuucagaggagugauuuccccuuccugcaccuuguccauagugaugguauaucacagggguccuuucucuuugugugcagcugccuuggcagaacugguaugaagcuuaaaagucacaugaacccuaauagccuuugcuuuaaggaaaagauugucuguuucacauucugccuuugaucagcagccucuggagaggugggggaaggcgcagaucuucugcacuagccagcguuagguggagcaacaguuuucacuccacugauuguccagauuauaguauaaggcauucuaguuccuucaauagugauaucaaaaacugagcauaucucauacccaguugacauggcuugacuuagauaauuuauaauagacuuaagaccagaaacugguuuccugguucacuuuaccagacugccucaggguuuugauggaauugggaauaaguguacuugcaccaaagccugucagaaccaucauauaggucagaugccugucaacauugggcaugauacaaauuagaguucucaugaauaccaaaggccuggauaguguuuuagcaagggguagucaaguggccagcacaagaauuacacagauucuugccugaccaugcucugccauacuuucugaucccagaaaaguagcaucauugccuauaccaugaacaacaauaaaaaccauugcauacuugccgaggaaaccaagugagguauuuaucauagaguggguaacuggauaaagguaagacuucagagauugauaguagggccagugacauggcucagcagggaaacgcaugugcugccaagccgaaagccaugacgucaauccucugaacccauauaguagaagagaaccagcucccacaaauugcccuguaaccuccacauguguaacuuggcgugcgcaugcacacauuaaaugaaaaugaaacuuuaaagacauuuauuguaaaugcaaaguauucagaguuuucaaagcacaaguguuguucuuacucuuacuucaaccuagaaaauguggucuuuggauauugcugguuauccaagaggucacauagcagugaccuucuucuaaauacuauuuuucuuguauuaacauugcauauuugugcucaguguuguuguuuugauuuguuucguuucuugcacuuucuuaauuccuaugucacucgugucagcagaaagaaucuaguugugaugacuugccccugagaccuaacuuguacaagaacaaauaacaugagauagaucuucaucagauguggagcaucugcuggucuagauuaucucagugacaucuuugggugcacuauaacuaggaaagaaagcaauuuagcuuagaagauggacuaccauuguucuuucagagagaacuuauccgcaaaacuuggacaagauuccauuuuuacccauaaguaacuagcugcauaaaccaugaagccucugcgcugcuuggcuuccaucacaggaacaggcucuccuaccaguccucuaagauggugaugugaaugugacagugucuacccaggagcaccuccacagugcuccuagguaugaagcccagccaucucaugaagugacuauuacuaauuuuuccuuaguuuaacaaacccauuucaaguauuuuaugaaggaagacuuaaaagguugaauuuuuacacguuucuuauuauuucuuuaagaauucuguaaaauguaugcuucuauucacccaucucuucucagagccacucucccuuccccuuccccuucuuccccuuccccuuccccuuccccuucccaacaacuuugugcccucuuccacaucaaggcugcccacauauucucagaugugucacgucuuccacuagagcauggucagcguuugagaggccgcacucuuagagcugaugcucucucucuaagcaguucucuguauaggagguggaauuucaugcccacuuccccucuucaugcugggauuuggucugcuuuaggcuggcacaaccacugggaguuccgauguauagcugccugcuggguccagaagacacuguuuucuuguagucuacuaucucugacucuuacucucuccacuccccuuccacaaugaucccugagucuuugaagagggcaauacauuauauguauccacuuaggacugacauugucgagucuuuuauucuuuguuccuuggccaguugaaggucucuguguuggucauuacccauuguaaacagaagcuucucaaaugaggguugagagaugccuugauugauguccacaaugauaaaucauuaggagaugauuuaauauuugcauuuaacaggaaaauaguaacagauucuuuuccagggccuaugaccuaucuaaucaugcggguuggcuuuuuguuuuuguuuguuuguuuguuugugcccaauaauggugccaggaauggguuucaucuugggguucaggccuuaaauucaaucagaaagggguuuguuauucccaccacauucauugcacuguugcaucaauggucaugccugacagcuuaguaagguugauggcugcuuuucuccucucgacacaugcauagccccuuccagcaccacucaagccagccaguauggacgaugcuuccaggucaguacuguucugugaccagaguguguagugucugcagcaaugcagguguacaaucaaugcaccaagauacaugguuaccuaaaaauauuacaccagauuguagaaguuaggaguaaauagucuagagucauaaacaaauaucaguguaucuuagaauuuuagaccaguuucuauguaauguguguuugguagccuuugcaaugauuuccaaaucauguuaaugaacucuggaugcucgagauguacagaugaaugaccuuguauucuucuuauagcauuucuguaucucaccauuuacaggaauaucucuuuucuaaugcuucauucucugaggcuuuagucugcuuucugcaucaggaauuucuguagauuuauggcuugcugcacacauuguucuauaauuuagauuuucagaaggagauguugcauguugcugccuccugcagacucugcagcauauaccaccugcagcuguacuucacuuuccucacaagaauugcuggggaagggaguauuuguuuuuaagauuuuuauagauccaauuuggggagaacuucaauauguaauuaugccaucucuguuuauuuccccaaaauaauuuagaacuuuuuaaggacuauaguuaugguuaccagauaauuuauuugacauguaucugugugauaaaggaagaauaagaaaaagguugugagcuuaugucuagaaacaaagauuaugauuugcccaagucaaaaaaaaaaauaucagucauuugggcuggagagauggcucagugguuaagagcacuaacugcuguccagagguccugaguucaaaucucagaaaccucaugguagcucacaaccaucuguaaugggaugccuucuucuggugugucuaaaaacagcuacagaguacucauauacauaaaauaaauaaaucuuuuuuuuaaaaaucagucaguaaauauaacccaauccuuacugucaacauacuauaagccaucuccacugccaugguugaagagugcauguuuguagauucuugugacauuuaaugaagguaguauaacugcuguauuuucaguaucuucucuuaaaaggaguaugugcauacaaaaacagaugacuuucacuagacuauggagacagcaauaacuacccuacagguacucgcucuuuuuauuugggaugcuaccuugauguuucugggucuuguucguuaguuugcugcaugugaauuaccuugaacuuuguacagaaacugguggcuguacuuguaucaaguccacaaguagugcuguucucggcacuuagauuuuuuuuuuuuaaagauuuauuuauucauuauauguaaguacacuguagcugucuucagacacuccagaagagggcgccagaucuuguuagggaugguugugagccaccauguggaugcugggaacugaacucaggaccuucagaagaacagucgggugcuccuaucugcugagccaucucaccagcccccggcacuuagauuuuauaggcaacauuuuuaucucuggggcaggcaagauggcucagugggcaaagaauuuguugucaagccucaugauccuaauuggauuccccaagacccacauaguagaaggaggaaaccaacucccaaaguuguccugaccuccuccacacacaugcauguaacacacacacacacacacacacacacacaggugggggacaguuauaucuugcuaaaacauuuuuaucuuguaggacaccguauaacagcuugugaugaccacugcuuuauaucucaugcuguaaaagacaaugaauaugugcaugccaaccagauuuaugucaacuugacacaaacuaaggucaccugggaagagaaaugucuuauagagaaauuguaucuauaagacccagguauaguuaaguguguagggcauuuucuuaauuagugguugauguggaaaugccuaaccccuugugaguggugccacgcuuagacuagugguacugagugcaguaaggaaacaggcugaauaagcccgguggaaaagacaguaagcagcacuccuccguggccucugcaucagcuccugccuucagguuccugccuugcauuucugucuugacaucccugcaugauagacuacaagcuguaacaugaaauaagccacuuccuccugaacuugcuuuucauugugauguuuuaucauagcaauagaaaccguaauuaagacaguauguaaauacuuccuagcuguuuagucuuaaguggggucuugcuccauagcucagugugcacuuaaacuuggauccuucugucuuagccuacugagggcugggguacaggaaugcaccaccauacccagccaucuucuugaacuauaaugauacaucuuucuuccuauauguaauuuuuuuucuuuugaggaacgagccuacugacccuuaggcaagcucucuccacaacuaugucuucuaucaguauagauuuaccuauaaauacuaaccuggccugggaguguagugugauaaagcaccucuguacaguguacaaggcucuggggcaaagccccagaaaaaaaaaagugaggaaacaguguuccagccaaauaauaccguaggaaaguuaaacacagcccccgccacauacacacacucacacaggcacucgcgcgcacgcacacacaguacugggaauucaagcagguccucaugugugcucagcaaguguuacauaacugaccuguuuccacaguagugguagugaaaaucaucuuuuuuacaaucuuugauuggauuauuuauuuguuauugugugugcuuacaaugugguagguggggccccacacaugugggauccaauugacaacuuuguggaguugaucuccuuccaucuuuaccuaaguucuagagaucaaaaucaggucucuagaguugcaugucagaaucuuuacccaggaucaucucacuaaccugugaauauaaccuuuaagcaacagaguagcauuugauuucuucugucuaaauaacuuacauguggcuuuuuuauuuauucaacuaauacuguguuccaggcaauauucuaggaacuagaaaguaaacaaaaaagccucaucucuuauaaaguuauauucuacuaccaagaaauggaguauaaugaucaguauaaugaucuaguauaggagugccacuguggggaaacagcacaggugugccagcgacaucccauugaagaaauggccuuuagcaaagaugagaggagguuauagacucugggccauaccauuacaccacacugaggguuucagacagagacacgagucagcgcaaaggccuaggagagagucgacagcagguaaauagaugugguugcaggagaaguggagggaggcugcaaguuccaucuuuauuucaugacagguuguuuuaauaaguaagacucuuuuccaaaagaaagauauuuggaagguuuugaacaggaauaaagugauugaauuuacauuuuaacaggauucuucuucuaagaaaucuguacugugguggggugaggguagaggcaagaagaccaguuaggaugauacuuccaaaguaucaugagaugagcugggagauagcccggaggguaacugcuugcugcguaagcaugaggcccugaguccagaucuguagcacccauacaaaagccaagugugguguacauaccugcaacccuggcacuggugggguuuacaguuggagcagagauagucggaucucucucucucucucucucucucucucucucucacacacacacacacacacacacacacagagcacuaaauaaauguaauuaaacuuuagcuucaauauacucgcuaugcaucgcgaugugauuccugguccucacaucuguguccuaugaggaaucacuagacccaaggccugagcaguuauagaauuacuaagucugaaguucuuauuuuaagaugcuaucuuaaauuuacuaaacucaggaaauucaagacaauuuacugaacccuagaaaguaacgcccaguuugcauuugauggccgugcaucacauccuugcuguaggagaaagccagccugcugcucccaccaggaaccucuguuggugggccgugucccuguucacaccgcuguacuuccauuggaagugcagggacagcaugcucuaugguuuccuuuccucagcaucagcugaugacuccuaacaugaagcaggagaccagcagagcuuggccuuugucuuuaucgcccccauaggcacacuggacacacagcuggccccuucuuucucugcucuggauuccuccagaugccucuggcuguucugucucucaugucuacaaugaaaaccuucuccuuaaccacgccaugggcuggucaugacaguucauacacuuucgugucugcuuuuuacaaaguuuagaaacuaaaccaaauucuggcauauagugagcacauuguguguagucugccgucuucagugugugugcacauguccacuccaaauuccuaguuuuauguacuugcauguguucaguagccccacaaccucgcauccucaucccacaaaccaaccuaagcagcuuugaaggccuaccucugcccugagacuuauauggucccuauuugguuugguuugguuugguuugguuugguuugguuugguuugguuguucugguauuguauggucucacuauguaacccagacuguauguagcccagaccaguucuggauuugaacucacagagaucuaccugccuugcucucccaagugcggggauuaaagguuuacaccccugugccuggcucuugguccgcuaaguauaugugguauuguaaccugucacuguggccaugcuucuugagagcaggaacuaagccuucucacuuccguggccaucauguccucugucccuucuguguuuacuacacuuacuugaguaacaauuuauuaguaaacaggauaaacaauaguagcuaucaguaacaaugguaacgaguaaauaaguuguuagaucccuguuuauccagggugcuguguagaaacgaugucucauauguaugcgucaauagagagguuuuaagucuacaguuccugccuuagaggaaauagaaaaacaauagucucaucuuacuuguccaugauaagcuaacagauauucucucaaccugcuuccauuauuuuuaauuuacauugcaaacaaguaucucuuugaacuaggauucaggauuaguaucuaugaguaaaucagggaucccucaauauccuagcuuggagaauaauuccccaaguuaaagugagccauguuuaaauuaaaaauaauaauggcuguggauagugguaacuuccucauaugguuucuggauggaaaguccucucaaaguaaauuuuccuaaaagucuaaugaaugaaugcuacuaacucgagcuacgaucuggccauacgcaguucaaaaggcaagguugggucucaucccugacugguuuccaacagcugugcugugugucauucugucuccacugacacugccuuugcuuacucacuuggucauuuaaggaaaggccauguagcaggaucaaaaggccauguuuacagacaauucuuuguuuucuacucuaugacaauagagaucaauucaaccccaaacagacaaacacucccccaacuccccuugagauagaauucaguaccagaauguggaguaugacgggcacacagagagacucacacaugcaugcacacacuuaaacacagagacaugcuugcacacaugugcaggcacagagagagggagagaaacagacagacagagagagagacagagagaaagacucagggucacaugcuuugaauuuuuuuuuccuucccuacucuguccugacucauucaccucacuaggagggaaucccaguguaugcccgugauugccaauuucaagugucagagauagcgucuuucuuucuagcagugcacuuuuaaggucagucaguacauaucauaacaguccauacauaaugguuauuacuuuaaaguuccugugaagaauuucauuggacaguaauugcugaguaagagaucuaaggaaauauuccugcugauaaaaucauuucuuuuguuuucccccuaaauagagaacagcagagggcagaggggugaggcaccuucaucagucucucagcuccaguccucagcacccacuccugugcuccgugugcucccuguacuccaagugcucccugugcucccuguguuccauguguucccugugauccuugugcucugugugcuuccuguguuccaugugcucccugugcuccaugugcucccuaugcuccauguguuccacguguucccuaugauccuugugcucugugugcucccuaugauccuugugcucugugugcucccuguguucccugugcucccuguguuccaugugcucccuguguuccgugugcucccugugcuccaugugcucccuaugcucccuguguuccacguguucccuaugauccuugugcucccugugcucccuguguuccaugugcucccuguguuccaugugcucccuguguuccgugugcucccugugcuccaugugcucccuaugcucccuguguuccacguguucccuaugauccuugugcucccugugcucccuguguucccugugcucccuguguucccuguguucccugugcucccugugcucccuguguucccugugcucccuguguucccugugcucccuguguucccuguguucccugugcucccugugcucccuguguucccuguguucccuguguuucaucugcuccccguacuccauguggucccugugcucccuguguucccugugcucccuguguucccugugcucccuguguucccuguguucccuguguucccuguguucccuguguucccuguguucccugugcucccugugcucccuguguucccuguguucccuguguuucaucugcuccccguacuccauguguucccugugcucccuguguucccuguguucccuguguucccugugcucccugugcucccugugcucccugugcucccuguguucccuguguucccugugcucccugugcucccuguguucccugugcucccuguguucccugugcucccuguguucccuguguucccugugcucccugugcuccccguguucccuguguucccuguguuucaucugcuccccguacuccauguggucccugugcucccagauguaacgcucugaguucuuacuucagcagugguuuuguuaguguuguuuccugagagucucugcacagaacggcaguagcuuaucucuucauuccaaaaaaagaaaguugacaaaaauagauuguugacuuguccaaguuugugugcuaagacuuuaacuaaggcagaacuugauuuucuggcaucgaguguccauccugauuucuaaaaacugaggguauccaaaggaccucucaccucuccuggcacaaaggcaucugucgccaguaaggauucuuccuuacacuggcagcuugcccauuaacucugacacgaaagcccaaagucccccauaguuaacauuuccugguccuuuccuguaagaacagugaagcacugaaagcugugguuuucuucggggagugauuuauuuuguuacuuuuuuaaaagauuguuuacaaaaggaguaaauaagaaacaaugauauaacuuguuuuuaaagcauucaugggguauuucuguguugccugcauauaaaacaagauucaguuuuauaacugcaaauuuuugaguagaaagauaagugggaaagacccaaaaauccuauuuggaguaucucuucuugguuaaaggauaauggacuuccauccccccucagugccuuccaucuaacugagccuagcggaauccuugcuauaaggugacugaucucccagccagaaggagcccacucagugugaccugagcuacugagcagggccagaggcaagccguggacuacuccaugguucacaaagcccacuuuucucugaucgacuuugccuucaaguucuaacucugauucccagucagcuuaguuaucacgucuugagaauucacucugcuugaaagcagugcucguguuugggaggggaaaggaucuuagcaggagcaagauuuguauaaagcucugaugcuuagcaguaacugugaggguguuguugggcuuuccugagcuaaguauagacugaacuuccuucauguggucucuauccuuaggauuuguguugcaaggugaugugcucauucuuagugucccucugaggcuacaagguuacuguggagcuaacuucuaccaaaugccuggggcuguugauugcuguuucuccucaaagucuggcaggagcucuccauucagcaucaccccacacacauaaacacaugcgcacacacgcgcgcacacacgcgcacacacacacacacacacacacacacacacacacgcacacacccacacuugcacaugcgcgcuugugcucacgcgcacacacacacacugguguuaggccuguuccucaguaacuucuaguagccagaguguuauccuaagagauucugcaguggccaaagcuaaaagaccuuauuuuaaaguccacucagaccgggagugcuucucguuccuuugugaguuuucgcagggacagcacuaguaacaacagcaacuuauccuaugcucacaauggucuugcucuuaacauuuaacucauacuauuuuuaaacucacugacacuucuggagacagacuuugcccucaggaagucuggguccaggcuguguuccugaccacagucaugccaaaagaaccgacccaucucugugaccccagcuggagugacuuggcugaggguuccagagucuugcuccacagccucaccuuccugacacuggcauuguauguguggacuaccacacugccucagguuuaccuucgcauggacaugguaauccuccuugggaaaaggaaaauagucuuguaggaguuuggugaauagaaucaaugagaagaaaagauguucuccugacuuagaaaugacaagagcgcugagaacguaauuuacucugaaaaacuauccucaaaaucaguuguaccucuuucccucaggugacuuagacuuugacaaugaguacugacucuuuuccacagcacccuucuaagcuaggucaguaucaacaauccccguguacagcagauacuccagacagagaaaagguguugaguugcugaagcacccacagcaguuccaggagcagaagugcccuccuuggaguuuugugcuuagcugagauugcucugcacuuucuuaccucuaagaaaaaaagacuuagaauugcauuaagugcaaaugcuuuguaagcaagucuaggguguuacgcauacaagaaugcuugucuuucaccugggaaagguguuagcuaaagcuuuucauuuaaaucaugauguucuuuguauaaauuaugagauacauuucaaggucaaucuaagucaucgagugucuucauuuugacaguagugcaaagucaaugcgguguauacaagacauuguugcuacuuucuuuguguguguuugcacaugugugucugucugucugucugucuguguaucucaucagagucuuacuguguaacucuugcuggccucaaacucaugcuccuccugcuucagcacacccaucuuucuuggauauuguuuuaugacacuggguccaauucuuucuuaucuauauaagaauauaaucuaccaggaaauuaaaucauguuuuucaaggcuuguuaguucucugaguuggaguagaaguguacugugaucuagagaacacagacuuagcucuuucuaaagauuucacuaacauucccccacaccacucacagaugacuagaaauguaguuuuaaaguuaggcaacuuaacuuaccaguaacccagcuacuuagacaaaucacaauuaacucaaaacgauucuguuuuuuuaacuacucacauaagaaaccuagcauuaauaauuuuuaauccuuuuaaagauuuucuuaaauuauguguauguuguguuuguguauagauagugccuaaggaagccaaaggccuuagguccucuuggaccaggaguuguaggcgguugugaagcgcggacauuggccugggggcugaguggggguccucuacaagacaacugugugcucuuaaccccugagccaccucuccagccccuggagaucuuuauauuuaaagcauuugguuuucacugagcugcugugaugcuucguacugcuaagaaauggcucaaaauaaccucaugcuuuucccuccuccccucuucccuccuccccucuucccuuccgggagguccugccugggcaugugacauggagggaagacugucuucaaccucacagcuguggcuuccgcguggccagguuugaugcuauucaggaagaccaauuuuagcuuugaggucuuuugaagaucauaccuuacaggugccgcugagacauuuucuuacugcagacauuuaaaugaugaaguauuuugcaguaggaaaagggaaagagaaggaaagugaugugaaagauaguucagaaaacugaguaggccuuggcuuugauaacaucacauuuuacacgacagagucaaggggaaaaguauuaguauuuccucucugcuuuuaauagccaugcuuauuucuauccaaaucaaggcuugucucuggaagugucaaguucuucacagugcauuaaagucacuuggguguggagaguuguccauauugcauuuuauuucaguguuguuauacuuaguuaucuguacuuaauuguucacaccagauggugagaacacaggcagauaccaguuggcacccucuguccuccaggguggaaugcaaggagaaagugcaguucugacugcccauggcucacuccccaccagccgcccauggacauuugugugcacacacacuguguaagguuggcuguauuccccguggccuccgaaacacagggagaaucccuguuccuuuggcuccaccgcaccuuccucuuugccuaugaugcuaccuuccauccugucuguuagaaggacuucuuaguagaggaugauauguguuuuagucaggguuucuauuccugcacuuccaaauugguguucucaccaaaggaagucagaacuggaacucaagcaggucaggauacaggagcugaugcagaggccauggagggauguucuuuacuggcuugcuucuccuggcuugcucagccugcuuucuuauagaacucaaaacuaccagcccagggacggcauuacccacaaggggccccuccccacuugaucacuaauugagaaaaugccuuacagcuggaucucguggaggcauuuucuuaacugaagcuccuuucucugugauaacuccagcuugugucaaguugacacaaaaccagacaguacaauagguuuggcacaaauuccagauuuaccacauagcuuaguuugaauuauuauuauuuucacuaagaaucagucuccuuguaucuaaaacaaagaugcugagcaguuuuuauaaggguuaaguggaaggauuagaaucacaaagcacuccauaaaugcuggcacauucgcuugcgguuccccuucugcaggcucaguggaugcuucagaauugaagcuauggcucugaaaaguguuuucuuggaaggacuugcuuggcacaccacgccgccucagcauuguuugucuucuguuugcuaucuucccaagcugcuugugaguuucuugaaagcucaaacucuggaaaccaaaucccuggcuuuggcaacauguuugcugucugugugugagaagcauggcacuggaaagugacucccucagucugcagucaugcuugaauguccugguuaaggagagaaacgacacaucguuaaccaaaggccgucucuaauaagaaagcuguggccuuccagugacugcaccuucagugacuauguacauagagcaaaacggcggaaaaggacacccauucagugagcuagaccauccggaauaaacaguggcaguggaaagaugucauaggcuggcuauuagcacagacugggaguuguucauguuaacagacaucccugauaggaagaaguccuuuaacucgaugccaccacaguagugaaaucagucccacuaugugagucaaguggguacccaauuuagugagaucaguccuacuaugugagucaaguggguacccacuauagugagaucagucccacucugugagucaaguggguacccaauguagugagaucaguccuacugugugagucaaauggguauccacuguagugagauuagucccacugugugcaucaggcaagcagccagaagugccagaaucucauucaagguuugucauuuuggucuuagaucgucuuuacccauguagccagaaugugcuaucuaaaaauaaacagguguccaaucacaccacaggcuuaaugugggguugcugucacucuccuuuaauccuuggguuuguaauacauguauauucuuagugauccucaccuuuugauaugucucauuuuaagcuacaugaaaugauaguauauuucucucuaaucccuuauucucagauguauccaggcucuacaugucucgcuuuuuguaguacuuuuagcuuugagggaguauuuuacagcagugggugaaacaagaucuugaggcucgaucuugguugccugccagcuuuucaccaaaauccuugauucuuccuuacaacggcauagcagcuaaaacuugaauuucaguacaaacuuuugagccacgugcacucuucuagacugacuccugcauugucugagagucaccuuugcucuugaugcuucggggccuuacauugaggcaacaugagagauguucuaauguaugugucugugucucuugucauugaggucauugucaugagaaaccccuggacaacagccaugacaaacagaaauacuuugccaagccacagucauuggaugcugcugcagaagagcccucugggcacggagcagacgaggacccugugcugucuguugagaacgcagggagggacucagaugcccuuagacuugaaaguaaguugauuugacccaaacugugcuucugugggaaaaucaacuccugaacacuaggcuuccacuuuucucuccucucaagaguuuguuuccuccuugcaacauccacucaacauagggugaacaucagaucagaucaggagggugagcauuaaacugaggcagaagacacugcagugagggagugcucuucacacuuuucuccgcuccagucgucagucuguggagugagagacuauugaaaggagauucccuguggcuucuggauuacguugcccugacccccggccuguccucagaugcucuuuugcuuucuccuuugcugugucgggaggaugccuguauccugaccuugcucuucucuccuucccuuauucuuugcuaucuugcccuggguguuagucuugugaauaaagcagugacucccaggcuguucuugagcucaggcaucugcacagcuccagccucaggcucauuaucuugauguauaggugcuuuaagucuaacaagcuuguugucgagcuugcguuuacuuuugcucuguuuucugaaguguguaauucccguagcugugacugcagcucagcucacccaaggcccaguuuauuuccccagucucagaccuguugcugcucucauuucugcaucugcucucucugcugguaacugucucaggcugucuucacuucugucucuuaaucuguuuuccaauaacuguagccuuuuacuuuguauauacaacuaucucugugugucauacauacaagcauauuuagaaucauaauuauauagggguguguaugugcacacacauuuccauauagagggaacagacagaaagagugcaagauaaugcacauaauugguacagaauuuucaaagcagaagcagccauuuuuauggauuucuggcauguccaaagcgucguuucugaacugcaguuuugaucagguaaguuuccaaagcuuaaauuuuucaguaguucuauucuguaucaggagaaucuaaauuaauauggguugugaggcaguuuugcccuguucuguuuguagcuguuucauuugucaggaaguacuuuugagccuccauaucuuuuacacagacugauaaugaccucugcaaaugcuuugcuuuaaauggacagggccugggcuggggcauguagcucagugggcagugcuugccuaacaagcacaguguuggguguguuccccagcacugcauaaacggggcuggaagcuucacguaccagcuacauagggaguucaaggccagccugcuuuauauggcacugucuagaagagggagagagggacauccuauacauuuccaaugccaccuucucugugaagcauucacagagguucucaaacauguaaggagcuccaucugcuaucuuguuccuauguuuuacaaaacauauuucauauauugugauuuguuugugugcuuuggcucacaucagauugugagcuuuuaccaagauuuuguuuacuaaaaggauuuaucuuagagagagagagagagagagagagagagagagagagaauguagguguguguagguguuuugccugcauguaugguuguaagcacuauaugcaugcagugccaguaaaagccagaacagggcaucagagccccugggacuggaguuacagaggcuuguuagcugccacgugagugcugggcagcaagcccagauccucuagaggagcagccaguguucuuaccugcugagccaucuccccagcugcuaagacuuaauuuuacuuacuguuucauguauguaaguguuugcacaugauaaucauguauggaugaauaucaugugcaugccauggugccccuggagaccagaagaggacuuuggauccccugaaacuagacuuucagaugauuguaggguacuugguugcugagaacugaaccuagguucucugcaaaagcaucgagugcucuuaacaucugaucuaacgguucagccucacaauuuuuaguuuguuuuuccugagauaaacucuuagagagucccugucaggaacucucuauguagaucaggcuggacuugaacucauagagauucaccuagccacuuccuaaguacugggauuaaaggucugccccgcaauaccaggcauauaguuuaguuuuauuguuuguguuaggguauguacacauaaaugcagaugcccacagaaggcagaggaggacagcagagccucugaacuuggggaaacccaccugacauggugcagggaacggaacugagacccuggaugggcacgccuaaccaccugccgucucuucaacucccagauuaugaacuuuuuauauaccaugucccaugacaucuuauauuuauuaauucaauaugguauuugccuuauguggauugaauuaaaauauuugccaaguagggucaguaguauggcugcugccaacgcugauggucuaaguuugauccccaaucuacauggugcaaggagagcacugacuccaaguuacccuuucacauccaaacacaugcccauacguguacacauguauguacacaaaauacauaaagaaaauguuuagaauaaauacuaauacaaaaucuuuucuccugcuauuaacuguuuaaagcucuuguguaggagaagcaaagcaguccucagggagagccccacucuucccugaaugugugaaugacugugucuuugcugcccacggugaccuucacccuuagaaauuuuaaaaaaugcucagcucuauuagaaagcauuagacuuuaaggaaacuaaaucucacguuaccaacucaaaaaauguauccuuaagcaggacagucaguuugcucacuuccagugaggaugagucucucccgaugccuggcaaucucgugucuucuuuggcaccaauacacccacacaguuccgugagcauccugagguugcuugcacugagagucaucagaaauuacacugagucauguggagggcuauuuuacccauuuauagacgugguccauauuccaguuacaacucuguaguagcuggcuguuugugacuaccacauuagucauuauuuuuuccuaggacaauucagaauaaaauacaaccacaguuuugcccugacucccuuuuguguaacacaucacuaccugagacaguagucaccuaauauuucuguaucuucgauuccaugucccaugugguucucuucagcccccauacuuaggaugagccgugguuacgcugacugggacagaucauuucucgaaggccccucagcauccugcagacuuaucuaggcagauccgcuuuccucugcugauucugcucacacugugaaaagagugaacacucuuaggcacccacuuagaugacaccuuguguaaggaaucuggaguucuuuuucuuaucaucuagggaccaauaauauguccacaggaggacagauuugguucccauguuuguagcaguaggcuuccccugcaugauuaucagugugacaaguccugcuuuuuaccauaaagagugugcuuucauagacagccaaguauagagaguaaagacauuugaaaagucuaguuuaggggaaaaaaaguaaagaaacacgaauaguuaaguccucuccagugaccauuaacuaugaugguaauuccuaccauuugauggcauuuuauacuuuacaugguauugugcauuguguccuaauuugugaaauagguacuauuaagcucaccuuauagaugaagauccaauuaaggcucagggaaaaguuugauaggucccucagguugucaguagguggcauaucuaaaauucauggucggccuccuggugcuuagggucucauuaguagugagugugcuucagaaaaaagguuugaugagugagaacauuauuuuuaguugauaaaauaauuuuaaugaguagacuguuuuccuacgagaaguacaaagaugaucucagacuaaaggccagucuuggucagagcaugcacauccggccacccugcagagcaacacguuucccuguagaugaaggaaagagcuccacucaugcauccuccucuaacguuucauuuugauaagagaguaaaaugaugcuguagauugacguuuucagaucagugcuuggugcuuguuucccugguccaggguucauugcuggcagccauccuuggagaagggacacuuagcaguuguagucauagacccugguaccauggcccagugccaccacccagugcugguguuaaagcuugacaguucaccucccugagccaaaggccuuaacacucggaagcgcuuguaguugaaggagcccugauauugguagcagagucuccccuggagacucccacuggcuuuucugggcuguccucugagcuguguuccuguuggacugacucacaaggaagggcgcuccacuggacuccugcugcuuuccuccugcugagcuuacugcacucacacugaaguggggagggcggguacuguguacucuaacuaccguccugagaguuuacaccagugcuuauguaguaaguccucuguagaucacagcuuugcaaccugacauuaugaucagaccacugacaugcaaggaggacauuagggcaccaaacagaguugcucagggcucuacacugguugcauccuaauuuggaacaaaguuugucuuuguccaguauaucauaauuaaaauuaaauauacggggcuagagagauggcucagcaguuaagaguacuggcugcucuuccagaagacccaggcccacuucccagaacccacacacagcagaucgcaacugucuaacuccaguuccaggggcucugacacccucacaccaauacauauaaaauaaaaaauuaaguaaaauuauuuuuuaaaaaguuaguauagucugauggccuucauggugcccaccugcaaucccaguacuugaaaaacaagggcagaaaggauuaugagcuugaggucaguuuagguuguauagcaagcucaagggcagccuggacuaaguaagaagauccuggcuucagacagaccaauucaguuuggguguuccauuggcuaguucugucugaccaaaccauccaggagcuguuguaagucaggcuuaagugaguaaggacuuugacuuacacccugccuguaggcucuuuacucuccaugguuuuugugaaucuagugcacauuuuucugucuuuugcuccugaaaauucucuugaaaccuguuucgaaccuguaaaugguguuucuuaccaaauacaaugccgugucuuuauuuccauucugauguuccauucccucucaguagugucccuggcacgucacccaccagccucuguggcugccuuggguccaucucucccuggcugauccauuucaucucccauuggcucagcucuuucuaacgcugaacuagaauacaagcuuccccucaugaggcuacuaauccuauuuccuguuacugcccugcugcccuggcuuggcggugguuauuccugcccacuccacucuuccaggucaacucaguauacucaauuccuucaaaaugcuguggcuucuagucucauugccacccuuugaguagucccacugagauguuuuagucuuccuagcaaaguauuuguucaccugauuguuucugagcaguaugaccgcagccacucuuaccaugugucacccccucaguuccauagucccucauuuaaugugcauuggggacuuucacuaggucucuggcuacuagcauaaucagcuuagaauuccuuaaacuaagguccccagaauuaaacucgaaagucuauguguuuuugaaacauugagaaauugugcugagcugccuccauugaaauuugggccacauagucuauagucucuacucucugucauuccugucagaauaucuaacauggcagauacucugugaacccaugugacccucacuguggauacuuacauucucuucagagucacaauauuuauccuccauuucccaagugaaaacggugccugguaaagaagaugaaggaaacguggaggcgugcgugcaugucagucucuguuucaguuuauaucacaccaucugccccaugggcuacaagccuagagucuacuccuacugcuugcuuccagcgcuauucaaaaucggagauuccuccacaauccagacaugucagcauacggaagacuguauuuccaauagaggacguauguacaggacgcugcucugcauggagcaaugucagcagaucaguucuuccuuccauucuacucuagucuuuaagcccccuggguuaugacaguccagcccucagcacacuacuaagugccagcaacucauguuagugaguuaucugacaaaugcauuaaguccccacucugucgugccaccgucuccucacugcacguucugggaacagcguucuguucuuauacucaggcugagaacugacugccaccucauagagagccugacuauuccauacaaggcuuuaaaauccugaagucauauuuaaaccugcucaauuauuuccuccaaagaucucuuugcauucccaaagucggcuuccuuuguucccugaaaugccuuucuacucccaaguucuguccuuucuucucccucuccacccgugccgucaccagcugacugacuccuaggccugggcuauccucauccucuuggcuuucccacacuucauuguuauucugcaagagaucccuuuuguaggaaccccaccagagagccuuaaugucaccucugaauuauaccugcugauugccuagccacaugcuuuguucuaaguaaguugcaauuagucacaccuuagcacaugccuuccauguucccgcauacauaucuacuuugguccauaaguaccugagcuaaugcacgugugcuuuuagaaaguuuuccccaggcugcuucugucuaaauccuacugcaauacucuaucuuucucugggaagcauugugugauugcauucagaucaucuuuauuauaaaauuuuuuaauugucccaaauguauguagcuuugugguuucgaguucacuguugguugguuacauuuaauuugccagggucagaagcauucaugugcuuuuugcucccaucaaaauaguuauggcacaaaugacauaggaaaagcuaaauaagcaaaccccagcuucccucggucacaacacagcccgugugugaaccaccaucuaaggaguagauaugaaguguguguguuuaguguuguucccuaagaaugccugucaccauggcucaaacacccuauagaauaguucacuggaagcuagcagcagcagaagccugaaacaguuccaugccucccucucccucucccucuaccugucccucccucccucccucucugauaaguuuaaguuaugcacuuguauaauacuaaguguguccauauacacgugacgggaguaguacuaagcaauaaccuugaaaacuguuuucuuggacauuuugcaggucgacaguguggaugcuuucacauaauagccagugcugaaagaaagaaacuaagaguucuagacacagccuguguucagguuaagguucucguugcugucauuaacucaugaccaaaagcaaccgagggagagagggcuuuugucacauagcagcucagagucuguccugcagggaagacaaggaagaaacugggaagcaggaacugaagcagaggccauggagaagcucugcuuacuggcuugcucuccauggcuugcucaggcugccuucucagggaggcacuguccacacugagcuagcaggagccucccacaauuguuaaucaagacaauagcucuacacgcuggccuacaggcuaaucugauagaggcauuuucuuaauccaggguuccucuucccagauaacccuagcuugugucaaguuuacagaaaaccagcucugccucccaugugcaaucuggagagacugaaauaucuugagaaaguacucugcggucucccuuuggccaaaagccacauucuguaagcccuguguuuugcugaaugaaacuuaucaaagacucuuuccugucucagacuggguggggaaauccuuugugagccauaggaagaaaaagaaaaagaacccaaaaaucagaugaggagcagugagagccaacucugacagcucagucagaugccaggcagcucuugcguuuaugcugcucugggaguucccagugccaacucucuagcuguuuuccuggcugguguggcaccuaauuuuaugucguuugccauucagcugggugagcucuggacuuugguuaugugcccaacuggcaagguaaacgacagaguuaaguccucaguugccugcaggacaggcuaagccaggcccagcagauucuugagagccuugacugcucugcgccacagcuacuggggucugccguacgcuuggccccguaccggacguuaggaacagcauagcaagacagagacuugaaauuagaucuuugucagccuacgugugucacuggccacgugagauccugacacuggccuuauuaacauguuucuaaaucucugaccacccuggaguugccaccugaaggaauaaugacgugccauaggcaccaagccagugcucccgggcuuaccaguggguguguggauaaaaggaagcaguuugcucuuaguuuuugugcccuacucauuucuuuuuuucuuuuccuuuuccuuucuuuucuuucuuuuuuuucuuuuuuucuuuuuuuuuucccuacucaucucuaaaaggaauaagauguggcauuuaugaagcaaaugacauaaagcacagcaauuaauucaaaguaaauagcaaagauuaaguagcaaacaauuuagaaaacggaaagaauuauguuaagaaaccuaaaauaaucguuucugagucucuucauggucuaagcaugggguggaacuugaagguuauaaacuucaugggaaaaugugagaggaaaauuuuccuagcacaucccacuaagauccacaauaggagaucguaauacuuaaacaacauaaguaauaccuucauauccauuuuuaaggaauuaaacuagcauauagcuauuuuuauacuaucacugaaaauggaagcuuccauuagaguaguuuucaacuaaccuuuguucaguucauacagcuaagcagccaugugugcuggacacacaacuguuugaugguagcugaauaaaguaaaagaccuacacaugcaauaaaucgcauaaugccaucacccuugccaucuaugguuuguauguugagcaggugaucuuucaaauaaugugccacagcugcccccucacucaugacaccauccauggcugccugccuucuggcuccugccauuacuauuugacaggcuuuuggcaaaggcuaaauggcagagauaguguucuguuuugagguuuaaagaugccaaaugguauuuuaugaagggggcucuauagucaugccucuaagcagauccaaaauaucccuaaaaacaagguuugaaucauucuguacuugaguaaacgccaugaaacuguugaccacacaaccccuugaauugcaggcacagugguugaagagagcaaugguucugacgagguggagaagucagaugaaacaaagauguccgaagagauacuggcuuugguggaugaguuucagcaggccuggccucuggaaggcuuugggggaacauuagaaaugaaggggcgacgucuggaccuacagggaauacguguacugaagaaaggaccccaggauggaguagccaagagcucuugcuauggagacugcagaagugaagaugaugaagcaacagaguggguaagaauuugccagcucagugcugaggagaaggcccagucaggcaaaccccaaagccuacauuguaaaaccagcauagugacaugugcuuauaauacagcacugggacaaggacagaaaucccuguggcuugcuggccagccagcccagccuugucaggaacucccacccaacgggggaaaaaaaacagaugacagcuccuaaagacgcuacuggaaguuguucucugaccucugcacccaagcauaccaguauguacauaaacagacuugaauacaacacauacacacacaugcauccacguauacacaaacacacaaacacauacucaaagaguucaccagcuuaauccucaugaaauuguagccagguuuuguacacucguacuguacaaguaugguucacacuguaauuuucuaggaaacgucguguuauaaacauuacugacucuucugggaggugagaguaagugggaugguguaaaucacccucaaagccacagacuagugauggaugacguacguuuccuuuuggugucuucuguguacucaucaagacuagucaccuuguucauuucaauaccaacuuuucauuuagauuuuuaaaaaauuaaacuuagccagaugcaguauacaccuguagucucagcacucaggaagcugaagaaggaggaugacaugagcccgagaauucagaaguagccugggcaacauagcaaggcuguucaauaauaauaaugauaauaauuauuauuaucauuguuauuauuauuauuuuaaggggaaaccuugguuggguuuuggaagauauuuuuccuuuucaaacuauacuuuuaaauuggagacuaagauucaguguaaaaagcacucaccauucuagugcacucaugagcccuugcccuuacccucaucucaugugcuagccagccacaguaacacaaauguccagucccagccuucccacagguagacagaggcagagacaggagcaucuccagaagcucucgggccaccuagcagugaagacauccugucucaaacaagguggcaaagccaguaccagagcuggaaggucauguccugcaugagcuacacugccuauauacacacacacgugcacacacacaguauacucauaucucucacacacagagauuuuuaauggauauauaauaacucccccccaauccugugugguugcacggagaguagugaguauaggaccauccccugaagcauggucaacccaucuggugccgaacccaugacagaaccugacucuuccuccccccagaggucaucccuggugagaccucaugagcccuuccugcaugaggguagcauagcugcucuggguuuaugagcacaguaggccugucaugcccagaaggcaguguuacuccagcccgcccugccucuggcucuuccaggccuucugcucucuuucucaguugucccugagccuuccaagaagaggauaugauacagaugucccauuugugggugaacacucuguauuugggcaaguucugaguuucugaguuauccaccauucacuauacaaagaaacuucucugcuggagucugagagcugcaguaaccaguggguacagagauagagauuucaaaggcauuuugauacaaguauccauuuagcagacuaauaguaauagguccacuccauccagcacccaggaaccauagauucuuggccagauucccagucccaggcagcccuucccuccaguggagcaggcccuaaauccaauuagaugacaaaugcuagucucgggaccguaccaauacugcacccaugagcguacauugccauacaggcugaucuuauucacagcuagauaaaacugucaaugacuuuuuuccuuuaagaaccuacauaacgccuucuugugcuauuaaagauaaaaguggaaaagagcuuccuggucagcagcaacuugauuuuuccauguccucugaccaaagccuguguugucuccagaaacagacucuugucaucaaggucugaugggcuaggcuguccuuacagccccugaaaucuguagcgagggacagauuaagauucauuggucucauuugucucuaacauguuuuggauucccagaucacauuccaggucaaacguguaaagaaacccaaaggggaucauaaaaaaccuccugggaaaaaaguagaggcaagucaggcagagaauggacaacguuaccaagcaaaccuggagaucacuggcccaaagguggcauccccugggccccaagguaagugaggcugucucccaucucauuccuaacuccaggucacugccucguuucucacaggagguguguuuuaugacuuagagcaguuccaaugagagguuagaggacauuaucagucacuaguauaagaaaauuuccauuaacucuuuagguugaagaccacugccuugcacccaguugaguuuuucccccagcaguuaaaaaguagcaauagaauuucuuuuuuaaaaauauuauaucccuuuuuaaaguaauauuuuuacuaucuuagacuaauaauucaauucauuaaaaucugucuuaucuaacuaaguuagauaaauaaaauauugaguagggucagcuuauccuaacucgggugcaccuccaucaguccugcauguccaaggauggucuccugcugugacaggaggaaacuuggauugguugugcugcaaagacuuguguugaguuacagaaggcaaacaccucuuccugcugaguccaucuguaguaguagaaaagacagccagguguaaagcacggaagugacccuuccgagcgguuagaugucacuguaaggagucgucacacaacauagccgacacggcaguguuuauagcauuucacgcuaaggacgcuccaagguagagaaauauaaaagauaauucugacacaagggaggcaaaacuaaagucugagcacugauuuugcaggauauuuuuauauauuuguaucauauauuuuccacgggggcggggguaauaucaaugucauuuaaagaccauaaacaaugcggcaguaagagaaaauauguguagcuacuuuuaucagacgaacacgcagcacucccacuguaacagagcguccagucaguagcagccagaaagcgcggacauaaacagcuaaggguuugcuuaccagacugucuaaauguguaggccacagugaaaaucagcagagccggccugagguuagugugacagaugggucagcgggauuuaggccauagugauaauucuucuacuaaugcucuugaggaaagcugucucauauauaccaaacauauaugcacagaguuccuuauccccguaacaacugaugcagccugcaugcggcacuuuccucauuaacuguauacaguacguguguggcacgugcagcgcagcagagaagcacagcacaucaguguaaggacgucccauccugacagacgguggacacaccgugucuuagcaacugucguuuucucacauuucaguaucucucauacaugagauacaugucacagaugauguugguaccaguuggcagguuuuuuucugucauacauugucugaaguugucuauccuguggaguugauggucucuugggucagcugcccuuggccuagcaagcaagcacaugaaacaguagaagcaggucagcgcagcaguacccaugcucuauggcgcuaagagaacugucagucaucugugguuucuuuguggcccuuccauuuuacagauauuuucuaaugguccuauaguacuuuaaagaaacgaaaagcuucucacaaagggguaacuaaagccuaccuggcugagauuaucugagaacaucugggcagauguguguuugcuugcacuggugggaggaagguugaaaugaaagccuuccucucacuaggcaagccaucuucugaacuacaccauggcccccuuuaagcaguuccacguggccuuagcuuagcagaccccagcugggcacuaaagacacuugcaaaugaggucauggagcugcuuacuguccuugaaggagaguguucucagcguggagaaagugcaaaaauacuacaauauuuuaaauaaguuuaaauaaguaucaauucugaccaucaccagcuaauaaacucccggugaaucauguccaaguuuuaaagcaaauuauugagcagauguuugucaaccuauggggagaaaugaggccuuugagagccauaauagacauacuaaguacuaauaauaacaucauaauaacaaaugaacuaauuuccuuuccuuuuuuggcuagggcuucuagacuggaagaccagggaagugccauagacauaauauaacuggaccucagcaaggcauuuaacauccucuuaugauauccuugugaccaagauggagagaugugggcucgaaguuucccacugccuacaggaaaaagugcagacuuccuagugugccauucaagacccuuuauaaagcagccucucuccacucuccaccaccacccaggaagcagccaugcucugauuuuacccaugccuuggcauaugcuguucccucugccuggaaugcccuuagaccaccucugcggugcuaauaucacucacccuuaaacuugaaacucaagugccauuucuccuuugcugccuucagacagaaguaguuguuccuuccuuuguacaacucuuggguuccuccuugaacacucugcugugacaguguaccaguuuccuuauguuugccuuccucacuagccugugagcugcagagcaggcugccucuucauguguguacacaguucccagacccuuauaauaggugcucaauaaauauuucucaagugaauuuuuuaaauauaaaaagaaagugaucuuuauuguuuaauguuugcguuauucaacguuauuuugaaauucuuccaagcugaucuuuuuuucuuuauuaaaauaugaaucuaaaucccugccuguaccucaaaugcuuuucuauuacugguaaauuccuacaacguaaaaagugccgcucagaauuaagguucuccuccugcucauccccaucagaaacccaucagauaagacguuuauuuugcucuuuccuggggaccugaccugaaguaagggcugagacugggcaggaggugccuuggcuagcacaggaguuggaaacauguguuagagucacauaaccgaugucucaguucugccucugccgcaccucuagccagagaacuuugggugagccgcuccuaaccugccuccucuucugagcuugggaauuaugagcagugaagcacagcuucugaacacacaggaaaugcucuugcaagaaauggugaccuuacagugucacagaucguauccugacacuuguuucuucguagcagugauugugaggggcgauuuugcacccauggaauauucggcaguguguggugacauuucuuggggaggcugugcuacugaaaucuaauggguugacgcccacgugcuacuaaaacuguccuucagugcacuacagugucccuacaacaaagcauuauccaccccaaaaugucacagugccagggcuggaugccugcuuuagagauauguguucccauuaagucagacguauccucauaaaaucaaaaccagaaggguaaaaaugaaacgugguaggaauguuagcauccgagagucucugaauccuuauuucacauuggccaaccucaaaugcaacaaaggaugauuuugauuucaucuuugagaauaaggccuuauuucagagaggacuuuuguucccacugccacgagugauaagauuggaauuagaucuguuauucuguggugcacacauucuaaagacaagaagaaaaaugggcaccaccaaccacaccaguuugggugaugucauugaggggaaacaacugcuuagcucccauuccuuuguacuguauccauucaugaccuacuuuccuuccagaaaagaaacgugacuaccagagucugggguggcccaguccugaugagugccucaaacuccgcuggguagagcuaacugccauugugagcaccuggcuagcaguuucuucaaaaaacaucgaguaaguaucuuugacauaaccguccucguggaauuuccuuaccagcgagccacaguggccucggcugaccccagcaacaucuucugugccaucggugaucggaagaguugucguucuggcacugugagcagcugagcuuggcuagcugggcucaguccguacaaaaagugauaaaugaccccguucuaggugccuuugcccauugcaagcugucagucagauguagcauauaguucauguugaagaccagauccuugucuuuagaaauacagaggccauugcagagacacguuuaggagagguagggcaaaucuagacuuugugacaccugugaagaaagcaagcgaaggggcuuuugcugaccuucucuucuggaacuguugcugucccccagaucugccccauuuagguucauaaucaagucuagcugagugacugcuccuaaucuuuccuucaucacaguugcagugaccucccaaauuucuacccuaaagccccagacucauuuauacgcacaagcucaagaaaacacguauuuucuccccccccccccaguguccaacauuaagaaauaaaauaaaauaaaacauugaucuugcuuauccauuucacuuuuuuuuuuuuuuuuuuuuuuuuuuggagacaggguuucucuguguaggcccugacuguccuggaacucacucuguagaccaggcuggccucgaacucagaaauccggcugccucugccucccgagugcugggauuaaaggcaugcaccaccacgccuggccuccauuucacauuuuuuuaaagauucauuuuuauucuuuagugauguguaugaguaugugcauguaugaauguagguauccauggaguccagacaaggagcuacaguugcaagagguugugagccacuugaugugggcacugggagcuaaagcuggguccucugaaagagcaauauguguuccuaaccacugagauaucuauccagcucccccauuccgcauucgcagaaaauauguucagcuguauucaggccagauacccagauuucaucuguuaccgguucuuacuucuuguaugcccugagaccuuuccgagcugucugcuuuucugcauccacacugcugcuccggacggagugucuguacuaccacacagguguaugugcgccuccagcccugcucauucuugcuucggucuuucucauuugcuuccuacuaugagaguucuuuggauguaagucaggccuucucacucugccccuucccagcccagucacagccuucagcccaaggccuuugagcuccgcugcuucaggaaagcugucacaaccaucccuccucacuggcaugcuuucaguauuucguguuuucuaauuuagcaugucuguaauccuacaccuuccaagacauuagcaacauaacaacuaggaccucauauguuuguuaaugauuauaggcuugggaucugauaugcaguagauuuggaauaaauaaaaccaauggagcaauaaauguuuuccaaauauaaguuaaaauguuuaaaguagaauuuaguggugccaaguuauuuaguccaucugguugucuguauggcuggccugugagaguugaucuccugggcuugagagacagcuaagcaagguaagaacauguacuucuuuuucuagaagaucaggauugguuuccagaaaccguaugaaugacucaaaacaacuuucagcaccagggauaucuguggccucuggucaccugcacauaccggcacagagauacacauauguacauaaugauaucuguggccucuggucaccugcacauacuggcacagagauacacauauguacauaauuuaaaauuuucaaaaucuuuaaaaaaaaaaaauaacuucuggagauaacuucauuaguacuuguauuugauacccaauacaaugaauguccaguugagucugcuuuuacugucuaacuuuuagaugacuuucucuuugagcaacaaguauggaaaaguaggcuguaaaaaccaguuguauaucuuauugcuaucuguucccugagagaagcaauccuaaaggaaacccacucauuugaaacccucccuggugaagguggaggugcugauuguuagaacccucucuggcuacuuggauuuuccaugguuaaugugaucaucuccauuuuccagcaucacagaacacauagacuuugccacacccauacagcagccagccauggaaccgcugugcaauggcaaucuccccacgagcaugcauacccuggaccacuuacauggaguguccaacagagccagccuacacuacacgggugagagccagcuaacagaggugaguacucagguuuguucaggcuggugugguguuagccucauagauacaauguaacugacaccagaaagcaagaaugagcagccaggccucaucacuguuugaaucuuuuuuuaguucaccuugacuuagauagcuuucagccaagccuaauuccauucaggcucuaagacaaagcuuauaauucuuaugacuauaaccaguacacuuaucaggguggacuggcuucugccucccacagagaggcucaggagagaaacauuuggggcagcuauuuuccuguugacauucuuaagaaaggcaggaaaaccaacccagcauaugccuagcaaagacuguaccucaaaggagauuuggaaaauaugucacaaaugcccauguuaaaggauaaguuaaauaagauagcagauaauauacaauggcauaauucagaaagaugugguagaaugucaugacggucaguuguaugucaacuugacacaagcuagagucauuuuagaagagggaauucaguugagaaaugacuccacaagacuggccuguggcacauuuucuugauugaugugggagugaccaacccuggugguccugggugcuauaagaaagcaggccgggcaagccaugaggagcaagccagcaagcagcacuccuuccucuguggcguguucaucagugacugccuaucgagauggagagugucaugagaguuguaagcugaaauauucccuuugcucuacaaguuauuuuggucauaguauuuuaucacagcaauagaaaccauaacuaagacaaauauauauauuggcaugaagaaaaguuaagaauauacuauauaugaagauauaaugacaguuuacacacacacagcaaauaucuggaaauauaugugagggcacuaacagcgccugugcaagcggcagagcugcaaguagauuuguuaacuuacuuucuaguguugcugggaugacuguguuuucuacgucuguaagcuuuucuaagugggagaggacuguggacugucagagucaucuuaagugugucuugcacacacuggcuucccagcagaugcacaacagugucccagaaaagcauuuugcuguggugcucuacccccagcugagcagcgauggcagcauccaaauccggccucuuuuucagcucucucaccaaccaucuccuucugucccagguacugcagaaucuuggcaaggaccaauauccgcaacagucacuugaacaaaucggcacccgaauugccaagguuuuggaaaaaguaaguaccccaaagguggcuagaaauuguugccugcccuuugacuucuuucuagaguauugguccccacauggcccuuuugccaggagcuaaugugaccagaggcucacggugaagugagcccacucaggguaccucagcacucucaugacuccucagucaccacuguugcucuuccuacugcuccuuugccuucugggaugaggcgaacccagucagcagggccuccucuccucugccaguguauugagaggcagugcugcugcuaggaauuguagaaccugguauaggaaguaaugcaguacauggcagggaagagcacgauagacaggaaguaccuugugaaguggguuuucuacucgaguccucaagcacacguacaauacugcauuuccagcagccagcucagagacgguaccugaaaugucuaagauggcuucucugccugcgugugaugcucuauaaaaaagaggaguuacguuuuuaauuugauuacucuguagcuaagaaucaaucuaguaguaucugauauugaagagguuauuucuaacggcgauuaagcaaauaacucaguucagugugagcaugacaagcagucauaacagcugccuuccugugggaauuacacaugggaauuguccacuuguaacgaaaguagggcccagaugucaucugcagcccaaguaaauaaguaaauagcaagaagcaaggauugccgagagugcuggagaucgacacaaaggccuaugggauuggaggcagaagacaggcugggguggcaguuucugaauauggccacagaagucuacucccugagaggaagauccugagugauccggagagcuggcacagaagugauccagacucaggcccaccauacagaggaacagcaaggcucaccagagagcacgcagcaggaagaugcugcuggcaccaaaagcauaauuuagucuagacuucuugccaugaguuuuaaaaauaacgugaaagaacuuaugaaucaaaaucacaaaacuaaaaaugcagggagaggcuagcaaagggugugaaaccaggauucucauccugaaugcuagcgaacaggagagagucccaggcagguuggaagauuggaagucgcagcagggagaauacagaugagcacaggaagagguacaggagaggaaggacaggauggaauacacaacacagagaauggaagagcacaugauggggaaaugcaacuggagcuacaacuaaauaagacuuggcaaguucuuuuauuucuguaaaauaugucugguuaaaaaggcaucuuccaaaagaguuaacaacgaugcuuauccaaggaaauuauucuguuuuaauaaagcaagagagaauccuugacgcuucccuccugacacaacaguucaggcuccaggagagagcaccccacuucagagcgacugcauccagcucaggacaaaagugcuucugaguuacuguugggcuuacaugaagcaggugucuacagaccucuguguucauuaaaaccacaaacagagcacaagugugagugugagcucucugagagcaagcgggaacagagcuuagaggcugcugggguggaggacagugaggagcugagaccugaugccaagacuggagaaggaugaggagcccaggguuaaaggaacugagccucagacucccacugaaccagcaagcccaggagaacaccuuagcuaggcuugggagagggggaggggggagugagaugcuggcagggggauuuagagaaacaauagcauauucaaauacaagugaaagccgauuuccagaugaagcugaaagaaggagcacacuggauaacacccagggaaaagggcacaagaaggaucguucucuucaucaacaggaggaggagaaucucccucccgagcauccugagcuacaucaggaguucaggaccuaccuaccuggacuagacaauaagaccuguuccagaaaugcaagccagaaguccccuccacccagcacaagaaaugaaaggaaaguuaaagagguagaaagaaagaaaaagacucaaugcccauguaauaggaauccuaaaaagaaaaaggggaggaaagaaaaagccaaagcaaauauuaaaagaccuugaaacaguaucuugaaaaggcaaauccucuagccagccagaccuagguaaagagaaccugucuuaguaaaaaauaaaaugcauagguccuaucuaauaaauaaacaaauaaaaugaaauuaacuagaagaaauggcauacuuggggaaaucaaccaagauagucaacucuaaaauauauuuuaguaaauuuauauuuuuaguccucugccccucuugcucuguguguguguugggggugggggguaugugggugucugagacaacugcauaagugccucuaccuacugagccaucuccccaaucucucaguauuuuuuaacaaauguauuugaauguucagaauagacuuguguuacuagguuuuuaacaaagacaugauuucagaagucaguagaguaauauauuuaggaugcuuaagggaaaaaacugagccuugagcuaccaaguuggccaugaguauaaaguccauaggccuugcagugauuuuuuuugcucccaugcacccaacuacacagccuaacugacuccggguagcauugguagaaguuucaaguaugcuguuugccuguacaauuaaucugccugcagaagccacugccauauaugagggcccguccucagaaauacagguaugcugcagcugucaaaaauagacugaguaaguacaugcauaaaaggucagaucaguauacugcuuaauuagugggugcugguugggaauugaugaucauaugcugauacagaggaaggaaagagugucaggaaaaauaagaauggaaagaaugugacccagaugugagguggcagcacacauugucacugggaugaaggcauucaauacggguacaauaugagcuugcccaaauaccaaagauagauugggaacgggucaaguaaagcaggcauacaggaagugaauacuuaugcacagguacuuucuguugcauucagggucaggggcaagcucauuagucauagccagaaaugcagacaggcuaugacaugagaaugagacuuucaggaugguuuaaagcauagcuaggggcuggagagcuggcucagcaguuaagagcacuggcugcucuuccacaguacauggguuugagucucagcauccacaaggccacucauaaccauguccaguucuaggggcuccaaugccuucuucuggccucuauggacuccaggcaugcgcauggugcacauacaggaaaaguaaccauacauaguuuuuuuuauuuuuuuaauuuuaaaaguacacccauagauuaugcuauauuuacauaccuacauaagauuuaaaauauaagauuuuaaguggacaagacauacagugaaaauaccaaaaccacugaaaaccacaagaugaaggacacaggaaaaauaccaauuucuuugucagucgguggucggggguucaguacuggagacuuagcacagagagcagcggcccaucucuuuacaguucucuccucuagccucugcacucagcugcagucacucacacugcugagcugagacacccaagacuacuuugucuguucauuugaugccuccugagaaggcugcaagagccagagcuaccuaagcuccagccacagcugccucuacauuagcaaagugcaggucucaaggcucugcccagagaaugugcugcccaccuucaguccuccacaucuaccuugagggaagcaauucugagaccaguagugccuuagcagaauucaugaaaccaaaagccaucuuaacggugcugcauaaaggaaaugccaaacccagaguccugugccagcagaaguacccuucagaagcugggcacaaauguagauguguucaguugaucaaaaacugagaaaauuuuccaccaguagaucuaaacuaaaauaaaauggaaaggaagaucaguaggaaaauuaccucagguagaaguauggaugugcaagaaauaacagcaaaauuuaaaaauaacuacuuagugacguggaguggcuggggcaccugggcaccucacucuggggaccauauaaaaaugugagguaacaguuacauagggacgaaagagcaauaagugagguuuaaagucccaacauuuaccuggugucaaucagacuguaagacuuacauguauacuuuaagccauaggcuaacuaacuuccaacauuauuuuaagaugcaguuuagcagaaggaaaauggaauagcauaaaguguuugauuaaauugaaggaagacaagaaagguaagaacguggacacaucaaacuaauaacacagacccagaagccacgugucaucagcuuucuaaacccagccacucccugcuuagaagggacacuuuaaacaucugaauaugaacagguugaaagugcagauaugaaccaugacaucauacaaaccgugacaaagaggaguugaggaucacugccuucagaaggcaccaauggaguuaaagugugucucauaaggagaaaggggucuaugguaagcuggguagggaccccaggugcccagagucugaaaguuaccuuaggucagagggaauucugcagguacacauuucagaguugagagaugaacuguuauccugguguacauaggaaggcacugugcacucacaggcagccuucaaggagggaggacagagcagauguaacucuguaccaaagccugugguacuguaggugaaggugaaaugaagagugccagccaccuccagaugccagaggaggaaggaaaugcuucuccucucaggccucugcuggucauggaugugcacagugaugcuaagcuuccuuucucgucuccagaacuaugcaaauaagcauauuucgguuucauuaaaucaccaagcuugagucaauuugacaccgccauaggaaguuaauuaaccaauacaguguggcugaguccuaguggcucaucaguagcauggcugggaaguacacacagugucaacauggacuugccgcaaagagaaaucgaugcacuccccagcuaguagguguuacuguacaccucagaagagcuguaaaggagcaggacugugggcagcuguacccuugaccccaauggcaugugcagaacaccaugucugcaagugacggccaugucuuuuccaaaugccugagaaagaggaaagagggucacagagcugauugguuuaaaaaaaaaaaaguuuuaacaguauuccaaaauuuuaaaucacuuagcauuuuucugaccaaauagauuaagcuaauaaauaaguaaaacuggaaagaaagaaagagaaagaaagauagaaagaaagauaggaagaaagauagaaagauagauugauuuucauauagguacaaagaaucuguaaacuuaauuuaaaaaaaugcuaaaccugaggaaaaauagaaaacaaugcugaaagauaugacaaauggaaaaauaacccacguucuugagaguagaguccccacaguguaagaauguuaguucuuccugaguuaauuugugauuuuuagccauaacaauaaaaguacuguguuuucuccagcaccagacaagcuaauuguaaguuuauccacaagacugaacaaugaagaauuaccaggcagacugaaaaagaacaguuggagagaaggaggacuuaaccucauauuaaacauaacgugaagucuuuaauuaaaacaguuuaauaguggugcaugaacacgcagacgaugagaaaggacaggaagcuaauugcauauggcagcucagcacacagaggcagcacccagcacaguaaaucacgugcuaugugcuagauaggaaacagguaagaguagauccauuccuuacacaucucuggaucagagauuuaaauaaguaugaaaacggaucucuuguaaggacacauagaauguggaguccugagaccugaaaguggcaaacacucccuggaugacuaacucagaauucacguucagugugggaagagguuaacaaauuacauaagaauuaaaaacuaacauuuucauaaagacuaugaacaauggaagugggcaaauuaaaccuagggauuauaguuuaaggguuuuuacaauuaauuucuaaggcguuccaagaagcaucagugucuuuggauagacuaaacgugauaggaaagagggcuaaugaaggagcagaaaaaaaaaugaaaauauucagacugaagcagagaaguguuucaggagaggaagugacauacuaacagacguggggcccccugcuggagagacagacugagggucucauugagaagagcagguugccaaggccacugaucuccacagugcauuggcagacucggcaguaaggcacagcugagacaaaagccauggagacauuggagacagucucacccuacuguggaggcaagaauucaaguuaucaacccaccacuggaagacaggggcuuccgauaaauaucccaggauuucaucuggaaggucugcagaugugugccuuccaagaaggacccaaucaggaaggagacuuugcccagugacauagcagccaaaacucaguaauggaauaaacugugaggagacgcucugugagaagauaacugugguuagcaccugccaccaagccuggugaccugaguuucacacacacguaacccaccugggacccacauggcagaggagaagaccaaggccuucaaggugcacgagugcuacagcguguguauauguauaugcauauguauauacaugcacacacacacacacuaaaaauaguaaauaaauaaauagacaaauaaauaaauaaaugcagacugcccucauaucuagugauauuuucaaugaggaugaacacuaaacuuuauaauacaauguaucauuuguaaagaagauaaccucaucuggaaccucagcaguauuguagacaaaaugucaaacccuccacaaaaucauacuacaugucuguagguugggguugaaacccaagagaaaagaagagaccaucaacagagacuuuaaggagaucucuagugucuggaguuaggacaaggacuuuaaaauaucagaaaucaguauguucaagacagaagaaaaguagaaacaagauuggaaaaaaaauucucuagagaauuaaaauuugugaggagaaaaauuauauggacuuuugguggcugggaauuauaaaacuugaaauuaaggacuuaauacacgggcuuagaaucagaaagaaaaaaacaguggaaagcccagagaugagaaauaagauggacaaacuauauuugaccaacaucaagauuguucucuguagcaaaugguauuaaggacaugguauagccacauggaauaaacugaagcucaacucuuaccgcaaaucuaauggcuaaaaggcuaagacugcagugucuuggaagugucccugggacuccugacccugggcugugacaccaggggcacaggagugguaacagcaggauagacuggagauuucuguggaucaccagcacagggggcagacugcaaagugggcggcaguacugcaaaucauccaacuaacugauaaguuaauguccaagguguaucagaaagugcucccucucagugagaagaacugaaaauucaaccuaaaaggguacacaggguuuaaacagccauuccuccaacgauagcaugcaguagccacaaccaggaggaaggaaagcauuccacaucacuaaucacaggaaaugugacuaaucuguuaggacaguagcauaaaacaaaaaaguauuagugaggaugaagaggaauuguaaccuuuguaggcuguugguaugaacauaaaaucuuacuguugcugauggauaaaacaaacaaaaacauaucauaggucuuccuaaagauaggugugccuaaggaaccagcagcggcacuccgugguacauauucaagcaauugaaagaaucaucucaaggaaauccuugcacacucauguuugcagcagugcucuuccaucuagccaaguaggaggaucaguaacaaugcccaacaucggauagauggacaaaugaagcauaaagaaacacagugacucagccaccuucuaccacauaggucaauuucaagggcuuaugcuaauuacaauguuagaaaaagucaaaaacagaaugauucuacuuauguaucagaacggcaagacacacauaucagacguuauaguacagugacgguugccugccagagaccagagggaaggggcugcuguuuaaugcacaauuuaaauuuucagaugaaaacauucugcagagcgauuauauacagugugagugcuugaaacacugccaaacuguacauuuagaaaugaugaucaucauaaauuuuaugaagucagaguagacaaugaaacauaagauuagucauaggagcagagacgagacacauuaagauguguuauuagaaaauacccaacguggaggauaaagaguaaagaaguuucagggaccuucagggauguaaggguuuaaaagaugugagacaaccccccaaaaaagaacaaucaccccuccagggagaagagaggacagugccgaggcaacacuuguagacgugggaacuaagcauucucuagcagggaugaaggacguucuuccauagaaucaaagaagucugugacugaaaacuaugaagacaaagaaccaucaguauaacaucuuagugaccauggacaaaagacagaggaaaggguaucacguucaaaugaacuacagccagccucucaacaggaaggucaaaccagaaacacuuacaaauacaaaccaaagcccaaagaaaucacaccuagaaacaugggucuuaaaggacuaagauaagacauuggagaggauggacgcagacaacggcuggugggaaaugaaacagggcaguuacuuaguaaacagguggcagcuuguuacggucuaaaucuaucugacucagcaagauuacugcugcacccuuaucaagagauacgaaaacauguguucacaaaaguacucauuacaaaauguacacaaucagucuauucauacuugccaaugaaauuggaacagugggauuguaucagaagaaugaguaaacauuggcauauucauaacuggauacuauuuagccccagagugccaacauccacaaaacccaaaauuacacuaauagaagaaguugaaaauggggagacagcucauuugguaaaguauuugccauauguauuagucagaguucucuaaagaagcagaacugauagaaugugcaugcguguguaugagagagagagaggaucaaaugggaaucgauuagauuggcuaagacgauaugacugagguaauccaaguaugcuuauacuagagaagcugagaguuuuucaguucacaagccuagacauagcagaaguccccauauggcacuaaggccuauagagucccuggucuuuagccuguauuggaacucagaagcugguucaaaugucaguuaagaaaugaugcagcaagcugggcgugguggugcacgccuuuaaucccagcacuugggaggcagaggcagguggauuucugaguuugaggccacccuggucuacaaagugaguuccaggccagccagggcuauaaagagaaacccugucucaaaacacuaaaaaaaaaaaaaaaaaaaaaaaaaaaccgaaaggaaaagaaaagaaaagaaaagaagaaagaaaagagagaaagaaaugaugcagcagcagcagaauagauggacuugccagcaagacugaaggcaagcgggcaaaaaccaaaguguucuucuuccacauccuuuuauguggguggccacgagacggugcuacccucauuuggcaugggucuuccugcuucaaauaaucuaaucaaggaaguucuucacaagaggagccagaaguuugcauucuagagcuggucaaguugacaagucagucaucucuaguaaggucuuuucagaccaaaggaaaugaucacagauggaggcucagaaaugcaagaaacaggggcuggugagauggcucagcggguaagagcacugacugcucuucugaaggucaugaguucaaaucccagcaaccacaugguggcucacaaccacccauaaugagaucugaugcccucuucugguguguuugaagacagcuacaguguacuuauguauaauaauaaauaaaucuuuaaaaaaaaaaaaaaaaaaaaaaaaaagaaaugcaagaaacaacagagagcaccugacagaaucagcucugggcauaaauaaggagguacaaaugaguagacagccccccagaagucacggcugcaggagugagugcacaggcaagaggcagcuacauugauagguuuaggguuuugguccaguucagcauuucucauucacacauggccucccucagaagggcauggaacaggaaaggcagugagcuaccacagcaguggauguguacuuccaaguaagcugcacagcagauuauccucuaccuaaggaacaaaucacacgguccguuguagcuucggucucucaaguuccauauaagcauccauucuccuguaguagucucauggaccuagaauccugcagagucuggggguuuucaugaauuauagcccugguuuauuauaguuacccaauccagauacaguucaccgcccagggucauuuuuacuauaagcucuguugccuauaaccaccauuuauuagaagaccuaaaaaguuaguccagcauuguuuccauuguaguacucaaacuucaaggcacgccagagucaugaucuuguuaaagcauauugaugggcccgugugucccucucccauauucagucagcccggguccagcuugcuugagacuugucuugccucuguguucuccggugacacguauggggugacacuguuggucugaggcucacacuaagaaaccaguguucuuacuuagcacagggcuggagaaccagcagccgugcucccuuccuguugaccaugggcggccuagcaaagagcucuguguucucuugccuucaacuuuuaaaauagucauuacccuuuaguauucuucaaguagccaucuguaauuaucuccuuagggaauuauugaguuugcauugccauuaauuaucaccagcugucagcagaugacacuaauuagacuccacuuuggguucagaucgauaagcaucaucagacccccaagacucucugagcuuuccacgagugauacucagaggucucugcaaaggcuccuucugugccacccagcugcugccaucaccacugcagugugugcuugguugucacgugguccuguuugaccuuguaagcugguagaggaguccucccuccuucugccccauuucccaggugcaggcucauagcgaugaguccacaccgucugguucagccgacagcucaaccuggugguggcguguccucucacaguguggauuguuuucuuugucauaugcaagcaguuuaguuuggcaucgucucaguuaccuggcuuccccuugucaccugugcuuuugaguucuccgucuuuaaaagcuauugucaguguggagcuguccucugcuucuucugaugcuguuacaggccggucuuccauuugguacuaauagagguuuuguaugaaaagggcugcuaaaugaaccccuguccuccugaaucagaacuguaagggucucugauacaugguaucauuccagacuucauccguggggaacugccacggugccuggccccgggcuaagaagcgccucugcgucucagcugugauauuuuagcucugugucucagcugugauauuuuagcucugcgucacacugaaaagaaccaggauuccuaggaaagaucccucuuuuaaaaagguuuauuucucuguguuuacacguggauucuugagugacucugugugcagcaugugcaugcgggcaccagagaagccagggcaugcagaggaucccugaugcuggcguuguaggggguucuuagcugcccugugagugcugggaacagaacucagguccucgcaaaugcaagaccacagagcaucuaucgagccccuagaaauagcuuccaccaagucuaacaaagaaccacccaaagacagcagcuaggucuugucagaagaacucagaagcaacuuauauaagcucccauuggcuaagcccaggguaaacugggugacgggguuuaguaagugcagugaaugggacuuaucacauguauuuaaacuaauaacuucgcuaugauaauuuuuguuuaggguucaugagaacaguuuauuuaucaaaauguaacuaauuagaagaauugugugcauguauucuuccuucuaaguugguuguacuuugauauaaauaaauaacugacaaggggaacuauguagaauguuccaacuaaaacaccaggaaugagagccccugcguguuucagguguugucacgcucacggauguauggcaguuacugguugcugucuucguagacugauggcgacacaguguguguggacuguuuaaaguuugcaucacuaucugaaaauaguccugcccuuacuccucccuaagaagucacaucagagcccagccuuguccccaguagucaauggcaggcaguguuggggaaaggaacacguuaaacggaaucacuggaagcaugcaagggucaggaguggcuccauguuccacagcccugccucuucacagacacaauagcugaggagaaaacuagggagacuccagagaucagacgaggcauccggaacgugucagccaguugcaguguguggaccucacuuaagcuauuacuauucaaacugugaaagcaaagcagaacucucauaauccaauugggggaaauaugccaacugaauaauugauggcauuaaagaauaaguugcaauauuuuagauacaaucuauuaaucauaggcuuuaaugugaguuuuuaccuuagcagaacccuaaaaaauuuauugguaggauucugugaagccugggguuugcauccguuaaacauacuggagaaugcugcgugugggaugaaaacgggcugcucagcacagaagcuggugcugagcgcggggaucacacugcuuucuuacugcgugugugcacaggcaggggucaggccacaacuugcugcuugguuuucuucuucuaucacguggguuucaaaaaccaaacucaggugcucacucuuggcaacaagcaccuguaccugaugagccauuuugcuggccuggcuuuauacuuucuacguauccauuauaauauauuuuaaagaaauguaaacaugauaaagucaaaaacaguuuaauagcaacagugaaaacaacuagugagaugggaaagguuuuucuuuugggggagggauguauuuuugaaagaggaucugaugcagcccaggguggccucaaacucacuguauagcuaaagcuaaccaugagcuacugcaccuccugccuucacuucccaagugcuagggucacgugugugccccagcuguaaguggaaugauuauuuaagaaguuuagucacacaguggguggauagguuagaugaaccuagucauugacuuagaaacuucacguaagaaaucccaucacuccucugcccagagaguuccuggacaucggaccccuugcuggccuucuucaugaagcucaggccucccccgugaugccuucucuauccagucuguuaacucagcaucacacuguugacgcugcugcaccucuaaguacaacaguggacuuaacagccagagcauugaaugaagacauaagucagucaguagaaaggaaugucaugugucccaaauggguggguacaaagagacccacaucuggacacaggauaauaaaguugccuaacaacagugacagauaacuuuaaaagcauuuuguucagucgaggugcugucaggaagacagagaagacacuagguguuucagaaaaccaaacuuaauuuagaaaacagauuaccuuguuguagaaggauggaaagggaggaaggaaauacugagguaaaccaugggcaacagcuauagugaguccucccagccaagggugggagacagcaagcggugugggggggaaggggggcucugcuagcuuacagaucuacaggaagcggucugcaggacucuaacaaacuccggcugcugcugaggcacagugagccuccuaggggagcugauugccccccagugauuacugggaugagucuggguggcaggaaccugggugaacaggaagagcaucccuuuccccgccagcccucccauccccuagggcagauguuugcagaacauaacaggaagccugcuuacaacagagaaaggcaguuuucagacuuagagccguaggaccacagugcagauuauagaauuaggcuuugggcucgagacagaaaagcuuaauaaauaucagugcagccacucguucauuuacccauucaguggguauuuacugagggcuugguuacugugugucacuugcuagugcuuaagauaaaucggugagggaaaccugaagggucucugacuuuguggagauuaggaaaggacacaucgccuacagagggauagugacugagggugacagccugggugaugggaccgucaaagcuagaugacaauucugaaaggacacagacccccuagaauuauaugaccuucugugagggaaggauaaagacauuuagagauaaaaagcuaagaaaaguucacauuccaagacuccugccccaaaggaacucuguguaauagccaccagugcauuaucccaagacacaaaauuugcuaagaaguaagaugauaaaguuacaaauacagacauaaccuauaaguagugguuggagauuuuaaaagaaaugacaaaacugaaguccuguagaguuugguacugugacgaaaaccuaaggugaacugcuuaaagaaagcaagacuaggcucucuagaggcugugugagcccagcuugagcuucauagaaagacaccaucuuaaggagcagaaggagacuguguccacacugggccuagcaugagcauaggagacaucaaagcccacccccacaguggcucacuuccuccagaaggccacagccacuacaccuaagccauagcucuuaauagugccacucccuaugccuaugggggccauuuucuuucaaaccaccacaaccaucugucuucuacaacuucuucuacuuaaguaaaauuaaacuggaaguuuguagugugaguuuguuuguuuguuuguuuguuuuuuaaucuaaauauucucucuaaacuuaaggcaaaguucauuugccaaacuuucacgugguuguuuagagugauggcagcuuccucggguucacaggucuguuaccugguugccaaauagcuaggcugcuuccaguugccgugcaucuguuguuuauucuguucaaguaaacaaacauucuuaacuuacucagguggauuuaugaccuagaagguggucuugguaaauauuucauauacuagaaagaaacagcaucugcugugaggugaaauaaucuagaaagguugacaguauuguucauguuuucucucucucucucuuugcuaacuuuugccuacuuccaugaauuacugagagccacauuaagcauccagcuguaauugugaguuuguuuauaucuuaguucugcaaauucuguuauuagguucagaacucaauggaauagaaaacaaaacaguacaaucaaugcuccagaacuuggguuuuuuuaaacaauuaggaaaacuuacaacaaaauugauuuuaaaaaaucauaaauaacaaacaucagguagaaagagaaaacugcagcuauguuauguuaaagaggugguggugguggugguggugguggugguggugguggugguuguuguuguuguuguuguuguuguuuaaauacaccuggggcugagggaguggcucagugguaagagcauuuguggcacaagcaggaggaccugaauucaaauccccagcacccacauaaaaaacuagauguggccaugcacaccuacagugccauggggacagaggcagaauugcugagcugauugccugcuggaaguugucuaaggaaauaagguugaaaauaaagccugaaauccccucaugccucagugcacagggguguguguguguguguguguguguacauauauguguguacauauauguguguguauauauguacauauauguguguauauauacauacauauauuacauaagcauauaugccacacuucuacacacucacugcacacaugcagauuaaauaaauaaauaaagguguacuuacagcuuuaugugaauacauuugaaaacauaacuuaaauaaauuccuuuaaaauguuuuaccuaaucugauuuaagaagaaaagaaacaaaaauaaucugaaaagucuuaauacucucaaauaaauugagcaguggguuaaaaaaauguauuuucaccaagaaauaucauacagaggaauucuaccaaaguuuugguaaauacuucaaucccaacaaacagacuuuggaguaagagaaaagaaacaauuuucugauuacuucuuuaggucaaacauaguccugaaaacaaaacuggacacuugaagauguauauuauaugucaacuuugaguugcaaacuuaauuuuauaagcauaaagguaucauaagcaagcuauugagaggcuggggccaguaacgccuuuucagauucauauggaccaauguggcucauccaagaaaucaagugguagagcauuaggaaagcccagaguuuccaagcugaagaagguucugaaggguagacugcaaaccacagucccuguccaugucugaaccaacaacucagaaugagcagccagggaccacaccgucuauauagcauggcuucugagcuaacaccuagggaggaagagaugaaaauaagccucucacuucaagggaaguauaugaacccuacacuugccagccuugcauguguauuagcuacuucuccauggcuguggucaaacaccaugaccaggagugccuuacagaaggaggaguuuaugcgggcucaagguuccaggaggcauggcugcaggcugcuggggcaggaagcagauagaucuccauccacccgcaggaaagaccgcaaacuggaagagaugcagggcugagcucuaugcccaccccagugguaaaagcugaaagacauuuuaaaggaccuaaauagaaagaguguuccuggguucuacuuauguucauaaauauuuguauauuuacaugcaccauguuugugaauuagaaaacacacacaccauucaccugucagccugaccugcagaaucaaugcugacaaccugaagaugccgacagcuuugaaaugauagcaggacuucugcacuggccagaugauggguaccacaggaggaggugcuugccugcccucagagcccauccccauauccuaggggguaacagcagagaagaagcucuuugaagcuguccucugaccuccauagcuaggccacgacacacacgugugccaugucacuuaguaauuuaauccuuuuuuauucuaaaaaaauguuuaagaaaagcagaguuuuuaauuucuaaggaaaaauaaggauuaaagaguagacaugaauucuuagugcuacugauagucagaaucacagacuaagaucccaguuaaguaccauuccacccaugauacacucagauauaugcuucuuggcucaaagauguuaaauagagcagggacacaagagccacucuacugugcacuuugguggccuugcacaggcacacagccucucugaaccaaggcagucucuaaaaagucacaugacaguagaacccagcucaugguuagugauugggcgugugguugagaagacaaacuguagccugucguugcuuugcagaaucagacauccuggguccucuccagcauggcagcccucuacuggagagugaaaggucaggggaaaaaagccauugacugccugcgccaggcccuccacuacgcuccccaccagaugaaggugagugaggggugagggagcuuccucgugcucagccagugugacauuggcauacuuaggugagggccagaaaaaugguggcccguuacuauccccaccucacaccuguacaaggaaguccucugguugagcaggccgccugcuugggagucauucugguguuagcucauccccuguggguuuggccagcccccaaagugcuuccuuuccuaucccuuuguauauauuccuccuacacacacaacccgccaaccuuggaucuuuccauagcacccguuguuaaugguggcugagagcaugcaguuuauuaucagauucauacugaguucugcauuaauauagaugcccuacuuuguacagacccagucuuaucugcuugucagacagugcacaggaugucagaagagagccgcuucgcugagggcagcucuggguucuaagcucaacucugcucugcacuaguguucugaccuaggcccagacaugaccacugcucucagcuaaggacaugcacucugcgguuacccagugaggacagaaaugaaccccuuuuguccaugucucccauagaacccagcacagggcgugacugccaugcucagauaacauguuuaaagggggaagcucugugggaacgaguguugccaguuguucagucugugcuucacaccgagggagcagucaaggcggucaggaaggcauuuuggcugugcgggccagagagccugugugcaccugcuggccuugcauguggugugaagacugucacagcagguaggggagggaucccuccaggcaccgcagaaacagguggcuggcuggccugugggcacaagccugccagcugcuguggauggcacaacaguccuuacacagaagcuggggcuggagcucagugcaggaacauuugucuagcacacgcaaaacucacucuggagcaugcgcucgcgucaaggcuugacucaggcugggucuguggccaggugucuguucgccaucagaagcuggggucguagcucaguagaagagccuuugucuaacacaugcaaagcccuggguugaauccagcaccaccaccaaaacaaaacaaaacaaaacaaaacaagacaaagcaaaagaaugcuucucacguaaggcuuugccaguggaaggguuuguuggcuuuucuucuggaacaagcuauuuugcugucuacucauugacuguagcauugucagaagugaagcucacucucccugcccucccuccuccccaggaugugccccucaucagccuggccaacauccugcacaaugccaagcucuggaacgaugcugucaucguggccaccauggccguggagaucgcgccacacuuugcugugaaccacuucacccugggcaaugucuacguggcaauggugagacugggguggagccagcucaguccuaaugcagaacuugacuucaaagcuuauuuugaauaugucacucuccaguuucccaaaaguguuaucuccaaaaucagcaucuacacagacagaaaguuuauccgcaaggauuugaggggugguugggugguggugguggugguauuggugguauuguugauguuguuuugguuugguuuuucuauaacuuuauuuagauuauuuauguguuugacuauuuugucuacauguauguauguguaucauaugcuuaccguacuuggagaucaguagaggaugucagaucccugagaacuaaaguuguagcuaguugugagcuaccaaauggaugcuaagaaaugaacucagguccucuggaagagaagccagugcucuuuggcccgugggucucauuuccuuaaguaacacuugaugccaucacagcaucuaccacuccauagcucuucaccaugagcuuuauggcacagugguguuaccauacuaguuagucuaagccacuugaacugacucaagccuuugucauucauucccucuagacucugagccccucaggacagagcugcucuucuucacgugcaggaaaagauuagguacucagcaaacaaggaugaaauucaguagcuucauaguuucuguucacaagagaaaaugauaacaccacccuccagguuuucaucuagucagaaaugugugugugugugugugugugugugugugugugugugugugugugugugugugugugugugaagcccaggguccuugcacuugauaagcaagugguuuaccauugagcucuacaaccccagucuugauuucaaaacucaaaaccccagguccccaccaaccccggcauaaccaucuauaacaugugaaccaagccaucugcugccacgggggaggggcaguccccaggcugcucuccuaacaggucauggagugaaagcucugggcuguaagcuaugugugcgucaucccugacuucugaggcaccggguccuggccaggcuggcggugcugaauugcagccucuccuguuucuuaaaacugaagacuguuuuuauccccaguaacugugaaauuugcugcugugagugaacaagucugucucauugugugagaaagccacugaggcuguccugcucucuucuauguagaauuagucugaguuaagagaguuaugugcuagauauagcauugaucaucucuaaauguuuuaaguauuuggaaaaauaaaaaaaauccugaacucauacagugcuaacaguugcccaaguucagcuccaucaugcuggacaugguagaaaaucaaagcagauacacagugagauucgccaggccucugucuagggguuuaggaagccuauggaaaggauguuguaaggccagguaauaguggcucuuaagauggcuacugcauauuucaagccaauagaggccaguuuucugcuuucugcuuugucuaugugcucagccacugcuugcuuugugguucuucugcccuugggaugaaacauacugcgucgccucacaccucagcuguccacagacuuaaauccacaucaaagucaugguggguugucccugaccacagccauguuuagucagguagugucgucccucacaucugcuccuuaucccucacaggaagaauuugagaaggcccuggugugguacgagucaacgcugaagcuacagccagaguuugugcccgccaagaaccggauccagacaauucagugccaccucaugcugaagaagggccgucgcucucccuagagcacuccuuccugucccucggcucucccagcccucgucagaacagagccccaccacugcugguacccgcauggaugaugugugugaauugccaaguaaaauguagcagagcuuggccuugcagggccagcuggguuugcuugguuuuaaguuccuccucccccagccgcccuccgaagaagcaucuucagaaacaggguuucccagacacuguaaauacugagccaggacaacucggagcuccgcucugucuuccaaaccuccaugccuucaaggcuccucugugguccagacguuucccuggggaggccagagccacgcugcccauucucugcuuccuguguagccuccguugucccuggaaucgcagugcugcccggggccagucagugagaagcagggauucuccacguccccaccagcucuccucccugacccagucucguccauuccacgcugcuauguuacaagcucucagagauaguuugcaggggaggaaggggaaacaacuuuacaaacgaaauauuuacaacagcagaaacucuuagggucagcugaccuuuguaaguuauuuauguuggggugggaggggggcugagcaggggagucagccaugugcaacaucuuuaucauuuguauuuuaauugccgaucacaaggaaaccaauauguugaaguccuauauaacagguuuauauauauagaauauguguauuugaagcccucuacagacugagucuguguuacuaauuccuuguucgcuguguuuccugucuuggacuaggcgugacugucagcccucucucugaggcuggcaccccagcuccucagaagagagccaggagccaagguugggugucccauacagugcccucaucuuuggucccuggagaaucaaaaacuccaacauuuuggauucuuuacgggcacauccugagaacaaaaauaaaaauuguuuaugagcaaaaucau

SEQ ID NO: 939 - RNA, 6320 nt, Mus musculus
acaguuaaucuuccaaguuuacuauucaagucagaaauucagaugacauuucuagugguuugcuguuuugguuuuuuauguuuuuugguuuuuuuugagguuucauuucuuacacaggugucuucaucaccaucacuucuacacugggggaaaaacaaucuccuuugugagaaucacugcauguauuuauggcgaaaauauuucugaaagucuagagugauacaagugagcacaagaaguuggucagcuugccuauggagugcuggcaauaaacucugaacauuccacaagccugagcugaaccuaggcucccuuggaagcugaacagacauaggaacaugggauugccagcugaauccugugaccaucuaguuauggaccucagagauagaucagcguggccuaaagccauuucaaguacaaaaaugaauuggacuauagcaacauaaauuugaacacaguaacuuuuccucuuugccugagggcauuuguaaacucggcagaaguaacuugaccucaugucuacugcagagcucacugcauucaccccuccucauccuuugcuuccuuccccuugccuagucaguaguucauaacuuaguguuccuuuugcuucagaaaucugaaagaaaaucuucaugccaugaaucuuuuucuuccgcaaggacaccugugucucccuuguuuaaauaaauguaaaugcucccuuaugcuuuugaaauaaauuuccuuuuguaauuuuguuuugugucuuaauguguuauaauuauaacuuaggauucuugaguuuuagauauuagcauuuauugauugcuucucauaugguaugcucuguugucaaggucagucuuaaaagccaucugguuuggauauauuuuuauacguaaauacagucuucuggaaaagauuccauucugacaaaacagcaucaggagagcugaagcaugcaugguguccugugccuauaacuaucaggguaccaagguaggaggaucacaagugauguaggcuauauagugaggauggaagaaaauaacagauucagugacauacaucugcaaucccaguaagcaggaggcugaggcaggagguucaaguuugaagcaagcauaagcuaauaaaaaggucuauuaaaaauaaaaacuugggccagcaaaauggcucagcagauacaaggaguuugcugccaagccuaacaauccccacuuccacaugauggaaagaaccaacucaugauaguuguccuaugaccuacacacacauaaaguguaauaaacuuuuaauaaaugccuauauuagauuacaaauuacaacaucugucccaguuuugagacugcgaaguaugguacugcucuugcagagaaccccaguuuaguccucagcacccacauaggcagucaugccuguaacuguagcuccaauggacccagcguaugccuccacagcagacaacugcauucaugugcacagacccacaggcagagaugugcugauacaauuuaaccuuuaaaaauuucauauugaaagaucaaguagauacauuuccugguauauacugcacuaaagccucacagugugaguguggcuggcaauucucccauuaugacuuuauauuucucuagguuucauggaaggaaagaagugcaauuguauggaagaaaaaaaaaaucagugcuuaaacaggauuuuuuuuuaagugacaugacugccuagcacauaguaacucagaagcgguaauuguucagucaugguuuggaugugaaaagggccuccaaggcccaugcguugaagcuuggucuccaguauucagaggugggcuucagguaagugagugagucauuagggcaccagcccaauacauggcuuugucaaccagaugaauauggaacauggagaaaaucuugucccuagccucuuuguaucuucauuugcuucucagccuucugucacagcucugcugccauaauccucucccucaccaccauccagucaugagcugaaaccucugcaacuggaaaacagaauaaguccucccuuagucuaaaguguuugcaccuuaagauuuauuacaguaaagagaagaaaauagcacaugucuguugggauuuguaauuguucuacuccaaaugggaaagcuacuucuugagaggaauugggaaaacccagccaaaaccuaaauacagucaagauuuuaaaaaaauguaaacauaagaaauuccuccauguuuagcagcuaauagacuaaaugagcaaagaauuuuaggucaaccagcuuuucccaguccuuucuaguucuucagaaccuaaauuggagacagaaaccuggacauccuugaaaacccuguggugugugcuuguuucuagaauagucuguucuuguucuacauucuguuacacccagaauacuaugggaucuuucaaauguaguauaacgggacaauucccaucugccuugaaggaaaaguuugauugguuucuguguuuccuaccuucuuguaauuguauuugcuuuuccaaguuuguguauucuguuucacuagacuagaccuaaggaccuuugcagaaauuaaagaguuuuauacucaaaauguagaaaauacuaucacaaaguagugugguaugucauuagugcuacauucagagguggcaagaaacuuggcaucuuuauacacuaggguugaccuguaccuuaaguugaaggaaagagcauaaguaaaagcugagaaaggauaaacaaacacuuuucucuguacuggggauaccuaaagcaagaauaguauucauacagacauccuuauauaccgaauguaacauuuuuauuuauauuuuaauaccguaauuuuaaaagauccaccuagacuauggaggauacacguagcuacgucacuccuaagauucuguuauuugaccaaaguuauuuuugcuaauguaauuagucauauauaagcuuauuugaugcuaguccuaagggaaauuguucacuuggauaaucuuagcauagaaauucuuuaaaucuagccuagaaaugaaguaagucagaguuuuaagcaauggagacauucucuugguagccuuaaaaguacuucucauguuaagagggcuacaugguaggaugaaguggguguuuugcauuaauagccagucaacauccagcaagauaccaacuaugccaaaccagauuuguguuccauagaaacugaaauaaugguuuaaagcuaguaaguuuauagcaauuaguuacacaacagaaaaacauggagagcucucaagguuugaaacaaaaccucaucucaaaggacaauaauuaugaacuaggaaaaacaaguggauaaucuauugaguuuguagacguugauauccaacuccuuuccaauacuuaaaugcccaaaaaauguuccugauagcugaaauauguacuagagauucuauacaaccauucauucugggguucaggaaucagcuagguauaauaaacaauuauuaaauaaugggcuagagauacauagcucauuaguaauaugguugacuaccauaugcaaggcccuaggcucaguccuuagcauuguaaagaaaaaaacagauaguauacaauaauagauggcuacaccuaaaaagaugcugagaaaaagggauuccaucacuuguuucuacuuuaaaacucagguuacaguccuuacugucuauauuuaaacucaauacgacacauaagagucccuuacaacuugacaccagcaucaccuuuaccaaccacacuuuccuuugugccaagccuuuuucaccugguuguagcucucucuacacauuauuauuacauucucaucuguauuuuaauuaacuugucaacaucauagcuuacuucuuaauggucauauuucugugcccauguaagaguccaaggaacuuagcuuacuggggauccccugagcaaaccauguggagccaggaucaaugcaaaaagcaagaggaauuuauuguuccagugcacuggggucgucccagacccgaaggagaggcggagcagcacccguucagugaguuuuuauaagguuuccaggaggcagaauagagcaucagcaacuaggcacaauaugauuggcgaaacagugcacccuuuaaacugguuggucuuuagggaaugagguaacaaggacuucccuugucugaaggugggcaacaguccauccugucgguuccacccuguggucugagaaauguuaauuaaccucucccuucuggaggggcaaguguuucauaaccuucccaaagguccugagcugaccuuuacacccagucucuacaggcaaauauauacauauguguguguauguguguguacacauacguacguggguguauauguuuguguaugagaacuguaugccacauguauaaaggaggauccccuagagcuggaguucuacaggugguuguggccuaacacugcuuccagggaagagcaggaagugcucuucagcccugagccaucuuuguagccccaagccaucucuccagccccaagauauaccuuuuuaauaaaacgaauguucauuacacggguacuuuuaagaaaagcugccuagugagcugggccugaugguucaugccuguauccagcaucaggugguugacacagguggacuuaaaggccugccugggcuaaauaaauuccaggcaauucaggcugcaaaugggacuucauuucaaaaacaaaacaaacaaaaucaacaaaaccaaacugcucucagaagaauuacaaugccauagcacagucucuguucccauaacaugaggcagacauuuguuuccugcaacacaucuauguagguggcagggcacaauuuuuuuuuuucucaacagaaaaaaaaaaaagcauaacagcuuuguuacaagaugauacgcccaccauacuaguaggccgaccugaaauaccuauaauaacauacauuggcagagccuggaaccuaagcugguuaacagcuacuguaccuguugguagugcgccucuuaaguuucaauaugcaaaucaaucaccugagacuucuuuaaaacauacucauaauggcugagucuacccucggggaagggaagccgcagugcuuacauauuuaauacaguccccuccccggagaugccacuaucuggguucuacaccuaggucuuuaacuuagacuagagcugcccaccaaaguccacaagacacguggugcugcugcuguaagacccaaaaaucuggccacacuggauguaaguggucuguaaggacacaucgcuuucuaaauuucggaagaaaaaguaugccgaucacauauacauaacuuguaaugagcugauauuuuguauuugauaacgagcuauuuuuuuaauucgaugugugacaugcauuacacaguacgacugcgccgcuuaacacuccauuacgagacuuauuaaaaaaaaaaaaaaaagccucucucagauaguugaaaaguauaacuuuuauugcccuaccagaaacaauacuuacuuuuuaaaaagaccuucaccgucuucucacuucugcucaagcuccaccuaguuuuauuaucuccccuccgauucccacgcuuggggaucuuauagccuccagaaaaacgauaacuagaaagccguuuccagcccugagguguggcaggaccggcuuccccgaccgagaguaaagggaccgguaucgucuccgaggcacuccgcgggcuccuccuccaguuccagaggcgaccuccccaagauggcggaccgcaaggagucgcuuccgcuuccggugugagcagcccggccgggggggcaagauggcggcggcaauagggguccgcggccgguucgagcugcuaccucgcuccggcccggguuggcuucucagccuuuccgcuuugcugagcgugguggcucgaggggccuuggccacuacgcacugggucgucacggaggacgggaagauccaacagcagguagcggccagggugcccccucucugcccgcgcccgaucagggggaaucccggagccgggccccuggguggcuccgcgcggccccgcccccagcuuggcuucccacggucccggcccacgggccgaggcuuccugcgcuccgaccuggcgccgcccccuccccucugguccccucgccccggcuccgccguggggaacuucucagccuuccaccuuggggccgcgcgccgucccggaaccgaccccggggagcugagacuugagcucccggguuaggagucacggauucaucauuaguucugccuuuggagccgcuggaccaggacccgcgcgccaccaccucuccccgaggaagua

SEQ ID NO: 940 - RNA, 27646 nt, Mus musculus
cgggccgcucccgacgcgccagucucugcguagacguugggggcgguaccgugcuguacgcggugacugguggcggcccggcggcggcucccggcguacuagugcggucgacggcucagauaaguuccguggaggcggcgguggcgccgacgagguguugggcgacgggagcgggcccggaacuuggcgcucagcaugccgacgguggaggagcuguaccgcaacuacggcauccucgccgaugccacggagcaagugggccagguagguccccgcggccugcagggccggccgcucgggucugggcucccgccgcgcugggccgcgucgccgggcgcgcacucgggacgggaacgcggccucggccugcuugggagcgcgcggccccgcagcacggucuucccgcggucucccgggacccggcagucagccgcgccgccuuucccgggcuguugaugaaauggaaaguuuuccucaagagaucgaaauugucgguucuggaggcagaaguugggaaagaucuagaaagagucggaugcaggguuugugcaaagcguggacgaggcccaauugccuggacuuagauaggaacucucacacgcggcggcggcggcggcguucguuccgagcgccuuuuugcgccugucccgcacccagcuguggcgggcguuggaggcgcgguagcggcuucgcgcucucucuggcgauuagcgaugcgcgaggaaaggacacgcguuuuguauuauuuccaguggaagaguuuugugaagaaagucacagggagcagcaguggggaggggaaagauccagccccaaauagaacguucugggaagugcucuccgcucccuuggccccgggcgcaguuuucuuaaagcuguugaguuguucuuccaagcuuugacaccuuguguugaaccugaauuggaaggucaugugcguguccucuggggaaagaacucagucuggccaggagguuucagaaauccauguuuucagugcuuagaugcuuuggugaugucucgguguguacuucccacagcacagagagagaaaaacauccuugagcugagugauggaggagucccuuccgguuccuuaggacgugugcaauucaagcagaaccucccuaaguuuaaggggaaguggaggagggcguuguaguuuaaccuaguauugugaauguaccggcuucaaaugucagacggccuuccuucccuacauuccaugucuguggggacuuuauuuucagaaguguguagguucgccuucacagauguguaaacgcuguuaggccaguuguaaauaaagcaggaauuuuuuuuuuuuuugucuugucuaugacaaaaaggaaacuacgauggucagucagaggaauucauuguuucuaggacaauugauaggacagacuugggcagcauacuuuuguugauuguuugugacagaguuagggaggaguguagcugauuguucuaccaaaacuuaauuuugccgcacaucaccaagagaggcuagggccggaaccuagaauaggaauucuuggccaauauguggauggugcucuccuaaagagagaaauugggaaaacucugagacuguauuuccugcuguuguguccccuacccuguauuuugcugaaguaggaaaaguguguuuugacagccauuuacauagaguacauuagggcagauggaagccaagcucauuuuguauggggagggacagguaucccuuuguggaaugcuugcaaccacauauguuuaaguugcucucccuuugccuuggguuuuggaauauuguagacugcacggguugaucauccccagucuaaacuccagacugcuccugaaugugcaagugucagaccucacugugaccuggaugugagaagggagaguugcacagauccugugauacuuaaacauuuuuaguuucguuuuuauugaguguguguguguguguguguguguguguagcuagucaugugggucugugugugcacauguauguggaggccaaggcugacauggggugucuuccucauuuccuauuuaccuuacucugagacagauucucugagugaaucuggaguccauccauucuaccagacugacugacugucagacaagccccgcaaacccuccugugccugccacccaagugcugggauuauugauccacacugugaaccaaacuuuucaguguguucuggggauugaacucaagucuucaugaugacaaagcaagcauuuugccugcugaguuaccugcccccacccacacccucauguuaucuuuaugacuuuaaaaaaaaaagcuagguugacuugaucaccuucuucaagaggucaaaaaugucuuucucaaggcaaaacugcuguuuaggaagagcguuaagagacagaagcugacaaggaagagaccuguuuuuuagcucaauugagugcuggcagucugauggaugcaguuuuuugagcgucugccagguacuaagcacugggcauugggaccuaaccuagugugaugacccacagaugguaggucgucagcaucuucaugacacugaugccgagagccaucaguuagacacagauggcggcauaaccagcacagugaguccugcccgcaucuuuuagagaaaaugccugaaagugcuuaccaaaaaagccacagcgggcuguagggugcugcugcaguuguaacugucaaaggcaagagauagcuuaguagagaagacaccaucauccguuguagaaauauaccuuguuuguuuuacaaaauaaauuuucauguuacauucccuagcugauugcuaugugaacccuuccgaaacuggcaguuuagaucaguugucuuuaauuugauuuuucagcucuuauauggcaaaguacucuuccccauucugagucaacacucuuucaaagcagcauucccaaauacaaggaaaaacccagucuucugaagaauaaauaccaggagagauguguccacaugugucccuacguggagaggcuggaauccccuuuaucagcccacaggagcuguucaccuuguuuuaugaaagucucugggaccugaagcagcaagcuccaggguccuccugccuccacuuucauugggauuauaagcagugccaccaugccugcuagucccuccccuaagucuagcuagucccuccccuaagucuagcuagucccuccccuaagucuagcuagucccuccccuaagucuuauuaguaaugucucugaagacauucagauccuuuucauccuccuauuuuuuuuaaugaucuuuaaaauuuuuauugcuuuguacaugugaguuuugcuagaagaggguaucagauucccuggcacuggagcuaucgacaguggugggccucauggaugcuaggaguccagcucccucgugaagagcagccagcauucagacaccuagccaucucuccaguccuuuuggaaccuccuuaacuaucuuuguguacuuauuaaugguauuucguguuuguauuuuauuucauguauggauuuucuuauuccuuuacuaauuauaauugugggaauaaucguuaaauccuuacacuguaccuugucuucuaaaaauauuucuuaaaguagaagaaauacgaagaagcaucuguaaaacauuuacaagguccaucucugauaaaugaaaagagcuuuuuaauagacagagccugcauuccuaauaagcagauugcaggugaucaauucuaaaugacguguuaaugcuccagucuucugucccugucucuuccguguuugacuacuccugccuccccccugugacucugccccuucaacucccuccucgcugcacacagcaugagagugaugugcaacccacccugauuucuuuucuuuucuuuuuuuuuuugguuuuucgagacagggucucuguauagcccuggcugucuuggaacucacuuuguagaccagguuggccucaaacucagaaauccaccugccucugccucccaagugcugggauuaaaggugugcaccaccaccgcccggccccuuauuucauauuuuaacuuaguucuaaaaugugaagauuuaacuuggucugguggaacacuccuauauucugaaggaggaagucuaggccagccuaggcuguauaacaaguuccagccagccugaccuacauagugauauucugucuuuuaggaacuuuucacgucaccugccaugaagcuucaugaccugaguacaaucucuuaccuucaugguggaaagagagaaccaacuaccucagguuuucuuuugaccuucauaaacuaccuuagcaugugugucagacaacuguuagggacaggcagugagugggcugcucugagaugcugcauaaucccaaagcucagauuugucuuccuguucccugaugcggaguguauugucuccugcauggaggaggacuugcuuugcugacuggaguuucuuuuaguagcuucaguuuguaugauuaaacuacagccaaggaccacguuccugaaaaauaaaugaaaacacuaguaccuaauaguaccaagugcaaacucccauuacaucaaggacaaagccguaguauagguuagcugaaacauuuucuuucuuucaggguucuguuguauuugagguuauuuugcacugcuagguguggaacccagugccaggcaaggguggcaccacugagggacacccagccccuucaucuuuuuucuuauucaaaaaucuguuaaaauccuguccuucaccuaaucucugaccacauaaugcaggcugccugaccaucugcagcguauuuuguuuucuuaguacauaguaauuauaugcaaugugacauuuguauguauauguauauaguuuauuuugaucauacccuguucucuuucuuucuacugaccccuucuuuuacccagcuaguccuucuacuuucaaguuuuguuugugacccagugaauuucaucuggauuacacaagaguauagaugaggcauuuacaggagcauaaguacuuuaccagagccuucaccaucaaagaaaacuucuuucccuuccucuggcaaccaguaaauacuuacagauccucagggaggggugaggccucaugagucccuucccauucuaugauaggcuguugauggcccagucuugugcacaugacaguugcugugaauugcaggauguuucaacacuucacuccauccucuagaacuuguguucuuucuaccuucccuacugugaugcucccugagccgggagggggauaacauaccucccauugauugcugaguauucaacagucacuuagucacaguauuugaccacuuaagcgucucugcuguugcuauuccccacuguagacagaagcuucucugagcagugcugacagcgacacuaaccuacacagauaaguauaauugcuuaggcagaaauuugauggacauguguccauuuagcaaaagaauaacuauaguuuacccuacuugacccuauaacuuucccagccauaggcuucugaccagguucacaguacaagcugugaauuccuuccuauggagccagccucaauuccagucggaaagaaguugguuacuuacauuaacagacucaccacuguuucuccaguggggauaucuugccuucccugucaagaguucacaacuaagugugacuguugaugacaagucucccucuacauccugcagacucuucagcacucugagggcuggccagcaggaaggaaacuuccagcuuauuucagccugauuucuuuauggccugcaaccaaaacaggcuuaucagcaguaagucuuaucaccuacuucuggugggcugccaaucacaauggcaauuaucuguuguguuuggggaaccuuagaggccucccugagccacaaugcauagggaaggagccgcccaccucuggcacuuggguuuuuauuuaauuaccuccaucuuuugaggauguccagaagacaaccucuguucaaacucuguccuucuuaaauuagcuuaccaauuaccuacucccuuaugcuuuugcauacauccuugguuuugguugcacucccacucuccccucuucccuaucucugccucacucccacaucacauuuucuaugccuucauacauacaguuucuuagaauacauugaugaaaauggcucaaauuguaacuuauauuuuucuugaaguaauacuuuuaaggaauuuagaguuguguuuuaauuauugaaacauaccaaaacgugauuuuagaaaugcauccaaguauugaugaggugguucaggggcuaaaaauacuuguuggucuugccaagcgaggacccuguuucaauucccagcaccaauauaauggcucacaacuguccuauuacucuaguuuagaggaucugcucuucuggccucuuuggacacauacacacuaaguauuuacagcuaaugcuucugauauuuucugagacagugucuuaucguguaauuggcuagccugaaacucucuauguagacaccgugaacucauguggaacgaacagccaugcuggaagagggauggacagagcuaugcaugauugguaauauuuaaugcuggggauaguccaaccuaccacuaagucacugguugcugaagauacuacuucuguuuuauuuucuacauuagugacaaguagaaggcugaagagaggucugcauugguaaagugccacccacacaaggcccugaguucagauaccuaacaugcacagaaaagcucagcauggugacuugggucuuacccuaagccugagcauuuggggagguggagacaggugguccuuggagcucacuggcuagccagucugugagcccugggaucagcaagaaguaauguggagaggggcuggaaagguggaaggcucagcaauuaagagcacauacugcucuugcagaggauccagguuugguucuagcacccauaucagccaggcagcucacagccacauguaaguucagcuccaggggaucccaugccaucuucugaccucugcagucaccacacacacauugaacacacacauacaaagauguacgcacauauaccuaaguaaaaauccauaguuaagaaaugagguagagagcaguagaggaagacacccaauaucaucacacugucucacgagcuugcacacacaugugcgcugucaucacugauauacuuuaggaacaccaaaaagagaacucauuccagugugauaguuagaagacagucauucaaagagcuggcaugaugucauuggauuuuugcacuguguaagugguaaucaggugacacguguuggcaaucauugcuuaguucuuuaaugaaacauugacuucuggauuagaguuaauucuuacugaacuuguauucauauguccauacagaagucuuagucucuauuuuuggcauuacuugcgaacaugaucagugucauguaaugaaaggaccaguuuggagguagcuuaugggaaugggcuggagaaguggcucagugguuaagagcacugacugcucuucuagagguccugaguucaauucccagcaaccacauggugguucacaacacaucuguaaugggaucugauguccucuucuggugggucugaagacaacuagccuggucuacagagugaguuccaggacagccagggcuacacagagaaacccugucuccaaaaaaaaaaaaaaaaaaguuuauuugauggaaauaagugagcuuuaguguauugucaugugcaguauuagaauuugucuuuauccaaaauuggcuggcuauacaaauuacuacugcuuucacauucuaaaauauaagaugaaauuaaacuucccuaggauuauuuaauuucagaaauguguuccuuucaccuuccucaaaauacuaauuagaagcagguuccugugggugggagacagggugagacaaggucuugcaugugcaccucaggcugucuucaaacuugcuaccuucugccccagccugagaaaugcaagcauuacagguguguagcacuaugccuggccacaggaacguuuuucuuuuuuguaaguaaauguaacauaacuuugaggauucuacaguaucuccccacuuuuaaagcaugacacacuuucaaggcuuggacuuaaaauuacggucguguuuuucuuuuccgguugauagugggaaugggcaauagggaguagagaaaucaaguagaaagguuguguccaauuuaaguaguaaaacuaguguuuguaaacaucugaagcauuugugugugugcaguuugucucccuuagcuucuaguccuucaguauuguuccaucuccuccucuuuccagcauaaagaugccuaccaagugauacuggauggcgugaaaggcggcaccaaggaaaagcgauuagcagcucaguuuauaccaaaauucuuuaagcauuuuccagagcuggcugauucugcuaucaaugcacaguuagaccucugugaggaugaagaugugucaguaaguuuaugauugacauuugaguaagcauuuuauuaucuauguaaaaguagcaugaucaaaauagcaaucauuagucuauagucugcugucauaguauggucacauuguaucagacccagugugaaugcuacaacugagaaaauacuaauaacuuuauuaccuuguauuuaugaaaaauauauagaauaacaaauuuuuuauuuuguuuuuucauuauccacuguugaaaauggaauguagccuacaucuuagauuguucauaguucauaugaaauuagauuuuuaaugcauuuuuauaccuacaaauuuacuauauaugucauaaaaauaguuggucacuguaauaucuauaacugauuuaccagauuaagaauaaauccuuuuccuauagacaaggauuaacauuuggcauuucuaguuacuugugcagguuucugagauuuuuuuugagcuauuagcucuuaacuuuccaugugaaaugagugaaucacuagcuccucuugcaguguuguuagacggaaacugcaucauuuuuaauaugagagcuaguaaauuggagucuuguucauucaaauuuaaguagucagcauggaagauucuaaaauaauuccuggucaaggcucugucauggaugcuguucuaaaggaacaguguauuaacaugccuaaaagucauuauccagcaguugaauggaaguuacauacaagcauguguguaguuacucaccucucugcuccaguccuuuacuuaccgucccuuucagcuucauuugucuuagguacucugugacagcugagugguaaauugagcagugggacauaucugugcuccaguuauucaggaggcugaggcaagggaucaccuaagccaagaagugugugaccagucucacaacacagcaguaccaugucucagcaacaaacagagggaacagaacuguuuuuaaaacuguauuccaucucaucuuuguggcaggagagauagcucagcaguuaagagcacuauugcuccucuagagaagcugcugucccagcucccacaggcacucaccguggccuucaacuguaguuccuguggauccagugcccucuucuguccuucuguccucucugggcaccagcacauagugcagacacacacauauacacacagagauaaaaauaaaagaaaaaaaucuuuaaauaauaaacucaucuuuguggcuggugagguagcugagcgaguacuuugcacauaagccuaacaaccugauuccaguccacagaacccacauaaggugggacggaugagccagccucacagaguuguguuccgaccccacaugcacauaaaugcuguuuguaucccucuuuuccaucauucacacacaugaacaauaauuuaaaaucuuaagaaaaaaacauacuuuauaauucauguguuucuuaagaugguuucuuccugguuuuaguuguccuaaaagcuuaguuuguuguuguuuuuuuaugaugccauuuuaguuauuuuuuuuuuuugucuguuugaaaucuugcccagauacgacgucaagcaauuaaagagcugccucaguuugccacaggagaaaaccuuccuagaguagcagauauacugacccagcuucugcagacaggugagagguucuuuuguugccuuuuacuguaaauauucucucuggaauauuggcucuacuucgcuuuguuuugcucggguggugggcauggagguccugccucugucagaugacguuggcccucucucguucaguauugugacccucacugauaacuggaucugugaggcuuguuuuguucuuaguccuguuuauagcagcauaauggugagcuugucuucagacuugaagcagucaucauuucaccuguuuccuacggugaagcacuugugcagucuuagcauucaagguucauggucauggccaggaauguucucuacccuuguaagggagcggugugucccccgagaguggcgcuuagguauagguggcuugguaaaacuguugaaucuuaaccuugaaaaugaaagcgagugagguaauuuauuccuuacucacugugcugugugcuguuguuucucuccccagaugacucugcagaauuuaaccuggugaacaaugcucugcuaaguauauuuaagauggaugcaaaagguaaaggcaguuuuucuaagucauggcucaaagccguaggaagccagggaacuugggcuuugcuaagaggucucuuucauaaaaguaaugaccuauccugaaaaagggccucccaacuuggauguuuguggcuuuccaauagaaguaauuguuuaaaaauaaacaaacauaacaguuuaaauuuccccuagaaauguaucgaaaaguuucuuuugcaacuuuaaagaaauucuuccaaaauaccugaguuuguuacugagggugacaaagguccgucaugcuaaagcugaugccccgggagcaaagccugcugggaacgugucagacugacguuagccagcacuggccauauucaggguuuguuuguuugaacagugaugaaguucaugugaacgcgucacacuauacacuugcucuugugucacaggaacguuagguggcuuguuuagccagauucuucaaggagaagacauuguuagagaacgagcaauuaaauuccuguccacaaaacucaagacgcucccagaugagguguugacuaaggaaguggaggaacucauacucacugaguccaagaagguuuguugucgucggggccgugggaucccugggcuauccaugcugggggggcuuuaggcagaagugacagaucccucugcagaagggcuuaccguaaauagcuuguaugggucacucuuucacgcauggcccgugcugaugugaaggguuuagucacacugaaacccuuuggguugcuguccuacugcuccuuacucugcucucucaauauucuggagauuuuaaaaugaaauaguagaaugaaaaaaaauggaaauaauaagcuuuuaucauugccuguaaaaccuucccaauaugagaacuuauguguuagcugcuuugcuuaccucauuuccgugacaaaauaucagacaaaaacaacuugagggaaaaaaagguuuguuuugggccacaguugcgggcaguuugucaucugucacaguaauaggaacuugaugcaacuggugacauuguauccacggucaagaaucaaggagagaaaugcuuauacuuagcuaguggucucuuuauccuccucacaccccagccugugaaugguaccucccacagcaguuaaccuuuugucauugccaaacuuggggaacaauuuucuuuuaacgaaaauuuagccucuucucucaugacaucacugacuggaaagacugcugcugagaaggugggaguguucuucccugccauguccugucgucguccgaguagaaaggguccuaauugcaagcuuuagugaguguaaguguggucccacugauacaggagacugacaggcuacuuaguuguaggaggcuggacuuaacaguuuucuagagaauuucuuagucacuucuacacuccccacccccuccaagagccauuuuauguaucuuucuuacucaaucugugaaauuuuaaucuguagauacauuguaaaucuguugcuguguauguuggcaaugccuuguaugucaaaaacaauuuuuuuacaucaagauuuucuuaaaaauaacucugguccucuuagagaauacagcuuuuccuuugaacuuaaaucuggccuuuuggcaaacagaagcaucagucuguagcagaaguagugcugcucuggauaaugagcucugccucucauucaaaugcuguucuucucgauugcguuuucuagguccuagaagacgugacuggugaagaguuuguuuuguucaugaagauacugucuggguugaaaagcuuacagacagugaguggacgacagcagcugguggagcugguggcggaacaggcugaccuggagcaggccuucagccccucagaccccgacuguguggacagacuacugcagugcacgcggcaggcugugccucucuucuccgugagcucuuuguuccauguugaugauacuugggucacucuugagucugccuguauucauuuacuugaacacuccucagaccuucccguaaaagcauccuuagcauaguggggcaaacagaaagcagagcggcacuggaagaacccaaggcagcaagacauuucucuaagggcuugcuuaggagcuuugcaaaaauuguaagaacuugcauucugucuccguguuugcccuacgugaguuuucugaaauagaugugcccuaguuugaaaaacaugaaggauguauacuuuugggaaauaugcaguguguaaauaguacacugacaugucacuaaauuuuaccugagagucaaaaaaggcauucaagaucugucgauguccggauguucccaauaaccuugcaaggaaggccacagaauguuaagauacuaaguccaugcuuuuugauggcagucugcuauugaucuuugaaaaaagacuugugacuuuuauuucuugcauucuuuuuuacagaaaaaugugcauucuacaagauuugugacguauuucugugagcaaguucucccuaaccucagcacccugaccaccccaguggaaggccucgauauacagcuggagguaagagaccauuccugcuuuaaaaagcauagcaaagcuaggcccaguuuuuaggagaaaugggagucacugacuuagaucugguuuccaggaguguaacugaaaggucuagcaguggcuagccaguaaucuccuaaggcaagaauuaauugcauagaaaugauuuaugaguuccauugcagcugcugugacagggcagcacuuccuguaaaugucauuguaugaaguuuauaccuuuaaggccuaaauacuuuuaaauaaggaacuuaauucaugacaaguuuucauacagauuuaaacuagauuaggccaguuagacgguucaagcagguaaagguguugcccacuaagccuaaugaccuaaguuuuguccccagaaacuacauuguagaaggagagaauagacuccugaaaguuguuguaugaacuccacauguacaggcacaugucaauacacacaaauuacaagcauuaaaaauaaacuagaaagccgggcaugguggcaaaugccuguaaucccagcacuugggaggcagagacagguggauuucugaguucgaggccagccuggucuacaaagugaguuccaggacagccagggcaauacagagaaaccaugucucgaaagaccaaaaauaaauaaauaaauaaauaaauaaauaaauaaacaaacaaacaaacuaguuuuaacaccacauauuccguacccccguccuccaguggagugaauacucuccuuuguuggcugucagcuguagcaggcgcagguaucaugggaucuguugugguguuugcacuaccucuccuccaccaguguuugacuuuacucaaauccugaaucacaccguguggcacagcaccaggcucugcaaacagccgugaugguagggaauugacugaaaaccuggaaauggauaugccauuuccuucggcuaccucuagagcaggggauuugaguauaugcugcacaguagugugcaucagauguccugugcacagccugagauuggaagcagcaggaugaacauuucagauacuggcaguuacuaauauuuccauauaguuacuagagucuaacuucaauagcaagaaccuacuguaaauuugagugguugcuguugcagauucugagugcuaauuggaagauuaauguauuuaucauuuuuuuucauuguaccuaagcaugagcccauaguagaaagaaacauggcuauuuuuuuuccucccuucuugcagauguguugggaauuuggauaccuagauaugcauauuaugacuguacuaagggccuucacuuucuuuaauguuuaauuguaagauuucaucucuagggauuuauuuuauccaguucuaacaugauucugagaagcuuaauugaaaacaaccagucuuuuaaagguuuauagaauuccucucauucauagcuccugcucauuuaaaaauaguccuaagaguaaauuuguguguuucagguauuaaaguuguuggcagagaugaguucauuuuguggugacauggaaaaacuagaaacaaauuuaagaaaacuguuugauaaguuauugguaagaacuuucuucuuuccuugugauacggucaauuuuuuagccuuaauauauuaucaacuuuuagaaugugaaaacuagcuugaauuuugccuugaauauuaauucuaguugaguacucuggccuuguguuuccucuuuuguaaggaagucucuuuggauuuccaagcugcugauucuuugcauaaagaucacccaugauuuagaggcuagaucacccccuuccuuccaaaucaaaugauauugugucugugaaaaagaaagcaucacuaacucuucugauugugcuaaauagucuaaaaacuguaguuggcauugcaaaggucauuuguuccaggccaccaacuagguagcugccuaaggccaaguagcuguagcaaccaggaaauagucugucguuuaguuuguaauuguggagaaaauaggccaucugauaaaaaucauuaucagcaucacugagugacucuccuguuugaugugagcaguuacauaaauggccagagauaagccucaggcccuuggcaucuaaggagucauuuagcaucugcugcuuccagauuuucaguaucuauugcguguuguaaggcugacauugaaugccuuugucacacuuucaguguaaagaguacaaacuuaaaacaguauggacuuuagaaaaaaaauuuuaauuaagaauguagucuugguguacauugaacauuggugcuuacugcccaauguuagcucuuuccacuuuggauauuagugguggcagcuguaacauagguucaugacagcugaugugucagauccuugguccaauagguccuagcucaauuucuagucuguuucuaguguucugugucuuaaaaucaugcuuuacaauuacacagguaucucuuuauagcaagagucuuuagaacagacugcaaacaucugcucucuccuccuuaggaguauaugccucucccuccagaagaagcagaaaauggggagaaugcugguaaugaggagcccaagcugcaguucaguuauguggagugcuuauuguacaguuuucaucaguuggggcgaaaacuuccagacuucuuaacagccaaacugaaugcagaaaaacucaaggauuucaaaauuagguaauauaugacagaaguggcuuaguccuuaacaaaaauggaaaaagcucucaggguuuuuauuuguuuuauaagaucugauucuucccacucuuccuuauauaggaugagaauccaaaagccacguuugugaacauuucacagaugugggaguuuaggucccugcugggaaaugaacucuugacucuucucucuugaccugugucuugggcauggucccggcugauuaacuccuccgauguuucucaccuguuaaaucugaaugacagucgggaugugaauaggcuuguacaacgcccagcaccuaguagggauugcguaccuauauccacaguuguugauaauauucaacaggauuaggauuaguggaggagcagugcuagacaaguuaaugguucauuuuuauaaggauacuuuccauaaacaaaauuucagugcuugacccauacuugccacuugcuacuacccucuaauuucccacugggaguuguuuacuauaugaucagucaggcagcauggccuuacagacuguaguaucagccaguuaggaagcugagauagaaaaggcacuuggccaucuggacagcauaauaagucuaucucagcagcaaauguuugcugaaauacuagaucagaaacuaauaacauaagaaaguauucuuuuguuguucacguagccauuuucugcacugugcauuguuuugccacagaaaauuacuuaagaacaaaauugaagugaugaguuacugauuaaauacuuugucauuuagguugcaguacuuugcacggggccugcagguuuauaucagacaacuucgcuuggcucuccaggguaaaacaggcgaggccuuaaaaacagaggagguaagaaugcugacugccacagacguugucaguuccagugacugacucugaccauugcugggauuuggugucccuugaucuuucauaauaaaaccacuuagugaaaucuuuucacuuuucauuacaaauuccuguaauauaugcugguuuccuuuaaaauacuucuuauauaacuccauguuguauuuuuuagguaaauugcaguuuggccugucaaagaagcaugguugauuugcauggaguagagaaauuggggggggugggagggagagaaacauagauuuaaaccucuacuuaggaauuucuaccuagagaugugaauuugguuccauacagaaugguaugugugcacagaaauuacugaauuuuaauuuuguguucccuuuacagaacaagauaaaaguuguugcacugaaaauaacaaacaauaucaauguuuuaaucaaggugaguccuuuuuucucccuauucuugcagcuagcuagagucagugcaagagguuuccaugugucugcaaaggggagaugucauuuccuuccuaagauuugcucuuuugaagcuuuauaguucuguaugguacuaagugacacuucugaagcuaaccucaauuaaaaaggaugaaaaguaugagagagcagugagcagauagaauuagacuuagaguagcuuaaaguucuggugguuugggguuuguuugucuguuucuugggacacgacacucuugacuucuuuuuaaugguauauuuuuauuuuauaugcauugguguuuugccugcauauaucugugugagaguguuaaauccuuauaacuggaguuacagauagugugagcugccauauaggugcuaggaauugaacucuggaagagcagucagcacuuuuaaccagugagccaucucugcagcccccaguucugguggucuuaauguuauugggccuuuuugaaugggcaggugauaugcaacacaugaaauguucuuuucugugacacuuuuuguaagcuuaucuguguaauacacucgagaguuuuguggacugcaaguuaaugacaacuugccuuuaaguuacaauugucuuccuguucuuuucuucccuaaauaucuacuaguguguuuguaacacgcagagcauaaaccuagcaguaaggacaaguaugccuucagcuaauguaguagaaaugcuauggagaaaaugagugucaucuugccaagaaguaaaaaggcauucaaagcagaagucagugcaugugugguuugcuuuguaaguccacuacucaagagggagaggcagagaaucaucaaaaguucaagacaggcuagacaauaagugaaacccugacucaacuauugaauuuacaacuccuaaugaaagcuuuaugauauauaucugcuaccauuuauuaccuggugucuuagucaggguuucuauuccugcacaaacaucaugaccaagaagcaaguuggggagaaaaggguuuauucagcuuacacuuccacauugcuguucaucaccaaggaagucaggacuggagcucaagcaggucaggaagcaggagcaugaagaggccauggagggauguuacuuacuggcuugcuucuccuggcucgcucagccugcuuucuuauagaacucaaaacuaccagcccagggauggcauuacccacaaggagccccuccccacuugaucacuaauugagaaaaugccuuacagcuggaucucauggaggcauuuccucaacugaagcuccuuuuucugugauaacuccagcugugucaaguugacacaaaacuagccaguacaccuggguuagaucaacaccuguguaaaaagccaugcagagugguacaggccuguaauaccaguacuggggagucagagacaugaggaucucuuaaacucacuggccaaucagucuaauagagucucugagucccagguuccgucaaagauccugucugaaaaacuaaagugaaagaguauucaggaagacaccuggccccagccucugacacccuccacacauucacacguacacaugugcaugagcacagaggauuaaauguuuucauucaauugaagcacccuagugacugccuuuaugaaagaggaaagcuuucuugguugguuuuguucauugaaauuguuaaauacugaugucacauccuaaaguuuggggcuauuuuaaagggaaaaaaauagcuaagauuuaaaucacauauaaaacaguguuaguagaagaauugguaucuuuuacaauaaaauggucuccauuuucuuagggaauuuucuuugggucucuguucaaguggaagcacaagaaauaaaagcuuucccuccuaacacauuuucuuugaaccagugccuugcacaaagccagucuaagauguguuuuccugccuccucuccuugcccacuacuuccuuaaucaacauauccacuagaagucuuggcugauuuugguuuguuuguuuuuguuuucuccaggaucucuuccacauuccuccuucuuauaagagcacaguaacauuguccuggaaaccugugcagaaaguugagauuggguaagaaauggauuuuaaagagauucacagucaaauccugaguucaguugcugcuuuuaauuuuacaagagagcacauuguuaguuaacuuauucuaaagaaacuguuaaaauaugacagaaagaaagaggauuuacaguaccaaguuguugcagagccuugcaaagugggugguggguauaacccuggaggguuuggguauguuuguauuccugucgcaucacuagacuuuguuugcagcuuaguacagcgaggagagcauauuucuuugaaggacuguuaagccuuguaaauaccuauaaauuuauguauaacuauaagccaacagauacugugauagcauggaacuuuacuuauuuucugaugugacuauucucauucguagaucuucuacaguaaagcucacaggcuaauuuagaauuguuguaacuuggcauaauacagugcuuugucauuuuugcuuuccccacuguuacaggcaaaagagaaccagugaagauacaaguucagguucaccaccuaagaagucuccaggaggaccaaaaagagaugccagacagauuuauaauccuccgaguggaaaguacagcagcaaucugagcaacuuuaauuauggugagcguuuucguuuggguacaagcaguucaagagauuaguuagaaagugguacgugcuuuuaauugugaauuauauauauaguaucauaguucucuuaggugguuuaucugaguuagccugcaaaaacggccauuggggaaauaauuauaucccauuucucuauaacucuugugcacuuacugagugaaguaugugauaccuaagcacuugaaaaagaaaauaugccagcuauuuuaagagaaacccacagaaacuggaaguugucgugaacuuguguuguguacacuccaugaaaagaaaaaaauaacucugucaggugugguggggagaguccacucaggucuagcggaaagagaggucauagaaauggaggcagaugacugagcaucgugcgcccgggaagauauuauagucuaccuuugcccaaaugcagucuucugucaucgcuucuaguccuccuugucuaggagaacuuucuucccaccuggccauucucugugaaggcucucgggucaguaaugaagucuguuuuuuacuagcuuuuccccacacgaaucauuuuuaaaggaauguggggcauaauggcacaugccuauaaucccagcacucaagaggauaaggccucagaggaucauaagcucgaggcaagccugagcuaaguaacaagaccaaaaggcucaacagggcagagacaguccaccuaaccaaccccuccucuugcguaggaaaagcuuacuaccggcaaccacaacuccagagaggcagaggcaggaggaguucaaggccaucuucauucauguagcugcauugagugaagcucaaaaauaaaugcucaaaauagagaugacaggcuauaauaauaccuuuguaguguuuuacaacucauaggucagccuaggcuacuugagacccugucucaaugauaccaguauuagcaacaaucauaacagcaaucaaacaagaaugcuguuuaucuugauugcuaauugcagucaauucuacaauucuguuugcuaaguacauucugagccacauuuaacuuuauacuccagauuucuguuucuaaggugagauaauuguagcgggaaguaaaauccucuugugauggcugaauuccucugaccuuugacaguggucaaaucccuuuugaccagacagguuggaaaaagccaguuuuagacugagaaaugaacccucccauauaaaugagcucuuacagccuucuuuaaggagugcaccgaaucuugguacucauauaacugcauauacaugugcauaugcacauuugcuuaugugaaaaauagggauagcagaguucuuaggaacuuagguaagaaugguuuugagaggauuugguaaugaaaagcagucuuuguuguuuuauuacaucaaauacuaucuucugauauuuuuugacuuaaugugauaucuguaaaaucugaaaaucagcaguuagaugcuaugaggaaauagcaugaacgaaaguaaucaugauauuuugcacagcacauaaagaaauguauuucucuguaacuugaauaguuacauggugaguaugaguuucgaaacauaaagauuuugucucacagaacccacagcuugauauaagguggagaacaaaugcagaaaauguaacacauaguuuguaugccaguaaacuaggauguaaauauauuuuaauuuuaaaagcugcaaaaaaaaaaaaaaaagagucacaaguaaauagaaguggggguguuuuuauuaaaaaucugaaccgggugugguguugcacaccuuuaaucucugaguuugagcccagccuggucuacaaagugaguuccaggacagccagggaauacagagaaacccugucuuaaaaacacaaauaaaauaaaauaaaauaaaaauaugaaagaggggggaacagguauggugguauacaccuuuaaucucagcacuugggaggcagggacaggcaugucuacauagcaaguuccauaacagccagaacuacauaauaaagaaaccugucuccaaaaacaaacaguaaauaaauaaauaaaaucaauuuuuuaaauuguuuaaaaaauaggcacuuuacuuaacaaaaaagcuaagagucaugguuuaagcuacuuggaaaucuucauuauguuaaaaggcaaaauggugugcaaaguagauacaacuccuuuguuuuaggacuuaaggacacggucucccaguguuuuacacuguccuguugagcauggccauguuguuguguucucacagucacaauuuaaaggguuuucuugacuucacguuucccauucaguuuaaacccauuucucuguccagcuuuaggauaugacugaugagugucgagugauaguuuuucuuguccagaugugggguuugguucccacagaugagcucacuugccuggagcauguuccaucacauuaguuguagauagaugcucacuucaguuuucuucuugcucacagaauuccccaauaggccaagaguucucauacguucuacagcuuguuccugccguucuuuuucuuuuguuguuucuaggcuauaaguauauuccuggggcauauuugaauuguuaguagcuuuuuuccagcgguuaggaauggagcuuacagcauuugccuccauauucaaagcccuggcacaaaauuuuuuuuaaaaaugugaaguuaaggugaacuugaaaucacuggucacuaaaaugcuaauuguccuuuaggaugaggcucaccaaaaagaagaaacuugaguggaauccuguauguuaaccuuagcugcauuaagaucaaaaauaaauguucaaaauagagagaugacagacugugaugauacuuuugaauagcugaaggcagcucuggccuuuguauuaaaacuaaaauuuuguuguuuggauuccuuugagaagcuagacaacguucugugcaucuuucauacucagaaaaaaaauaauuaaaaaauguaaagguuaguuuugauagucuguuggugaaaaacacuuuauugaugcauagcaaauaauucuguacauuagcacgcuaagcguguugauacuuaaggaaaauuauuuuuguggacugguauguaguucaguauaaggaaguccuugucucuuacaccuaagaagaaugugggagcagugagaaagaaucaaucaugccaugcaccuuaaauauaaacaaaugcaguagugagagagagcuggcuaaaggucacugcaucugucacugacagaucaccgucagcaaccaccgugguacucucaaagcugaccauuauggguaguuuaaaauaugcaauaugacuaacuaaagaccuauagcuuucuguuguuguauuaagcaucuugaaguaaguauaucuauccuaacacuugucaccuuugacuauguugucuagugcacuaaacauguuaacuucauuaaagugaguugcauaucaauccaugaauaaaauugucauuguacaagaauugaccgagucaggcuccauuacagagaaauauuggcuaaguuggagcuguuuaguuaguuuucugucucagaauugaaaucuuuuuccuuuuugagaaaaagggagauucgucagaaaaucaccuaauaagcaauaaggucagaaauuuuauagugaacacaaaauugaccuaaaagguguuuuucaagauaucaagauuguagaucagaaagaucaguaccagccuugauuacuguuggcaagauugcugcagugaggaagucugaaguucaacagauuugauuucauauaccaugaugaacaguccagcuuugcugauaacuucaguguucuucacuggaacaucuuuugaacuaauuccucuugguuuuguucucucuguaccuugacuuucagcaaaugauguacugugcucauucagaguaucugugugugugacacauagcuuuuugagagcucuggggaacucagauagcucaugaaguaauagaaaggcucauuacugaaccugcacuuaacaugagggucaauucuguagauggugagaaagacacugccuguguaucacaugaaaaggcagccucauuauccaaaacaguuggaaguuuaagauacuucucauauauaaagacaagcaguuuuuguuacauuaauucuuuaguaaaugcagguauuuuuauccuguuacucuuugauaaugauaagcaccaaaauagaaauuaacaaguaugguuaugcuaacguugcuuugaaacagcuuugcuaaugagaaugguuuagucaaaccucugugaaguuucuggcacuuugcuguuuuccucucuaccucuguaaauacauggacagagugaauuuugaagauaguggcagaaugucacuuuugcuuuuauaaacccugcugcuguuuucagaacuaaaagcuauauucuucuguuugcugaaccaugacgcccugagcaagaccuaaaccacuguucgcuuuuucguagagcagagaggagccuucaggggaaauagagguggccgagguuggggaacacgaggaaaucgaagucgaggaagacucuacugauugugacgucacauucuucagcauugucaugagauuaauauacuuaaaucuacuacucauuggauugccggggaugucccuuuaaaaggacugcugccuucagcugaaaauguaauguucuuucuaccuuuguauguaugaucuacuuuuguaaaagaccaugguuguguccaagguaaaaccacaacaauauuuuuggaugcuuugucugcagccuugacuuguuuucacaauauccucacuauccagacuucaucuugugaaucuugcuuuuacacaucuugaugguuugucacugagaucugacucuauuggaaaagucagucuagccugugaucuggugaagaucaucacucuugaaacguuacuguucuccuccccauuccguuagguuucugcccaacacauggagaagaguuaagagcagucuuaaccuucugcuuucauuguuuucuaaggaagcugcuaggcaguguugucgcauuccugccaagucauagaaaugaagcaccagcuucucacaguguacaggcgaugccagccuuuuagaaagaacuugcuuugcauugccccuucagucuucuccauauuuugggauacagcuuugaacacagggucuuauuauuugaauaggaguacaugugcauaauauacguacagacauaagcauauguuguguguguauauaugcaugcuauggaacuugaguguacaaccaaucaauacauuaaauucucggaagggguccucugacauagcgauuaucccuuugaggcugaauccauuacugacuugguaucuagguuuucacuccaguagggaggaauuucagucagcugaacuuacagauuauuauuguuguuuaaaacuaaaaaacaaaggcuguuuuuacagagacaaauuuaaagacccuuguuggugaaauacagccagaucugguguacauacagguucccacaggaucugcuaguguaauguaggauuuggagacuuaauaaccagggcuacccaggagugugacuuggugacauaguaccauaaaaguugcucacuccgcuugcuuuugccacuuucaaauuuuaacuucucagguuauuaaucagauuauuguguaaguuagccaauagucuuuagauuaaggcaacagacgggagguucguggagugucucauguugggcauuuuuaguagcccagacucuguucuucauuugaauguuucacacauuuuuguucacaguuaaucuuccaaguuuacuauucaagucagaaauucagaugacauuucuagugguuugcuguuuugguuuuuuauguuuuuugguuuuuuuugagguuucauuucuuacacaggugucuucaucaccaucacuucuacacugggggaaaaacaaucuccuuugugagaaucacugcauguauuuauggcgaaaauauuucugaaagucuagagugauacaagugagcacaagaaguuggucagcuugccuauggagugcuggcaauaaacucugaacauuccacaagccugagcugaaccuaggcucccuuggaagcugaacagacauaggaacaugggauugccagcugaauccugugaccaucuaguuauggaccucagagauagaucagcguggccuaaagccauuucaaguacaaaaaugaauuggacuauagcaacauaaauuugaacacaguaacuuuuccucuuugccugagggcauuuguaaacucggcagaaguaacuugaccucaugucuacugcagagcucacugcauucaccccuccucauccuuugcuuccuuccccuugccuagucaguaguucauaacuuaguguuccuuuugcuucagaaaucugaaagaaaaucuucaugccaugaaucuuuuucuuccgcaaggacaccugugucucccuuguuuaaauaaauguaaaugcucccuuaugcuuuugaaauaaauuuccuuuuguaauuuuguuuugugucuuaauguguuauaauuauaacuuaggauucuugaguuuuagauauuagcauuuauugauugcuucucauaugguaugcucuguugucaaggucagucuuaaaagccaucugguuuggauauauuuuuauacguaaauacagucuucuggaaaagauuccauucugacaaaacagcaucaggagagcugaagcaugcaugguguccugugccuauaacuaucaggguaccaagguaggaggaucacaagugauguaggcuauauagugaggauggaagaaaauaacagauucagugacauacaucugcaaucccaguaagcaggaggcugaggcaggagguucaaguuugaagcaagcauaagcuaauaaaaaggucuauuaaaaauaaaaacuugggccagcaaaauggcucagcagauacaaggaguuugcugccaagccuaacaauccccacuuccacaugauggaaagaaccaacucaugauaguuguccuaugaccuacacacacauaaaguguaauaaacuuuuaauaaaugccuauauuagauuacaaauuacaacaucugucccaguuuugagacugcgaaguaugguacugcucuugcagagaaccccaguuuaguccucagcacccacauaggcagucaugccuguaacuguagcuccaauggacccagcguaugccuccacagcagacaacugcauucaugugcacagacccacaggcagagaugugcugauacaauuuaaccuuuaaaaauuucauauugaaagaucaaguagauacauuuccugguauauacugcacuaaagccucacagugugaguguggcuggcaauucucccauuaugacuuuauauuucucuagguuucauggaaggaaagaagugcaauuguauggaagaaaaaaaaaaucagugcuuaaacaggauuuuuuuuuaagugacaugacugccuagcacauaguaacucagaagcgguaauuguucagucaugguuuggaugugaaaagggccuccaaggcccaugcguugaagcuuggucuccaguauucagaggugggcuucagguaagugagugagucauuagggcaccagcccaauacauggcuuugucaaccagaugaauauggaacauggagaaaaucuugucccuagccucuuuguaucuucau

SEQ ID NO: 941 - RNA, 1560 nt, Mus musculus
gauaagagaggggaagggacaggggcuagaagaggggccccagagggccauuaagguacaggcacgacacgcaugguguuggugaauccagagccagggcgccacucggucagcacaaugaccacaucucccuucuugaagaagccucgggccuugccaacauccauggccaagguuacacgauggucaacauccucagcccaggcauucaguauggcauccuuacacagcacagggaagaugccacgguacagaugggccuggcaagcagucugggaauugcacaucacagcaaugauaggagcccgagggcaguaccuggccaugacuuggugagcacgauaauggcccuacugcaggauugaaggaggccuccacgguacccacaguggcagcuucuguggggucgcugguaauguugccaggcggcggaguuccucaaauagcuguaagugguagaugacagccucugccucucgggcaaucaggugcugcaugugaacacccuccggaggguagucccccuuggaaguuucucuggacagcacgaugccgucugcuccauccaggacugcauuggcuacaucacugccuucagcaugaguggggcauggauucuugacuaugcuuuccagcaucuguguggcacacuugacaagcuucccagcuugguugcaucuuccguucaucgucuucugagccaggaagaccuucucugcaagaaucucaaugcccaggucaccacgagccaccaucaucccaucacuggccuccaagaucucaucaaaccugcggacaccuucaugguucucaaucuugcugaugauauugauguucuugcccuucucucccaggaccuuccugacuucaugcacaccagcugcuuugcggaugaaagaugcaagcacuauguccacauccugcuccaccccaaacuuuaggucauggauguccuuuuccgacacagcggggagauccacagcagcgccggacaggaucacacacuucuugcugcccaaggacgcaccauucuccaccuuugucaccaggaagccagcaccuuucuccuucaccugcagugagaugagcccaucguccacggagaucuugcugcccaccuccaccaccuugcagauguucuuguaguccagccacaggauccucucgucacacuucaugaaagcuuuguucagggugaucuucagaguggcuccccucuucagcuccaucucuucagugccgcuacccuugaugaguccaguccagaucucgggucccuuuguauccagagccaccacaaugggacgguagagaauggaaucagaugcaaagcuuucuguggcuucacggacauucuuaauggucucugcaugguacucauggguucuaugagagaaauucuacugagccacauucauucuagacuuaaucaucuccuucagcaucuccacagaucgggaagcaggcccaaugguacaaaugaugccaguguugcaggcccugaugggcacggagucaauguccaggcagcacauguguuccaggaaggugucagccaug

SEQ ID NO: 942 - RNA, 1560 nt, Mus musculus; identical to SEQ ID NO: 941

SEQ ID NO: 943 - RNA, 18325 nt, Mus musculus
ugguccuuguauuuguccauucucugaugcuauaauaaaacaccugaggcuggguucuuuauaaugaaaaugguuucguuagcucagaguuugguuuugaacucuacucagaaaggguaagccuuugauuugaccccaggcccacaaaccucccaggcguggccugguuuauuugcugucaugugguuucucauugaucgggaauuaaucgguggcugacaggcuucccagaguggauugcagcugucuaggaaaugugcugauuuagagagauuuucagauguuguuaacaauccaaagagcauagugucaaaugucuucuucucucugcucauucuuggcacccugcgccugugauucagccacuccacgguguccuuuugauggcauucacuacuuauuuggggaacuuugaagcucugccccaaaaugucaucaagaauucuaaauuauuuuucuuccucuucuguuuaaggaauugucacuaaagauuuuuuucugagacagccugcuucagcagcaauuauuuugacuuacgcuuguacuugguacuuccguaauugcugccugguuccucuccaggcuggcuccagcuucagaacaggucggacuuacaucuccuccuagcugugugaccuugggugaauuguuuccuauuucugagccucaguuucucccucuacaaaagcacccauuaauaccuuccuugcagguugaugcuaagaauuauaagacaauuaaaacucaaaaggccuuagcauagcucccaguacagauuccugucaccucaggagauggcagagaacucuaguucacugggugccuggcucacagaccuugugaguuuacucuggguccucaagaguccggggcugucuuuccccugacuuucaaaggcuggccugccuuaguuaccagggcagauucuacagaggccaauggggcaaacagcuuugagcugaguguucccagauggaguuuccaaccucuccauucccuuagccauucucuggcugugcguuacagcagccaugcccgggugugcccuuccugguuuaaaauggagcuuugugagccucaagugcagccagggucucaaaugcuuugcuucaauggaggaccaagggccagagggaggguacugcagugguuaaaacuucaagguugcauggggaaagcuagcuuucccuacagagggacuguaucccacuuuaaaagcaguuuguauagacagugccaccucccucugaaagcccgccuuuguucauauggccagcucugcccugcaagacccuguguugcaccaggcaggugucguggcagaauguucuccaagagucacuugucaugauggcccuggacugaaagaaauugggucccagaagucagcagcaucuuuggcagacccaccuguuaguguguguaaucugagauuuguuugcucacagucucuccugagguuggauguggauaaggcuaggaaagccgguccuggguuacucucugauguggcaugguuuggaaacgauuaugucuuaucacagccagaggaagaugacagaagaggaaggucaacauucaucaucuucagcaccauaaacguuucagagauuuccaggauuugauggguaacauuuucagaaugcuacauaaaucauuccauuuuuuucuuucuucuugacugccuucuucuaaaaaacaaaaccaagucgccucugaaggcacugaggagaauaugugucacucacagccuccuuggagccagcugaacuguggcaaaugucuucuuccccaguaauacugggcucuguugauguuguuguuagcacaguucuucucaggggcgcggagucacuguggggggagggugggaaagagcgaggccugugauuuugagcugagaauaguagcagcaauuuuaggcaauuugaaaaauucuauuaagggcagucuguuggucuucugcagaacgacaggaccccuuucaaaagccuccugguaaccugcaaggggcugauggagucuggacgcuuggcucccugcacccccaaagucaucuuauaggacccuugccugcccucugcuccccucuaugccuuuaaauggaaacauuaauaauacuucccuguuuagggcuuuguauauuacagauugaggaaugguuuguccacauaaagccggacuccugugggcugugggacaaacugucuugucaggagaaauaagaaaggagaccaacugaggaguuucccacaaugccgcugugaacauugcacuccugcugauuuuuuaguguuucuuuuuauuuaguuguuagguuuucaagucuuagaugagccaugggcuuuugaccaggagagcagaugacaguuguugaggccagggaacucuuucucaggguacuuacuaccuaggagcaggugagagagaggcagggcuacgaagagagccauguacuagagucuccugacccuuucauguccagcacugugagccuaccaguccuaaaggcagcauccugagaaccauuguaagcacugcauaccuccugggcaggacacagagaucugcugcccucugaagggaaagugcucaugcccucccuucugaccugggugcugucugguggguucuccgcucugggaguugucuaggugauggggagccugauuucuuuuggcuguguguuccacgugcuggagugaaagguccugcagugugcagcaagggagggggcaggcuaggaggagggggaaguagggagggccggucuggagagagggggcaggagaagaucuccugugauuccgaaguuuucaagccauucugaccccaacccagaaguagugauuuuuuuuaaaucacagccaauuacccuucaucuucuucaccuaugccaauugaaaacauggaagaaaagaaagaaagaaagaaagaaagaaagaaagaaagaaagaaagaaagaaagaaagaaagaaagacagacagacagacagacagacagacagacagaacgaacgaacgaacgaacgaacgaacgaacgaacgaacgaaagaaagaaagaaagaaagaaagaaaaaccaaauaagugcuuggcuauguguuugcuuguuguaauucuguaaacagcgcagucuaacuucagagcacuguacuagguauuguaggugcucucgagaugaugcauacagacuguacacaggaggauaugcagcuguugagugcaguuaccuuuugguuaaucucccugagaucuuggcauagccuauguccugcaucuacuggaugaggagaacgaauaacugcagaaaggguaaugugcucgacacacagaguacuggugucuuucgauuacucguaucuguucauuuucagcuggccaugagacaccacgggaguuucccaucuuauguuugacagagaccugauauuccaaacacuaugguauucuccaaggaacagcucagugagacuaguguuacugcuccaaggucauucuccuguuugguuggguuguuccuuccagguggaacaucuauguuccaaauauccaggagucuguguccaggucuuuuugguacagcuuuuuuaauggaacugccccucauuucugucucuguuaaaacugcaaccgauuuccugccuugccccuacucacucuucauguuggaggcaugugucauaauucugggauacuuugguugugauggugugugugugugugugugugugugugugugugugccucaggagccagauaucuugguuuuugagacaagucucucauuguccuggaccucacuguguaggcuaagcuggcuggcuaggcagcaagucccugucucuaacacugggugacaugcugccaucacacucggguuuuuaacauggaugcaggggauugcuugguuuugucacuuaagugucuacuuacaaacacuguagucuauuauuagccugugauguaagccccagccuguaaggucacgagggcauagcuuuuguucugaacauggauguuuucccugucauucagcaaggcugcugcagaugccugcucggugggagugcuuuggaaugcaugacuggaagaaagucuuucuugcugugguuuucuugaaaugaaaaaguuaaaggaaagguagaagccucgcuuagacuagaaaugaggaggaugaggcggcguggaguuagagaugguguggguaguguggugacagucccaaggaaaagacaguccauccacaggacagcaggcagacgugauccugucucaucccucugucccaagccugagucugcccacagaugcccaaugcuggcuucugcaucuucucaacagugccccaccccccaaaaggcuccaucccagacccuguucauuacccagagcugauaagacaguagcagaaaauuucuaaauccccacuggcugugcgugaggcagauaagcagugcucugacagcaaugaaagcagucccuccccccuacccccgccccugcauugagcccgaaacacggaauaaaacugagccugugcuugcaugggcauuccaggaacguggagauguuggaauuccagcaggccauuugugggcaguacugcaagccaccaacuguuuguucuuggacuuuucugcgauccacacaggccagccuugagggccuuugccacuguaaccagaagaucgaagcucccagaaagccagugugaucucccagccaguguagauaaggcccaagagacuccagcuucccauuuagcauggcaguugagccaggcccucccugaaagauuuaauuauuccacgcagcagugcuugcucucuccccuuaguccauguuagccuugcugcagcagcaacaaaaaaaaguaauucuuucucagaggucauuuuuuuccuucuaaauguuuuuauuagcuccuuguucaagcuaggaacuugccuggcagaggaaagcgucuuugaugggccugggagauggcucagaaggcaaagcgcuuguugugcaagcacgaggaccugauuuuggacccccagccaccaugggaaagacaccaggcauggcuucugcacuccagcgcagggggagcggagauaggggcauccccugaaccugguacuagccagccuugccaaaauagugagaccaugccucggaaauuaauaaggugggcagcaauagagaaagacaccugacgcacccucacaaaggugaacacaucuacagagaguggggacagggacucugaauacaguaacagugauugccuuuguagccauagcuuacuuccuguguugguugggaggauuagaguugaaagugcauuagugaccuuugaaugccaugcaauuauguacugggaaccuaagcuggaagccagauccuggaucucuagaaugcccauccaucucugauuucuuccucuacuaggagagagaaggaaacuauuuggcauuuuccaagagcuguuggaguaugauauacugggugugcucucccaagauuccugugaagcaaaggcuaguugaauggacggauugauggauggcagaugauggauuuauggauggauagaugacagaugauggauggaugaauagauggaugacaaaugaugauacauaaauauauuaguggguggauagauggauggauggauggauggauggacggauggaugcaguuugacaguuccaaggaacaacuccauuuucaugccaggacuuaaccagcuccucuaguugaagagguaagguggauaccauagaagauguguccauccagggcuucacaccggggaaauuuuguuuugccaguaaguauagucacuguggcaaugcagccccuaaguagaguaacaggggcaaguguagguuauccgaggacacaagccuauacuccaaccagcuuuguauaacccacuauauguaaugcaucauaggugcucauuaaauguuuaaaugaaugaaacgugucaguuaacauaggcucucuggaaauacauuaacaucuaucaagaguucggcagucuacagauuuugaaauauccaaaaauaaucaccccuggagagaucuccguaaaucagcaaugaaagagcuaagagaaaacuauaaaucauuccauuacuguuucauacguuuccaaguaagugauuuuggaagcaugaguggugcauaagcuguauuuagccuuggugugcuaagcaaauuugaaccaaauauaaauccuggcaugauauuuuuaauccccauggggagggacaggacgcuggaggagaguugagagagcauccaagcuauuugggaaaguuuaaucuacauuuuuagaaagaugcaguuugaagaauuagaauaucaaucacccccacuggugggauucuucaucuaaggagaagugacagcagccccagcguuccucgagucucuucagaucacauuauuaauauggguuuugucgcccugugagccaugugugagcuuucuuggcauaugucccuguccuucgucuccuuauuuacagcuugcaguagacuuguugagugugaagcaagaacccagacagaauguuaaugcagacaaaugacaugugagccggugacaucuuggggcuugggugcacaucacugagagaggcccagucagcuguggccaugcucuggcauuagcuuugauuugcuccgcauugcaugaagaaugaagucucagcugugagcaucucagacaggagcugaugauggcccuuaaaucuauccuuccccaccggagacugacuuaauuagccagggcgcugagcuuaacuaaugguggggcccggugaaugcuugauuugcaauggaaauucagguuggcauggagucucgguguuaagaaugcauuggugaguuuugcagcaguuccccagccccuucucacaagucuuccuuccuggaauauuucaaauucugagacagccuuguccuuagaacuggauccuauccaccagccucagcgguugugauauuuagcaggacagauauagacagacuugagaggccaaacagcuucuuccuccucagacagaugaaacaaagaccagcucacugccuggcuuugugugucugucugcaaggguguuugguaucaggggaaaauuccaggagcuaaauccaggggcagaaaaagcagugcagcugcauuaggcaggaagccagugaucugggaucaggaaaggggucugggaugauggaagccucaagauaagcaguuuugguuggaugccagcacgggcaguugccugcuuuaaugucuggauaagaacuugcuuguaauugguagauggauugcguggauggagauggagcaugaaaauaaucuauucccuucccucaauuaaacaucccccccuucuuugucauuccgacugcucagcugacccagccuccugaucgccagcacaagagcagcucauaucccugcgggguggggauucguuucugggauccauaucaaagugcuugcccugacuucccuaccuaugauguguggcaggguaaguaacauacacaguguggauaaguggguuuggggagaugcggauccgagauaccaaguuguaggugggcaccuuuuaagucucauuuccguccaguuucuuccuuuccuauccauguacugacgugcccacuugaccacuuccucaugcacugaugguggcuuccuaaagagugguguguguacagcgauggggauugggcuucaaguaggguuuuuuuuuuccuuuagaaaagaaaaugaaagauagauaagaggagcuaguucagcaagcaaaagcgcuugcucugcagccugccaacuucagcucaauccccaggauccgaauaagggagaaggagagaacugaauccacagcauuuguucagaaaugcuugauacuugguggcuggguuggcaagggaugguguuugcaguauaagugcaguauauuaagaugaccgacagcuaagaggggaaggcuuggaguacuggacaagacauguggacuccacaccacagaaauuucuguuuguugggucagcaguggcugcucaccuccgugcccuugcccuggucuugcuucacuggcuuacagaaauagacaccaagagcuucugggagaagagagacaucagugauaggacuggguaaagacauugcuucugccacuuccccuagugagacuuuggguuacuuaagaacugacagugugacugagucuaugaauaucagcaacuauccaucuuggagcuucucagcucagcuuucagaaaagauuaaaauuguggagaugccuuacaugaacacauaggccuuagggcaacuguccaucaagagugaccuccuccucuugcuccuccucuucucccccuccccuucuuccugcuguugcaacgugguuagacccacucaagagucacuuuauuuaaacuugaaugagucagccacuuggaaagcaagcacaucaauaaacucauuacucagaugaaauuguuccccugucccugcaccuuacaucuguccuuaaauugcuccucauuuccagaaacagauggccugcuucaaaaaauuuuugcuugaauggaaaaaacaaucuagagaugauagauuucaagugcacugacuugcgggggaaacaagaugcugauguugaggcugaccacuggcaaggaguagcauccagucuggucccuaacuauucauccacuguucucugcacuguacagcaguuuccuuccaaguaauggaguucugcaggagaagugacugugugagacucuuccuagaaucgagugguuaaaagcugacgggcugacuccuuuaauuucuuaagcaaagcauuuagaacagagcuaggugcuuuguaaggaagcagcuagguuccccaaugucccagaucuggauguaauguuagaaaauccaguguuacaaauguguuucaccuggaauuagccaggguucaauuuuuauuguuuguggaaaaggacaucuuuuuaaaaucuuaugcaacugauuugcuuuucagaaacacaauaagucuugcuuccauuauggaaguaaauacucugauuacaggauguuucaagaauauagaagggggaaauaaacccguguuucccgcuugcagaaauaagcauuacagcaauuggcauucuuccuucuaccuuuuuucugugcuaagguaauggagucucuugguccuuccaauuaggauauucauugcuuugcauccuauuuucucccucuucaguaaauaucuccauccugaaaacucgugcuuggcguccuuaauggcuaugugauguucuuucagauggcuccaucuuauuuucguuuauucacaugacugcuaguggcgcuuggguuuugccaauaagcugugauucacauauucauagcaauuucucuucauauauauauauauauauauauauauauauauauauauauauauauauauauauauauuuggugugccucauguauguguguguguguguguguguguguguguguguauguauguguguguguguguguuuccugugugugggugcaggaaugugugguucacaauggugccucaguuucuuuccaccauggugaggcaggaucucugacuugaaucuagaggucucugauucagcuaaucuagcuguccagcuuguucugggaaugccguuucugccuaccucugcaugcagucugccacagucaccuggcauguaugugggugcugcacacauccccagcaagugguuuacccacugagcugccuugcuagcccccauaacaagcuuuuuaaauuuuccuaguuuggauuacuucuuuaggucaguuguuccuagaguuuauaucagccccaaacacacuuaagggcucauugcauuuuuauuacuaagcugaaguagaacuguuuacagccccuacaagcgauugaauagacugcuucaccucuucuauauugugucuuugccaacauaggguguuacugcuuaaaauacccuucccauguugcaaggucagacaugguaucuguuuuuaacacuccaugcuucccucugagguugauugcaguuuaauuuauuaggacgcugcugcuuuucacggaacuuaagagccgagugcuccugaagcaggaaguucuugguuuauagcuuuauaacacacacaugcaacauauuguuacuuuucuuuuuguuuggacccauuaccugacagaagcaacuuagggagucaggaauugauuugguaccagucagucacggucacgaccaggaaugggggaaggcaggagagaggugaccaauggaggaagccaagagagauggcugcugguucucaguucacuuccuccucuuuauucagucugggacaccaaccauggugcccccacaccugaggugggucuucccuccuguuuccugucuggaagcacacucagagacacaccuaaauucuaaaucacucccauugauaaagauguugacaauaaugaccaacaucaccucaacuaaaggaggggguggccuaacgguccuagaacucuggugauugagcuggcuucuccaucuuccgggaagaaaugauaauugccucugguuuguuuuuguuguuguuguuguuguuguuguuguuguuguuguuguugucuuucuaacuucugacugagccagcagccauuggacaccuccuguuugugguccucaaaguguguuuuccucgcucccccuuccucccuuucuucuccucuccuuuguucccaucuccucuuccccugcuccccucugcauccugcaacagcucaggugaaggucugacagcaggaaauuaacuggcuaauccacacgcggcgccccuggguccugccccuuucucugcugaacaugauuuaugguuguuuggcagagggucaaaaucugauucugccaaguggaauagaggggaaaauauuugauuucuuugacaccguucauuaaaaauucauacguauggaucugaaaaugaaacauuucuucaugucaacaugaguuacagggagagccuugagcaagaccuggccauucgagugccacacugucacccggcagugacaucagcacugcagugccuuugaugagacaagauuggggaaagccauguagacuccagacggugcugaugaaauuuuucuucucugucccaggggauuuuccuuguagccagaagccaguuguuuagaacccacuuuauucuguugucaaauccacaugaggucuccacuacugguacgaugcaugucaguugacuaguaagcuacgacuuacacugaaugcucccacucucucuacuugucuucuuaauuuguucuuccuugaccuguuccuuucaagucauccgauuuucacagugucuggacuccaggccuuucauuauaaacaccaucacuucuuggaaacaugauuauccagcccagugcuucgcaaacuguaaugcauacauaaauugucuggaucuguuaaaacgaagguucugauucagcaaguccagaaggggguuggagaggcugcaucucugccagacucccaggagacaccacuguacgaucuaggcaacaggcuuugaacaucaacacucugguauuuaccaugucugugcuggucugaaagccgugcccaccuaggaucuguaaauaucaugugaccuuauuugugaauaaaggucuuugcagaugaagugaaugaaguugagcauauagucaguuauacaaggaaccagcaguaagagauucauucauucauucauucauucauucacaucaugaaauugacucauacuagguccaaaucuuugauguaugccaacaggccggaaacucaaggacucaugcugcagucagucaugagucaaaaagcaggauuacuuuuucaugcaagaaccugggucacuucuucacacgccuguaacugaguagaggcccagccacaucaucugccucauccaggucagauauuacucagguugaacguaaccccuucacagcaccaacuggacugacaguuuucacuaagaggagcaccacagacugaccaaguugacagaaaauuaaccuccccagugaggucauggucugcccaggugggcccucacuccaacaugacuaauaagcagauuuuaaaaauguggauggaaagacaaagacacugaagccacaugaggacagugaugcacacaaaggcaagguuugcuggaggccaccagaaguagggagaggcagagaaagauggaacuuggucucuuggcuuugagaacugugaacaaauauauuacuguugguuuaagcuacauucuacuguuuguggcgcuuacucuguguguguguguauacagucagaaauguguaugcauaugcauauguguaugcagguguaugcauauggaugcuggacaacaaucucagguaucauuacacaggcacuaguuugggggauggggagucucucacugggcugcggcucccugauuuagcuuggcggugugacuggagguccuccuuucucugcuucucuggugcugggaagcaugccucaccaugccaggccauuuuacacggguucugggguucgaaucccagucccugugcuugcacagaaagcacuuuaccgccuaagcuaucuccccagcccacagcaaaggaacuaacagagcacucuaacugguuaguaggcaccgaagagacauuaggucaucccucuaaagccaccaagcgugccuuuccuugggucugcuaccuugaaagaugggcccagagucugggaagucacuaguccaaaugugucacuguuaaaaagcagcuccgagcuacuguggcugcaaaugaaucggucacuccccugcuccuuuuuccuacacucucaugguagccugggaggccacaucugucuccuuuccugucaucucucgcguugccuucagguugcagggcaagucuggugacagaugaggaggaguuaaauuugcuuuucuuugaacaaacuacacuaauuaaaaugugccccacugggagugucauuugcuauaaguaaugcauauuucauuaacauuugcuuuaaaaaccaacacgaucauaaaguugcgauugcucuagccuaaaugcuggccggauuuaauaugcaugcuguaugcugccggccuagagaggaacuugagcaggcaauuuuuggugcccggcugaugcguguuuuuagcaggggcgaaucaauaccgggugaggguuagacuaacaacgugggcugucaagaacaggagaaauaauuaaaguuaugauauuagcaaagcaacgugauuguagggggagugaauagaugauuuuauucuguuccuccccaccuccugcugccucaggcauauuugcuggcauuuucagaaggagguggaaucaggagguguguuucugcuagcgaguguuuaaguaaaugccaguugugaucaauggagucuccaccaggaaagcaaagcugaaaaugucacucauuuugcuuuucaguaacaguuauaaguuugggguaguggggugcacacguauacaugcaccugaaaccggugacaucagcuuuagucacaaacaccaacccaaguggcugcugaggagagagaauaaccuugcagaagcagagccucuccuaagaggcaugccaaggggaaaucaaacugcccaccuccggaguccuuguugacuguaggaguccucaaaauaaagugacucucccaagccucugagggugggcuucagacagugccucagccuuguguucuuugagcuugcaaaggacacuugagaaagaauccugacaucuggguugaaaugcaguugcaaagaggaacacaguugcauagcauggaaccacaagucguucaucacuguggguccaguguggacaugaaaugcccuccacaaacuuacaucaggauuuguaagaagagauuggaucauacaggccuuaacccacucaggcguucccagcucauccuuuagaagacaauagauaauuugggacagugguucucaaccuuccugagacagugacagucauguuguggugacccucaaccauaaaauuauuuuauugcuacuuggugauauaauuuuacuacuguuauacauuacaauauaaacauaugcuaugcaggauaucugagagcagccacagguugagaaccauugcuuuaggagguuggguccucagugaaggaaauuagucauuggacaugucuuuaucccugacaccauccuguuucucucugcuucuuggcugccuuuagcugagugguacugcaggcuuuucacacuggucuuccaccucaccaaggcccugaaacaacagagcugacugaccagagaccaaaaccaggauccagauuaacacuucacuccuuuaaauugacuuucucagauauuuugacguggaauucuuacuuguugguaccauuuacucgguagaugcucacugagugucugcuccaugacagacaucucugaagacacacagcagugaauaagguggauaggaaucuccaucuucaaugaauuuacugucuagacuguuauauguggagaagaggaaacguggggguaggggagcauucuauggggucaagaagagugggaaaaggaaauagugugagguguagacagauggacagacagacaggaggugagagccugcuggccagaaggaauugugucuucgguucuggaugaggugagaugacuccaguagaacugugaugugaucuugcugcugggcugggauaggacaguggaagaauuaguggcuagggggacugcucauaaaggaauccaggaguggguacccagggcaggguggaaagacguggugagaagugguugucagugaggauugcuuguggaauugaugagaagugucaggggugcggccaugguuucuggacugaaaaaaaggaagaguggaacucauaagagaugggaacgaugcauugccaaaggaagugucuguaacucagccuggauguguugucccuugaaaugccacauggccuuggagagcugaucuccaggacagauugacaacacucauuccgauucauaguucaucauuagcucuuuuuagugaggucaagagcccucugguaccaaugauuugggguugcugucugagcuggguguuuccagguucauggaauuuuauuugggaguagaguaaaaggucacagagauuguaggguagccaagaaacuuugcuuaaagcagagcaagagaaaagaugggaaugcacugcaggagaccaucagacgcaugaguggagacagucaaguuccugcucugguguggggaggggacagcuuucucuuaugggaucggagggacagaagaauuuguuuacuaaggugguucuuuguuuugauugacagauuagaucauuuaaucacuuuucuauuguguauaucccuuuccaaaauauaucugauuuuuaaucuugugcugcccaauuaugcauagguauaagaugguaaauauaggauuuugccuaaaaguuccuuugaggacacaauuuugccuuauugcacauggcaaugcacagccacuucaggcuagcucauccuuucccccuaccccauaccuggacauaacugagaauguaucugaguggagucuguguaaguuugauacuccucagggcaaggaaagcagauuccacuuuucagaaaagagauuuugugcgaagccagaugcagcagguugggccgugguugguaggcauauuguuugcagagggcugugugcagccugacacaggugggugcucacaguugcuaggcacauuguuuggagauguuaugcgugccugcuacauaguagugaagguucuaggcagccaagugcaucauuagaagaugugguaauucaugacccaauccaugcagagccccauauugcuaagcuauucccugugcuugccuaggucaccuccagccuaaacuuuccaagaaaauauauuugcuucuggugucucuuaaaauucuaugguuaguuuauuuuaaaaucacuauuuuuuuaacuauuaaaguaauaaauacccaagacuaaaaauguccugggaauucuaggaccaaggugaauaaagaagucuuccuugccuuccugcucugcuggggcuaucaguguuaaaaucagguuaggcguuuccuuggccaccgguuuuuuccugugugauauguugugcugggcucuguauuaugaagugcuggauaagcaucgccucacaguacucagcuuacagaccucugagauauaggcaaccuguuucuccacaguuggcacaugaguaaaugaaaugaagggaaacgucccugcaggcccgagcuggagagggcacacacucaacacacucacgagaccuguggcuccacugucaggagccaguacccuaggaaucuucaugaggaaaucuuaggaacauucuggcaucuucuuugcaagcuguuuucugaagagcuaccuacguuaaauaaaaauggacuaauuaaauguggccucuucgaauagacugccauauuuuuaauuauagcuuucucuccggagaagguagcugaguauuguuuuggaaaguugcucaauuauuaaugguuggauaacacccggaaaauguaaagugucauuaaauugauaauaagaaugccuuauggggguggguaccaauuguaagacgcacauacaccacacacacacaguccuuaguuaagacagugcccuacgcaucacacacacacacacagaguagaguaugcucacacguccuuaguuaagagaguacccuaagcaucaggaauggcaugucagccugacugaccuucccuucuaggaaacacaauucccucucuuccugaucuggccuugccucuguuccagacugcauguagcaggaaagaggagccugucuacacagggaaacacaguagaaacagcugggcacaagcuguuaccugugagaacggggcaagagaaaucagucagcucuauauggaaaguggucccuugucccuucugcucugaaggaaccuuguuggggagucaagagugagguggcccuuugaagauucacguacucagacucaugguuacacccacgcucacauacaccugcguguaacuuccggugagaggaaguagaccaguguugguagucagacaguagcuuagaguccucuaauuugauccuaugggcucagaaaaaggcuuuagcaucaagauuuucuucccugcucauguucaccucaaucugcucgccuucaggaagacagggagcaagcuccccggugggcauugcugccugcuuacuggaaugguuaugcuccugagagacuggcuccacucaaccucaaagguugaguucccuuacaaaagcuucaguucccuugcccauggacuucugccuucaguuccuggcugaagcaccugcagaccuuguguaacaugacaccauucuguaagcaagccuaaacagcccaguguaccuuccccuucaucugccgaguccugcauucuuggaaagacauuccugcagugaccaucaguuagucaugacugcuucuaggccaucaguuagucaugacugcuucuagguuuuuuuuuucgaaauuaagaaaaacuggcauuguuaaacauuaagcaaagagccaagcuaagacaauugucaggaggcugccauuuuugaagaagcaccagaaauuuggaaggauagaaaacagacuugaucagguugggauggaauucaagagauggagacaucguucaauaauaaugacuuccaguuuuuuaguacuuaguguccuagaaacuacacugagcauugaggcacaucauuggggauauagauagugugauagccauggugagggagacagagaggucaagagaucuagcacacaacaguagucaacaaacucgagauccacucuucacaggcugccaugaguggagagaaacagcagacacuuuuccaaacaaaacagagagcaaaaacaggcgaaucagugaugguaaauagccccaaacucauagcaaaaguauggguauuugauugguucucaaaaacuaaaaaaaaaaaaaaaaugcuuugaaacauuuaaaacugucuuagcuuccuuccuucugugacgauaaacuauuccuaacuaaagcaacuuaaaggagaaaggaguuauguuggcuuaccauugggaagauagagccaucauugucuugggaaagacaugacagcaugcagggacagcauuguguggca

SEQ ID NO: 944 - RNA, 2429 nt, Mus musculus
agcugcugggaagccacggggaggcgaguucccagcgccggggcagagcgcuggccagagccccgcagcgcuccgcggccgcgauggggcuccggcacccgaagccccggagccagcuagcagccgggcccgccucgccgcccgcacccgggcgcccgggcuuggcuugaagcggcggcgguggcaccggcgcgccggcaggagcauggggaggaagaugcggggcgccgccgccgccgcggggcucuggcugcuggcuuugagcucgcugcugacgcuguggggaggacuccugccaccgcggaccgagcugccagccucccggccgcccgaagaucgacucccuccgcauccgauccagaguggcggccccgcgcccgagccgcgauucccucugcccccgccccuaguaugggacgcccgcggcggcucccugaaaacuuuccgggcgcugcucacccuggcggccggcgcggauaacccgccuaggaggcaccaggacgaccgcgggcggcacgagcccuccgggcuguccuggccagaggagcgcagggcggugcacgggggcgucuucuggagccgcggccuggaggagcagguuccccggggcuuuuccgaagcccaagcagcagcguggcuggagguggcacggggugcucgggugguggcucuggaucgcgggggcugcggacgcaguuccaaccgccuagcccgcuuugccgacggcacccgugccuguguacgcuacggcaucaacccagagcagauacagggcgaggcccuguccuacuaccuugcgcgccugcugggccuccagcgccacgugccgccgcuggcacuggcucggguggaggcucggggcgcgcagugggugcaggugcaggaggagcugcgcaccgcgcacuggaccgagggcagcguggugagccugacgcgcuggcugccuaaccucaccgacgugguggugcccgagcccuggcgaucagaggacggccgucugcggccccugcgcgacgccgggggcgagcugaccaaccucagccaggcggagcugguggacuugguacaauggaccgaucugauccucuucgauuaccugacggccaacuuugaccggcuugugagcaaccucuucagcuuacagugggacccacgcguuaugcaccgcgcuacgagcaaccugcaccgaggaccaggaggggcguuggucuuucuggacaaugaggcgggcuuggugcacggcuaccggguagccggcaugugggacaaguauaacgaaccgcugcuacagucgguguguguauuccgagagcggacugcuaggcgcgucuuggagcugcaccggggucaggacgcggcggcccgguugcugcgccucuacagucgccacgaaccgcguuucccagagcuggcggagcucucagaaccccacgcucagcugcuacagcgccgccuugacuuccucgccaaacacauuuugcacugcaaggccaaguacggccgccggcccggggacuuaauaacacuccgaggaagagagggacugggguaugaaugauggggguuagggcugucuucucugccacgggcaacgaccaaccagccaacgcccacccaauggucugaucgccaagcugucuaaaaaaaaaaauuguguguuacccacuugccccuuucuuuucaugccaggcuguuuccuuuccaaguucuggaagggcaaacucaccgaggcgagaaguguaacauucccuccaccuagcuuauaaaaagaguucugugcuuguguggagauuggauccgaagaaacuggcugcugggguuuggcccgggaauggcagucucuuugggagaugcaguccauuuuugucgcccccuccaccccuucccaaaaaggaaaacuuccguuugagcuaauuccucuauuuccuacuaaacacagcgcugguggccccagagcaggcugugacaagggcuggugaaacccccuuccuguguucgcccuuuguuccggcgcgcgauggugagauaacuguuccaagcugagggacagcucuggauaggacaaagagagcaagacuuccccgccccugggagcccuccagacccugacaguuugucucacccauuccugaacuccuaucauuuuggccugaaggcuaugaauucaggacuaguuauaagcagagucaauaaugaauuucuuccugcgucucccaauugaccaaaauugacaaugaugauguucaccagagggggaaaaaaaucaguuucaugcacuuuacuuuuuuuaauuuuaauuuuuuaguaagaaaacuuuuuuauuugacagaauuugccuucuguguguauauaugugcauaaauugugcuguaaauagacuaaacaaacuuauauuucaauaaaagggaguuuaaaauuuagaacuuaau

SEQ ID NO: 945 - RNA, 3134 nt, Mus musculus
uuaaaaugggaaagccaaguggcaugcgaccaggggaccugacuuggcuguccaacuugcacagcaagguuuaauuccaagcaucccugagaaaagucacagaaguuaaccucauugcucucaagccugcaaugauccauaccggggagcuugcaucuggagagagguuauggguucaaagucauuggcuacagaugguuccucucccagcuggagucacauccucuagggcucgagacuuuccggggaauuuacauaagccagcgugaaucacaccaagugagguagcaaaaggacucacccugaccccugccuguacugcgguggggggcugucugaaguuuucagaucagacacaguccaaaggaggguacaaggggaucaucccacucccaacaagagcaccggacacgccgcuacucccaagcccuacaauuggucucugcccccgcccccgcuccgacgcccccgcacggacgcccucaguucagccuccuccccgccccgaaguccgggacagaacguggggccaccucucgcuccuggaaggaucgguugccgcuuuaaggggaagaggaagggaaggggcgggggaguggggggcggggagaggcggcagaggagggggagggggaucccccucgcucccacgugguccgggcgccugugaaucgcgcccgccggagggucucacagcgaaauacaaaagcugcugggaagccacggggaggcgaguucccagcgccggggcagagcgcuggccagagccccgcagcgcuccgcggccgcgauggggcuccggcacccgaagccccggagccagcuagcagccgggcccgccucgccgcccgcacccgggcgcccgggcuuggcuugaagcggcggcgguggcaccggcgcgccggcaggagcauggggaggaagaugcggggcgccgccgccgccgcggggcucuggcugcuggcuuugagcucgcugcugacgcuguggggaggacuccugccaccgcggaccgagcugccagccucccggccgcccgaagaucgacucccuccgcauccgauccagaguggcggccccgcgcccgagccgcgauucccucugcccccgccccuaguaugggacgcccgcggcggcucccugaaaacuuuccgggcgcugcucacccuggcggccggcgcggauaacccgccuaggaggcaccaggacgaccgcgggcggcacgagcccuccgggcuguccuggccagaggagcgcagggcggugcacgggggcgucuucuggagccgcggccuggaggagcagguuccccggggcuuuuccgaagcccaagcagcagcguggcuggagguggcacggggugcucgggugguggcucuggaucgcgggggcugcggacgcaguuccaaccgccuagcccgcuuugccgacggcacccgugccuguguacgcuacggcaucaacccagagcagauacagggcgaggcccuguccuacuaccuugcgcgccugcugggccuccagcgccacgugccgccgcuggcacuggcucggguggaggcucggggcgcgcagugggugcaggugcaggaggagcugcgcaccgcgcacuggaccgagggcagcguggugagccugacgcgcuggcugccuaaccucaccgacgugguggugcccgagcccuggcgaucagaggacggccgucugcggccccugcgcgacgccgggggcgagcugaccaaccucagccaggcggagcugguggacuugguacaauggaccgaucugauccucuucgauuaccugacggccaacuuugaccggcuugugagcaaccucuucagcuuacagugggacccacgcguuaugcaccgcgcuacgagcaaccugcaccgaggaccaggaggggcguuggucuuucuggacaaugaggcgggcuuggugcacggcuaccggguagccggcaugugggacaaguauaacgaaccgcugcuacagucgguguguguauuccgagagcggacugcuaggcgcgucuuggagcugcaccggggucaggacgcggcggcccgguugcugcgccucuacagucgccacgaaccgcguuucccagagcuggcggagcucucagaaccccacgcucagcugcuacagcgccgccuugacuuccucgccaaacacauuuugcacugcaaggccaaguacggccgccggcccggggacuuaauaacacuccgaggaagagagggacugggguaugaaugauggggguuagggcugucuucucugccacgggcaacgaccaaccagccaacgcccacccaauggucugaucgccaagcugucuaaaaaaaaaaauuguguguuacccacuugccccuuucuuuucaugccaggcuguuuccuuuccaaguucuggaagggcaaacucaccgaggcgagaaguguaacauucccuccaccuagcuuauaaaaagaguucugugcuuguguggagauuggauccgaagaaacuggcugcugggguuuggcccgggaauggcagucucuuugggagaugcaguccauuuuugucgcccccuccaccccuucccaaaaaggaaaacuuccguuugagcuaauuccucuauuuccuacuaaacacagcgcugguggccccagagcaggcugugacaagggcuggugaaacccccuuccuguguucgcccuuuguuccggcgcgcgauggugagauaacuguuccaagcugagggacagcucuggauaggacaaagagagcaagacuuccccgccccugggagcccuccagacccugacaguuugucucacccauuccugaacuccuaucauuuuggccugaaggcuaugaauucaggacuaguuauaagcagagucaauaaugaauuucuuccugcgucucccaauugaccaaaauugacaaugaugauguucaccagagggggaaaaaaaucaguuucaugcacuuuacuuuuuuuaauuuuaauuuuuuaguaagaaaacuuuuuuauuugacagaauuugccuucuguguguauauaugugcauaaauugugcuguaaauagacuaaacaaacuuauauuucaauaaaagggaguuuaaaauuuagaacuua

SEQ ID NO: 946 - RNA, 90536 nt, Mus musculus
gggggggggaggggggcggccauucucuucuguccaagagagcagggcaggagugcaggggcaguagcgaaagcaggcuggugugucuuuaaacuuccguuggcugcuuagucacagcccccucgcuuuggguguguccuucgcgcgcucccucccucuuaggucacucacucuuucaaagccuggaauaaaaaccacagccaacuuccgaagcggucucauugcccagcagcccccagccagugacagguuccauucacccucguugcccuucuccccacgacccuuuuccagaggcgacuagaucccuccguuucauccagcacgccauggacaaguuuugguggcacacagcuuggggacuuugccucuugcaguugagccuggcacauccacaucagcagaucggugaguggcccgccaccgcgccugaggacuccagcuggaugccucuggguugaaucgcccuggggagggacuguagugaauugggcuagcaaagcaaagcugggauuuggggcuaugcuauuggaaagaguuuacgccugggaagugcugcuuuggugaaaggaaaagagaaagggagaagaaaguuugcugggcaaguugcccgcagauuuugggcgagguccccaugcuugcuggagcacauggcucaaaaguaacuguacucuuggaugcccgcagccucugucccgacuaacaggcucuggugcucaagggcuccccaagccuggcuaacuguggcuaggcagguagaggcagacacuggaacagaccuguagagcacuccccaaggugugcacauagcuacaggccagagauugggcaaugagcuuuucagaaaggagccuugaaaagcugaagacagugggucccagcuuugacuaguuuucggggcucuuaaagucagcuuuggucaccaacggcuuuauuuuagcuugugggaguuugaacugguuugugugaggcucugaguggccuaaagguuccaacauggaccaaggaggacacauaaccggagcaauaauucgaccagccgcgcagugcuugcagucuaggcaaagucaaacagcaacaggguucauauuugcugccuggcagccucagagcaggaggggaccuguaucaggguaaccugugaacuuuagcgcagucccuaauaucccaucuaaaugugguuggugacuuugguggcuguggagaggaggagcuugggccaaauauccaguauggcucauuuucaagcguccccccuccuuuaucuauauaugaacagauaauuccacgaaggcuuugguuaucaucagcauaguuaaauuuucuuugaagaagugccagcuaggucauuaagucagcucagacuucagugaguuccucucaacaagaauuacuaaauccaguucuggggguaaggggugccaaacuggguuuuuuuuucuuuuuagacaugguacguugggauuagaaaaucgcaccuccauuguugaauguuaaauuuugaaugcugaugcagaaguaaugcaaauaauaauugcaguaggacacuauuggccauuuguguguguguucuuugcugugcuauguuagguaauucacauaagcuaucucauuuuauccucauggugauuuggugacaaaugcuccccccaacaccuuaccaguagggaaacagaggcucagagagguuaggugacuuccccuagucacacagcaaggaguggggcugggugugaacuuggguucauuaaguucccuagcuuagacugccaugggauaucuaaaagcaagugcuagacaaaguugaaaagaccuucagggacaguaacagucuagccagcagaggcugcaguggaggcucccauagggagccagagcuccuaggauccauuggaaggcagaaacauucaggauggaugagggaaggacagagagagccuggaccugaccucagaggacaggaggaagguuggcacacugcucccaccuuuguuggggcugaggagccgaacucccacauuuuccuggccugucucccggcuauucuaaaaggucuacucccagauaccuguugcccuuccaacccccccuggagucagguucugaggccagcaggcucucuucugccuugggguuucuaccuucuuguuguacaguguggcuccaggacaaguagagcuggugccaguagcagcagcuccauggacccuggcuuucacgcccuuguaaagccgaugaaggaacugagacucugaaaugagaugugacuuagcacaggaugugugugaaagagaaaggggagggagaagagaggcaucaugguugccccauucugggagugacugguuugggaagaugaugaggaagcacugagaccagcaaaguugcuggugguggggcugaggguggggaggguggggaauggagguggaggggcguuggggagggguggcguaagaggaggaagcauccaucacugugcuggcagucaaacgguagagaagugguggaggccuaaagcaacuucucccccaagggaagaaaguggcccuagaccaaaggcagaggggacaaguguccacuugcaucucuccucucccuuuccaaagaucgugguuaggaaacuguaccucuauuguugaggaagaugggguucaucugggagucuugggacuuggggacagcaggcaccguucugcuuccucugagcauuggcaguuagaguguaggcuaggccuucccaggugaagaaguaaggaagcaagcccuguccuugcugaaguaucuccauucacucaguuacucccggguacacacagaacaucuauuuccuucuaaaauacagugaggaguuaauguguugggagacucuggcagcugaggagaaaaaaaaaaauucuauuuucugccaacuuccccuuacgcaggaggggaugcuggaccacacaaaauuccuagucuaugacagaucuccuuccauucauucccuaaaaguuuccugauucacugucacagacucaaaaaugggaacuuuaaagaucacuaaggaaaaaaaaccaacccuucuuuucccccagaggaagcagaccaugggagacagggauuggugaguugccuguuccguuagggugugaggacaucuuugaaauacugaagucucuggaguacugugggagccccaguguuucaccugaaguggugaggaggaaggugcggucaaucugggguguggcauaacauuuuuaaaaaauauuuuuauuagguauuuuccucauuuacauuuccaaugcuaucccaaaaguuccccauacccuccccccuccaacuccccuccccacccacucccacucuuuggcccuggcguuccccuguacuggggcauauaaaauuugcaaguccaaugggccucucuuuccagugauggccgacuaggccaucuuuugauacauaugcagcuagagucaagagcuucagaguacugguuaguucauaauguuguuccaccuauaggguugcagaucccuuuagcuccuuggguacuuucucuagcuccuccauugggagcccugcgauccauccaauagcugacugugagcaucaacuucugugaaaaauauggaacgcuucacgaauuugcgugucauccuugcgcaguggccaugcuaaucuucucuguaucuuuccaauuuuaguauauguguugccgaagcgagcacgugguauaacauuuuuaacacuuucagugcuaccuacacacucaucacaguuuuguauuuuauggcucaauauauucaguuugaguuuaagaauuaugaucaccauaucuuacccuaaagaaaaaugguacccaagacaaaccuuucuuguuucauaugacucuugagcauuacugaaaaauuagaaguacccuauuuuucauuuauuuaucuauuuguuuauuuauauucauucauuaauuuauucacuuuauaucccgauugcagcauccuuucuccucccagucuccccucacauacuuccucccccauaccccuuccuccuucucugagaaggggaaggucccccuggguacgaacucacccuagcacaucaaguuacugcaguacuagguacauccuuucccacugaggccagauaaggcugcccaguuaggggaaugggauccacaggcagacagcagauucagggauugccccugcuccaguuguuuuugaacacacauguacacaucugcuacauauguggaaauccagcccauauuuucugguuggugguucagucucugggagccuccagggguacagguuagcugacucuguuggucuuuuuuuggagucccuaucccagaaggaccauaauuuuaaaauccuagcauauugcuaaugccacccaguauccaaaacccguaagaagugccacucacugcucaaauucagucaacaguaguuguuuguuuuuuguugcauggcuuugcaguggucucacacauugagauucuccuagcaccguuuucucgauaaugaaaucaaggauccaaggacacaggaguagaguugaggugccccaucaucuaccaucaccccaucacuaccuuuggaggauucuggaaguagccgguggucucucacuguuccugccugcuguacucagcagagugaucacgaauagccucucucucuugccucccuccagaaggcuguaggcuccuggcugcccugccuugcccuccucugucccaucuuucccaggacucagccacagcuguuagagaugccaaccuagauauuuauugcuaaaauaaguccauuuccuuaucagaguccagcugcccuuuuagacaugcucucauuucuaggcuuggcaaaaagggagaggcugcuccuuaccuaagagacaagucagggcaauaccccuugccugcaaauuaagaaaggucccacagacacuccugugcugcucucggaggcauuuuggaugcagugacccauagagaacugcuguuauauacucuuuagaugguuaaauauacucaccccauuugaggggaagucuugaaaucccaggcaguggguugacagggcuuucuagagaaguuacagcucuugaaccaaaauccacugagaaccucuagaagcaaguggcuacccaaccagauagacucaguuccacuaaaaaaacaggaggcauguguguguggcagggcugggggauggcuuccccaacagccugcccugggguugcuugccgacaagguaugaguuacauuaguguuucaugaggaccuccauuugagcaacucuaaccagagcguucgugggaaaugacucuugugaaagugugagcugaagcagguggcagcugugucuuggccccgcagaguuuuuaaagggacucuucucuccuucagagagcgauucuugggguuuguaccagaagcugaugacucgguuuacuuugugccucugcuugaacgaggacacaagcgguuuuuugaggagggccuuacauuugagcccagauuuucauucacuuaguggucucacauuuuuguuaaacauauacuucacugaaacucagugacagaguguuuaccuagcaugcaugaaguccuggcuucaaccuccgucacuggggaaacaaacaaguaaaccaaaaccuaaaagcaaacaaccacaagaagaacaaaaaccaaaaucaaaccaaacaaaaccaaaaagcccauccuagcuccaaacuggccaguaaggauuuggggagccaggaccgauagugagaaauggaaaagauguuucugcuaccugccuucugcagccucgugggauauccugagggauuccaucuaaucaaggauuagaucucacucacuuuuauggucccagaucccagugcagauccacaaugacgaccagaaauguuggacugaaaagagugucugaaauagagaaauaagaauuuucauguauaaaggcaggcuagcugacacacuaagugugcaaauaugcuuguguaugacagcacgcugagaguguugacauucuccacaguguguggagaagguuuggcuggccaacugcuuauacaggggcuucuauguccucuucccaagcagagagguugucucucugugcuuuugguggcugcuggcuacggggugggucuaaggagaggguuaguggauggcugggaauggguugaugacaccaaacucacacuuaaaccucaaaaugaaucacuguccagcagcaguuugcucugagagcugcuggucugacacuaggaguccuugaaucagagacucacagacccucugaaucacacuugguucuggcagguggaaucagcagggagugaugcaggaacacuucccagaacacucuuauaucuucuauggcucacuaucaaaaugacacuacuguaucccacuagugccuaaucugcaggaagccuggcagcuaacagggcacccaguggcuuccucugcaaugagcuugcccagcacgaaguugcucaagccuggaguagguccugcauuccuuagaaucgcuugucuaccagugcucagagacugccaaacacaggauuuggggauacuguuaugggggcuagacucacagagccagaacuccaugagguuggggugccccagcugccugggugugcccgccuggugcaagugucccuccuuugugcaagugugggcagacagacucacaguggguggggagggcuugagucaccaaggauaugauuugcaaaacucaggucccaagaaccuuccucaagucuucagcuuuugaaaguaaagguuaauugcaaaacgccaggguggaaggaaaaggucauaugagcagugauucugagcaucuguaccuucagcaauggcuggaaguuaaggcacuuugagagcucuuacaccguuuguauuugcuuuuuaguaccgaacuguagguuucugagcuaccauuaccaauguuaauaaucauaacaaacagaacagacccucuccuuguuuucuauaaacuaacuuguccaaacuaugcaccaaucuuauaaaaacagugcuuuuaauacccucuuuccacauaugagggaaccaaggcacagaauuuaaggaaaugggccagggccacauaguugcaaaaugaggggacugagauuuaaaaccagguccucaugugagugcagguccugaaaggguccagaaguacguguuggauacccuggaucugggguuacaggcaacugugagccaccucguauggugcugggaacugaacucugagccucugcaagaacagcaagcacucuuagccacuaagcuaucuaucucucuagcuccuugccuuucauuuuaaaaccuggcaucagaggagaguacagaacuugcaaauaaaaagggcaaagaucauguccucgaagcugcucuuuuaucacaugaucaggagucuagcuccuacuuuguggugagguuugggaguuaaguuaaugggggaugauauguguuuuuguucaugguugcuucauuuuuuauuucucuccuugguaaagguggacuuuaaugacugauguuuuucugucaucuaagacugugacuuguaauuaaagaaagcagaaggaggcaugggacaaauaaacaguaaccaaguacuuccgauuuguugacaaaccccugaauccagggucuucaugcuauaaacaggaauugaugggaagaaagggaaacugagacaggaguuggcuuuuacauccagggcaaagaggacuugguccgggguagcucuucuucucagcucuauggcaaaccaggugaccuggaauuggcuugguguacagcagacaaaugucacuugggcaauaagauccuuuucuuugggcaucccuggcugagaaacaaguuauucaggaagagaggaggugaagcacuugggcacaugugacucagucuguaaaagggcugcagaccuuuagucuggaggcaggaacucauucaggauuucccaucugauucaaugucaugcauaucuuuacuauuaagugagucugcagugccuuccaaaaguaucacgcaccaaccaugaaugaggcagcacuguuucuuauuucauuuuuuaaaaggauacuagugaaaccucuuugcaaggauucaccaccauuggaacuaagacgcgagggagaaaagagugggugcacacaccuggcccuugccuuugcccuugacagucauuucacuauaauccugaccccgucucugcagguuccagaagcaccaaauaaguaugucaggcacaaacgcugccagugaugacuguacccugccuaaaaagccgagucuaacagagaugaguuccaacuugaagccucaagagaacuacuugcuucuuuucuguagcuaccagagagcuguaggggcuccacacuggcaaagggaggacauggacugagggaagcccaaagagcagaggccaugcaugcaugggugagguuuggagaggaaauccucuggcagcuugucuuguguuggauccucuguuuuucaugauaccuuagagguuauguucacuuagagauuacguucacuuauuuauuccuaaauccaauuccucuccucuacuguucacuaguuaguuguucaugcuauuguugcauugccugaccauucgugagaacuucacuuagggugaugccucaguugguaaagugcuugccuugaaacacgaggcucuaaauuugcuccucagcacccauguaaaaacccaggaaugacagugugcacuuguaagucccaacuccagggagguggagauaggaagacugugcagccagccaagcuauuugacaaguucuaggccaaugaaagauccugccucccccaguggaaaacccaugcauuaugaacauuuuugcauacaccauagcuccagcuacuggcacauuucccuaacuauaguaagcucucauuaaauauuuagaugguuaaccgaauuaaauuucuggacuuaaucuuagaagaaaucaccaucaguaacuauucgagauauuuuggguaaguucugguugucuugucuuucuuuuuggucucuagaaaacauuuucuucccucgugcuccuugaagcaaaucucaaacuccuugaaguuucuuuuucugggcacccucuucagcuuaaguggaucuuuguuaagguuugacaggucaggcaaggcaaggaggugaaaaagcccauuagauuuuguccaauagaguaggccucuugauuuccuuuaggucuggcuauguguaugacucaguuaucuuaaaagcugaccuugaauauagugacaccccccccccccgccaucaucaaaauccuguucucagcaacauucugagacacaguguuggcuuuuuggucccuauguuuaaaaaugugugaugagguggagagagggagugucauuucgucccaucagugguuugcagaucuaggagcugcuccauguaaaaagacaguuggugcaggggggagggggagcuuaggggaggguggugcugaagacuccaugguuguaaaacaugaaagauucuaguuuacucucucugucacccaugagcagggugagcucagacauuuaugcuagaccaagauucagcucaagcuuucuaaaguuccgcagcauacagaagugcucucaguauagaaaugauccucuguuuuguuucucucugucacuaauucacuauacaguuccuccccacaccacuguccucuauuuucucccuguguaaaaggagagagcaagacccuaggugaucucuaugguccuguccaggccuccuguucuauaaauucaccacucugaguucacuaauaaccaugcuucauaaaacuuaguggagaaaauaacacuacuauaauaucguaauagaacaguaccaaaaaugugauguucaguguggauuuaaugucaucagugagcuauuaaugccagaaacaagcacaaagacccaguuauacuccauaaacagcagcaggcaaaagugauuucuagggacaaggacuuucccuccucguacacuaucaaauucucccuccuucuuggaaggggauagguguaccccaguccugacagagaagcuaacaaugugucucagccacacagcuuccacugcagggagcuaggccuggaaucaugggcugaauccaaaugaaacacugcuuguuucaaugauaauucaaacaguauugucccaggaggucugaaaauacagcuuuugugagaagaaacuaugucuuucauucuuaaaguuucaugagcauacuggauuucucaaccuccuucaaggagccuuuacagcguguuacuacaaaaugauccauguauucaaccaaaccacccacuauaauauauguacaccuuggcugcagcaacggcucacugguuaagagcacuggcugcucuuccagaggacucagguucuaugcccagcacuuguaugcuagcuuacaagugucuguaguuucacuucugaaggaccugacacucuuuucuggccucugagcauaccaaacucaggcaugggccauggacauucaggcaaagcacucaugcacauaaaaaaugauaauaauacauaugcacauaugauauauauuaugcaugaauauaaaacauguuauauacauauaaaacuuuaguaggguacuguacuaaaggccagugagaugaguuuacuccuucuaccaagagacuucuagauccuuguuaaauuuucuccuauaaauccagagaaauucuuucucagugggagaaaaaaagaaaucauaaaugcugugauacucaggagguuuugaaagggggggucaggggcugaauacccugucuacuuccagcccucagucagugacugaaggucuucggucagguuguaauccuuucugcuuguccccacgucauagucaccuggaauccaccaaccuuugauggaaauaaaauuccagauaguuucaccuauugugucguaauugugcccuuaguuguugaguaugguucugcugucuguauuuccaaccaguuauacagacaucguguuacucugagaaaagugagagcccccacagugccagcaaacagcccuuugucuuggucacagauuggcuguggacauggucccucuuuuaucauugcuccuguuuccucagauauaaauuggugacaagcugaccaguuuauuauacugaauugugugauugacagguggaaggaagugagggaugccugugagcuauucucggguaugugauagguugguagcuagaagcuacuaacuuaguagaagucaccaagcuucuaaguagaagcuaucaagcuaccacguagaagacaggguguaacugaguggagaugagaaaaagcagaacaugcuccugagcugcugguauguaggaagaucucuaacuucuaaucuaguuagacgauuauacugaccugagcugcugguauguaggaagaucucuaacuucuaaucuaguuagacgauuauacugagugaggggaaaaaaaagaacacaggagaaggggaacaaagaggguacgucaugagcaaaauguuuaaaggaguggauaaaaguaugacaucauugaacuuaaagguuaucuacauaagacaguucauguugaagagaugguugcaacagauuccaggugacagaauaaaaaugacauugucuauaggguccaauucucccucagaggcucagaggaagcccccaauccugucagguagugcuaacagaaucuggaacaaugugagcgccaaugcggcggugagaacuuuaaaacuuuuaccuuguuuggagagugacaauucaggugacucccaaacaaguccugugacauccugcuccuguggcauuuauugcugaucaacagaggcuuuuuggggugcuguguuaaaaagcuuaaucuuaugcaaagacugcugugauccauucgugaugucugccauggacaaaauauuuuugagcauuuggcucccuccugucacaccaaugacaccauaccggagcaccaaacuucucuauguuauguuucugaaagucaucuguagaauccucuggaaguuuagccauccuugcaucuagauaaggagccauccucuccaccccacccggcauccagcacaguauaaaaauagucuuuuacccagaggacagguucagucacgcgugccuccucuucugauucaugcuuguucuguuuucccaucaccccaugucaaguuaguuucuuggagccaggaaucuccuguuugaaccaaggccagacauacugguaaagggacccuucuucucaucgcuucaucugcaaacugagaagacaaaaaaaaaagaaaagaaaagaaaaagaaaaagaagaagaagaagaagaagaagaagaagaagaagaagaagaagaagaagaagaagaagaagaagaagaagaagggaagccucacccacgagggugauaggagaaagaacuagcuaaugggaagaaagccuuugaagaugaaaggguuguacuugcauguuaauuacaaguuuuaucagccccuagagccuuugcauucucagcugccacugggcucucuucuaggcuucucaaauguaaaacagcaacaacauuccacagacuggcucggcucagagcauccaaguccagaaagcugaauucuaagcucaagcuagccaggcacucugaaccacucaaauuucccuacuuguccccaagggaaaaaguaggcucacuaccuaggaaggcaagauaagauagagcugaaguauaaacaaaaggcuccauggagagucuacuagaaauagccccuggguaagauuaggacauucugcucuaauucccaaccagugaaagccuaauugugugaccuugggcuauuggcuuuaucuaucuaaugcuucgauauacugugugaaccaccuaggauaauaaucccucugccuccucuugaccucugcaccuuggcuugcuggugugaaagugaguuuguuuugucaccccccaccccuucccuggucaggcugaagcacaugaauaaaacuacaaggugcuauuauuaccugagcuaacuuucaccuuuaucugugucuccuauugcugguugaccccaaucauugaaaccauauucuuuggaaugcucaccaaucuucucagagcuuccaaaccccuucuuaucuaggagggcuucauauuggcccaggcuucuuuuugguugugccauuuccugaagcgugugaauauguucgggcugacaggggacugagguguucugcacaggugggucucgauacuuuuggugggauagcucaaucacaacacuggagacagguaggaaggcuaucuagugcugaaagcuugaaacaugcaagcugaacuggauacccacagcagcaccauaauauggcucauaaaauggagaaaugaagaaagaaaagaaagagccuaagagagaaguuacaauggccuuggcacuacaauccaaagaggcuaccaagucagaaagaagacuuggaaaguauauagcacacuuguccuuauuggacauccuauugaaacuucaaggcuucaagugacugcccaaggucacacaacuuacuggcuauauacccagguuuucugacuccuagacaagccuuuuuccauuuuccuucuuugaaauaguagaggauaaaucacuaagcacugaauuaccacucuaagaaggccuugaauauaaaaagggauggaacuaaaggagcagugcauuaguggcacaaugcagaauguauagguaauuacauucuuuaagggccauugcugcacuagagcuguucauuuucuugcaugucuuauuugguguucuuuggaucauuuuugccuuauggggcaaccggaacaaaagguccagagcaaccuagacuggccuuugggauucugaguggcgucaauggucaugugcuucauggauugagucaacaagauguguacaugauaaaucgugucugcuagacacugaugauguaacuugcgaugugaagcacagucucauuggugcuuccuggcaucaacagcgugucugggagauagacacuaaacaaaaagcgaucccuuauuugaauacacauguccuguguuaugaaagagacacccacaaucuuaugaaggcacagaguaaggggauucccaucuguucuaagccucuugagccccauaaggugaccagcaucaccuguauguguagcauccccuguucuuugagguccuuuuuuuguuggauuucucagaaccccaucagcucuaugugaaaaauacagucuaguggcuauggccccauacccauagaaauauuaagcaaaucuaggcccccuuugacuaccucacucuuggguucuauaaaagaggaaguaauguaaguucuccaaauauugaaguuaguugacagucauaucugcuucguaguugauagugguagaugagacucaugggaaucuaugaaguuacuagagcuuuguggaacauuguuggaguggcaaaagaaggcaaauucuggagaaacagaagaugccacacggagcagcacuggggaaaauuuauaguguauucucagguugugauauuaagccucuguguaggauuaaaacuuucagcuuggaccuaggguuugauagcaucuauguuugaaguagcuuguggacugacuuccuguggucaugcagguacauccuuugggcucagacaagaugagcagcuaugcacucugggauaugaaugucaaucuauuuggcuucagggacuucacugcuuuaucuuuaagauaauugcugacucugaagaugaugaaaguagauucuuucagacuagugcuacggauguggugagaaaacaaacauucaaagucaaaugcaggagaugauagaaaaaaauguuuaccaaaugguauaggcagagacugccccacaugaucuauugucggcaaccgugucugauacaagagagaaaagugaagggugucugcuccaucauggugauagcauccuucucaucuucuuguacuuccuuggguaggugagauagggauggagauacaaauauuacaucccaccagaagauacaacccuuugaggcagcaaaccacaagcuugcuauccaucaccugcaucugggcucacacuugucaugucauccagcugaguaucucuaagcaauagagcaaucaacuccgucgaaauaacuccucccacaguaagaaaugugaggguagcguaguuuuaguaucucagugauauugccaagacacauggcucucuuuuucuaacuuugcacccugcuauucucauuaucucccaacaagucuuccucauguuggccaucuggcauccacagcuccaugcaugaaaacucugucaguaccaaucagcagaagggaugcuuuauucauaagcaccucuuuuaaaauggagaggaggcuuucuuggggucuuugauugauuucucuuuucuuucaugggaccaauaggaccacaugacuggcaaggagaacucagaccacaguuuggauuuaagccaagcaugaucuacccauuggagauggaagugugguccucuccucuccagaacagguucuagauuucugugcaaauuuaaguucaguuagaucuauauugccauggucacaacgucugcuaugauguauaaggucacagaaaguaucaaucgauaugguagaacuacaguuuaagacucaguauguggcaaagccaaaacuuccaauuucucugagccacacccuccagcuuuuucugagaagcugcccuucauggccaggcuuuuugagacucauuacaauuugaaccuccuuggucuaucuaugucuuuucucaguuccaauagcuauaaacauaucuuuucauuucuuccagaaaagggaauaaaacauugagacacaaccuuaaacuuguauuaauuuauacgagauagcuccuggacuccucuuucgcuugcuugagcacuuuauuacuggaaacucaugacuugcagcccaucuccacacagcuggagcuuccccauacaugaggaccacuucucugcagugauccauuaaaaaagaauuacccugaccuuggaugagcaucucuuccuguaaguucugagaugaugacccccaagggagauggccagcuuccccuuucuauuacauuuuuccacuggaguguuuuaauguguaugaaguguuuucagcuccauuaucuaauccaguauucacauuaacuucgugguuagcauuauuauacucuuuuuucccuaaccguagugaaguuuuaaugauuuuuuuuucucccaaguucacuucaagucaaggucagagcuaauuaguguacucugaggauuugacuccuagaugauagcuucagaacccauguguguaccuucauaccauauuagcuccuugggggcugauuuagcuuuagggagucuggaauugacuacugaaucguauacuaauauugucugucacaggugggaagagcccuuccuucuaguuccuuugaguucaaaguucaaguguucaauauauuaaccuuuugauaaaucugaggacaagauggggguuuuguuuuguuuuguggucuaauccccugccccagugcauuuagcucagcagucuaacauccugagagagggagaggccuucaggauuuacaaaaaaucauuggccauuucauacaugcauauuaagauuuugagucacuccuccccacccccuagucucuucuuuaauuuggucuuuagccaaagccuuucuucuuccccauggguccgcuucuugcccucaagucuguuuuugugugugagugacuggcuuuaguuauaguugcucccaugagcaugguggggaagcuauuuccugggacaccagccccuuaucaguggcuacaccacugaagaaagugacucccugucucccagcaaccacugacugcugcuaguuucuuagggagcggugaggccucauuaucgucuccucuauucacgaugaaacguuggcagguccaaucuugugcagguuaccacagccacggagaguuaaugaguguugcagucacgucauguccaggaugucuuuuuggagcacagauccccaucccccagcucuuacauucuuuccuucuuguggugauuuuccauuccucuuugguugccuaaauacaguuuaaggauuuuugacacuauccaaggauguuuaaagacgggucucacagaugugauuauuuaguagagaagaaggaagccagguuuuucucuaccuaaugaugaaggagcuagaggaaacagauucucuugagccaacaucacuguauuuugagauaaauuucauggcggugcaccuugcuggacuucagcuuguugaaucaguuccuaacucauccuucaguucccagcugggaccuugcagagcaaaagcuugcugcuagaacgagcucuugggucccaccacaccuugugcuccuaccaugacucacuguucuguauaguugacuugucuaaugucuggcuucuccacugggccauaacuuuuauuggaauagugaccccgugagccuuauuuaauguccugaccccagaagcauaguacccugcacauagaaucauuggaagaauccucauugaauaaaugagguuggaacuggaauucuuuucucugaaggcuugugaucuacuuuaggauuagaaagguuuaggugagauuaugguuagacauggugaguuuagacuaaguuugaaauugaauuuuuugaaaaaaacaaaacaaaacaaugucucucuauugucuaucuggcaaugaaucuaacacucuaucuaucuaucuaucuaucuaucuaucuaucuaucuaucuaccugucugucugucugucugucugucugucugucugucuaucaucuaucuaucugccauauauguacuugcauuauuuacauuuagcuucuaagccuaucauuuaucaauuuauacuaucucuuuaaacuauuuucauauucucucuugcacacacacacacacacacacacacacacacacacacacacaagcacacaugaaagaucucucaucaagcaggcuucaucuccuuccauccuuccuuugucugguaccuaucauugcgcuguccucagucucuccacaagugacaucauccacgagauucucuucuguguuuuucuuaaaugcugccacacagaagcugaacgugugcagcaucugaccacucagauacaugugaaggacagaagaaguguucuucuaaacccagcacugugggggucagguucguggaagcaagcuguggauacuccaggcccuuuuugauggagcacaaagugaaguucccaaaguucuucagagauguguuugaaagaauucucucuuauuuuaaacaagcaccauuagguaaacuccaggcuuccuuuagcugcugccucuucauagggggaaaaaugccccuuuauuaagugugugagcuuccuguuucuguuuuuggaguguuacagucaucagccacuucuggauuccgcauuguuugcauuguuaaaaaccuuggaaaacucaucugguuucuucuccaaacaaguuucccagacacccccaacccccaacccccgggaaggcauucagaaacaggccccaguuucaaacaggcgaccaagaaacaaugucuccuagagccaggcaguuuaucuuuuucuaaagucuggaauaaaaaauguuuacuccagacuacauaguuaaguccuaacugucagagucgucuguguccuguaugcucaagauguaauguggguccuggcaucacagcuggauucuaguccugccacuugccaguuacacugccuuaagugaugcacuuagccucuccaugucucauuugucucuucucugaaacggaggcuuaauucccacggcuuaagcacugcugggaugcuguacaugaagcccuugauagaaagucuggcauggaacaagcauucaagaguaauaauuaugaucauuguuacaauccuaaggcuccaaggccucucucuuccccauucaguccuaacuaugcuccugguacauuugaggaacgcuuccaacugccuugggaaagucuucauuucauuucugagcauagucagcugaugaauucucauuucauuuggcggggucagcauccuaaaauugugacucccgcacaggcuuacuggaacgcuuucggagcagaugaagcaggcugugaaguuccgggaaccuuggcuguagcuggugaaagcaaacugggaagcacgcuuuggggccugucuuuacuugcacaauuacagucaaucucucaggcugccugugucagcaggaucagccuuuccugccucccguucuuccaguuacugggggcaaggggaggaguggcuuuugccuguguguguguguguguguguguguguguguguguguguguguguguguacaugagguguaagcauggacugugagcaugacugcauacaggugugcaugauaaggccagaugaugccuggauguuuuuaucuuucucuaccucauuguuuggagacaaggguucuuccuaaaccuggaucuuaccuguucagugagauuagcuggccagugauuuccagagacucccccauuucuccuuccccaacauugggguuauaggcacagccccccugacauuauagauagaggcuagaagucugaucucaguuucucauguuuguguggcaaccauauugccuacugagccacgcccccccacccccccaccccaagcuguagcaacacuucuuuacaguguuguucuguggccucggagcacagaggagccuuuaggggguuaguucaaugcaauagcuucucucugcuggaguuucucagggcccacacccuucccacaagucccagcuugggggccaguuucugagugcauaaaguaaaugccucccugccugucauugggauguucaauucuuucaccuccaaaaauaccuguaauugccuuuaacugcuuaguucugcuguccuccaaaagccacucccagccacacccccacaaugagcaaggcuuuuuacaccuuuuaaaaggaguauuugcaucugagucagcuuuccaucuuccauuucaugagaguuuggcuuaauguuguuuggaacgaaacugcagauuaucaaaacaaggaugacuuuucauugcauaaagacauaauagauucaaaacucaaaggaauccuugguaucagggggagucaaggccaguugccuauggagaagagcauuuacugagcauguacuauggucuacuuccuugauggcaauuugcaugcauuuacugucuuacacucgucuauucuuccgaguaaauauguauugaauaaacgagcgacacuucuucagcgucacaggagucugagaaauggaagcucaugaauuggaaucauuuaagaugccucagauccuaugugcugggauagcauuuaacucagagucaccuccccucccucccaugaucccaccaguucaccuuugucugguuaauucuagucuucugcucucuggacucagaccuagaaaagucaaggucucuuucgugucuuuguggaauuuagauuaaauaaaucuuuuuuuuuuuuuuuucuggaucauugaguaaaaagacucaguuguaauaacucagaaaggcugauaagcaggaaaggggagggugagaguuuuccucuuuucucagggacaaugggcccuuaaagaccaccaguggccagggauccagcuagggggcaguucuccacuguccccacugagcagcuucucaggcaaggaccaucccaggacuguagaaugguuugaauuggucccaaauaccgaaauucacugcagggcacacuggggauguuugugguaauuuaggaagauucucucuaaggaaauuagcaacucuguuguguuuuacuuaauugaaaccauucuuugccuagagcuccauugauggguggacucgcugcaauuugagaacaggaugcuauccacacuuuuuguuuugucugcucuuucacucugcuggccaguccacucugcuugaaauauucauuacauccuagcuguccagauaacagagcaaaaugccacuacccagucccuggaucacugggaaaguuaaucagcuuucucacagaccucuucuagcugcagagggcuggguugggaacuagagauucucaaauuccacuucuuugaugagaaugcugggauccagagagcugaagugauucuuuaaguacucauaacuuacuaguaaggagaugagcacagagauccaugucaaauaagugcuuucauuacuacaucagagauauuuugugucacacucucugacaccauggauaaaaagacgaauaagguugggucuaaugggacccuuacugguuggauggggcagauuucuaauauauauaguguucuuuauaaaaaaaaauggaucugucuaaugugccagaucaauuuaguccuaucaucuaucuaucuaucuaucuaucuaucuaucuaucuauccaucuaccuaucuaucaucuaucucuacccucuaucuauguauuuuucuauucaucacccauaaucucuuacucacaauaugaguuguaagaagccacauaacuggguagucagggcugaucccuaaacaucuugagggcuggaggucuuuggcauuaauuaaggauauaauaacugaucauuaauuaaguuaucacaagaggugcuuuaccuauaggcuucuuugaagacaccuacuggccaauagcuaccaaguacuaagcacuuugcuaagacucaggcacuuugcccagugccuuaucugcaguccuucauuucauccuuaaaagcacuccaugaagaaagcaugaccuuugcuucaccagugaagaaccugaggcucaaaaguuaaaaaugacaagccccacauagccucacugagaguagggccccacguguggacaaugauccagaugaucuugugagguuaaagcccuaacauuuccaaguaauggaauaaaguaauacuagcacggaugaucagagucacaguuaggcuacucugaaacccuggauugccuugaguucauggcuaagaucuggaagggauagauacagcucuacuauccccaauacugaaaccagcuugugauccgaauggagcccuuguccucaaagccaggacauucaguagccaugcgcuuaccuuccaguucucucuugccuaucuuaccgaguccaaaugcuagaggcaucuagaggacaucaaaaggagauauuuugaucccuggaagaugaauaugaauccuaaauuuauuuuaaucuggagauggguagaggagaaauuccauuuuguccaguguauugcuuauauuuuucaugccugugagcaaauaccuggcagaaagggggugaaggaaagaggguuucuuugggcuuaugguuaaagagaguacagucacuguggugggaaaagcaugacagaguucaugguagcuggagcauaucacaccaggaggcaggggacagggauucuggcauucccuucaccccauuuauauuuaguccagaaccccagcccaagggauggugccagcuagaccuagggcuggccuuccuuccucuggaaagcuucucugaaaaaaaaaaucacuccuaggcauaccaaggagugugucccccaggccauuccaaauccagucaaguugacaacgggcagugagucaccacaccaagagucagauccuacccaagcccaguaaacaaacaaacaaauaaaagaagggcacccuuucuuaggagagugagcuuaagagcacacugguccccugccagugcagcuccagcuauggugacagacaaugccuuguuuuguuuucugucuagcauuguuggucucagacacugccucauucauagguuaguggcuucccugugugcucuuuguuucuucauacacucuuugauggcagggauuuguccuuaucacuuguacccagggucacagcuggcauacacuuccauauuuuauggaugacccugugagucaagaccuuucaccguguccuuauucuaggcuggugauuguuuggcaugaacacggugugugugugugugugugugugugugugugugugugugugugugugugugugugugugugugucagauuuuaucccaccuggccauuguucucacccaaaauuuucuagaggucucuguagcaaaagaagagcccuuuggcaggucugcucccuugucauuuugaauggccauuuauuuuaagggaaauuaacaucuuauuuucuuuuggcaucuugauagaggggucauuuguaucuuccuguauuuccagacuucuggguuuucaaauaagcugucuucccuaauaacgggaaguuauguuuggcccacuccaugugagaauguaacacaugcuaagacucuuguccaaacccuguggcuuuacuuagauguaagagcuuguuaaaaaugaguucugggagcuuggcauuugagaccggcaucacuguuacagauguaguugcacagguugaaagcacaaagagggauggaucacaaucacuaggugauuggaaaaguccuaacccuggacauccuuuggcccagauuuuuaaaauccccacccacacagcccagccucugauggaucuguuuuacccuguucguauguucaaagugucugcagaacgaacaagagucaggcucacggaggagacaggcaccuucguggcaucccuaccuacucacuuuagcacacaacaugaaaagagaaaaugagaaacaagagauggcaauguugcaaugaggccugaugguuuuggugccuccgauuugggaaguggugggaaccuagaacucggucuaguugcaaugcuuugucauugcaaauacagcuaugucaccucacuauguucugauaaacuggaagauggugaggaaguaaucuaaaggcaugacucuaguuuggcuuuuuuguuuuuuugagacaaggguauuuuuuuauguagcccaagaugacccagagcucaugauaauuccuaucuaugcuggauaguuucaugucaauuugacacaagcuagaguuauuugagaggagugaacuccaaucaagaaaaagccuccauaauaccagaauguagaaaugacuguagagcacuuucuuaauuagugauugaugggggaagacccaacccaguguggguggugccacccguggacuggugguccuguguucuauaagaaaguaggcugaguaagccauacagagcaaacaaaacagugagcagcagaccucuagggccuuuaaaucuacuuaugccuccagguacccauaggauuuggguuccugccuugguacccaucaguggauccuggcucaguauauauaagccaaauaaacccuuuucuccacaaguugcuuugggucaugauguuuuaucacaacaauaguaacccugauuaagacaccaacuuagccucuggaauuguuccauccuaauccaccuuaagucaguauugucuacaaggugagcuacagauaaguguuaagucuuaugggcaacuuaauuuauuacuaaacucauagcuauccggauaaggcuuuuugaguaaugcaaggaagaggccacuggggguagaaaacuaucuagugcuacuagacuaugagugucaccauucgacccaggaacugaagugauaacauggagggaggggcuacaaagaucaaucuaaauaguauuugaacuagauuuuguuugucauggcagagcagaggucuuguccugccuacuacucuagccaagcagaaauccaaucuguucguuaggauuuuucuuuucaucuagguccccaaacgguccacccuguuagacacagagcucuuaagucccagugcagugcagauuucuguauaaaauucuccacccuaaagagagaaagaaauaaucaucucccaucgauauucuaauuccaacucaauuugcauggaauuagaauauugagucccuugccuugaaacugucuaggaagaggccugacuucccuucucuuguggaauuucuggaagccaaguuaagaggcugccacuugugcuuccaugagaaaacaggaaggccuuugcuugacaucuaacccuuggguagguuguuaaacuucucagucucaguguugccaucugcucucugcauaaaggcuugugaugguuaccacacuuaucucagaugacuguuguuagaugaggaaaucgcugugcagggacuagcagaugcaaaccaugugccccuuuguguuaacccagcucagaagcccagacaagggcucagaggcugaaauaaucagagccaguguuucccagccugcuaugccccacaauuggcuuacauguuaaguaucccaagcaggcagccauggcuuucaugagcugagucucugcuuacuaccucugccucuaucuuuugccacuuucaugauaagagcugggcucaaugggcuuccucucagaugaggaaggucacuuauucaaccucuggaugcugugcagagagucccaggaugcagaaucuucaggacacuugggcugccaucccacacagaguagcagcucuggacacacugcaaucuuuucacuuccacucaaaaagaggcuaaaagagacagauagaaggaaaggaaaaacaauagguccuaccuuggacuuuaggugguagaugagcuuuguaggaacuggagguggccuuucgaauuccuccucugagugaccccaucuugaagggcaauaagccguacuucagugacugagucuugauauuucaucagguccacuguuuauccagcagucacaguaauguaucagucacagaaauguacccagccauggcagaauguacaaaaaguccgaacuuuucuauuuuccucucugcaaggucagauaauagaucuucaaggaggucucuuuugcaagguacuuuuauguuugaaacaaggagagaaauacgaagguuauacuaggcaaaugaguucuaaagcauuuuugcaugauguaucuuauaugugacacucuuagagcuucagggcccugugcuaauugcuccuugucuguuuccauagacaucaguggggugacccauuuuccuggcacuuucaaguuaagacugaccaaaugaugaguaucauguaaugacuggccucuaccucagaguuuuccagacugguuuagauauucccauaggggaguuugagagggccaggguaacuggagggguaggcuagguacugaggugagacuaaacaagguggauucaggcucuaggucuaucucaaagcccucauucuggcuccaccucagauaacgauacuuacuggucuuagccauccugaaucuuuccagugcaucaugguagcaaaagaaagauagagcacuacucugcucuauaaaugcugcuguugccccuccuuauccuggcaucaacccaagaagaucuagguagacucagaagaucugaggcaacaucuauguucaucaaacucucccugcaucucuuguuccuuaaauucuccaucuguaaagugggugcauaguaccgacccuuaaggcuucaaaggacuguuuugguaugcuuguguugcguaucucaugagauaaaguccuauuaacaaggugauccaggucuaaaguacacgaugcauucuguucuacagagagugacaccaacacaugucuuuauuccugugggaauuuuauggcccuuucugauauuugaaugugccucagguaugcaaacccauacucugagcccuuuuaucucacaaguccugaagauguccuagcuuugaugcuaucaauuaguuuuauuuagauuugagauuacccaugacuagugauuauacuauuuaguuaguauuaugauuucuauucucuuaaaaaugauuuuccaggugacaugugugugauugcauaaggcuauuuccauaaaaaaaaaaaaaccauacaaagccuuuugagcauauucucauuuuacugaaggagagagaaaggcuagaugugucacagauccuacugcaaguaguucaaggucacguagcuuauagugaauaggauuugggugugacccgugcauccuccuucuagauggagacuggcucaccagcaugccaggacucacugaucgcuucucaagugcagauaauaacaaguaaccgcuucuuauucugcuuugucucucacgaggucccucucuugaucugccagucuuucaaagugcugccucuagacuugugcagaagguguacucuaauuagaugaugucaaaguaauuacagcugcccagaaaaaaaaauaacugcaagacaaaguggagcugucguucuugccucuccgaacugcagcgggaaaaaccguauguggccuucugcugcuuugucaguccacuuaaccacauccugaguuugugcuagucaaucugcuaaaucaauaagauccaaaaguggaaaaaaaacaaaacaaaacaaaaaaccaaagguguuaaggccaguggauuuccugguugccauggcaacacacaaggguacacacugugguuucuuguuucaucugucuuccuggaggcuuguuccccauggaggacuuggacuuacagaacuccuauuuagugagauaaaacuaggggcaagcaagcaccuugauagauccagaagaaggggggaaaucuucagcagggucuuacugcccauguacccaacacagaagcaaaaggcaggaagaaggcuucuucucacguucuaaaaacaacucaaggcaucucuagacuaugcaauggguuggcuauuuggaggacuuggcagaauggcccgggugacagcuucuaaggggguugcucuuucauagaguccuguuggcucaugauggacuccuuguuccuuaaacuagagacugagaggucaggguguccagccaggcccccagauauuggggugccuuuccccuuugagugccaagagaugaauagcucaacuaaaagcaccccaugacaaauucugaaggaaauucccuccauaugauugugcaugacugucuucucugcucauuaaaacuucacccgccuuggggaugauuccgggagagacugagucacuaguuacucauggucugcagugggcagccaaaggcuaucuagcaccaagaaugauuuuggccucauucaaaaguagaugcugaacaauauacucuuucauuaggcacccgucacaugggagucagacgauggcacaagugguguaggggcaaugggaaagcugccagccuucuucuguacuggcagguuugguggaagcaggggcuauacagcuugaaugguucccagauggaaacuucugagcugcaaagacaucgcacaaguggaaaaagagugacuugcccaugauguacuucggaaugaugcucccuggccaugaguuguagauuuauugggaacagcaugcucaaacaucuuauaaaauauacuuuguuagaagcauuguaccaggagucaggaugcugcaauuaaaguccccugagauugugcuuucuucauaauggucuaggggaccaagcucucaauuuuauuuucuuguuucucacagcuaauuuguuuaaggcccuuuauuguccuaccuuuaaucauggaugaucuaauuaccaauauguuuuuguuuuuuguuguuuuuuuuuaaagaaaaauggcacguucccuacuugcuucuaaucagaaucagcagagcuaggcucaugaauugugucaucuucuguguaagauguaagcucugcaagucagagggcaguaaaagagccuuggauuuaaaugccaaacacugugaaaguaaaacccacaugugcacugguugccacucacugcccacgcaauuaguguggcagucucauagggggcuagauucuguuaaggaccaucaagcaagggugucagguuccagcuccaucagccuagcacaucuacuugguaagucuagaccuuugggauugccaauagacauuucggaaagucacaagugaacccagcuguggaucaaagcagaaugccagcucuucucauuagcucugccugagcauggcuggagcacuugggauauaaaggacagaaggcugaaacugcagccaggacugaaccauuccaauucucaaaaaugucuugagaagagaacaggauaagaucagagagaaucucgguuggauaaagccagugaacaaguugcaguucaggaacucuucccugagagaggauaacagauccaauaguauggugauuuuuccacuguagcaacucagaccuguugggugaagaccuucccccuucaggcagaguaaaggaaauuggguaacaaaugggauucugauaguguucagaucuguuccaugucuaagcuaccacuuaacccugugacucaaacagccugacuguucagucuguaccuggcucuaccacuuccuuaagacuucucaaugaauuaaucaaugcaugugaggugugguuaauaaaagaacaugcuccauaggauugucgugagaauaaaaugaauuauuaggugcaaaacuauugaaaacuguaacaucacccagaaaaggcgcugucuuugcuugcugguguuccuacaacccaugauaaguaaacugugguaauuaggcaagucacggaacacaggaaacuggucuggcuucuaugucuacuaucucuaagacggcgacuuuucuccacuacagucuacugugagccaaaucaacagaaaaauacuuaauucugccucauaacucuuggggagagagcagaaaagaccaagcauauggcuaguucaugcuagcaagcaucaauucuuuuggggucaucuaaagaagggagaguuggagagcuauccaccucucuugggcacaguguguucauaagugucuccugguggucugcaugugugauauauugcugucuauuuucaggaggucuaacuucauaaaugaucgccaaacuugugcaaauguguuguauccauuacagagaugaugucuucaaaagccaguuacaaaaacacaagcggucuucaggaacauuuucuuuuauggaaaauagcaaguguucagaaacagcuucaggcucagacauuuuuaguggccaauagagaauccuuaaagaagccugauuggugacucuugguagauaucaggagagcacaggaaagccgaucuauuuguggccagaagucuaucuuccuucuucuagagcaggcucuacucucacucaccucucgagcaacuuugggaaaaugcagauaauggaaaccugaguggaaauuacauaguggcuccuucuuugaugauguuaugauuuucuuccaguugggaaaugacuggguguaugaagaauccauuucucucugacuucacaauguaagcaaaguguugaagugggugauuucccuagugaaaucauauuuuucuugaucagagauaagguggauggugccauaaaauaguuaugccuuuucugagagugaguuuuaaccauagcccacaacagguuagaaaucugacccuuccauuuggaugaguuuggucaugacuuagugccucagauucuucgucucuaaaaugggcuuuccauacucuuccccaagaaugauugcuuuaauugguuaucuaacauuaagugggcagaccugaagucauauaccuaaaaguaacauuacaggaauugaacauugaaacucucucucucucucucucucucucucccucucucucucucucucucaaguggucuugagagggagcaaggaugguaugggagaguuuggagagaggaaggggaaaauuaggcaauuauacuuuaauuucaaaacuaauauuuuuagaaaaaugacuuugccaaugugcugaccucauaagacucagaugagaauuaaguuagaugaaguucauaaggcaguuggcaaaucuccaauacucacagccucaauuacuauaagcuccauuuuuaccaguuucauuuagugagucccacagacucuagcagguugguagcauggucccuuuagcaaggcugagcaccagagauguuaagcagcucccuggcugugccaucucuugggaguggcagagucugggaggaucugaacucaguuaagcuauuuccuucucagguauuauggacacacucaggugucuccuuccccuugaucuuggggaaucuuggaugaugaaccuagagaugacccugcccugcucauagccugucauaauacgcacucuaagggagcggcaugucccuggaggcuucucucucaaucagaaaguagcuccagucuacaucuuucauugagcccauucugucucucuaagggaggggcuucgaacaguucaauucauuguaagauaaaggagauuuauuggagaccagaggguuccgaagaaaacauucuugaaguaucuucauauggaaaggcuuguuuaagagauacaauugccauuuaauauaagccuacuugugugugugugugugugugugugugugugugugugugugugugguauacccacacauguacaugccuguauaugggugcacauguguggguguuuagguguuugcacacauacagaggucagaggacagcauaucucucacuccuuagaagcuguuuauuuuuuucuucaauacagugucucucacuguccuggagaucaccaugaaaacuaaggcuaguagccguccuguaaguccuggauaucagucugccuguuuccccagcacuggauucuaagaguguaccaccaaaccagcuuucuuauaggaccuagugcuuuuucagcaagcuuuuuaugggcugaguuaucuuuccuagccuuaguauuugucacccaagucauaggacuccuagauggcagaggcguuguuucugaggaaacaacuguagacagacagaagcucauccuccauacucgaagcuugguccaucgcugccauggauacuugugcccugcuggagaugaucuuugguucaugcugcuccccucucacccuucccuucaugaugggaacaauguuggcuaugcacgggugggauaaggaagcaggagcguuaccuauccugggguuaggagaagaaaguaguggugaagcuugcggguuccaggaggccaguccagguggguuugaaugucugcuucaccaucacagcucagugaucucgggcauguuucuauagucucuccucucugugccucacuuucucuaucuggaaagugguaauuaauauuaccugccucuuaaagguguuuuaaggagcagauuaguuagcacuuguaaaaugcuuguaagagugccugacaucuacacaagcacucacuucugcuaucguucuuggagagucugaaugccuucauaaauugccaggacuuaaaugacacacagaguucaagguuuggcccauuuuaaugcaagagugacccagagaggauggauggcuuaucagcaugauaguugaucuugaugucuggggcaccaucauugcaauuccuaaguguccaaaugccaugaggguuaggaucuggauucugucucacgagauuaaaauaagcacaagcguguacuuaauauuuucugagaauuucuuauugacccagcagccauuuucagaugcuggcagugugucaggccccuggcuaagguagcaaggugaagacugaguuugucugucuucuucugcccuugaugguucacgcacacacagagucaauuacagggacacuuagcaaauaaccaccacauguccacacacuauccuaaaagucacauugguuguugcacauggaacaugaggggcuuuacucaaaagucacagcuugcauuggguucucuugcauuugcauauccaaucugccagguggccagcuagaauugauuuucauaagaaagaaacugccucucaucucccaaccauuguccaagccucugccuuuauuuuuaaaccaggaguugacagcaaccaccugggucaggaaccggcagguggcaucugacugaagucaccuuagcagcucuaccuacaagaagcugauucaaacauuucucuuuuuuucucuuucuuucucucuuuuucucuuucucucucucuuucuuucuuucucuuucucucucucuuucuuccuuucuuuccucccucccucccucucucucuuucuuucuuucuuucuuucuuucuuucuuuccuccuuccuuccuuccuuccuuccuuucuuucuuucuuucuuucuuucuuucuuucuuucuuucuuucuuucucucucucuuuuuucuuuccucccucccucucucucuuucuuucuuccuuucuuucuuucuuucuuucuuucuuucuuucuuucuuucuuucuuucuuccuucuuuccuuccuuccuuccuuucuuucuuucuuucuuucuuucuuucuuucuuucuuucuuucuuucuuucuuucuuucuuuucuuauguaugcuggagcagggagaggcccuggaagggcugucucucugagugacagcuucccuuugugaaacuggucaacugaaaccuaagcugcaaaugucaguaaaaauaaguaguauuucaaagggacuuugugcauuuccuuccucugugugcuguugcuucacccgccaagaacugcacgagugccugcagagagcacacugggccccagagauaaggaauuaacugcacaaaaccuccuuucuucauuugucugcuuccaguguuucaugauuuuuuuguuguuggugguggugguuuuugguuuuuuuuuguuuuguuuguuuguuuuuaugguaccugcuugcugaaaacagaaaccaaagaaaagaagccaacugauauuggcuuacaugccuucuuaagggugccuucuuucuugguuuugcaucugucugacgcuguucggaaucugcuuccugcuuuagaagcgagcagcugucaccugcacaguuucagaauaaugggcccacuuuugucaucaugaaacaguuguuuggguguggcucuccccuguucuaagcgugaaggaucuucucagcacaugggaagcugguucaaaacacuguggggugauugaaaacacugagaggaguucccaccucagccaucuaaaagcuggggaauugugcacguugcuuuauuuucccccagcuucuguuucuugacauuuaaauauauauacaaagcuuuuuuuuuuuuuaagaguacagaugacagaaucccaagaguucaggacaucaaggaacaauuuagggaaaaaacccuccucucccacuaugauccacucugaaaugaaauguagaacaaagcaggguccagguggagcauguggcucuagauagaaauggucacuuccuucagcaacuccuuucuuuaccuuguauucucuuguugguaaaugcugagcuuuggaggguccagagucuggguuaaagccacuucuuucugucucaagacccagagucaggcacauucuccgucacugcugagagaaaaugucgugaggugacaauucagaauauaauugaaccaucccugccacuaugaggacagagcauuucauguagaagagaauucagggcuguguucucaggccugagguguucagaauggcugauggcauugagggaaaauuguaguuggaagagagccagcaacucccgggcuagagagggagagagacuauagccagaucacauuguucuugaccagaaggaaguuuauucugggugcagcugaauguauagugcuagaagugauaaggcaagggguaacaccaguugauuguggaaauguguauuaugagcacauuuccaguugauuguggaaaugugcucauaauacaagaauaggugggaaacagaguguggguaugcauguguguguaucucugugugucugugucugugugugugucucuguguguagcuuucuuagaaguuggcuuguguuucuuuauuacucuuuuggauauuauuuugucuguuuccuaugacuuuauauuaauuugaagaaugggccuaaaaaagucauuauuaacgaagauacuuuaaggaugggguccauuaugauaucauacgucagaucugagggucccuuauaaugucacaucucagauuuaagcuugauguaucuuuggaaagccaaagugaauuuugaaggccaugucaguaguguuguuuauuuggauuuuuguuguucugagacaaggucuuacacuguaguugaccccgauucaccauguagcccaggcuggucuugaacucaggugauccuccugccucagccucccaagugugggauuucaacugugagauacuaugugcuguuacuugguuuucaugugugugcauguguguguagguucucauuugugugccuguucauacaagcauguucaggcaagagaaaaacauuggcuuucauuccucaggugucaucuaccuuguuuuuagacacaaggccacuuauugggcuggaacgcaccaagaaggcuaagcugguugggcugcgagcccaugggaucuaccuguuaauccaacccuaauauugcaagugcuggccaccauacccagguuuuuuguuuuuuuguuuuuaauuuuuauuuauuuauuuuuuuaauuagguauuuuccucauuuacauuuccaaugcuaucccaaaagucccccauacccccccuccccuacccacccacuccuacuuuuuggcccuggcguuccccuguacuggagcauauaaaguuugcaaguccaaugggccucucuuuccagugguggccgacuaggccaucuuuugauacauaugcagcuagagucaagagcuccgggcauacccagguuuuuauagguggauuuugagggauuaaacucagguucccaugcucacaaggcaagcacuucacuggcugagccaucaccccagcugcauguuuggcuucucccaaugccccaucuggcgugguuuuuuuuuuuuuuuuuuuuaagucuucacuuacaagcacuucuuaccauugaucuaguuucaugcaaauuauuaaugcaaaagccucuaacaucuccguuuccucccacagauuugaauguaaccugccgcuacgcagguguauuccauguggagaaaaauggccgcuacaguaucucccggacugaggcagcugaccucugccaggcuuucaacaguaccuuacccaccauggaccaaaugaaguuggcccugagcaaggguuuugaaacaugcagguaagagagcagcaccuucacugggaaaagcccacugguuggggcggcgcuuauggcuggaaggcuccucccugacaguugaauaaguucuugccuaaagaggcagcccuaccuauuaauuuggccaagucaaacugaaaccgguaugacaacuggaauuuaaagucggcuaaagacaccuuugugaaucauagggagggaggccagaggaagccauuagggucauaucaguugcaacccucuggccuaaugugcuccuguagcacucuccuggcuuugaagaggcauucaguaucacuguaggaaccacaagaaaaugcaagccaaauaacaguguuuaagauaaauagguagcuggcagagucuugacugugcagacuugacacaaagcacguucuucaaaccucucucucucucucccccaccucucucugagcuuuuauguugagcuucuaugcugcuaugguuugacaaauuaaguaaaacgauguggaaguuuuaaagcuguauuacauuaaaguuauuaucagaagccuugagaagucuuuuacaagguacacagguucccagaggaccuuccucaaaucauuuuguuccaggauaauugauagaggcagagaacauuuuauauauauguauauauauauaauuuauauuauuuauuauuauaaugaauaguauauauaauacuauauauuaugccaauauauuauauagacuauauauaauauaaauacauauaauauauaaaguaauacauauuauauguuauacauauacauauuuuguuuccugucacuacuguguuaguguguauguguguguguguguguguguguguacuuuuuuguggucagugguaugcaugaagaggggcuuagugacaacuucaauugaguaauuagugugguuugaguuccccagaagaauuagauaguuuucauaagggcucugaaugcccaccccagcccauagcuuaggcacuguagcucccuuccugcggcuaagcccacauguguucccacacacaugcgaacaaugcuuuuagaaagucuagugcagaccucuucgugcaagcuauuaaacgcaaguuaauugcaucuguccccagcccuuaguuacagacucaggcacccaccacuugaauggcaacugagacucuugcucugccuaauauaguaaccaugagccacacauggugcauuauauuuaaguuaauuaaaaguagguuauaugaaaaugaguucuuugauggcacuagcugaguuucaauugccugguagcugccguaucaaacggcauggcuuaggguagagacuauuuccauuguuuaagaguguucucuugaguagcgcuagcuaggcaucugucuguaacuguccagagcuaagucugagggauguuaaugaaggugugauggcucugcagcuauagguugugacucauuagcuucaugaaggauggccaguuaacaaaaccuacuccuaaggcuaugcuuuacaauguggucugacuaggucgcuguguuaagaaaguguuuuuaggaagcuggucuaugguugugaaaugcaguuaagacauacuuuugaaauagaggguuuuuuuguuuuguuuuguuuuguuuuguuuuugguuuguuuguuuguuuuaccuguugagagcuagagggaaaaaauacagaauauuaagcugccaggauaaugccaaaggcauccuuuaccuuaauccuuaaacugcccuguuuauuucuaagacauuuuguagaggaagcagccgagccccacagcuugucauggauacacugcuuauacuuagacgagucacagucugcugugaucagucugaacauaaugacuaaguccucccaagggacagaggauaaagggagaggaugcaaggacuugucuuuccuccuguugacagucacucacuaaggccauauauacuuauaggaauuuuaauguccccaacucauguauagaacaugcacauauaagugacagguagaaugauauagugaaaaaaaucacaauaauacacacacacacacacacauauauauauguguauauauauauaugcauauauauauauauauauauauauauauauauauacacaauuuuccaacaugauguggaggggcaagguaaagaguaauuucacuguugaguauuauuuagaaaauaagcagaaaaaaaccucugcugcagaaaucugucaucgcacccauaacugguauuaaguguuucaaaacucacuuucauaauuucccugagguagcuaaggaaucugauaucugccaaaaaccagaagggaucgucucacagguucagccaaagccucagcaacgacuucugucuugucugccccacccuguuuaguggcaacucucagguccaugagaacuuauuaacguuuaauugugugcccucccaccacugagcuaaagagacucugggaaaucagucuguccguuuggacggggaauuagucauucagcuuccauugcaacacccacauaaugagagacuuuaugcuuaggagcuuccaagucaugcucauugucacgggucuugcagggugcuggggucuguucuguugucccugcagaagaggguaaaagaaggaaaagaugcugcguuugagcuugcacaacaugucucaaacccugcuaauuuagcaucucccucuuugcucucuugaugucauacacccuuuuccauucaaguaacauuuucucaguccauauccaugucuugagacauuuuauauuucuguuauauggccacuagggugcuucugaggguggugguaauaugcauuguaucugaaaaggcccccagaccuaaauggcucucagaaucaccuagaugggugugggaguggauaguguguuacucucuugagagcuuuguuaagugagccacugccauccacuucuguaauugcuguugcucucagcucaaggauagcaaauuuaucuccaugggucuuggauggucacaaagccagacacgccaugugcucagcacaggagcaaggcuucaugcuggcgauagugggguaaaaaaugagucucgagggagaaggcaagaacaggaaagaagaggagaaugggcaauaagacaggucuggagucuuagacugaacggaaggccaauucacuuguuaucuugggagauugggucauuuuaugucauuuuugaaaaauauaaagcuaauuuggugucaagucuuacaguguaacuuuuuucuucuguaacuuaggcuucuugaugccuuuaagaacauugcugaccuuacauuuuauaugggacuauuguuuuguauuuguggaccuuuaaaagaauuaucuaaaaacaacaaaaaucuccagccuuuaaagaaacuaguuuugccucuguccgucuucaucucucucauccuccaaugcuguuguuauuggauauuacauaauucaguuguuggaaccccuaacauuuccagagaaguguuaugccauauuaaaugucauuugaugggguuuuaugaaguggcaucccagacguucaugucuauugcuucuuguuuuuccuuggcagguauggguucauagaaggaaaugugguaauuccgaggauucaucccaacgcuaucugugcagccaaccacacaggaguauauauccucgucacguccaacaccucccacuaugacacauauugcuucaaugccucagguugguuccaagugcaugguuuugggguugccugugggagcauuggcugacaacaguucuguugaagcauggguggagcuuucugaagcuccuacucaaaaugaguccugaagguuucuacaauagaaggaacagccaugaacagccuguguucaugguacuaaugugccaggcauauagagcagaugauaaauaauuaaauaucaacuauuuuacaugaggauggagagugcacaggaaggcacaagcuuuagggaugcuuuuuauuugagaggugaacagggaggguacaucugaggaguuauuuaggagagccaugaucagaguaaaggaguuagcuaauggcagaugggaaggccugugaaaccagcauaaggggcuucuuaauucuacccuacaaacaccaggacauucaacagagcaaaagccuaguggucagaggacaggguuucaggcaaugaaguuagagagguauaagggaagaguagcuagagccuuuguuguguugggaaaucgaagcauuuuuuuuaaaaggaacguaguacucaucuauugauaauuugaggguacaagccaaacagcuaagaguauucuuauaaauggaguuagggaaauggcaagaaggauaugauagacucuugaccuucuugaaggccuccuacccaacagcugagaucacuaggaauaagaaagcuaaagggagauagacaugcugggcucccuccuuugccuacaaaaccauuuccagccaugagcuuagaaguugugccuacaagucuaauucaagccaacacacacacacacacacacacacacacacacacacacacacacacacacacaaucgaagaauucuaugaacuguaaauuuccagucaucugaaaauaauuaaaaccauaaaugucaaaguuuuaaaugccaacaaucaaacgucuuaguuugcaaacuguaucuucuguuccccugaaggguugaaacuauguggcuagaauggaaaagcuuugagaugaacuugucacauccuccaggacugaaauuuuuccuuaaaaauggaaggaagauguuaaauagauuggaaacuggcuuaagacuuuaucuccaugaaaccauagauaguauaauauggugguaggauauaaaaacugugugggcuuuuaagguaacaugggacaucaagggcacugggagagauuacaucagugucuucaggcugugucagugucacccacucaucauuucacaagcacugaggaucagagugggaauucagaggugaaaucaagaguuuucgggaagaggauauaugcauugaggcugaguuguugaaauauagcacaugaacccagugauuuauuucgaggauguauggggauuggagagacacaaacauaaaacaagggaaaauaucacagaaaguuuacccaucccuaucauaugaacaaaaaccacauggaguuugaucaaaauggggaacguacacccgaaauuauacaggacacuuuccauacucaguaacaugacccaaagcucaaauggguaaacaggaaguaggcaaagaguaaccugggucuaacuucuuccaucuuggugcaaagguuuaggaaagaagggauuggacagguggcaaaggcuuaucuugauguaauccuuccugcugcucacagucuuggguucuuguuuugcuucuccugcugacucuuguccagugaacguaugcaauaaauggcacugcuguguucccacacacucucgggaguuuuacaaguuggugucacuuugagcuaagguucugagaaauguaauugaagcaggcaaaagcacauacuguuuuauggccaagaguugaagugauccaagcaaacagccacugcagcuauucuuccuguccuuccuguugccugugaguuuaggucggucccuagcacagggguccuugaugaaugcucuucuccuuagggaggcggguguuaguucaguugaaaacuaagagaaguacucgagaucugccucacacccaaaugacuguuaaaaguaguaacauuuaaaaauguaucauuuucccuuuuuuucuauuucccacauauugauaagcuuuuauaauuucccuuuaaguucaaagacgauauuuaucaauaguaucuucacacuacugggcuaauuuuauuggggguaagaaagaaccagaaacuauguuucuugucuuaaaggaauuaacaaucuucuugaagcuauaauauagaaaauacagaaaggagagaggaggauaaauauggcuagggauaagcauauuguauauccuggaugccagagcaugaagugagcuaaagaugcugacagugucuagcucccugccaagaaugucuugaaaagagucuuaguuuugaccuaacccaaggacugcaaacacaagaucucagggaaaggcauacccauaaaccugcagcagggagaggaagcagcaaugcauaccauagcagauaacuucgacaugcuaaaacccugcucguauuuccauggcuucccaaugaaaaauauggcagcuugaagaaaaggcucugugguuuuuuccugccucaucucucaguaucuaaggcuugacaugaaugagcauggugacuucuggugaauugacacaaaugacugacaaauucaugaucauguuuuaaagcuugcuuucauuaagaugucacauucucuucuuacgguaggaauuaaggagcagacuuuauauuugugacuugugcauucacucauuuauuugaggauuguuggaaaauguauucacggaacaccuacaguguaucaacccuggaggaagccccuuucuagcuggcacccagagcuuggcaccuaaacugaauaguuauuaucuuagcccuuugaagccagaggagccaaccauucugagaauacagccccagggaagccaaguuuaguauuuauucaacaaaccccuguauucagggauacucacagccaugccuugcuuaagagacugaagcuccaucuaaugaggucauuugaguggacacgagcaugaaugaauaugguaacuacauauuugggucacugugcaucuuggcauccuggccagauuuaacuaguguaugaaauuauaggugaaauggagcaugagggggcucugugugagcacuuaucauugacagaccagccucaguguuguugacgugccgcauccaccgcaacuuuguuccagcaaauuucacaggcccauuucuggagaugcuccucauucggauacuagaaacaucgcacagauuggcucagccccaagaaaaagaauaauaccuccaaaucucuccaguagcuuacguuguccuuacucuuuaauaaggggguuugaagagggaauaaagaguuagagaaguauuauuuucuaagaccuugugaauuccuuagaaucagggauaggagcagguucaucuuuuggcugcccuuuuucuucuaugaccuggccuguauguguugaguggccuuuagaaagaggggaugaacuuggaucuucuagucacuacucagagcaucucuuuccaggcuuauccacaggccucuguugauauuuguggacuguuuuaggaguuaccauguuagaugugcuuucuuggagaauugagaucuuuccucucuuuucuucucauuugacaaugagaagaaucucucacaauauuuuggcccaagcggaugaacuuaguacucauuuuguagaguccacacaucuuuguggugggcuggcaagcaggaggugggggguaggagaaucauaugaauuaccacaaaguaaaaugggcaagagaagaucaugguguacaugaagaagaaaugcaaagcugguauguacuggucuggaagggauggacuucucaccuugcugguggugacuuguucauuuacagguucucuuaaugaauuuucacauagcaacuuuugcaagagugcuuuuccuaaagcccacucuucuacuauuggaugccuacaccuggcacauccuugguuuucaaagaacugacuugauuuaaaaaaaaaaaacuguuucuuuauauuuagcugcuagugauaagcaaccacuacuuauuugcccaacuacuuguuucugccugaguucugagugugcaacaguguaugacagggaacuuaaaaaugcuugugaccugccuuccuugugacaguugucugccaguugccugccucugucccuccaaaccuccaugcaugucuguauguauccacccaccaauuaauuucuuucuucuuucauccuugucauaaagcaacucuagaagaaaccaaccuaacaaauucucauucaaaguuuuaguggaaaugcacacccuaaaaguuguuaugcaguugagucugauggcaacacuuuuguaaccccagcccucaagaggcugaggcaggauaacuauaagaguaagggcagccuguguaaaaaacaaacaaggggggaucccuauagcacacaaauggaaccaacccucacauuaaaacaaaaacaccuuguagcucucuggguuugaaagcucuguagucacugaugggcaccaagcaucagggcaugacugagguuguaguuaagucacauugucugaucuuaggauuuaggaaauaacaugaaagguaguacacagguccuggcuucugaugguaucaggcaguacuggccauaagucuacaaaaaacaccugugggugaccagcuagcccaaaucauagcgaaagaaucgggguagaagauaaauagaagacaagaaaaaaggagccaaaugauauauguuaagacagcaugaguagccaugucaaagguggccagcccuagcuggacaacugagaagcccugcacauugagaaggcacucauaaauauuagccaaacuaaugaagcuauuaaucuuuuaauauaaaacuaggaauuuguuacuuacuaaagauuuugauuaccagguaaauccauugguaauguuuuaaucuucagagucuuucaauguucaugucaauucuauguguucaccagcuucucaucacccaaguuuauaucugggauuauaaauuauuuuucuugaucgucuauacaugccuucauuuuaacuuauuuucacaaugauuauacgugucuuuuuuaauugaaaagaguuuuagaauucucucuaaugguauacuuaauuagagaauggccuaugucuuuauuauuucuaauuaaacaugaaacaucagacuugcuacagugcaggcacagaaugccugccucccacaguccugggauagcccaguguguuuugccagcuccgggauugcaagugucaacacaccugaccuagaaugcaugcuuuucuuaaugaaugaaguugcuggggugggaauaguaagauuauugaaacuuuugaaguuaaauaagauuguaaaagcacauuacaaaggugugucccuuuuggauuuaccaaauuucagggaaaaaaguuauuuaggacaauuagaguaaauguuaguuuaacugacuuaauaggacauaaucugugaaguuuuuaaaaaauuauuuauuuuuauuucauaucuuuguuuuccuuccucacagccccuccugaagaagacuguacaucagucacagaccuacccaauuccuucgauggaccgguuaccauaaguauguaccuccucuuguuucuggugaucugucuuguuccugaagaaggcaucugacuuguucucuauuacuaauauuugcauaggcuauuaaguuguauccuuaagggaagaacagcugugauuacacaucccauuucccuuuucaauucuggcuugaaacuguacucugauuuacccuauaccccauuccuaaaacaucagucauuugaaacccacauccauauuuugcaaacccauccguguauuccacagcacuaucauuuacuugauuuuuuucuugugguuuccucucuccuacuuaaaauacauuuguuuuucaaaagagauuacaaauggacaaccaacaucacuuguaauaaauugagggcaaccuuaaaaaucaauuuaaagggcaagaaaaaguaaauaauauuuucaaucuauagcuguagaagaccugagcugugcucugucuaagagagaguaaagcagucuaauagguagagaauuccacuugggaauucccugcauguauaacugauguacaugcuaugaaagacacaggcuuccugauguguguuucaauaacauuugugccacacccaccucugaucaucuguagaaaauuacaugugcuuagaagaugggaaaccuuccucagagcuuuccagcagguaaccuuauaaaaccuuagagauuuuugcuucugugcccccucuuguugggaagaagaacaauguuagaaaaagcugauuuccgcuucugcuuccuuggagccagcccccaacagaggguguggacauaggcgcagcaguagugggaugccuucccagacuguguaaauccagccuuucacuuggccugugccuguggcagccacagaaugcuucacaucccaacaacuaccaugugauauuagagcaucaacuuucccuaagcuucacucuucucuuauguauaaugauacaacauguaagaaugaucauacaacucuaaugugucucaugcaugccuggcccauaucagaugcuuaaggaaugcucaguuuccaugguuucuaaaaauuuccuccaaaguccagauuuacggaaguuuuaucgauaacaugguuugaauauaugucacuuccaccccuccgccuugcacccaccaagaauucaugugacagaaacuuaacucccaaugucacacauuaagaguaaauggaauugagguccuugagaaguaguuaggacuggauggaguaaagaggaugaagccugaugauaucaguagguuuauagggcaaggaagagaggccugagcuggcucacuugcugugucuccaugugaugcccuuggccacaggaugcagcgagugggacccacagcaggucccuaucagacacuguucuuggcgucucagccuagacuccagggccauaaucuaaacaaaccuccauucuuuauaaauuaucuggggguuggaaagaugucuuaguuuuaaaaguauuaguuguguuugcauacagccuggguucaguucccagcaccaacacagaugcccacaacugccuauaacuccaguucaagaaaaucuaacacacucuuccagccucugugggcuccuacacacacaugguacauauaaauucauauagaauauacucacaaacauuaaguaaauauucuuuaaaugauaagacaauuuaaauugccuuggcuagauguucagaguaacugagacguugacauuuuuccaacugaaaguuucauuuaagcuagguaagugaaacaaaggauccuugguaccacacaugcaauucagcaggaaacaguuuccagcaaaguacacauaaguagcugugugcagcaaauggcugaggaucaaggcagaaaauguguuuuaaggauggauaaugaauuugauuucauuuuuacuuuuucuccucugguucauucuggucacuuucuuauuaaacuaaagauucuuauuaaacuauauauauauauauauauauauauauauauuugcuaauuuuaagguugaauuccccugaggaugguugaagcucugucaauauuuagacaaaccaguuuucuagccagaaauugggguuugauuaaacugacaaaaguuaccuuuuaaaaagaaucuuucuaaaggauugcaaauauaugccuuuuuuuguggaggcuaugugacuacuauuucaaauccuuccuggguugggauggaaucaagaguaacaaaauguacacauauuucagggacgauauagggugggagaagcaucacuuauugagccucuucuuauuuugaccacuuacuauguugagugcuaaugacagugaaucaugugcagcgcaugacaaccccauccagaaggcuggaccauuccuuuacuaaggaagaaacugaagcucacaggcuuaccuugucuaaagcuauucgaaacucagauuuaaauguggggacuucccaguacuucaacuuucuccucauuucuagaguaugugggugaaggggguggacuauuucaacaucucacacacucuauaugagcauuagacagacagauuucuuuuuaaagcaaaaagaaaguagcuuuaaugucauguuauaggacaauccauuaucuuuccuauacucaagauauaucagcuaugaauuucuaaaggugugucuguaucuccuucagcuauugucaaccgugaugguacucgcuacagcaagaagggcgaguauagaacacaccaagaagacaucgaugcuucaaacauuauagaugacgaugucagcagcggcuccaccaucgagaagagcaccccagaaagcuacauuuugcacaccuaccuuccuacugaacagccuacuggagaucaggaugacuccuucuuuauccggagcaccuuggccaccaguaaggagaauggcauccuggguuuuccucuagcaguucuuugacagaaugccaacggccuuccugaguaacgcacaccccagggucuguuuucugccaucucuagacaucuagcugugggugagaucauuuagggaguccagcucuuguuccugucaguguuccuggucauugugccauggcuucuacuccccuucagauccccaccaucuucaccucugaaccucuuaccuugggauaaggaaugccauauuggcaggguuuccucaggaaggugccgauuuucucuugcuccuaaggauuuaacagugccuccgaccuguuacagaaauaauuugugguguugcuuguuuuauucuugucauuugccauuuucuuuaagagaaaacuguucucuuaaagucaggacuguagaguguaugcuccaucagugccuuaaaggauccauucuuaggauucugauuguguaauauccauauucuuaacccuaauuuucaaaccaugcucccccccccccccccgccaaaggaagcaagagugagggguuuucugaucaccuucuguugcuguagaguucuggauugcaguuugugggggaagacccuaaugcaagagcauuagguaucugugggcaauggcaggggaggcagcccaugcagcauugaguggcugcagguuugugcagaugagcucuguuaggaaggugcucagagauuuuuaucuccuccacuucccucucugcacuuccucuaugguuuguuuuagaaugagguuuuagauggccgggcuccuucuguggagaauuauucacacccaaaaagggcagcuaagccuucacugagccuccuaguaugguguggauuuucacauuuccuggcugaaacucagagggguggaacucuggcuuuuucaccguuuggcaggaacguacuggcuugggaauauacaagauagggcccuugucacccagaagccaggaagccuccauagcacucugaagcaagcugaacucacuuaacaguguuuuagauuucuguuaucagguugcugagugagggggaaggcugauaugaacgggugcaggauuccagucauucucaggaaauuguuugaagccuuuccaaaaaauaaaaaagaaucccccaucagauuccggggguucggggauagcucaauggguaaagugcuugccaggcaagcacaugaggaccagaguuuuuugaucuucagcaucuacauaaaaaguugagcaugacagugugcaucugcacuccuaauacuagacagagacggggaaaaccuggagcucacuggcuagccagcccgggcaagucagugagcucuagcuucagugaggguuccuagcucaaaaacuaagguggacagcaagcaggauaacaucuugaugucaaccccuggccucugcacaugccuaaguacacggacuccaucuauccacaugaggcaacgcucacaagcuucucacgcccucccaggucacuuccucucugaugguuugucaccuuguugucuguaguguccugggaaauaccucuccacagagaccucugcagagcaggcaggugacauugcgagcuaugugcaccuacuuggguccccuguccuuuugaugcaaccgugucugacgugcuucucauuggaaugugcaguuuugacagauguuggcaaauacaguaauuaguggucugauaaggaagcagaacaggucuaaccuaaaguccuauuucccaccccaaaagaacauccucgaacaaaaucugucauguggagauugaauacagcuggagucccaaccuguguggggugggaguuucacauguacuugaagagggguaauuggccaaauauauuagcauccuuaacccauucccuaagcacugcuccuuccccauccaaucuggccagucagugaauccaucuuaaggugcuaauuuuguaccagauccauucuaauacucagagucucaggguugagcauggcagcacgcaucuguauccuaguaacaaggguaauggagacuggagguauccugcagcuugcugccuaaccaauuuagccaaauucaggugcagugagagauccuagcucaaaaauaagguggacagcaaucgaggaauuuaaugucaaccuguagccuccacacaugcacaaguacacagacuccauccguccacaagguacaucaguucaagcuucggugcucucccaggucauuuccucuaugaauaucaaaaaaagaaaccagggucagugagguuuucauccauucacuccauaucaugugucuucucugcuccagacacugcugagguuuaugagggucagaggcagaucgcccuucacggguacagcauccuagcccagaaaucaaagaaagggagugaccgaagcguaccuaaaacgcagcucaggauucgagggaaaaggagcuuuugccuucccuuuuuuagagagcauguggcuuaguucuuuuuaauggguguggaggagaggccaguuugcccaccaguuuaaguuuacuugaauguagcagguagcaagagagcuaugcuaucuaagcuucugaauagaauccuaccuuuuaagucccaugaggagcuucccaagggcuuacuuaucacuguuggguggagggcugagacacagugagagggaguggauggagauuagcaugcaggggagcagaggucaagagcugggcuggcugaggacauggaagaagcugugccuggcuuagccagcucauucuucccuuuagggugcucaguggguggcaacugggaaaacuagcaagaacaacaggcucuguaggcuuggguuaucccacuggcugcuuauuauaaauguuauuuuuggaaggaucugccuggaggugugucaucaguuccuucuuauuggucaucuggaauucucuggaaucaagaagccuaaacuaauuuaggaacuaggcuccugccuuggacagcacuacuuccugucuucuggguguaaagugaauaauuuguuuuccaucuuacaugaccuuacauggguggggcaaguugaaaacucacaccuaggcugacacuucuuucacugucuccucucacacagcuccacuuaggaaggugauaucaugcucauuuugucuucuguauguccguuuuuucuuagcucauucucugggguacuuccagguaggggucagaaacuaugcaucuucagugcaguuuuccacaggaggcagucuguagccucuugugggugccuuccugggagccuuguaauugccuucucucucugcuuucacuaacgugaccuuugacauuuguuauaugugaugcucccauucuaaacuggaguucgcauggaacccaguagguucuucaugguaugcaagaaucaccugcaguaugugaagaccauaaccuagauuuucagggaagcguuugaacuaaaacauuuucuuucuuaaaaccccagcugauucagacaaugaucccaauagcauuugcuauuuuguuacuaugggggaacauucuggaaaccaauccaacuuaaaagucaaaugaaauauuuuuuuuaauuacaaaauguucuuauuaucuucucucuaacuugaauagaguucaacaguucuuugcuuuugucaucucgauauggggaagugauagacccuggagaaaguuuuaucuaccgacagcauuuuagguacacacccucuacaaaauucuuguccaacuauaaaguuuaaaguugugcuuaugaguguggguggagccuugaaaugccagcugucacagacuaccuggguguaaugcugaacagacaggaaagauacaagcauccucaaagaaugucugaagauaaauuaacggaagccacugucagcucugcugcacugaagaccuccggguuguggcugaaugacgccaucaagagaaaaggaagucucucuccaucagaguuacuuugcugcuugaguuggcucuggacaugauugagagggguugaguagaagaccaagaagcacugacuucaugcccuaaucugccuuguugaugcuguccugagauucugcuagauaguaggagucuggaaauauaaaaguggccucaacuucccuuuugaaacccucauucuauaauaaauagagauauucuauuaggacagagaacacagguuucauauaggugaaucucacuaaacacuauuuucauaauuaaucuaguugccucaacugugcacucaaaaagccaugcagcagcucagaaacaaaauaauuggauauggucuugguuugguaauucacaguccacaacucagacucaggagcccacaacgagugcaacuacagguaaacucucauaauuuuuugcugauuaucugucuucagugagguguuaaggaggauagauguucuuauagacagcauccuggcugacaucagguucugauaucuucaguggccacagaggccugugaaaaagaccaagugucuccuacaugccuaacuuuaacuucaaauuaguuuuccuauguuuaggaaagucauugaagagaugaccucauaaaagcaucuacugaccaaaugaucauaccaauaaaagaaacaaguaaugguuaaugaauaaaaaacauagacuuuaaaaaaauauuuugacacugaaaaccuuuucugaaaacaccaagaaauggcauaaccuguugcuuuauaucagugucuaggagcuacaaauaggcucuggggauauguggucauuagcucucaaguauuuugaccugguagcuuugcccuaggggguugggaaaggcaaucagccuauaacaucaguucuuaaccugugaauugaaacuuauuuggagauaagacccuuucacaagguucaccuaaaaccuccagaaagcacagauauucacauuaugguucauaacaguagcaaaauuacaguuguaaaguaguaacagugaaaauaauuuuaugguuagggaacaccacaacaugaggaacuguauuaaagaguuguaauuaggaagauugauaaccacugguuucuaauaauaggagguaauagggaauucuucacuuauuaaccuauauugacagauauuaggaccauauuucuuaauaggcauugucucugcagaaauggggaaauagaugugugugugugugugugugugugugugugugugugugugugugucuguguguguguauguaugugugugugugugcguccuuguaaucagcuaaggaaacccugcugauguucuucugguugcuccaucacaaugauuaauaucaugcugagguggguggcugcgggggaguaaugucaguauaagaaaaaugcugauuguaucugugcacuuuguaggacaagucaugggaaagaaaggggcuuuguaacuguguuucuucuugaauuguuacugggcuuuuuugauaacgggcaaaacgaaucucauugaucauugcauuuggaauuuuauugguggcuucagcuuucucugcuuuaacuuauccugguauuuuggguuccuauuauuucauauuccugugugcauuaugacgacauaauuggcaaucuuuagaguauucaaaucaagucuguugcuuuggucuugguggagucauuggauuucuucauuucuucuugauauucuugguuuacuauacuauuuuuuaaaauggacugcucuuccuugcaaagaacaauuugacaugaaaaugauuauggggcaugucucuaugauauauggguccucuuuggagagagguggaaagaccucuucuaugucucucuuccugucccauucuugcuugcauuugagauucauggggucacaugccuguggugacaugacuucuggcaaagauaucauacucugaacuccuagggaaugauauugguuggucaccuucaauugugaagaauaucacagagcuugaguuccuaagagcuggccauuaaagucacaaaugguuagauuuggagaggaucuuaaaugauuuacuucaaccaacuuuucuaaucaucugauacuuuaauucuaguuuuuagaagaacauucuauuucugaaguucucaccaugggucuuaauuuggccucaugggaaaggagacaaauaaagaaucuuuguucuagcuuauagacuggaacuucagauaguucucaugcaaucuuugagacaucucuucugccaauuggacuucacacaaguguccagcacagguuuuucaucuuaagaugaaagaacggaccacuuguuauuuaagguuccuccaccucugacauuuugugaacuacaguuugggcuccugaaagaaacagaacuuuucuuuuaauuuccuuuuuuccgcuuucuaccacugaugucaagaagaggugauuuucuauguagggagagagugaaaaaauuuacggugcuauuacuuaggaacugauaauuaacauuucaacaaucaauucaaucaugguuacaacagccuugaugaccaccccugaaacaccacccaagaggcaagaagcccagaacugguuuucaugguuauuucaaccaucagaguccaagagucaucuucauacaacaacgaagaugccugguaaugaguuauagauaccauauaacauaugucugcuugacagccuuuaauaauccucauuaaccuaugggaugugguuaaagucuaaacaccaugcugucucacaaaucuaggaaggaucuugaacucugcguucucuauguuugauuuaauauuacuaauacaugauuuucuucucuauacuuuauaggggucuuaggaaacuaugaagugggggcaauucuuuggugauaacagaacauuucaacuuuuuuugaacauuuuuggaugguuaauaaauggcaaaaacauuucuguuaauuuaucuuuuucucucuugugguaaauuuuacugagaucgggcaaagucuuaagagcuccuugcuuuccucacauuagagacucagggucugacgcuaaagauggauaaaguccaugagcccuuuuagaaaugucagaauggaaacccuugcuucuagugagugaaaccccuuacuucauacaaugaacaccgauaaaaaguaagaauaaaagaaaacaaaugaauuuuuaagauaugaaugcaccuauaagauuuuagaaaugucacagugggguguuauuaugucuugaaacagcaaauaaggagaugugaaaccuuccuauucuuguccugacauccuagcuucaauauaaaaugcuaaugauguaauaagaaggauaucugaaagcaagggggauuugcaugggccugugcuucguuguguucugcucuaacuccuuuggcuggcucuacugcugguuauucuuuagccucccuaaagagaauguuauguuguaaagauuauaaccagucauuuuaagguucacacauuagcuucagugaugaggguuuacagauauacaaaccuacucucucauuuucuucuuaaaaucuugggaacuccaugauaucucccaugccugacuuucuuccuuggugaaauggguugcuugacagccagcucaacuacuaauguaagucaccacaacagguacggagucaaauaccaacccaacaggcugggagccaaaugaggaaaaugaagaugaaacagacaaauaccccaguuuuucuggaucaggcauugaugaugaugaagauuuuaucuccaguaccaguaagaauacucaauuacaguagaaccauuuaugcaaggcuugcugagggaccuaaaugauauaguaucucucuugggaaacauaugaugugaacaguggcuaaaccugugauuuuuaccuuaauuccauucugaugagacuuuuggaggaugaaauaaaauuucaugaaugggaaccaaaauauauuguugggaaaaauagcucaugaaguuucagacacccuguguccuuucuguucuguucauuaauguuugcucuuauagaacuaucgacauuaucaaguguggcugggggguggcauaucaaagcaccacaacuaauauucacauuguguccaugcugugccagagauaggaacaaagggauggaaaggccagaauguuugccuacaagaggcucauggacugcugggacagaugcucaugugauuaggaggauggucauuuaaaguuucacaugacccaaacugaaagcuugggaggcacaagaauggcuuaaaaccuagaagcccaagcucaagaacuaccuuauuaaucaaaaaaugguuaugauuaaagggaaaaaaacucaaaauacuucaacaaacuugcuggacaccaauguaacagaacggcacuggaaggaagaauagaugcuaccacaaccuuaaaaccuuguaguguuaacuacuaaaagcaaagagugacaccacuguguaaacaagcccaaaccugugagcucuauauaacuuccuauggacacugagguggagauuguagagaaaacaucccauccugcuagauaauggauuccucuauaccuguccuaggcaaagauuuugcuggaaagagaugaaaaucauaaaguggacacaauuaaccuuugaauacaggguuuugagugcuguaucagcuaccuuaggcaauaagaguucuaucuauucuauuaaaauuggaggauuucauucacaagugaauaguaccuacagagggcaggaucuaaaaguuagcuugugguuugaaggccucugaguguguggcaaugauacagcaaauacuagggagaaaccagguuuucuauauguagacuugaguuauguauuuauugagcuggaugccucuucagagcuuagaacuuaaaaaaagaacccaaggaacuccacacauugagcauuacugugacagugucuucuagguucaggauguagcuuccuugcaaauauggucaggcucugggagguaaaguucccauguuccccucccccaccuuuagagaguguaaucaauuucaguucaauuuucuacguaacacauaaguccuuuaauucaacaggaugcccuuuuucuuuggaagacuugagcuaacuaaaacuucuuucaaaauuauuagaaaugugguuaaugacucuaaauuauuuucuuaacuugugaaaugauuuuguguuauuuggguaucaagauagaauuugaaggaaguugaacuugcaaauagccuuuucacaaaauauauuguuucagauuuugucaaaauggaucuuuuugcaucuuguuuuccaggcuuccuauuuugcaugcuauuauugcggcauuggugaacugacaugucuuucuuuuccaauguguugugcugaugguggaugguuacuuguggcucuuuucuauaaauguaugcauauugauccucuuucauuagcugugaauggcuugcuuauaucauguucuguauucaaugggacucucauggauaaccauguucagucuauauucagaaaaaaaguagcugagcuaaauggcucuaugaagcagacauuccuuccaaaaaccaccuacaggaaagcuuuggcucuugugguuauuucuguccccaguaaagccacuaacacaauagugauuccuauguuauaacucagcuaucagcuucuucagcucaaggagcuacaguuagcacaucugccagugauaccaaugaaugacuuggacuuucaggugcagaggguuccugcaaugugcauggaugggcaaaacucuucccagcuuuggucauaauugguggaggguuagugcuuucaacacuguucuuccuacuccuacaacauccuucacuauuauauucagaagaucucauguucuaaauccaaagacauucuaugcuagaauucaaaggacacugagauacaaagcaccaugguggaugaagcuaagacucucuccuucuccgucauuuccacucaaccaucuauacagcccuguauagaugagcugcugcguagucuacagaagagacaaauguacaaaggaagcagugaaggcucaagaaauaacauuuuccuaauugccucaaucaucauuaugacaguugcaaguacuccacggguuucugcccgcacagaagacaaccaggacuggacccaguggaagccaaaccauucaaacccagaaguacuacuccagacaaccaccaggauggcugguaaugagcuaugcacauaucauguaaugauacuuucucucaaagcuuaugaugcugugaaggucaaaccuuuguauccgaugggaaaauuaauuaacgucucaucacaaauucuuagugaacuuuccacacaggagucauuuaucaaucauacuucuuggacauaagguauuuuaugucauuuuguuguaaaaaugaauauaucuuaaugguuuaugguacucucucugauaaaguggcuaugugggaauaauaaguaauaucaaagaaauuuguaccuguucauuuucucuugggacagacuagugaaaucacucagauuuauugagaguaaguacucagagauaaugcuuaggcauagaaccaguagauagauaacauguacuuuaguggaagaagaggauuauuaaagacuauuugauuagacgucacaguguacuuaaccaucauugcaacagauauagacagaaucagcaccagugcucauggagaaaauuggaccccggaaccacagccuccuuucaauaaccaugaguaucaggaugaagaggagaccccacaugcuacaagcacaaguaagaaggaugaugcacugaaguugugguacccaacuuaucagagauguuguguagcuguuagcuacaccuuuugugucugcacaguaaauuuaucugcagagccugaaagaggacauuuuuaaaaauaaggaagaaagaugcaaguugucagauuuuccaacagacaagaaugccugcaaaguagaugugagacacugguuuuguguuaaugguuccuaaggguucuguuuuugguagcugcuguguuuuuggaaaugugugaugcgagugugcacuucagauauuuagugugggaucugggaagaaagcuucauugaguggccaguucuucagagucuucaucuuccaugaagcucugugauacacguucuuuuaucacacucuuuuccuuacucugugguagaacugaaccccuucuguccuuggugagaaggcaguggcuccuauguucucuuuuuuaauuacaagcuaccauucuuuuguuuaaaacacccagggcaaguugggaaagguucugaugcuccuacuguccuuucuacuuauagacaaauauaccaaguuuuucaaaaaacaaucucauguuucaccaauggacugugaaccuaagacaagaaaacaaagaaaagagggaaaaguacucaucuuucaucuguaucucagagaaaugccuaauaauuuggaauauaacuaauccuugagauggcaucuuauagcacuuuuaaaguuaugacucagacacuauuuuuauacacuuaaaaauccuuaaaggggaauguaagaaacagcuacuuagaaaccaaagaagcuuaggauuuccugguuugauggauguguugacagagagucaaggaaacaguugagaugugagguaauaaguccugggcauuguacugaaugucugacagacaucuauucuuuaucccaguaaaguugauauaugcauaaaucuuaaggguugacuuaaccaagaaguagacuguugagaacaaagaauaaagaggaaacagaugucucuuaggaaucagacccauuccagucuccucuggggucuuucagaaaucuugucaauuacuauaaaacauuugcucuuuuagaagaaugcuaauugagaaauuuggaauuaauauaucuaaugucaaaauaugacggucaagggacauccuuacuaagaaaauuugagaauccagauacaguuaacaaaaagaaguuaucaucaguguuugcaaaaaauccacaugauuucauugaggggacauuacaacuucuagaaaagagucagcgcuuaugguauacaguggaaguacucuguuuuacuaacacauuccugcuuuuucugaaauugacagggcaugguugggcacuugaaggaucguuguauuuauaugagagaugauaaugugaauauagacauauguauaagcuugugagcacacaugugugcuuaaugacuuaaaauaauagaaaauaacuuaagauuuuguaucuuucucccuuuggacaaucaguuaauccccaaaauggauuggaaaauauaaaagcaaaauuagcaugaaucccauuuuaaaaccauauugcuauuacaaagucacacacaucauuuucuaagauaaugauguagagugaauuuuguuaagacacaaaguucauuugguuuggcaauuuauaggcuuuaguuugcaugaugaaucagaaguuggccaugagcuguuauaaauaaaaaugucaguggauuucugacuuuuccaggaagcacccugaugggauuugaucccagucaucucgacuuuuaaaaacaaugcuugaaagguuaagccugucugauacuguuauuauuuauauaauuccccaacuggcuagaaucgguuuuucuuccacuuaauuagcuuuguuaagaagagaguuuagcaauuaaaaaugucccuagacaaucacauaguagaucaguguaguaacaucccaggcaucccgacagcgugcgugccagccauuucugcugaguguuauagguuaugcagucuauuugcaaaagucuauuacaauaguguugugaguuguuauauaacguguuuucuccugcaaaauuacccaaacacaaagauuauucuuccaacagaagcucucuuugucagaauauauaaagccauagacaauauuaaaucaggaauaauacugagaguucauaauucacagguuaacaucuagucaugacuuugugcuacucugaguacaugauuuucagaaaauaaaacuuguuuucccaucugaaaaauuaacagguugcauguuguaguucuagaaucuaccuuucagaauauuaguaacugguuacuauuaucuuucucucucuaucuaucuauauaucugugaauguauguguguagguauguauguauugcccauucaucuaccaucuauguauguauauauuuauauaucuaucaaucaaucaucuaugugaguauauaucuaucaacaauuuauuaucaucuauguauguauguauguaucuaucuguccuccaucaucaucuauguauguaugcaucuaucuaucuaccuaucuuuuaucuauaucuauguauucuguaucuaucaucuauguauguuuauuuguaguaucauguacauauguauguauguaucugucuaucuaucuaucuaucuaucuaucuaccaucuaucuuuugauuucuaccuguaauguagaaagacauaucagaggguuuguuaagaaacuggauagcacggcucaucaucaccauucuccucucgccugggcagcuccuaauaguacagcagaagcagcagcuacccagcaggagacgugguuucagaacggauggcaggggaagaaccccccuaccccaagugaagacucccaugugacagaagggacaacugguaauggaggguuucacaauguggguggaaacuaccuucugaguucagugcuagacauugaagauauugcacacacacacaaaaaaacacugaaggagguagucuauuucuuaauacaucauguugaaguaaacacagauccagaaucuaaaugcuccuaaaaagcuaccuagccaggcauagauagaagcacacaaaggaaauagucuauuaagagugucuuucauauuucauuugagguaucagugagauaaugacagagcuccuauccaauuaaaauccucuuucugcuuuguaaaacccauucacuaaauaacaagacuaugccuuucccuuauauuuaugugaaacgauagguuuauaaaaauguuauaaaaaaccuauaguugggggacuagauccauacauuacaauaaaaaagacaccuaugugaugucaucaaaucuuuuguuccuaccugucucuuacauaucuccucaaauauacuacuguuuaaucacauuuacaaauaagccaucuucucuauucugcaacugugggguaguaggaaucaggcuuaaaucuaucaucucugaaggaugcuggaugauaacaugucucugcaagcuccaguacaugauuccuuugucugcaugauuaagcauugggauucacccugcucugcaaagcgugugaauuccauguuaucacuugguaucagugggaaaugucuccguguuuccaucugcaauauagaaucugaugcauaauuucuuugcagugcauggcaacuuauaaaugaaucacuaguagaacagcggguguggugacuagcucccugguguguuuaauucuaagggauucuauuguaaucuuucuuucuauacuucuacaguggcacagaauggaacaaaggcauaaaccaugugcccacaugccauuugucauuguuagaagacaaugcuucuaauggauuccaucugugcuuuugugaugaguaccacuuucaugcucaucacuggggaagcuauuaccuuaagucgucuguauaucaccgcccgcucauugugccuuucgcugugggaugugcuugucucggagugacaucaugcacuugaguucuuacaccuccuucuuuaggagacuguggcagcaugugucgagaauuacuucaucuucccuugaugccuauaacuuauccucuauccaucacagcacuuguuaaugcuaugcuauguugugaccaagaaaacaagcacaaaugaagugaaaccugggaaccauccuaaacugaugcagcuccugguccucagaauuagcaagcuguucccauuaccaucuuuagagaacaaagucuuuuuuuaaaaagucaguuuauauaucccugaccaaaugucaaauaacauuuugauaauuguuugaacugcauggucacaacagcuucggcccacaacaaccauccaagucaaagaauaacaacacagagucaagaggauguuuccuggacagauuucuucgacccaaucucacauccaaugggacaaggucaucaaacagaaagcaaggguaauagccucugagacuuuuuaauguauuguguuucuuauaaucaacuaagugccuuuuccguuugaaaugugccauugauuuuuaguucagucuacuuucguaagcauccucaugugucuucaacaauaaguuuguugauacaaguugguaaggaguggauauguacauccaucuacaugcaaaguuuuauuuggagagugaagaauuuggcagggagauuaaaagacagucaaucguagacugacaagaguagaaguuauuucugcuaagggagaagugggucauuucucccuuuaagauggucuuacuacauagaccaagcuggucuucaauucuugaugaaccuccugccucaaucucccgcgugcuggcugggauugcguauacuaucaugucuuugaaauccaaagauuucaaaguaaacaacaaauaauggauuuagugacagucuccauuauagauucaaagauaaauuuugguuuugguagagaaauccaagugguuaagaaaguuggugaguaguuaaugugaauaaagaacuuaaugacucaggaaacuuuaaagcuauuucuucuugccucauucagagaaaaugugguauuggaggauuuaggauuuagaucauucauggcucuucuagaauagcuaugaauugugaauagagaauucacacacaagacaagcacaauuaagcaauuuaaaaagagaaaaaaauaugaguucuaguuuugcaagaaagaaagauuguaaauuauuuaacuauuuuuuauauuuaagagcaaauuucauuuauuguaacagcaguagccuguuugacagaaauaucaagaauugauaggcucugcccucucaguauucaacaaauggaagacucuguuucuccuacacccaugacaaaauauccuuaucacagaaauguaacauuuaaaaaauaaccaauagagggguaaauuuuuucagagaaguauaugcucaaauauaugcucuacauauauuugaacugaaauacauccuaaaaguucagugacuauauaucuccacauuggauaacuacaaaacuacuuuggagauauccaaaguaaagcaaaaacuugcauaguuuucuuuuuuacgaauacuaucuugucucaauauuagugaacagacacugugaacaaccauguauggagacagacaauucaauuuauaaggcaucauggagacacaaggauguguugucuucauuuacacuugagaaacacuuaaaaguuagcugacaacagaaaacauuuaauagcacaauacaucugacaccaugagucauuaauaaacagaaaaauucauagugucaauagugaaaugaacacuaaaaacacuuagaagacccccauacuuccuggagacuauuaaagaacaaaggauuuaaugauuuuuugggggaggaggcaaaaaccuggguagucaguaaaaggaaguaagguggagaacuuuuugaaauggagacucccgugagcugauccauagagaaagaaaagccaagggaugcacaaacaucacuaugccuggacaaauguggccuaaaagggacaaaaguguuucacuggccaggcugggacuauucuguuagguuacuaaagcgccacaggcacacugagcucacaguucuaagugcuuagcuuccaggguuggggcuccaaagagaccccugguuaaacaaacaaauaaacaaaaagaaaguaaaagaacuccagagucauuaguaaguuuccaacaugauugcacuccaugaguaaauauaucaaaaagaaaaagauguuaggucuccaggucuccagaucugcagaaaugagcucaagcuggaugacagagcuuuucuggcaguuaaaugaaggcuaguguuccuugggaacuuuugaguccuggcagaagggacauauggcuccccacugacauauaccugugacuacaugucaaagcccaugauggccuccaaguaccucuuacaacauuucaaagcccacaucucaguuccauggcccuucccuccuccagcuacucaccuuccuaauucuaugcuauucucuacuguucccauacuuacuuacucuggcacuucuguuccauucuguaucucuugcuaccucacuaucuccaccauucuuucccacucucccucuuuccuagacuugaucauacccaauuugauggccaugcucuggacucuuccagaugccucuggaugcucucucucuccucucucucucucucucucucucucucucucucucucucucucucucucucucucucucucucucucucucucucucucccucccucucugcuacaaaacaaaucuuaaccauaucauggaucugucacaucagcagauucuuuacugugcuuccaccaugcaugauaguucucuaagaauuuuacuuauaaaaggaaaaaugaacaagagugacugcagacccucuguagacaaggucuuuuucuugcugggcauccauuuaaaauuuugauuguggguaauuggucuuuguucuuugaaaucuggguaacagaaucagccacacauuuuucucuaacagagaucuugcaugucuuugcuuuuagcaaguaaagacugcugggcaccacccaaggugggugcccguaucccagugauuucuuuccacuggagucagucagccagagguggugguguggguggauugaguaaauuguagaguuagcuguauugaugcucuuuaugggguucuuggucccuauuucacucugaacuuguuauuucaguccaagaaaucugugauaaccaucgguaaaagcagucuuuuuaauuacuccagggagauucucacaccacucgacacuauaaucaggauucccaggaugcuucuugcuuuuauuuauggggagaauaauucuuauuuguccacaggcacucucuguuuucuccaccuagguauauuggguaauauguuaucuauuuucuaugcuuauuuugugaaacaaaaacaaagagacaagaaaggaaaccacuguccguuugaaaaauuuuauuacuauuguuuuguuuuguuuggccuggugagcagaugacaaaaugaugcucguguguguuauuugucuccacgugucugacaguacuugucuauuuuagaaugaagcaagucacacauggauugugucucugccccuuuguaaagaccauaagccccauugugugcuccuguaacuuccuuucagacuaagcaaaacaaaccaacaaauaaaugugauagcuaucaucuaacucugcccugaaaugacaaccauguauaucugugauuauucuauaaagaauaauuuaucccaauucuggacauguguaccaauucuuucuucucacugggcugaauauaaacauuaguuggcuauaugacauaaaugacccucaggucauuuccuagcauuaggaauacugcaauaacaucaauuugauuccuucagauacagacuccagucauaguacaacccuucagccuacugcagcuccaaauacccauuugguggaagacuugaacaggacaggaccacuuucagugacaacucguaaggauaaugauacacagccccuuuguugaccuaucuaucuacuucccaucuggucaagauguugcauuuggugguggaaugguggcagucuuugcuaggugacuuagcucagccagggucugaaucuguuuucauugucggccuuucuuguagaggaucuucuaauccaaauugauauucauccaaggucuacuccagugucaaugacuuuuuuauuaacaaagauauggaaaugucauucaucucuauuuuccagcucuaacuagucaugugacacugaagaccaucaauuguagaguggugucuucauguuuuaacggacucuuuuugauucccacccuucuuccaggccaggcagaagaaauacuguuuucaugauuguguaaagacauaugagggccagaucauuauaguaaauaggggaaucacauuuagcuuucagaggaggaccaaggcaaggaccaaguugauaauugacuaagguggcagagucccuggaaucaaaaagaaccauuugcuaacaucuuuuucuaucacuaaauaucuacuaggaagaaauaugaaaauuuuaguucccuuaauuuucaauacaucgauaaggauagcccaaggaucagccuaaugccauucauaaauucuuggcagaauaugaaagaaaucccaaauuaagaagggauuucacugcuugcuacacauaaugagcugagcccuucauaggagcccuuuagacauaagaaaaaagccagcaggcauguguugauugucaucaauguagauagcaugguguuaggcaucaaaggaaacauaaggaagccuauacguggcccuugccagugcacagcuucuauuuccauuuuauguuacuguuggguuuuuuuuucugauguuagcucugggauuuagugaaugucucucuccugguuauauuuguuuggugguggacauggcugauggguguguuuuauggggcuuuugcaccugcaccucagaggucagugccuuucuuggaagaacacaaaagaagagaacucaaaacagucaaagugguuucagauaugggcaaugauucaaucucaauuugauacauaucacuggagacccuguguuugaccaggcaagcauuuccucggugcagugaagagaaacccuggcuacaggggagaccacagcccuacuaaaaaaguuguaacucaaaugcaaugcucucuauaaaggaauuguguauucuguauaaaguuacucugaguucauugauaaagaugagccuuuucuuuuguguucacagauacuacacagcaauauuuuccuuauagucuaacaucuaggcaaucuuuaugguugagggaaaacugaaauuacagcuccacuuuccaugucucugugaucuuuguuucuggaauccuugcugcugcugggucaaggugguccagggagggcaguguuuuggcuuuagcuucagaucggagcuucacugagagacaaagaagcaaacuagggacaaaauaucuguaacuuugcaucagcaagcagacgaugaaaggcacaaauaucauucucccauuguaucuguccaucugauauucuauaacuagucuguccauguaaguccauguguuaugguuucuaauuaacaauggcuucauuccucguugaaacagcacagagucauucucagaacuucucuacauuacauggagagccggaagaagacgaaaaccauccaacaacuucuauucugccaucuagcaguaaggaucauaaaguccaacuggcuuuuaagcagaaaucaagacguuauggguacuuugugguaucuuugguggugguaccuuuguagcaucuuuggugguggugcuuugugguaucuuuguuaguggugcuuuguagauucuuuuguggugguacuuuugugguauguuugguggugguauaucuguugccuauuauagauuauuuuuuuugaucaacaggugugucugguggugguugcugauuuuucugcuuuauagaucuuuuagaagccauuguacacuagguacaaacuuuucugcugaauuuuaaagguauugcuuuaguaacuugguuuaauaaugauuguuucuguaagauuucuuugauauccauugaacuaauauuauuucugauuugucuucuggaccauagcucugugguauuguugacuaugaagaaugcccuccuagcacagaaaagaaaauuuaugucaauagacucaggguuuuuuuuuuguuguuguuguuguuuuguuuuguuuuauuuauuuauuuuuuuuuugaucuugaagauauaauuccaguugcaggcagaaugguuucaucuuucuauccaaugguuuguuuuuaccccuuccucagagguagauccacaaaaaagauaaaaauccuguaguaccugaggugacuucaaagucacaaugagaucaccacauacucuugaugacucagacaaucugguagcaaguaccucuucuguguaggaaguagucaccaaaaucucuucaguugagugcuaucuggcuggugucuugcaaaacauaguuuucacucaguaccacuugcuuuuggucuuggagaacaaauagaaagaugucucagcuacuuuaccuucugaagacaagcacaugguggguggugaccuuacagcugugggcuuaucauugacuccaccuccaugcagcuaagagcggcgcuaaagaugcaagaagagguggaagucuucccacagauacaacuacuucuguagaaggcuacaccuuucaauacccagacacaauggaaaaugggacucucuucccagugaccccugcuaaaacugaggucuuuggagaaacugaagugacucuugcuacugacuccaacguuaauguugauggcuccuuaccagguaauuuaaccauuugucaucuagcuugcuucucuggagaaacaacauauauuuuccuauuguaagggauauuuucugugcaggcugugauuagauuacuuugugccagggggaugguuuucaucauuggucaucaauuauagugucagcaaacuugaauuugagguaaaacaaugccuccauuuccugauguagcauccuuuuuucauguguaaugguucauaugguagaauuucuugcuuuguauuuucuucauucugugauauauuaacuuaucaugugaaauuaauauuuugauggauggaaauaguuaaauauuagcaauuucacuugauucagauaauauauucugccuauuuaacaacacuuuacuagacauucaaauuauuuucauaugcugguaucuuugcucugaaauuaccuuuacuuggugguggacugauugguuuuauuuuuggugaugaguugguauauaaacauuuucuauuugugguaugcuucaaagucuaugauuuacuacuaauaaacuaagacccucauuuuuauuguaaugguaaauauaugacuuacucaauugagucuaacauggaccuagaacgaaacuuuuaucucaaggaagcaauccucucuacuucucuucuuuauuucuuuguucguguuaagaaacuaacacuauagaaagggaaauuggaaagggauuucuguggcuaagaaacuagacaccuccucccacuaguaccuguaaucuggguaccucuuaccauucaaucacugacacaguaaagaugaguaacuuuaaguauaaauauauacauacaugcacauauaccuaauuuguagaaagacccuaacuccuccacucucccaaaagacaaagauaagaaaaugaucucauggaaaucccauaugcaaagcaaauggcaguggugacauucugauugauggagggagggaaaauccaagguguuacaugcuuagcacauucccucuggcuucccacucuaggugcuuuaaaaauagcaacuucagcaguaauggcaagaucaaacccccuuacacucugaaggcuuuugguuauuguccuuauuaauaaucuucuuuuccucauuaaaaacuucaaauguuguuagauucaugcagcaugaaucaaaggagaaacaaauguucucaaugcuagaauggccccaucaugccacuuaauggauuuguauuuaaaaugacaaucuuggauauaguuucuuaggugguuuucagagucuaauugcuaucaaguaaaacucuuucuaccaaauuaguacucccaugugcugaucccuucugauuaauguaagaaaggcaauggugcugagggguguccuucaguucuuugugaauucagugaucaguaaauggucugauucccauucccuguuuuaauucagaagaaccacggaguguauuuuucuguucauaaguauuucuguacacugaauguaaaacacugaaacaugcgauggcaguuguggugaugggccugguaaaggcgcuggcuuugaaaauggugauuuugguggugggacuguugguguggcauuucaucaaaugcgguggucuuuucuccaaggaacaaagcggucucucugcaauaguuaugugcaacuacaagcaaguuugccucuccuaagcagggaaucacauaccgugcauuucacuguauucuuuuucuaggcacccuuguaaugaucuguaccaacuuuuggaaccccuguugucuguguauauuguuucccauaugauuugaucguauaauuuggauuuaaaauuagucacuugaguuugucucuaccuagagcuuucuggugauggguauuugagaagguuagaccauugugagacagguuaguuuuacccuacugaugauguguuguugccaugguaauccugcucaguaugagaggaaccgcagguucagacauuuguauguccuuggcugaggagccaauggggcgaagcuaccaucaucugcagacagcuauucucccuuugaaaaacagcucuuggucugcuauugggccuuaguggaaacugaaaguuugacaauaggacaccaaguuacuaugugaccugaauuaucaaugguugcugaucaugugggcuuaaccuuuuuuuuuuuuuaaauaugaacugagacuucugaugcccagcugccugucacucacaccauuucacugguucuuaauacacuuaggguugaccuuucuccucucuggauaaauaguuugauuuucccuuugagcuuuugccucguucauuccuaagauucuuuuguuucagauucagagaaaucucuuuuuaugcuggauggucugagccacauugcacccauuuaagugaucacauuccaguaucacaauccuuauccaagcuaugaaguaucucauucaaaacucagcccugugaaagcaucaucauauuuuucucagaauagccuuuagcucuguucuuggauuucuacccgcacgguauuuuuagugcucaucugggaugaccugugcugccugaguuuccuucauguugauuaaggauccagccuguucaacaaugucucaaaggaugagcagugccuucuuccuuguuguuagcagaugauggcuuuccgaaaacgcaaccaacagaaagggagaugacagugugaauggagauacagugcugacugguuuuuauugcuuuauuacucuaggagaucgagacucauccaaggacuccagggggaguucccgcacugugacucauggauccgaauuagcuggugaguuuaaaauguuuagucacuguuauaaucuccgaacccgaugauugcuaaugaaacaugcaucacugucccuagagaauuauuucacacuuuuuuuuaaaacauauauuuucagucucagggaaggcuuauuaagucacuuugcuggaccccaccccaaaguuucugauucaguaagucugggguggagcccaaacacuuguauucuuaauaaauucccagucauccugauucuacugggaugggcacucuacuuagacaacugacacuguggcaaaagagcguccaugugaaagggucuggaaggauucaagcaauacuucucugcuggcuaguuuuauggcacaaacaagcuagagucaucucagagaagggagccucaauugagaaaaugccuccauauaacugggcuguaggcaaacuuguaggacauuuuuauaguuaaugauugacaugggguggcccaacucuguuguaggugagaccacugcucgguuggugcuccuuuauucuauaaggaagcaaaaugagucaccaagggcaagcuagugagcaguacuuucccccauggccucugcaucacccugccuccagccauguuugaguuccuccugccuugacuucccucaauggacuguaacacauaagccaaauaaacccuuucauccccaaguggcuuuuggucaugguguucaucacacuaugugacccuaacaaggacaaccccauuuuacacugccccauuauggagucaaaaagagaacucuuuaggcaugaaauagcuuggcuuugaucaucauucauuuaccucuaaauugagaaagaugaugacagggucugagauucaauguucuagcugauaaucuggagauauugucacagggcacucuuuacaaccaaaugacagaauaaauaccuagaaaauguuuagcauaaaucucauaauguagccagcauuucagaauuuacugugugccagaaagauuaagcaaagcauuucauuucuacauugaacuacaugaaacugauauuuccauagggcaagugaucccaauaccagggaauuuagagcucauuuacuguuaacauaucuaauuaccuugcaaacccuauaauauaugaaaacacuguuaucaucaccuuauuacggaugaggagacugagguaagagguaagaaagguaagaggagggaagcaacuugccaaguugauaugaccagagagugguggagccagguuucaagccugggucucauauugccuugccuaagcccagucuggaagaaaauuccauaaugaccauaauuacugccagacaugcauuauuaaauagacugcuguuggccaugacucagaugaaccccuagaaacauuacuccaggcagcaaagucugacaggaggcaaaccuacuucuaaucccuaaugcugggauuacagagaugucucuuaccacuuccucuaugagcuccuaauuauuacaaaucuaugugguccauaagauccagaaaauccauaaaaauuagcagccucugcugcaugaguuugaugcaagugccgccucuaguguucuaaugaaucuggggauggauggauauuuacaugguggcuuuggugacagcccuuaaauguaggagcucugggguguagggcucuuuggaaauuauccuaaaaagaaaguaaugguucaagcucaccagggucuuuagcacacuuggcauuccccagcuuuaguuuccuuguuaguaaaaguaaaccuccggucaccuacuucaguaauagagauuuuguguaaaagucaagguauugagaaaguaagagauuauuguuugaaggcacaguuuccaaagccaagcgaucccuacaacuuugaguguagccuguggagcagcagagauugcauacagaagcuugcuggaagcgccuaauuuugucccauccagguagauacacacugggugagggucucagucauccaagccccuccccuuccgcugauuugugugcuccacucucucugccuuucucacaguugacgccaacggaaugaucuccgugcccaugucugggguugggccacguuuccaaacugguguguccagugcccugcuuugcagaacuuguucuccaggccuguccuacccugguuagaucuauggaucuuuuggucugucuguggcuugaagugagaaucgggugggcgggaacuagucuuuuuccuuuggcuccugugcaggugucuauuguucagacaggagguuucaucuugugcacacaccuagaucuuuccuugcugggagcacuucuuuggaaaaggaaaauaaauagauuauaaucuauuaauggccuccuuuucaaauaucaaaggcugcuaugagucagaccagagagaccagugggagugacuguaccuuuacagugguuuucaaggccaaaguucuccaguuuggagggcugauaugccaugacuugugcaugcaaacccugccaguugcucaggacacugacagguggguagaaaaauugccuuggccucuuuugagauuugugaaagacaggccacucucggaacaggaugaggucugucgaaacaacacagaaguuacuuggcucuguuuuguuugcucuuuaggaaaugcacaaacuauauaaaccaaguuauccuauguaguuagauuuuaccauuuacucugcagagucuaaaguuugacccucucagcuauccuggccagugggcuaaccaaacagucuugucuuggcuucucucuccuugguggccuuuacgauuccagaacagguugcuguuuaguggcaaggaguaaaggaagaaaagaaacagaaaaccaagauguuucuuuuuagauguggaaaagauaucauuuuccuuguuuggaaaaggcaccugggcucugacucagugauugucuucucacaaugcuucuuuacaaguagggaguuuuguuucuuuccuuauuuugucguuugacaguagaaagcauucaucuuucuauuauguuucacuguauuagcauagacucuacgaaccacuuauuuauaaacagaaaaagugccacucccacacacacacacacacacacacacacacacacacacacacacacacacacuuacacaccauggcaaaaauaaaauuggcguucacaccaguaccuacaaucaauguucauccuaguuugcuuuccauugcugugauaaaggccuucaccaaaguaacuuggggugggggaggucuauuugaauugccuauccugagucaugguauacugaagacagucagggcaggcagcuggaggcagacacugaagcagaagccauguaggaauguuacuuauagcuugcucuccauggacugcucaacuugaauucuuauacuacccaggaccacuugucuggggcggcacuacccuggugagcugggcucucccauaucaauauucaagaaaguucccccacagauuuacuuaucggauggaggcauuuccucauuugaaauuccuucuccacagaugacuugggcuugcauguaucaaguugauaaaaacugaccagcacaauuugcaugugauuguuuuagacuuuggacuuuccaaagcauauaaauauacuagggauauuaauaaaaugaagacauuguuucuggagguuucgaguguugcuugagauuuuugaauuccuagccaacucccuaacaaggggguccucuuggccgaugguaccacuguguuguagaacuaauaaauacauucaacuacuaccaucauauaguucuuuaggauucugugaguuaacaaugaagugguuucuguuaugauccucacuuucaaagugagaaaauagagaguuaaagauaaggacuuggccaagcacacguugcuaauaagaggcagaguuaggcccuaagcccaggguugacuagcucuggagcuccaguucaaacacugcccaucacuguuccuugccacagaaauaacauuuguaagcuuuagcuuagucacacugaacuuucuugggaggcgaggagagauuauaucuuucgccuaauauuuuauaacccuccacaucuugaaucuauuuauaauuucuaguaaggcagccgcuggaggguagcccggcaccaugcuguggaaggaacuccugaguauauuuuccaaacaugggcugaaagagcuuguugcuucuccccuuaggacacucaagugcgaaccaggacaguggagugaccacaacuucugguccuaugaggagaccucagauuccaggugaguuuuccaucaugaagcaaacaucagauaauuacagcaagauucucugaauauccuagaugagacuucaucaaaugcacaucuggcuucccucuguaagauuaaguauaaauaaaaaugcuacagccuccuuguaggccucuguuucccccucuagguaucuauggaugagcucacauugaggccuaccucaaagaacugaugcaucaguuacuaaggcacucuccccucaggaaugaugauggaucacccaaguucuuccuagcucaacgcaguuuccccuauauuucugggacugagaugaagaguguuauucucuugcguuggcaggcagggagaagacaccaaaucaucuguguuggcuggagugaaaaccauuccucugguccucaaacuacuuuuccuugagggacagucugcuaaugcagccagaaggaacuuuucauaaagucucauacacacagggagggagcuuugacaucuggccgucccaugcuacaagauuuaaaauuugaugcaguuucuucuuuuaccuugggguugaaaaugagcaugugcaaagggggagauuccacaaaggaaguuucccuuaaugcucuuuuaacccuuucuuuagagggcuccaaaacagcuucccuuguggaccuugcuccuuuaucucaacucauuggccaccuggacacaaagauagaggggacguucagggaggagugggcaggggagaggaggcuggauucaagcacgaggauucaucccaaucuauugagaaggaauauggacuccucagugcugaaggccaggcagcauagaagaaggaggaacagaagugacaucuuccugaaaguguccuugcuuccuuaaaguaaaccaaaggggaugcacagucugaaguaagaggaaaucaagacuuccaaggaaaacuguggcuaacaaaucccugucuuucuucuuucucaagccuucauuuaccacacacaucugcaacugaaucgauucaacuugucaauccuuuugaagccugaguuuaaaacaaaugcauaauauuacaucaauccacaagugguacauaauuauccaguaaauuuuagaaacuauagcuuagaaaauagauggaaauaucaaucucuuacuguaucucaauacccacaaguguuaaagcuacagucuuaauuaauguucuuccuaauauuuuuucaaauuaauuuauuucaaaacugccacaugugcuauuugacuaauauuuucugccugucaguuccacuuuccaugucauuaagcaccuuucucuugaauuauguagcacauaacaaaauguguaacuccugaucuauuuauuuaaucccucaccauuggacauuaaguuggcuucaacuuuuauugguauaaacaucauaacaucuuuaaagauaacuuugagauccucuagcauuuuagaaguguaacugcuaaaucaaaaaagcuugaguaauuuagagucugucaucaguggaaccgaaugauugaaagaaguagaagaugucucucucucucuuuuuuaaccuuuaccguaggaacauucuuugcccacuagauuaugaacuccaccuuuguuuugagcaaaaugcaaggcagaugcucuuacacagacaugggcuguuucugucaagagaaauauaaauuuccuuuaaucuacuuagaaguucaccaaaaacauguacagacuucaacagguugcuugauaucuuuuuuuuuuuucuuuuugaaacacuuuuauucuggaagaacuauugaugaaagguuaauaagagaagucuguuggacgaacaucuacagcagagucugucuuaggguguuuuagcugagcuguuagucagaccacucugcggagcugacuggggguuuuauuuggagcggaucaaguuuuaaauugcauuuuuaaaauuucauaaagcaugcuugugaagcucacauauguccuuuuccucaccacagaauggcucaucaucuuggcaucucuccuggcacuggcucugauucuugccgucugcaucgcggucaauaguaggagaagguaagagagagugccccuggcagcuuuccacuucaaagggcaucguggaacuuggguuuuauauccauguugcucagacuauagcccuugugacugucagccuugguacccuggagcuuguuagacauguaggguuucuugccugacaccagauuuccugcacuagaucccagggaauccugcccauaacacaguuuaagaagcccuucucugcccgauucuuuagaaaaguaagacaucuaugaugacuuggaaccccuccuuuaaccagugcuugaguuuuacuguuucuaaacuuuucaugguuaaaccauaugcugacuaucagauagaagcuauuaaauaguucacuggaaagacacuuaaaguauauacucaaccacuggcucauuuaacaaauauuaacuaagcuuuuccaaugcuuaaaauguuguauaacaaaucaagaguuggucaucuuccuuugaccauuggaagcguauggaaccuucuggaaucuuugcccaaaauuggcaugggccacguuuugcugcuuguuucucuuuaaggauauuauuuuguguuuuaugaaagauucaguugaagagauucggggcauugccuagggaaauucuucucacagugagguauaugaagcacugaugauccucuagacuagagaaucgucgguccagugccacagaaagggcagaugguugucuucacauccuugaaaccccucucucccacaguaacaaaggcucuguauucugaaagucauuuauauacuaugcauauuuaauuaauuuauaagcaaccucucaguagagugcuacccaaggugaaaugcaggacaauaguaacucuagcaccaggagaugggaacuuuaagccagggcacuuaaaaauaaaagucuaaauuccuacccagacguuuuaaagauucauuguuuuuuccuaaaugucugcugcagacaugaagcuguuuguaaauaucccuugggauugccccuuggaagguuggagucuuccugcuuaacugggcugccuuugcugcgccucuaaaucaccucgcaguccccaaaugauucagauucugagaagucagaagagaaauaaacacuuuguucuuacuguucagaaagaauaagaaacuguuuccaguggcccgcacagucucuggagggcuucgcaucaucuacagaaaccagauagcacugcucuacacugcuuagaacucgugacagugcucacucaaaucauggugcugcuaacuauaccuuugagggaauaagaaaacuauuagucaugagugcugcccacccauggagcaaaggcuggggaaaauaugagagaccuccuaugggcucccacgauuacaugaaaacaaaucugggagcugcagaagugcuucgaagcgcuuuuguucuuccucuuggcgucccuguuuucucuuggauuauuuuugcucaauuaaauaugaacuuccuuuuuuuuggaaucagccuuugauuucaggcccuagaaugugucacauguacaguccauaagcuuugcagaugucaccauggagaugucccagaugcucuuggcauggaggccccuccuucagcaucucagcuguccuggagagcaguuggaaucuugcacauuguagcaucuuagcccucauggcucccugucuccucagcagcagagaaaggaccucauggccuccucuccccuuguccccaggccagccaucacccuagcaacccacaaacagggcaggcagaagcuggcugagccagccucucaccgggaaagcagcuucguggacuucauaaauuauuguguccugauuugauaauugaaaacagauuugccacacugcugaaaagugguuaaggaccgcaugggccccuuaauguguguuguguuccuaaaacuaauagcccaugggccucuuaaugugugcugcguuccuaaggcuaauagcccaucucuaaucccgcuagaaggcaggagccuuucugcuuugaguacuccauuuaugaaagauauggaacucuauuuucaucaaagaaaguuugguccagaggggauucauuuauucaacaagcaucuuuugcaggcaucuccggcuguuagcuuuaaugaggaaggagagaauauggagagcacguucuucucuaaaacaguuuugagguuuagauauauggaguucuaagacaggcugacagcugggaagaugguuauguuaguaacguauugcugugcacaaaggagggccugauucaugcccccaggacccauguaaaaggcuggucaugauggugugaccucauaaucccagcacuggggagucagagacaagagucuuucccuggagccugcuagccagucuagugaaauuggugagcaccagguucagugaggaaaaaccugucucaauaaaguagguggagagugacucagaaagacacccaacauugaccuguggccuccaugcucacauaugcccaggagccaauaaaccuaaaugcaugaacgaguguacauacacacacacacacacacacacacacacacacacacacacacacacgcacgcacacgcacacacacacaaacacacagagcuaucauugaggacacccuuugugcucauugaaccagagguggcauuaggcagagauacuaacucccagcauuuguauugcaaaguucuccaagagucacagcaucugaaugguccugaugggaugggcaucugagagauggcuuagcuagaggaggacccaugucuaguucccagcacccacaugguggcuucauaacccuagauccauggaucugcuacccgccucugggcuuugaagacaccuggaaaacauaugguauacaugcaugcaugcaggcaaagcacccaugcauauaaaauaaaaauaagcaaucauugauggugggagugcuccaugguuuccucaacuuuucccacccuuggcaugaucacaccagcuuugccugcugccuucaugaaaccaggagccugaauuagagcucugugugcuccccagaagagcaaguugcaucaggagccaguugugucgggagauauuggaugaggcacaacaguagcagcccuuaggcaccuuccccuugaagaauuuaucugaugugucuggaaaggagaaaagccuccagggccuugccaaagaaagcuuccaaacucaggucuggucucaaaagauucuaugcuagcugugcagagcacgccccgucagccuucccuuucaugagaaugaugauauuuuuaaggaaccuuugccuagucauaaaucuccaugauuugguaagcuuuuccuucuguuguguaguagucaggcuuagucugaugggugcucacuugaacugggucugcauccuagaagagugccauccaugagacuuccuccagggauaaucaugguccaugucuacucucuaagcuaccaucauagugacuuuagacucauucuaucacagaaguaagauguuucccccucaggaaaaauuuuuauuuagaaauaauaugagcugaagggcgggcauguaauagcacagguuuggagauguccaggcugcacauccauagagaaaagagcagcauagcaaaucguucuuuugggcgcuuggagguagcuagaguguuaaucacaaggaugcguuuguuaaagcaaauucuaagaaguggauuuuaaauuguucuuuguuuaaacuuaacugcacauaagacugggcauggcagcacacaccuguaauccuagcaagcuaaaucuggagaaucaugggugugaaaccagguuagguguauagcaaaacccugucucaaaguaaauagguccaacaaacaaagaaacaaauagccacauguggcugguggcuacuauauuggauagcacaucucuaguaucugcauaaacaucugaagggguuuggggauagaaaagccauaaaaucaauugccaaguuauugucuaaguagagaucaacuccaggaugcucuaaaaguauguuaucugaauccagugcccaccuugucugcccuccccuucaaggauaaguccagggcuggcucauuuccuuuccuguguuugcuguguguucuguggagcuugcaguucaagggaggaaaagacaaagaugagaugaguuuuuguaaggacaucuggucgcuuagacgcagcuguaaagauaacagauguaguguguaguguggcaucagacaccacucuuggauucaaccucugguuuacaaacaccucuucagcauccgucuucugugcugaaaaccacaacuaaggaaaaggaaaaaugucggauuagucuuaaacauggucuuaaaagugcuuauuaaugcccagagcacuugauauuccacuguuucuuagaauaaucuuaagcaaccuuccugaaagaacauagacugauaauagggacagaaaucuagaggucagugggucaacacagugaacaugucuaccugucugcugugacacacuuccaaaucaguuccuucauuuggaaaaaugguucucaaccuggguugugacccccuucagaggucgaaugacccuuucacagggguugccuaagaccauccugcauguuagauauggcgauucauaauaguagcaaaauuacauuaugaagaaaugaaguaguaacagaaauaacuuuaugguuggaggucacuacaacaugggggaacuguauuaaaggguauuauagucuuaggaagguugagaacaacugacuuagaggaauagcgucaaucugguccugccugcgugaauugacguauuuuuguacugacaagcacuuugcuguuuuucauccuaccucucagcaaucugguugauaagcaaaugggacuuaguuaggcgaggcaaguuuccucuaagaacacaggcuaggucaccugagaguuuggaauaauacaggcaguguucgccuccagcuuuugaguuaucuugccaaugcauagaggaaggcagguggagugcugggguuguuagccugaucucuggcagcuuuaacaagcaggcuuugccacucauucucaguaggccaguuaaacagguaagucgauucagagcagagaaagaaaagguagacaauaugaccauugggaagaggaacaaagaaagauauaccuugacaauccuuuccccaaauccagcuccagaguccagacaugaaauauaaauagaggauaagauguuuggcagcuaagcaauuucagugauggcaagaccccaccuaucauugacccaguaucgugugggcuccaggcugucuggcacagcaguuguuaaagcugugggaaagaugugaaaucuuucucccaaagacaagguccccucuggcuugcaccaagauucagcuuugcuuuucccaaguaugauauuaggaaauucuaauuucuuggugucccuuauuacaauggucugauagcccaaaggaggggaauaaaguucucuauaggaugccaucauuccugugaggacaguuacagugacagcagccaaagaaaccauucgaguucaugucacauggcuuccauucuauuaacuacagccugcgcuugaaugcuugcuauauccuagguucucuucugauuaucuaaggccuuaguuuguucaaccuacaauauucauaaaagcaauaaauagcaacaguagacugucuauugaauucccaccauccugugaggcugacaguccuaacagccugauuucacaagcacguaagcugaggcucagagaagucaagugcauugcuucaggcuacacagcugcauuaagcauuugaaagcucuuugccacacacccugcugucuguauggaccuuguuggugguguucccagcccucauccacgguugaaguaucuucccuucuacccuuccccacucacaccuaugcuaaaugauacaggaucuacuuccuguugaggcaguguauauauauauauauauauauauauuccccaaacaagagauuaaaguuuauggccuuggcagucuuacagggaagagccuaugaucacaaauaauagacaauuugucucuagaguucaaaauacccugcagcaaagagaaccguuccaguuucauacuguuuccaaaccuccagcauggacagaaccaggcagagcacagccaccuaaucuugaaacuugagggcugaguaugguggucucagucauucuuacuuuugucaccucaagcaagccuuaaaagugcccugacccucauuucucagugcuguaaaauggaagugauugucacuuuaaugaggggugauagcaacuucuugugcuuugccuagagcuaaccaugcauuuaauaaauguucauccauuuccccucaucauagcugugaagcuguaagacuuggcuuccauuagccuaaccuaacugcuacaggcacaacaacaaucagguuacaacaaagaggaagcuuugaaucaggcugggaggggccaggcagugucauuagaaucacaaggacaaggucagagucacgcuuuaccauagaagcccuucuccugccuuaaaaucuugaaucacauugcuaagaaaccuuaaaguggcacgaaugguuuaucuucuguugguaucaaaugucuuauugcaggacuuuguggaaguuaaccgaccgugaggagagucaauauggccucacccuucuggagcacugaugcucucuuauuccccacacaagcugcaauaauacugacaaagcaacacaguguugacugaaagaggaaguagcggaacuuucuugaguacacagaucaaaaugauuuacaaucacaguccucaugguuuaucugaggcugcagaguuauaaugcuccagaaacaaacauuugcacugcacagggaaggagagccggggcuccagagucagaugaaucagugucugaauccuuccucuuucauuguguguugacuuagaaagacuguuggauuuucaugccccugggaguuucuucaacucuaaaggggcuaggguguaguaauagcuuuggguuucuacacuucugauucucaaaggcuggagcagacaccucugcaguauggugguuuauuguuugguuguuuuauuuuuuaagaaaccagagacugacuuuagagcagcgguucucuauaugugagucuugacuccuuugggagggggguugaaugacucacaugggucacaugucagauauccaacauauacgauauuuacauuacaauucauaacaguaacaaaauuacaguuaugaaguagcaaugaaaauaauuuaauaguugaggucaccuugacaugguaggcuuuuauuaaaggguugcagcauuaagaagauugggaaccacugaccuagagcauuauccauacuaggcaaguacucuaccacugagcuauauccucagucuucuuugccuucuuugagacuggguuucauuguguuauccaggcuggucuguacuuaauuguuguaguccaggaaggccuugaacuugugauuuuccugucucagcccccagaguagcugcaaauauagacuguuaaacuucagauuauggagcccagcucuugauauuccugauuucuucuucaauagauuagauagauaauuuucacaucugagaaguucccuuuugaugcuaaacuaaagaaucucacuuuaagaaguucuggagucaggaagaugaaguugagaaagcaccaugcucaguucuggacacauaggaagaccacacuaaacuauggugaugaucaugaugcuauccccagcaguacuggucaugauaacgauuguugguugguugauugacuucugcacccuuucucauaugauguuuuuaaaacuuaucaggugugggcagaagaaaaagcuggugaucaacgguggcaaugggacgguggaagacaggaaacccagugagcucaacggggaggccagcaagucucaggaaauggugcauuuggugaacaaggaaccaucagagaccccggaccaguguaugacagcugacgagacccggaaucugcagaguguggacaugaagauugggguguagugccuacgccauuaacuugaaaagacagcacgauuggagacgucauuccugggagcugggacccuccacagaugcaaugugcuacugacuauuauuauuggggauuauguuuagcauaaaauuuucuauuccuuuuuuauuuuaugucauuuuuuuagagucuguuccaauuuaugaaaauagcauugcuuucugaaaugagggcccaaauaauacuccauuaagaauuugacuuuuccaguuccuuccuaggggccuugcauuaccaggguaugcuaccauaggcuucuaccaaaugcacauucuuggucccuauugaaccuuaucccuacccaaagucccagggaacauccaccagcuaaggauuuuccccagaaccuagauuggucucugggaggaaauuugaauggguccauauugccucuccagcaguccaauccuuaggcauugcuuuccagcggggugggagaucagguguacugguuacauacucucuuuauagacucccuucugcuggaaaauuuucagaugcuucugagagauccccaaagggugaugcuauuuaucuuuaguaagcuauuuaucuuuguuuuugaaauaucaaacccuggagguccuuuguucaguaugacuuuuuuuuuuauuuuguuuuauuuuguuuuguuuuguuuuguuuuuuuagguuacuuuaucagaagcauaacaggguauaaauugauucauaauaaguaccgguccaucuuccaucuugacccguugugcugugauccuucaguuucuaaacaagcaaagucugagucuuuguagcacaucaguguggccuuaguaugguccuccuaagcucaugcuagagcaucugagccugcuggguucacccagcucaaucucauugaagaucagggacaggagcacuguuuucauuccaggcucucaaagggguuucucuccuguucaagaaucugaagugagaguaggcaagcuucagucccuuuugugcuuuggugaccacccuuuucuauuucuuaaagaacacauuaaguuuuuauaucuuacaacguuugugguccugugucauagagaaugaucuuauuagugauuucacaaaacauugugguggggacuuguggcgccuucucauaaaaggagaagccaacagaaaugaaaguguaaacauccagcaguagcuugccacgaggaggaggugugauguacaacccccaucucacucuagccauggcuguguuuguuggugcuuucacaagcgaguugguacuuagaaucaguucccuggggaaccccucaaaaagccacaggacugcccaccacugggaucuuaucaucagauaagcagguuuaugguuuagcaaaaggagaaugcuguuacccucauaguuuucacauauugggcaaguguucauucaucugccaggaugucccauugcuccuggaucuuccuagguaucuuguagaauauauuaacucuauaaaauaaggcugucucuaaaauggaacuuccuuucuaagggucccacuuuuacuguugacuaaauuuauauguuuaguagguuuuuuuuuccaauaaaaacaaacaaaaaaaaaaaaaggagaaaaaauuuucaccugagucagguuugaguuuauaucaaaaguggaugugaagauguuccuuaaaggagauacacggacuuucuggcacaauuuugagccucagcucuccuuacucauauucuagccucccuccuucccugcccaucucucccccagagccauggcuuucauggacuuucucuuucucugugaauacuauaagccaguuccauauuuagacaccugguuuucuuguucaaauagacacuagaugauucuuggcuauucuccacugguauuagaauguccccuguccuuagagcuauccuggccuaccacacccacaacaggcucccuggggcucuuuaaccuauaugcagcaagccacucugggauuggucauaaaagggcucugucaagcucuccaugaccccuugaugcccuuugagggcacaagaagagucauacaagacucagagcuaaagauaauucucuacccauucuaaaaaaguccacuaguuggguugugguaggacauugcuugccauaguggugaugauucugguagcacaaucugacuuugaguuacuccaugauuuuguaaaguauuaggagcccuuaaaguguucuuuugccaucaacuauaaauuucucauauauccuggaggcuuuccuucucuuugccuuggguaaaaaucaaaugaggugaaagauaccuucauguccauauuuuguauguucuagcuagauaaaauggauguuucagaaaagccuuuaaaaaucuuuauauugacauccauaacaccaaaaacugucuuuuuagcuaaaaucgacccaagacugucacagcaaaguagaagaaacagccaucuucuuuggaaaaguaaaauguucauaagaacagggauugcccacuaugaugauaaugauguacugugucuuuguguaaguccuauguguugacuuuucaaauauagccaauugcuuagguauguacaaugaguuuuucuauuguuccuuugauuuuucagagacccccccuuucuuuuuccaguuuuuguauauuuauugauugacuaauaauaaugaggaaaaccugauguguacauuacccgauugaaaguguguauuggaaaauauuaaaagguuguaaaaaauggaaccuagggucucuggugugaagggucugggaaguggagaggggcagaaagugauugucuggaugucugaauaauauggaagaagucagaggcagcuggcauccuuuguuuuguuuuguuuuguuuuguucuuuuauagccccccccuccuauuuuucuuugguguuuuuguuuuguuuguuugauuuuugaaacaggaucucauagagcucagacugguaauaaauucaauauguagccgaaaau

SEQ ID NO: 947 - RNA, 31314 nt, Mus musculus
uggagccugaagucaccacuccagcgggccuggccaacaagauugccuucuccggguggagaccgcugcguccgucccugcugucucacguuccgcagcucugcagcuccgcaauccuacaccaugucggacagucgggacccagccagcgaccagaugaagcaguggaaggagcagcgggccucgcagguaccccguguuccccagagccucacgagaaugugggcggcggcgaguaacggcgcgggcuucccuuggguggccugcgcugaggcugcaccacuggcugcgcucgaguggcugcuuucugucccacgaaccguuccauucugcggagaggggaugggacugcgggcuuacagcuuuucgcuggcagcaggggccggguggauggcuccgaguuuggcauuugugccagcugggacauaggucacagcuuaagggagacauggagccgucugggcaaaguggaagagagcugcagcugugagccaggaaguuggagccagcuccugcuuuauguuugugaaaucuuagaucugcacucauugguguuugggagguacccgagccugugccucuagcaucauucauggagacaugcaaaacacacaacauucaacaauuaaauaaaaguauuuuuacaucuauuaucucauuggcacugaagagcaucagaccugguauuuuagaacuggcaaugacauuacacaguaaaaaucgcuuuguuucacagaacuuugagugccuguacgugccaucugagcaccaccgugcuagacaggguguacaaauauuccugugagauaagaccacacccuggagaaguuuagaguaaacacugagagacaagauguguaaauagaugauuaccauuuaguucugauugcagauuagcuguggaguguagagugagugcuggaguuggaugcaagacaaaucugagcagaugacgauguagacaucauagacaguggggauuucaguagacuugguagggacgcuccuggccugggcaucuuagagaaguuggaguaggugauacugcagggccccaaggcuucugguuagcagggcaggggggugggggugagggagagagagacuuuaccccuugcucuuucucccuuaaaacccugauuuuguugguuaacugggagaucaauguuuaguauucauggaccgaguuugggaaaauguugauauuuuucucuaagcucuuggcccuauuguccuucauuauuuacaacuagaucuguuaaauauuuuuuuucccugaguucuucaagagaaccagagagacacagaaucauaaucagggacauacagcuaguuagugguagagucaagauuagaaaugagcuccuuagagucaggaccuguuggauacccagugguugcuaaagccugacucaugcugucaugaauacuugugaacugagaaacacuuguagugagauuuuuagaaaauaaaacacacguguucuguuuauuuugagaccaguuuguuugggggaaucacuaaguuguugcucucuccucuuucuccgcacucuguguaugucacccauuguuggucuuacugauguuuucuuccucaauuugugcuacucugaauaaacauuucuaggaggggaacccccuuaucuucuggaaggaaauucgcaagugcuauguagccuagauaagcugaaauacuugauuaugaaaagugucgagaauuccaaaauaccgaaaagaacugcaguguccuaaccgaaaagaaaccaaaguguccacuuucuauguugcacaauuagcucuuuaauaagauuauccaucuccccaucccuucauucauccaggaaauuaguaauguuuuuaaaguguuaccuccucaacaguauccuuuguaccugagcaugucgggggugugaaugaagagcguggugugccuuacagugauacuuacauaaagugaaacauagcuuuauguguucuguucaacaagguuuaacgcacacauagacaaaugcauccugagcccgaauccagauauccgccgguggucugaggagauggcucagugugcaguguuuucugugaaggugggaggaugugaguuugugucaccacaauccauguaagcccugccaugguaauguguaccuuagagccccagugagacaggagaacaucuagaagugcacaggacgauuaaccugguguacacaguagaaaaacaccauaaaccaagugcaaggugagggcugacaccugagguuguccucugacucucacaugaaugcacacacacacacacacacacacacacacacacauacacacacacacacacucagagagacuucaaugugcccaguggaaaucguuguucugaguguuuuagccguugauuuaugagguuuuguauaaagcucuuuuuuguuguucagugaaaauguuuucuugugcuguguaucagcaguuagauuuuuuccacacucuguggacuuuguuacaagauuagaccacuaucuauuuauuuauacuauugcugggcaccuggguuauucccaaguuuggauuacuaugaauaaagcugauaugaaaacucuuuuuuaaaaaauuauuuauuuauuuuauguauaugaguacaccguagcuguccucagacucacuggaagauggcaucagaucccauuacagaugguugugacccaccacaugguugcuggucauugaacucaggaccucuggaaaaguagccaucucuccagccugauaugagaauucuucuauaccagccauuuuauguacccacacuucaauauuuccuagcuggauaugcuggcacacaccugugauuccaguccuaagggugaggcagggggaucacuaauuugaagucagccugaguuucauggcaugaaauccauguccuaauaaauaagacaaaaccucaaacuacuaggauuauaggauuuacuggguuauagggccagugucuguuuuaggagcaaacugcacagccaucuuccagagagguuguaccauuuuacacguccgucaacaacaugggcguucugggugcuuugcuucccgucaguguuuggucuugccagaccuucagucaguccuugaccucugugguuuuaauuugcuuugcagucauggacuggagauguugaguauccucucggaugucugccgaguaucagcuccaguguaaccuguuggugucucuuucauccuuuuacaacuugcaccguuugucuuuucacccuugauuuggcccucguuuuaaguucugucuugugcagguuaauugcuauagucacgguguucaacauacaaaauagcagaaacacaucagaaauuucuuccuuuuuuguaugguucagagugguuugagguugaaggaaacagggauguuuuauuccuuauaguaacugagggccuccgcugaaggacacacaagguucuaacuggagagauggcucaggagauaagagcacuugcuucucuggcacaggaccuggguuaccagcacccaauggucugaaacucuaguuacagggaucugacacuugcuucuggccucuguggacacuguacccucauagugcuuauccaugcaugcugacaagacaguaacacacacauaaaaauaaguauaaguaagugacaacccccacuaagguacuugaggcaucaguagucagccacaaaaaugugacguguauggagaaggguguuugggaagauuugggaucagguucacuucuguucaaguuuccuuagcuggaccucuguuaugggcuaaguauaggggaaucugggaacuguggucuaucucugugucuaggaagucacauuauuaugcugucuaagguacagauuucauauuucauggaaagcuauccguguauuuuuaugagucaacagaaacaaccucuuuuuaaagacuuaguuauauuguucugacauuccaauaucuuaaaaaaaaaaaaaccaaacaaacuuguacuggagcuguaaauguaggaaaugccagcauucuguuguuaucuccucuucuaagaaccagaugcccagcgccaaguuggauggauccuucuuuggcauccgaaccagaguauugaucacugugagagcaauuuacaaaauggagucuucuugugggcagauguugcugacaacugaacugggagcuuugugaauauugaauauugagcaccgaauccagugucuucaugggcuugacuuagacccaccuaaaaaaccccuccaaaaauauauuaaagagagcauucugcagguauccucagaaguuugcauggaacugaaauaggaguuuugucacccacugcucagaccacaugggcucuuucuuugcgaguccgagguuuaauaauaagccaccucugcccacuggagaaugugaacaugagaguccugacucuauucuguccccuuguuaugggcucuuagccugccugucuugccagugaguuuucuauaagagcguguacguuucugagguuaacccugauaaccagcacgcugacgcccagugccagugugagggccaggagaggaauggccaugcugacgcccagugccagugugagggccgggagaggaauggccaugcugacgcccagugccagugugagggccaggagaggaauggcgagggagaaguugaaugaaccuggaugagcucucuugucucaugcaagcaggagcagaacugcuaagucauggugugucagcaggagagacauggcuagggagucacauuauucuaagucguugucuuagccaaggucuaggcuauucuguguuuucucuccagcuuagaaagcaggagauaauucacaguuaucauuuuuguuauuaguuuccuuuuuuaaacguaccccaauccugcaacuucuaauaaaacagcaaaggcaucuuuuucaucuguagauguccugccuuucuucagcucuucagccuuucucuccagagucucccucuguucucugucuuuugagaacugguacuagaccagucacggugcuaacaacauuuugaucugguuucaagagagaaaacacuuuuuuugcgguugcuguuuugugcucuugauaaguuuguucuuuguacaggauuauucuaaacguuuguaaucauugaaaacuagcgccauguauguuuugguuaugaagcaguaagagugaauacuugagcucuacuagcaaccacuguggccuguuuacucacaugcaaauaggagagucuagccuugcuugacaaaacucucucauguguguaacugagggacguuauucagucuguccuuggagcccuggcuuggcgagaguauaaccugacauuuauaauuuuucuacagagaaaaaacuuuuucuuggaauuaacaaugauccguugguucucuuagaaccccuugccauuuccuucagcccugggcccuucugaucuucguguaguuagcaccacgggucugcaguucuuugcuagcuugucagccacuuuggaguugugccgugacuccauguggucuuagugugaggccuaugguaguaucagaaucaaaauggagcugcuugugucaaacuuaguaauggcaaccaaaaauccuaacaaagcccagccucacgcugcauguuuuccaguugugggucccugugaucuguugcuagaaacagcgucucucaugaagucucagugauguacugaucugguccgagccaagugugguggcugugggguucuugguagagagcggguuuccagucccuuuugcuuugguuuuccauauugaaaauaggaagaaguucuuuaaaguauuauuuauuuguuugcuuguuuguuuguuuauuuauauauuuauuuaauuuauuuauaugugugugaaagucagaggucaacuuucaggagucucuccuuccaccucuggguccuagggaaugaacacaguugucagacuuggcagcagugucuuuacccacugagcuauuuggugccuuggaaauagugugauagcggaaguguuucgggagaggcaugguggacagcuagcuacuggccagaugucaacaugguaagaaucacuacaaaugcuaccuucucagaauuagcucuuaaaauuguccagaaauaugucuuauaacaaguucauucuaaagaaugucuguuucuggagcuggugcagugggucauccagccugacaguuuguuuccuaggauccucaugguagaaggaggaaacugaauccugcaaguugucuucugccacgcgagugagcaaguguguguguguguguacaaauaggaaaaggacuuagguaacaucacuuuuaaaaaauuuuuaaaaauuguuuuuaaagugauguuuugcuaaguuaaaauuauaauaacaacauuguaacaacaguuacaaguuugagggcauccuacuggauauucauccucugucuaaaguuaccuaagggccagagagacggcucaguggguaaagcauuugucaugaggaccaggguuaagauccucagcauggauguaaaagcugggcagguaaggcagcuaucuguaaucacaggaggcagagaugggcucccuggggcaagcuggcuagcuacacuuguugaucagugagaucuggguuccacugagagaccugccacaguaaauaaaauggagaccaaucagggaagauacuuaaagcaacuuugagcuuuguaugcuuacaugugugcaccugacccacauacaugcucucacacaugggacaugcaugcacaaaggcgcucauaucacacacauauaccacacaccacacgcucaugcgcgcgcacacacacacuacacacauacaccacacacacacacacacacacacacacacacacacacacacacaccacacauacaccacacacacacacacacacacacacaccccacacauacaccacacacauacacacacacacacacacacacaccccacacacauacaccacacacacacacacacacacacacacacaccacacacauacaccacacacacacccacacacacaccccacacauacaccacacacauacacacacacacacacacacacuguucucuggacaugugcaucaccuguuauguugaauuccuaacauuggucucaugagauugucaggaaguuuaagugaaaugacucgugcagucuauucuccagucccaucaacucauugcaguuaguaaaccuuuuucgcacggugggacuaugaucuucacuacuauuauugacaagguuagggauccggcccagaaccucacacacaggaguaaagugcuugacuauuggauaaggccugcuucuacuguaguguuuucaucuaagaccauauauugcugacggauccuauguuagcccucuguccagugcugcccugaacauccccugaaguugagcaaucuucuuuuucagucuuugcccccuggcucuuuccugaacugcaggcucuugaagccuuacuuaucauguuuguuuaggaggcaguuguauguccuugaggccacgugaggaaaucuguuaaugauuuaggaaauuugauugagugguagaacacucgucugaggguuuaugaguuuuauaaauuccaaggugauuucccccaguguucuuccauauagagaacauuaauaauauaacccaucuuaucagaaacaauuauuuuuagucaaaagaaaggcauuucuuuuguuuguuuuuaauugugaagagauaccacacauugcuugagagaaaugagcgucuguccauagcacuacaucugaaugucccugucaugguguccuaugaaaguuccauugcgugacaaacaucagcccacgggaagcaccggccggcaucaauucuuugaagaccaacuguuugcuguuaguuuugauauuggguaucaaacacauauguucuuuuuugagggguaccuaucuggggucucacauguggaaucccgugcccaacucuaggagcagcugagcccaguagcagauauuagucaccucugcuucccagaacaggugucuugggaauugcuguugacgugugacaaggauuuuugagagcagauuuaguaguucagcacuuagcacauaggaaauugaaggacaaggaggaaggugugcugguguuagugaaggucagcuggaaugacuucuguacuuuuucccuuguguucacacagagaccugauguccugaccaccggaggcgggaacccaauaggagauaaacuuaauaucaugaccgcggggucccgagggccccuccucguucaggaugugguuuucacugacgagauggcacacuuugacagagagcggauuccugagagagugguacacgcaaaaggagcaggugagagcgaucuguguuccucacuccuaagccggcucaaaggauucccaaagcaccugacaaccuuaaauagaaggaaccuuguaguuaacagaccaaaucucuuuuugguaaaaccccaaaucuccuuucuugaagaaaugaaaauuguuuguuaauagaacaauagccuagguuuuuauagucuuauauaucauuauaauaacaucaauuauagaaucauauauuauacuauuuauuauugcauauauuauaauauuauauaugauauaauuauaucacaauauauaaguaauaauauuuuauaacgauuuauuuauuuauuuauuuauuuacuuauuuauuuauuaugaguauacuagcuguuuacagacauaccagaagagggcaucagauccuauuacagaugguugugagcuaccaugugguugcuggguauugaacucaggaacucuggaagagcagucaguguucuuaaccacuggccaucucucgagccccaauaauaauauuaauaauauguaaguuacauaucauauaacauauauaacauaggcauaaauaauauaacauaauuuauauacaauauacaaauaucuuuauauguuuauaaauuauacauuaugaauaaaaauuaaaaaugguuuauucauuuaauguauaaggguguuuugccugugcaccacgugugucacuagugccucggaggccagaagaaggcaucagauccccuggaacuagagucaugaucauucucuucugccauguguguguuggauguugaagcuuccucuggaagagcagccagugcucuuaacugcugaaccaucugucuagccccaaaagaguuuuaaccuuugagagcuggggcgguagcucaguuuguaaaguguguccugcacagcgacgacgacccgagcuuagauugccagcauccauguguaaaaauagcugguguacuauaauguaccuguaaccucagcacuggugggaagguauggggcaggggaguggaugggagcucucuguuggccagccuagccagaucaguaaaccucaguuucagugaaagagcugugucaaucaaucaaucaaucaaucaaucaaaguggaaagcaaucaaggacaugcagcuuccccucugaccuccacacucacucacaugcauauacauauacccacaugugugugcaugcacacacacacacacucacacacacagagaacaaacaaaaaaaaauaguaacuuuacagccauguguggugugugccacaugccuguaauuucagcacacuugggaagcagaggcagagagagacggaguucaaggccagccugugcuaagaagcgguaauauccuaucucaauaaaucagacucagagcuuaucuaacaagccuaggguucacucuccagcaccauacauacuaauuagugaccuuucacuaccuuuuccauuauauaguuuaggaaagcgaacgcacagacagcugcacagcugcagcuucauugaaauaggcucuuuuggaauaaauacugaaaugaaccaaacaaauagagcacaguuauguuggagcggugaguuugugaugaauuuuccuucucuuuugucuggcuucuguaaaacuuuuaucuucuuuuaugguggaugucaaagaugacaguagcagugcaucccuuuaaccccugcgcucaggaggcaaaggcaggugaaucgcugaguucaaggccagccuguucaacauagagaauuucaggcuauccaggccuacacagagaaacacugucuucaaacaaacaaacaaacaaacaagcgagccucgagaaagaauaaagcaucuucuccuuagcuugcuucugugcucgucugggcagccuuccuagcuucaccucugcuuucuagauacguuacuuccuguuguguuaugucuuuucuguuggcacuugucguucaguggcuguucuuccagccccugucuccuucccugugucuuuccaugucgauccuuguccccugccucuaccucaaggcccucgggucuuugucuuuggucagccaaagcuccccagcacccaucauccccucuugacuuccgccauguggcucucaucggagcaccagggacaaucaggcuuugcguuugguuccuaacauucuguguucgaucacuucuucucccccaucgaguuggaagaucucggaaggcuggugcugggugccuguuuaguuucucuugucacaggcgucugguugagggccugaagcccgagugaugguccugugcugacaguuucucuuucucauuaggugcuuuuggauacuuugaggucacccacgauaucaccagauacuccaaggcaaagguguuugagcauauuggaaagaggaccccuauugccguucgauucuccacagucaguaagucagucugucugcaugccuucuuugguucuuucaaacuauacuuuuaauaaacucucaagaaaaacguacuaagaaaauaggagauuguagccuguuuuauuguauagaaaauaucuggagacaugcaggagguuacucacuguucuguuuguugaaccuugaaggggcuaccacugcaauuuucuggcauuuagaaagaacguucuucaagcuauugccucaagagaaauuuggaguggaguucuucuuaaauaaccauucuaacaaccgcuuuuugcugagaauucaguguagagcaacgauagucuaggugauuuaccuauacuaaccuguaggucuacuuuucaaauagaugggauuaaucuauuucagaaugaugaagacauuuuauuauuauguuacagaauuaguacuugcaccuaauacacacacacacacacacacacacacacacacacacacaaaccaugcuaugcaaaaaugaauaagaugaagaauaacucuguaccuuaacuaauuuucuuaguacuaacuuucugacgauucacucucucuuaaaaacuuuaucauuuuuagcuuauguguguggauguuuugccugcauacauaccuguguaccauguggaugccugguguuaucagaggccaggagggcgucucagauccacuggaacuggaguuagaugguugugagcugccauguggguauugggaauugaaccugagucuuaacucugguuaagaacagccaugcucuuaacugcugagucaucgcuccagcggcacacaacucacacuuuguuuaguacuccaaucuucauaauuauugucuuaauuaccuauuuaaauguauaaucccaucagcuguugauauauaccuuagcacucucaauucauucuuuugucugauuucuagauccaauuauuagauagguuguaguaaaaauaccacagauauuuaaguaucuaaccugcaucuaagaauccuggacuuccaggaacccacuucugcaggaagcauauugaagauagcaggugcuacguuuuucuacgauuuauguuuucuuggcuguaauauacuuggcuauguuccauucuuccauuugaaucuuccauuuuaaauaccuaaucugcuuccaggaaguggacugaagaugguagaugcuagguuucucugugauuuaugguuucuugaaugcaauaugcuuggauguguuucauucuucuguuugacucuuccagcuggagagucaggcucagcugacacaguucgugacccucggggguuugcagugaaauuuuacacugaagaugguaacugggaucuugugggaaacaacaccccuauuuucuucaucagggaugccauauugguaggugauggacuggguugauuuguauugaugucguccaguuuucuuuagugauuggcauuugaggauaagcccuggaggaaguagagaauguggauuguguggguugcccuuugucuuaguuaggguuuuauugaugugaagagacaccaaggccaaggcaacucguauaaaugaaaacauuucauuggggauagcuuacaguugcagagguucaguccauugucaucauggcggggcuuagugguuaagagcacugacugcucuuccaagguacugaguucaauucccagcaaccaaauaauggcucacaaccaucuguaaugggaucugaugcccucuucuggugugucugaagacagcuacaguguacuuacauauaaaauaaauaaaucuuaaaaauaaauaacaauaacagcugggugaugguggcgcacgccuuugaucccagcacuuuggaggcagagacagguggauuucugaguuugaggccagccuggucuagagagugcguuccaggacagccagggcuacacagagaaacccuuucuugaaaagccuaaauaaauaaauaaauaaauaauaacaauaaauaaauaaauaaauaaauaaauaaauaaauaaaauuuccccccaaauuuaguuuaucucuguaagaucaagugauaauuaccauuggccuuagauuugucaugucaagauucauugaccuggugggaauaguccagcuuccauugcagagccuggagaacaggcugugccaagaagcagauagaggauauuuuucugugugugguaugugguguguguguguguguguguguguauguuugguggugguaguguuuaaagagauacuucagcucugagugcauuugacacuagaauauccaaagaugguuguauguacugaacaaauuucauuugaaaguuuagcaaucuaguuucuggaauuguauugauuagaauuauaauucauaaaggauccauagacaaaauauuauauaagacacuauaauucuuacaaacuucaguuugggauuuuuauuuuugcuuucucuccccccuccccccauuuaguuuccauccuuuauccauagccagaagagaaacccacagacucaccugaaggauccugacauggucugggacuucuggagucuucgucccgagucucuccaucaggugagaccccuucuucgcuauuguauggccugggguggcagugcugcuuagaccuugcaauguguucuugugccuagguuguuuuauuggacuuggcuucuggcuuuuuuggggugcuucuucagauuuuuugaucacaaagaguuuacaucuaacaugaugcuuagaugguuggaaacacuaucuaccaauuaauauuuaggagucuuuaggaauaaagucuagucagcagucaagccgugugguagggaagugaggggaaagcagugcuaaagcuuuugcuauuaaaauagaguuuaagaggccgccugcagcaggcaguaggcggcggguggugggcaccaccacaaugggccacgaugagcaaauucgugauagagaggugggaaagauagaacacggagcaguaugugcccugcggagagaggcagucuggagacaugacagcagugagaaccaggcugacaugaguggccuguaaugccaccggaggcuguggugcugucuguggucugggcugucucugagggccuugucuggaucuguaguccuccuggaggcaggggacaaguucauggucugugcugucgucagaaagcaugugaaaguccaugauccacgcucuggcugacugaagagcaaggaagccauguuugcagugacauugaugauugcagaggcauagcugaggaagagggacauggaaggcuucugugacaaccccuacucucaccccgcucccccaaaguaacagccuaaagaaggagacacggaagagaacucuuaaaaacugugaaaggaaaucaacucugcaauuggaggcuucugagggagaugcugugggaggggaagggacucaguucuaucuaagggacaggucacuggaaguuuaaccaugcuccagugaguauaugggcaacccaaauuggacuuguauuuucuaguuuuguuuucuuuuuaauuuaauuauuacuacugucuuuaaauucuguuuuuauuucuuugggggaggucacaagggugaggucacagaaggacugagaaaugaguaugaucuggguacaugaaaauggaaaugugaaguucccaaagaaucaauaaaaacaucauguuaaaaaaauaaaaugaugaaaguuugaacagcacguuguaguuuagcuuccagauuugcuuuagcauuccuucauagaaauuuugucauuuucuauaggugaagucaugauagcccggggaaguuagaagguguguucuguguggagaaggaauuuucuggaaaugcauggauguaacaaccugggauacuucaauuuaaacgggaggguuuccauuuguguuccuuagguuucuuucuuguucagugaccgagggauucccgauggucaccggcacaugaauggcuauggaucacacaccuucaaguugguuaaugcagauggagaggcagucuauugcaaguuccauuacaagguacucguugucuggacagaggguucaaggcucuuccuacacaacucuccuucccucuccuacaggccugagcagagguguuuccuaucuuucucuuccuuccacccaaggguacaaaggguugauagaguugaauagcaccacgaauauuuuguuggccaccaauucaaagaacaaauucaggccacucaaguuagaacuguguguaguuguccgaugguuucuuucuuacauguaguuagaggcuggggcacauggcuucugucuuugguaugaucuuggcuuauauuacaguaugcaacauuugccagugaacuugagaauguuaucauuauucccuaagcaccucagaaguuuaaaagcuucuguuucuaauugcaacugcuaagcuaggaaagaagggaguggguuagugacaaacgaggucucccuccuuuuuguguaugugguauggaacugauugccagugccuuuuguguuuugagacaggaucucauuaaguugcccaguuagccuugaacuuccucgguagcccagcugggccuugaucuugcaauccucuuaccucagugucucugaguagcugggcuuucaagcccacacagccaggcuuagcaccucuccccuuuaacagcaucucaaaggugcgacuucuucugccauauuuuaauauuuauuugaacaagcuauuuacgaguauuaaauggaaaagugucuccuuuacaucuuggaucaauguuaaaaauccaacuggucucuggauuuauaauugucaaagggagcuguguaaggucacucgggacaagaccuggugauguggggcauccugagcccagucagaagccuugcaggcaggccagccuaaacccagaucuucacugucccggauaacugaccuuggacauauugcugggaguucuuuucauuuguaaaauugggaugcaacuacagcuguccacaggccugcagugaaaagauugcuuauagguuuguucagcagagaauucugcgauagauagaaaugcauaugaauucauucauucauucauucauucauucaucuguucaguuuauuuugauuuauagauacuuuuuucuaaaccaagagaucugguuaacaucagaacagcuuuguacuguuacgauacacugaacauauugggugaccuguggaugguugccuuccccuuugcucccucccagaguugcuuuugcuaaauguuuucaugacgcguggcuuccggagucuuuuggaaugaggcacacggucagccaguugaccagggcuauagagaucggaguacuggcaaagugacccaaugguuuugaguguguuuggcuuguuuggaaaggcacaaugcugauuuuugccugcucauagagaauugguuuagaguagguacagugaagcucaugguagcucgaugaacucugauucuauaacuucuuaaaacaaaacaaaagcaagacaacagaggcagggggauaugcugaucacaauuuuaggaauuuauuugggcuguuuuaaaaaugggaauuagguuauuuccagaauuccuuggucuaaggcaaaugauacuggauguucaagagucaucugcacucuccaguuuuuaaaaacauguccagagggagggagagguagggggaggugugccggagugggggugggguagggaggcccugucuuugugacuggguggaacuguagaccacugugauaagugaaaugauccaggcauagaaagacauauguggcaugcucuguuucauuggugggguuugagaauuaaaagaugaaauuagaaaucagaguccagagagaggaggggcaggguggagggugggaaaggcugccuggugguacugagucacagcugggaggaccaaguucuuuugugcuguuguacugugacuguagauagucacuguacuacagcucuaaaaaacccggaaggaaggauuugaguguuuugcuaaaagaaaugguaaacauucuccauuaauaugcauaguuuuuguguuuuaauguguuaguuaagaauaaagugaacuuaaaaacccuuuaauuuuuauuaucuguugcuuauuuuaguggaugagaauuuuucuuauuaagacaguuuuuuuuucugauuaaaaaguuaauaguauaaaaauucagaugauguaaaaaaaauaaagugaaagagaggaauaauuugacauugaaaagaauugguauaaauaaauauaguuuccuguaaauaaauuuauuacuguuaguucugaacaguagaagugugauuuaaggaaaaugucaucguguuacccaaaugggcugugcuaccuagaacccuucagugaagucaccaguuacgguuuguaaccgcuuuccuaaacuccauuugcgcuucuuucuuucacugugcagaccgaccagggcaucaaaaacuugccuguuggagaggcaggaaggcuugcucaggaagauccggauuauggccuccgagaucuuuucaaugccaucgccaauggcaauuacccguccuggacguuuuacauccaggucaugacuuuuaaggaggcagaaacuuucccauuuaauccauuugaucugaccaagguaagucagcagcagcuggauugcuucauaagugucguccuguaugcugcugcugcugcugcugcugcuaaauaauaauauaaauuauagccaugcagucacggugucaggagcaggcuagauaagaggugguagcucagcagagcccuuguucccgugagugggugccucaccucuccucuugugugggaaguucacugaggucacguuggagccuuccuguguguuauuagcaggggacaaauuuugaaaagcuaauuuacucuguuucugcaccagugucaauauuuaccacuuacuguuacgaaaugauaaggcaaucaccugaaauucuuaucauguuucuguuggguuaagaauuauuuccacgggcuugauuacaugugaaaguugguguuuucaugggggccuuccaggucugccagcuggcuaucugguaauuaugaaucugacauuguuuucagguuuggccucacaaggacuacccucuuauaccaguuggcaaacugguuuuaaacaaaaauccaguuaauuacuuugcugaaguugaacagauggcuuuugacccaagcaauaugcccccuggcaucgagcccagcccugacaaaaugcuucagguaagccaggaagaagacuuguucugaggcaggcgcccguuugugcacacacguacaugugcacgcacuguauaacucgguaugagcuuuuaugaggaauuacuagaacuuucacuugaauguuaauugaggugcuuaauuccugugaggucacuuggaugagacauccuuagguggucauucucuaguuacaccaguuauaaaacauguccaugguaaaguagcuaauauuucaaggugugaacacuugauuucggacaaaagauauaauaguaaugacuccauauuuuugaagaaaauaaaaugacuagcucagccuauaaggauauaauaaaugauuauagccaucgacaccauaaccuauccguuucuauuccaagguggugcuugcauauuuucuaucuaugaaagcaacacuauggaugcucuuuauuaacccaacucugugauuaauagcaguggaauaguuuaaucacgugaucucaaaaagcauucaguacccuuuaagccacuuucuagggugcugugccaagaggucaaagagggacaauucugcuuuggacuaggaaucaguaggaaaaaaucagcuuaauaauugccaugcacaucaaucuucuguguguuuagacucugaccacgaagcagggguuauagaucagaccuuagaucagaccacagagauugaagguugcuucuuauguaaguucugauuccuggcaaguaucagacuccuuggagagcaagcugagguucucugugugucucgggguuaccuuuguuguggcacuggggacaucugacacuucuuuugaaagucagcuuucauuacccuaguugaguagggcccugcuagguguguuucugcggaacacuggacagccaugguguaaggcagagaguacugugacggaugugagaccgggccagugacaaaguucuaggaacgagauggcguuugaaggcugaucuucaguaagugacacagacaguagaggguacgaggacaggcacagaggugugcugcguugggaauauuuaaacuguaguaaguccucuguccugaaugagaggaaucgagcucaccaagaccguguuagcggagccuuuaaguguuggacguugugcaagugcccauucugggaagacagaaggauuuuucagcuuuaagaagcacggcuugggaacugucggguagagcaauucucagugaugauagaggaaggggcugcaguuagggacagagagggaacuggaguaguguauagcuaaaagcagacauguuagcugcuugguuggcacugggaaauagaggaaguccagcuguauagccugcacuggauugaaaaaauaaaagaugacccacagucuuccugagaguccauuucacccguguucuuugggaccacagccacacccggggucagauagccagccggucagucacacaguaacgcacacacugaggacuggaacggaguaccuggcccagggugaagcagccacaggaaaggugugaaguucugugcgacgaaaggaaacaaccguaagccaggcgcagugcuguuauccagccacauauucuaauucuguggugcaugugaggagccuugcagcugcggaaggacuguugguuccguuagcuguuuggugacccgaggucaaaggugguuugaguggguagggacuguagucugagggguccuuaggaagauuauuuauggaauacuaaggcagagagcuagguaaaaagacuaauuauuccugaggugaaugagcucugaagccgggcaguggccuuuccuguguugauggguagugucuuugguugcuugaguggggaaggacuguuuggucagguagagcagugguguaagggacaaagccuugugcaagucacugucagugugagcgcucacugcgcccaucucucggccugacugugucaccuccacucacugacaacaggguuagggaugccuacuuacuauaagguaagcaaaccagaguggugugcuagagcagugguucucaaacugugggucauugaccccuguggggauccaauggcccuuuaacaggggucaccuaagaccauuggauagcacaaguacuuacacuaugauucauaacaguagcaaaaauuauacuuauaaaguagcaauaagaauaauuuuaugguuggcagucaccaccacaugaggaacuguauuaaagggacgcagcauuaggaaggcuaggaaccacuaugcuagcggcuccauccaggagcuacccaugacucuguuaucgccugucgauggugcugggcagaugguguugggcacaguuucuggagcuaguggaggcagccagcucagguugagucacacuugcaugaccagacaucuaaacauuaccuagaugauuuggaaugauggugggggaaagacugaguuagcagcaguguuggcagagucagugggacugcguuaagcacuuaagcauggcagugugagcgauuuguuacaagauaacuacuguauguaguauuuaccgucucuaccuccgugcuuaguuuucacuuuuuaauguucauuuuuaaaauauaguucaauuuuaaaauuuuaaaucaauuugaaguuagcauacacauuagugaguuuucauuacauguauugcuauuauauuuuauauacccuucccccucugcccucccucauuccccccaccucugcccuccaucuuccccccucugcccucccucauccccccccccgcccuccaucuucccuuccuucuccauggugcuccccccaaaucccuucagcuucuacgucacauuuauucuauuaccccucuagucucccuuaagaucucuuuuuccccucucacagucuccuuuccauuuuuuuaagccuugguuuuuuuguuguuuugacaucucuaauuaggaauaagaaugcuguguaggagucagggcgcuaacgaaggcaguggaagaagaauugcucagaguaauagugagaagagcucagcgauuggacagcgaggccagggcagagcaaaucugaguguuuuuuuuacuaaaaggaaugucacgaugguugucauccugccuugggaauaauuugcauccugguuagccucggagucauuaccuguggcuguggagggccagugguuccaaccacaccuuucucuccgugcuuguuaguaaaucucagaauacagugucuaauuccccauacugugugggaggcgcugcuucuuugaacaauuuccauacagcugccuuuggagaauggcgcuguuuuaagagcaagggcucaauucuucccuuggaguagagggcuggggagauggagaaauacuucaggauucuguugaggugaaaugugaaauaccaugccaagguaaugcugcguccugggggguggguaggcaucguugucuaggacagacgugaggugaguguuggccgcauggcaggggugguuagggacgacgacuuuagggagaaugcacuuucuaaguaggaagaggcuugacucugccaagcaaagcuaggcaggguuaugcaguacucauggacuuuaaauuuuagaaugaugcuuauagcuucauuccuguuucguaacugaguauccuaaugucuguuauguauuacuguagggccgccuuuuugccuacccggacacucaccgccaccgccugggacccaacuaucugcagauaccugugaacugucccuaccgcgcucgaguggccaacuaccagcgugauggccccaugugcaugcaugacaaccaggguaggccuggauauauuugaguccuucccuguaaaggcagagagcaugaggacugggugggccaggaugcuaggccagugguucucaaaccgugagaccuccugugcugugacaugcucuauaggcgcugccagccacccagaucucuucuguuaugaaguuuugagcugcccguggucucuccugguuucuauccauuuuauacacaucccagagaguucccuccuccaguugcccuugguaucugucugaagcgaaaggcuagguggaagcucuacuaccacaauggcugcuguggaguguguccaaccuaagcuacagaaugcacaguuccucaggucacucuuacccuucugagaccuuggaaacgcagaggcacaaaguccacgccucugccuguaguucuggugaaacuggggcaccaacucugacuggaauuuggaagggggcggggaggggagagagagagagagagagagagagagagagagagagagagagaaugaauuucaagggcugugcucuucuuccaugucuguugcccaaguugacuuuaccuaaguaagcuaccgagaugacauucuccugcauuugagugcuuugaggguucauuugucaagugcguggcuuucccaucuuaauuaccuucuugaugccaaugcaccgaaagccucaggucuuaguucuggauagccaagcagagugcuugguugaugugucuucuuuuaauauucgaguuuaaugaauaucuugguuuuuuaauuucaugcugggagccugugcuuaaguuaauagcugcagaagucggucucugaagaaguuugaccagugaagucuauuugaaacaguagcuaucuguacaaaaaucaaacauaucguauacuagaggguacaccuccaauaacaaagaauauguguacucuaaaggcaacuugggauauagaggacaaacacccauguaauaguucuaacacccagaggccaggccaaucgcaucuuucaguauuucuugcagugcuccuucaggcgccauuuuuacacauuuaguugcuuugcacaugcuuuuugugcucugcuguccuguccuuaacucccaggccucccuggcguuuacugacugcgcaugcuuucugccaaacuccacugaguaggucuaguauuucugcucccuuaagacucuggaggcaugggccugagucgucguaguugacacuuccugugucuaaaucuugccuuuccggucuucgagacuuugauguuuuuuuccuucuuuuguggccuuuuuguuauugcagcugugccuggcaccgacagaugucccuguuucucuugagcuuaguuuauaguuaauuaguucguguuuacaucccgcuggcacacuugugagaaaguugcucugggguugacgcugaaguccucugcuugauuuuagagcacguuugugcugugcucuggaaauucucaugaaagagcuuaauuguuuccaguugccagagccuccaagacaacucccacucuuggguaaaggucaggauguauuugaaaauagaauuaaaaaccucucaaagggugaauuccuagugaagaaauauuguggugguuagcuguugaagucuuuccuugccguagcgacacagcuaccccaaggcuacguucugaaaugaguaaccgaucgccauaaugguauauggccuuuuuuuuuucugcccugcaugcacccuuggugccuuggucacuguguuagguggcaucuccuaauuauccauaguggaaaaucuguccugucggagagccacgaagcauuccagucacaggcugcuuccugugagccacuccuuagccuaggcagcguucuguacgggcagugugagcucccauagucaaguuucugcugauaccagccaaagcggcagcgugccauguggaaaguaaauauaccacaacaaggggccagugagguagcucagagggcucagggaaccugcugcaagcucaaagaucugaguucacucucagggacccacaugguggauggagggagagaguugacucucacaagcagcucuuugacguccguacggguuuugugguauaaguaaaccugcacaugcacaguaaauaaaaguuaauaaaaaaaugccaagcugagaaaaagaaaagcuuuauuuuuuuaaucucagaaucaugaaggauguauaauuauaucugccaguauuuuguccaaaaaaauuaagauaaaugaaagcuagcauauuacaaauacagauuuauuuuuuaacuuuuccaaguggggaaaguaaaaauagaauugaggggaacauuagaauaagcuaaggagagauguuccaaagccuuaaaggcaugcgaggaagaguuuugucgaguuuccucauugaaacagacagaagugcaggcuucuagcccugccccaccaacaaugcaccagcuaugaacaucucagagcuucagauuuggccagggaaugaggggauagaacuagguugcucuguacaguugagucaacgauuagauggagccuacauccaaaugagacgaucagaucccccggugucucugggccugaucucagagacaacuacgucacaucuuugaagaaacuuccuggugcagguaagcaccaggcgguguuauagacaaggaccucugaaguguugacuggcauuugagaucucuuuacucaggcagcccacacgugccugugggcagggcaguguccccgagccuguaguuagaccugaggagagagaaucauuucccagcaugugauguguuuacaucggugccugauguauguguguuugauuacugcugugggccucuccuucccagauugaugacucacuaaggaugacuaagaugacaucucuaaggaugucucugcuucuuuucaaagguggugcccccaacuauuaccccaacagcuucagcgcaccagagcagcagcgcucagcccuggagcacagcguccagugcgcuguagaugugaaacgcuucaacagugcuaaugaagacaaugucacucagguaauggcuuucugggcuccuccugggagcuuggcuguuuuucuugucagaccucauuaacgagugccauuagucucauuauauagcucugcuggccuauauagaccaggcuggccuugacuccuaugugcccuccuugcuucucucucucaaguucugggacuaaaggcgcaugccaucacaucggacuuacuggccacuucuuaaggugucugucuuacuuaggguuuuacugcugugaacagacaccaugaccaaggcaagucuuacauaugacaacauuuaauuggggcuggcuuacagguucagagguucaguccauuaucaccaaggcaggagcugacagcguccaggcaggcauggugcaggcugagcugagaauucuauaucuucaucugaaggcugcuagcagaauacuggcuucccagcagcuaggaugagucuuaaagcccacacccacagugacacacccacuccaagaaggccacaccuucuaauagugccacucccugggccgagcauacacaaaccaucacagugucuaaugcaccuugaauugaauccaaagaagacuuagcucuaacaaaucagucucuauuggcuagagccaaagagcugucuggcuacucuguccauuucacauaucaggacucguucucagcccccacccccagccuuuauugaaaugauugggcgaugcuggggacagugaucuccugggaauuuaagaaaugagcaagucuauuggcagaggaacucaguuuccagggacuagaccuggcgauccgagacggccacugacgaccaggaaaaugguacuuugcuagccuuacacagacagggccuuggguuugaauccuaauccuggaaaacucacaacaaaacuggcaucgagaguguguggguuccucucagggcuccugggcacccggcucugcuguucucagggagugggggggggguucacuuccgcuuuccacugcuggcugcuuguucccacugcacugccuccucaccccccuuuuuuucuccucugccucucaacuucugcuguuuggccacgcccacaccuggccuacucucuuuucugcuguuuuuuuuccuuagcuuuucucuuuuugagcacccuucacucuagucccgucauaguugagagaauccgauagucuucuuaccccagacuguaucauuggucucggaucacccuacugcuagcugcccuggcucaggugcuuacccuguuuccaguuaugaauggcugccccaagggcuuuucccguggaugcucugggagcccgggugugggcugggauucgcucaguguaacuuccaccacacccagccaaagaaugagaagguaguugcucuggagucccuugugggagcuuucuguaaauugauauuuaaauucaguuagaaccuauuuuuauuuucucaguuuaaaaauguagauuccaagugaaauauuuauaaauacauagcuggauucacugugaagauguuuuuguuugaaaggggggggcuaguucuauuuuauugugggauauauagcacauuuagguaagccuuuuauaguagguuauuuuuagagauaugggugaauucgauguacugcaggauagccuuggcagucaaggguuugcuuguaugaggucaagaucgauacaaagcaaacccacacaacuccuuuagaaacgagacugccauuuguacguuaagguuugcuaugugagcuuuguguuaugcuauguuuucuuauuuuagugagaaguuuucuuaucauuauguaggacucgaauuuuuaaccagccaugauccugguauuauggguucaaagugaaguggaacaauaauaaaaguccugugaccaguacccagaaaacuucaugguuuuucccuuaaaaaugauucccuuggccuuguggcucagaggacuugcucauaucagaucucuccucucaugaagaacaucagaaagacagauuaaaagcuucgaagaggggcuggagagacggcccugugguuagcagcacuuguugcucuugcagaggaccagggcucaauucccagcacucauauguggcucacaacaauccaaaacuuccguuucaugggaugugacacccuugucugaccucccugggcaccgggcaaacuuguggcguauauuucuaauacaugcagacaaaacauccauauacauaaaaggaaauaaaucuuuuucuuuuuuuaaaaaagaaacgccuuggaggacaaagcaagggcuuagugaccaagagcucagaaaagcugcagaaaaaaaauaaaguuuugugugugugcgguaagcucuguagcuugguaacgaaucccugaaagauuggcagugagcucccgugagaagcuggcugcagugaaccacuaggaaugcuuccagaaauuacuuuuugggcagcgagguggcucagugguuaaaggcgcuugcagccaagccuggcaaacugaguuugagcucuggaacccacauagaagagagaagugauacccgcaaguuguccuuucacaucuacacauggcacaugugugcacaggcuucuccacauucaguaaauaaauaaauguaaagaaaaaagucauagauggccugccuccucccucccuccagcccucccucccuccagcccugccuaccuuccuaccuccauagacagacugaauuaaauguuuugcaaagguacugcagcucagcuaaacacguuaucucuagguuccaguaaugagaucgaguccccguagcaaguggagguauucgggaaguaugcguccuguggggguguccucuagugaagguguuaugccuccgagaaguuaaaguucaaguccuagguuuuguggguugcagaaagcuacagcuggucucaacguagugccgaugaccaggaaagaguacugcccacuagacggagcaugcuccuuggaagcaugugggugcuaaguggcagcaaccaauccugagaaaauuggacacacacacacacacacacacacacacacacacacacacaccugcacagacacccagagaagaaaaccaguuacaagcuauuaccaacaaaugaaugcaaaagaaauuaauucaucacauaugacaguuuucauuauaauauuaaugugauuuuuaauugugcauuucuaauguagacucuuggaguuuuauucauggaaaaaugguugauuuauuuauuuauuuauuuauuuauuuauuuauuuauuuauuuauuuauugcucucuuguugcugaacaggugcggacauucuacacaaagguguugaacgaggaggagaggaaacgccugugugagaacauugccggccaccugaaggacgcucagcuuuucauucagaagaaagcggugagucuggcuuugauggcuagagggugacaccugcuggcucauggagguagugcagccgugugggagaacccugcaaggaaaagcaguuucuaguuuaccugagcuaagaugacuuuguagacagugcagcaauucucagucaaaguucgauuaccuugucucagcguuuugucuggcgugauacauacacucauuguuaucugguuuuccaguguguagacauucaguugaguuuagagugaauucuugugugugcugugcaguucagcuguagucaguucugugugugacagcagccguggcucugcuuugucucccggaagcuuucagaggaugacagguauuguuuccgguuuugugguuugaagccuguauccagguucaccgucaugagucugcgacucuucuucagacagaguagaagcuugcuucuccuagagcaagaacggagcuauuccccgaagcgggcugagucgaggugcugcggugugucagcugacugcucaucgagcuaccuggagcccucucucuggcuucuaguuuuuuggguugucccagaacaacguucaauauaaacugaguagccuuucuggaccguuugugcauggucuuaaaucgaggcagugccaagucugcccuuucacacagauuacuggcuuguuggguauccacugugaggucagcuguuuauuggcggcugguacaaguuguucagguguauuuuccccguaauauccuaugaggucugucauauguuuucucccucaauaagagguucuugcccuuguggugguguuugguugucuuacaguucaguccaguugugacaggagucccuggaacuuguuucauaaccgcagauuuaggggucaaaccuguaagaacccuuccacuuuagauuucacgcaagaucgcuggcacaugaaaguuccgacugcugucucaggguucacaggagccucugccaaguugguuauuugcuagcauggcucacagaacccagggaaaugccuuauguaguauuaucuguucaucauaaagggcaucucaguacucaccaaauggaugagacgccugagcucgauauggggaggaagggcuaccaguuuucaugccucucagccguaccagccucccgacaccuaccaagaggcuccgggagcccugucauacaaggacuuucaugggguucucccuacauaggcauggcugaccaggucaucaguuaugaggugacuggacaccauccguaggcucggggugggauuggaagucccaccuucaaauccuaugcucguugugucugguaccagcucuguccugcuguucacugagccucccacgaaccaucucagugguacgcggacgacaguaaauuccacaggcuucaggauccaugugccaggaauggaggauaaagaccagaugugucucuaugauccacauaaguauaauugucuugcucauuuacagagggggacauggaaacucagauaggugagguggcuucucugaggcagcucagcccauagacuggagaauuuauacuggaccccccaggucuuucuccagaaccugauaugaccuguugaaauguccuucguccccugaccaguaagcacaagaugcugacaguucacauaggggugaggagaugcuaauauguaaguuccuuuugacuccaggucaagaauuucacugacguccacccugacuauggggcccgcauccaggcucuucuggacaaguacaacgcugagaagccuaaggugagcccugagugguguggcugggagaggagccugggcugggcugggucagacacagcuugguuuccagugccauuaucgccucaguucagcaguuacuaggcauuuucuuugacuuacuggcacaacauauaacgcuucauuuuagccccuacgcaacacugaauucauucacaguggauggauuucugaguuguuuuaagagaaaucccagguuccuaacucacugguccuguguucucuucccaugauacagaacgcaauucacaccuacacgcaggccggcucucacauggcugcgaagggaaaagcuaaccuguaacuccggugcucagccuccgcugaggagaccucucgugaagccgagccugaggaucaccuguaaucaacgcuggauggauucucccacuccggagcgcagacucacgcugaugacuuuaaaacgauaauccgggcuucuagagugaaugauaaccaugcuuuugaugccguuuccugaagggaaaugaaagguuagggcuuagcaaucauuuaacagaaacauggaucuaauaggacuucuguuuggauuauucauuuaaaugacuacauuuaaaaugauuacaagaaagguguucuagccagaaacaugacuugauuagacaagauaaaaaucuuggcgagaauaguguauucuccuauuaccucauggucugguauauauacaauacaacacacauaccacacacacacacacaugcaauacacacacuacacacacauacacacacucacacacacucauacacacacaugaagagaugauaaagauggcccacucagaauuuuuuuuuuuauuuuucuaagguccuuauaagcaaaaccauacuugcaucaugucuuccaaaaguaacuuuagcacuguugaaacuuaauguuuauuccugugcugugcggugcugugcugugcugugcugugcagcuaaucagauucuuguuuuuucccacuuggauuauguugauguuaauacgcagugauuucacauaggaugauuuguacuugcuuacauuuuuacaauaaaaugaucuacauggaaggaccguguuugguugcuuucagcucuguauaauguggaaugugaaguagagauuaccagcucucucugcaguaacaauaaaagcgccagcggccagagccuccauggugucugucuuuggauggccugcuggcgcacugagacagcagucaac

SEQ ID NO: 948 - RNA, 40016 nt, Mus musculus
cgucgaagccauggaaggucccauagcuguagugguccccucccuucugagcacuugcccacgugcugucugccacuuaagcggauucacgugcagcggcggccccggcguagcucagcuguguagaauuuucuccagcagauuggucagccuggguagcaacucggugucuucacgugcuuccguugugcagcugccuggugucggccggagcagggcgcagguacucuuugcaagggacugggucggauguugagaugugcguuugggucuuucacuggccgguagggcuggcucgaguacggaagcuucuguaccggcuggugccuguaucuucggacucuucgccuggacugcccuacagacagacguuccugguccgggauacucugacaugcggggcuggcuucucgagcgcuuuccgggaguguggcuccuucccacacucgggcuucuucucucucuuugagagaauggguuggugucaaaacuauuuucugagaaacucggcuccucguagcagugguaggcuuugaacuaacgcgguuuagucccagauauucugcucuuaaauacugcaguaugccaguuuauuugcacuauuuagcugucucagucaggacauuugacagugcaccucgugaugcuuaguacccggugcuguguguacaagaauggauacagccgaaugaaaaugacuugucgaucagguugugguggcguauaccguuaauuccagcgcuuggaagguggagccuggaguauuuuuuggagcucgaggccagucuggucugcauagugagacuguuugaaaaaacaaaacaaagcaaacaacaacaacaacaaaacccaauacgauucaucuuauuuucucuuuccaauaaugcuuuccuuauguauuaaacguuucuuggaaccaguaauuuuagaucguuaucagaucccucacucuggccauuaauuuuacauuaguuuuguguguaguuguauuucaucuacuuuuaaaaguacuuuuuagaauuaaagcuuguacucaggggccuuaccuguuaauucuaagacucuccuauuauaacaaaaaauaagacucccccccccccccccccccaagacaggguuucucuguauagcccuggcuguccuggaacucacucuguagaccagucuggccucuaacucagaaauccgccugcuucugccucccaagugcugggauuaaaggcgugggccaccacugccugacaagauaagacuuuuaacaauuaagcuggacucguuaacauuagguacccauucauuuuuuguagguguuuauguggcuggcaacauaaagcuuacaaacugaguugcuuuggacuuggguagaucccaguguaaagucuauuuguuacaucagugccuugggauacuagauuuuuuuuucuuuuaagacuuauuuauuuauuauaucuaaacacacuguaguugucuucugacgcaccagaagagggugucagaucucauuaaggauggcugugagccaccaugugguugcugggauuugaacucaggaccuuaggaagagcagucagugcugagccaucucuccagccugggauacuagauuuuuuuuuuacugcuuuccccuucuaaacaggcgccauuuauugugauacuguuuuguguuaagaccuguuaaagccuauguuuagggaaggagguuuuguuuaaagcacaacagguuccugaauuuuaaaaucacacauagccugacacucuaauaccgggggagugugauugauugucuuaauuuuuuugggggggggggccuauuuguuauagguaauuugauaacauuuauauuuuauuaaaugcuggaggaauugaguuuagguccccagcuaggcaaauauuguacuacuguacacccaauaacccauaugguacuuuuuaaaaucaccuguauagagccguuaguguggcuucucacccaaagaaacacauugaaucagaaauauuuguuuucucucauuuuauacguaacauaugaauuuaagcuuuuauuauuauuauuacuauguuuuaauuguguguguuguguggggucagagaagaacuucuucuuuuuuuuuggggggggggguuugguuuuuugagacaggguuucucagcccuggcuguccuggaacucacucuguagaccaggcuggccucgaacucagaaauccaccugccucugccucccaagugcugggauuaaaggugugcgccaccacgccuggcuuuuuuuuuuuuuuuuuaagauuuauuuauuauuuuuauguaagaacacuguagcugacuucagacacaccagaagagggcggggcagaucucauuaugagugguugugagccaccauaugguugcuggaauuugaacucaggaccucuggaagagcagucagugcucuuaaccacugagccaucucuucagccccagagaagaacuuuuagggauccccguccugggaagggucugcuuguguauacggccacugccuggcaagucuuuccuuuugccauguggauucugaggaucaaauucagguccuuaggcuuggcaacaagaaccuuucccugcugagcccuuuaaccacacauuugaauuuuacggaaaccaaaccauaaaagacaaaagucaaaauaaaaaucacuauucagaaauuacuuuuuuuaagccccccccccccauguguuguguauguauacaaaaugguauuuacagggucuggaauguuacucagaugguaaacugcuugcuugccuagcaugcauaaggcccuaaguuugauucccagaauagcauaaaaccuuguuguggugauauacaccuguaauuugagcaguucccuguaauccuaguacuugggaaguggaggauccgaaguuuagggucaucuuggcuauauaaugaguucaaggccagccugggauacaucaaacucuguuaaagucucuuaucuuccuacucuuuggggucuauagagauaccauuauauguuuuaaucauucuuaguuuuauuuacuuaauuuuacuauguuguucugauuuucuuuuucuuuuuuucuucgagaacgagacaaggucucucucuguagcccuggcuguccuggaacucacuagguacgccaggcuggccuccaacucacugaagucauucugcuugugccucuccuaauuuuucuuaaacuccuugauggagauacuaaguacacuuuucuguugaccuuccugcuucagaacacgucaccucucuagucugcagauuauaaaacagaucuaugucuuuccuguggugguguuugaagauucagauuuuguaauuuuuguaauuagguuuauaaacaugccagcacagcucccacauagggcagccagccagugccacuuacuuggauguaauacagaaaccuuucuaguauuugguucaucuguaucuccuuuauuucuguguuagugauagcuuuucaucaugaaucggaagaagguggauaaccgaauucgaauucucauugagaauggcguagcugagcggcagaggucucuuuuuguuguaguuggggaucgaggaaaagaucagguaagacagaccugcuaaaugcuuccucaguuguuuugugcccugucccaaugaguuggcuaguuagcucggccuuguaggguuucagugcgcagagucauuguaaccucuuugcugguggaauauauaguggggacguauguucaguacuuggaaaugguaaauucuguauauuuagauucaugaguagacgagccaguaucuuuagaacccugaaauaauggcuuggccucaaggcugaguguaugugaccuagcuucuaguuuccguuugguuaugacagugaccuuaggugguguccuugcagguuaguuucuaugcuucaaaugaggucuuggccuggcaguccuuauguugucuuugacucuuagguuuugugauuuuuuuuuuuuuuuuguccuucuugucaggugguuauucuucaucauauguuguccaaggcaacugugaaggcucggcccucaguccugugguguuauaagaaagagcugggauuuagcagguaagcuugggcuuuggaugucacauccaccuuucagugcauacuuaguuaaaucccuuggcugugcuugagaauugcgucuucuuucagaccacuguuuacccucggaagccuuuguacuucguagccaccccuuuccugucuggcuucugcuucugagaucaugcugaccuugagcucauagacaccccuggagauuugaucccuccaggaacagcguuucucccuuucuccucuuuagagagcuucuuacaccaguucaccaguacuagacaguuggugauuguuuaccucucucucucucucucucucucucucucucucucccccccccugucucccucucuccccuuuccuauuuuccucucuuccccccccccccccccuuuugguuugugguucugguuauugaccacaguacagacaucaugucugccuuacuacugaguuauauagcuagccucuuauuuucugaagcuauaauggucaagacuucuguuggcagggcuggagagaugguucagugauuaaaaaguacuugcugugcaaucccaaccgccacaccuuaagccgggcugccugcagauagccugcaguucgaguuccaaggaguccaguacucucggacuugauaaaugcacguccugcacaugcaugcuccaggcuccauaaaugugugccugugcgcgugugcucgcauaggcacagaugcaggcacauaaaucuuggagaaguuugcaggaggacuccagagcaaacaccuauagguaccgugcgaaugcuugauaauauaaaggauaaaugagggccgaaggaguuaagguuucagcucugcuccaggguagguggucgggagccagagugcaucuguuucuuggucaccucucaucucugcagaucugcucugugcuuccacauggugaacuagcucacuagcucuuuuuuuccccugucucucuggcagaaacauacugaguuuuauguguaaggccaaccauauaaaagucaggcuuucucccaaaauucuugugcauagauguucccaaauggggcaucacauauuaauauaguuagucgcagucaugcagaaaccucuaacucugaaggaguuugagaugagguggacaguacuccuuggcagauaauccacucuguggacugcucugggaaccuucuuucaugacuccugugcaguuacucaguccacucccuccccuagcugccucguaccuaauguucuccugaugggccucaucucgcucauuuggccugugcugugccaagucuccccgcuggcuccugugcugaggcugccguuuccgcccugacuucaacugcugaggucacuuguuuccgugucuguuucccuaaaguugucuccagcaccuuucagucacacuuguucuaauguagugggacugacgacgaccuuuucuuucccugucagggcacuaagucugucuuauuagaugguuucuuucauuaucuauuuuucuaucaaucuaaucuaaucuaaucuaaucuaaucuaaucuaucuaucuaucuaucuaucuaucgacagggguuuucuggguaguucuggcuguccuggaacuuacucuguagauuaggcuggcuuugaacucaagauguaccugccucuaccuccuaagugcugggauuaaagacugcacuacaacuuccugacccuauuuuuucuuuuaaaaguguauuguguaugugaguguguguagggggaagggagaggaagauagagguauuugugaguaugggcaugcagugucaccccauguguguggaagacagaugacaaccuucuggaauuguuucuuugcuuccucucucucaugccccuccacacgagcauggcugcucuuaguuauuggaccaucuuucaggcccuccaugcguuuucagaagauugauugucagaucagcuagguggguuagaauuuuguuugaggcaccuugacucugguuuuuggcuugguacuuaugagauuguguggggucagauaacucuugguauucugggaagagauuuucuuucaaguuuagcccuccugguuucaucuuuuuaaaauuguucuguggccacagucuucaugguagugacucuuguguguaauacaguucaggcacgcaggagccugggaugagagguuugacaaguuuggguggcauagagucgagacacugucucaaaaccugcaggaggguggggaaaucuaucuauaccucuucucccugccugccccaagccuugauuuucacaccuccaccuugaaggaaaaaggacuuaagggaggagccagaagcaagcgucuguggccucaguucacacaggaaguagaggcccacagaggagugccucaguucuagcuauuacauuuggaaacagugguucacuuuucuucaguuagugccgaggggauguacucaugacuaggaaccaugaguauuguagccugccagcagcccugcuucccuagcccuuuggggagcagcacaguagugggaucuuugguuccagacuuuagguaaugaggcaucuaaguuuaguuuuaagcuucacuuguagcccugccccuguuucccaucuuuaaaguggucugcugaagucacagccaauagugaguaguucacgugugugugugugugugugugugugugauugugugcaguugugugcagguguaggucaaaggacaguucgugggguucuuucccccuuuuuaaggggacuaaggguuuagacucagguugccaugcuggcaaagccugucuucuuaacuccacuuuccuuaguccuuaaagggaaggagacagccacugucacacacccccuucuaaguucccacuagcucugcagggcugaggaucacugugcuucuucugccccuguuaauugccuuucuugggaugaugguauuacagucaccggaagaagaggaugcggcagcuacagaagaaaauaaagagugggaccuugaacuuaaagcaagaugaccccuuugagcuuuuuguagcagccacaaacauucgcuacugcuacuacaaugaaacccacaagauucugggcaauacuuucggcauguguguccuccagguggguguccccuucccuacagagugacuacagugagggcagcagacacuuggaagcaccccaccccaagcacuaucaggaagacuuggccgcuuugaaaagaaaacuggguuacucacccuagauagaaacgauuuuuccugcacuugacuagagauggcagaaaguagaggacugccccagcacaggcuccugcccaccaugccugacauaguaaggucugggccagugcugugugccuugggauacugacacaggagaauuguucgagaccagccuagccuucaucaaaccuaacuauauuccacaagcacuguggacuugggagucaccauagaguccuaguccuugcuggaacuaagacucccagccugugagccaugguggcaauuauauagcugugaccuccguauccgcucuuacccucuucuaaauagauaagugacccccauucugguuuucaagaaccauauacuuuccucaguacagcuuggugaaauuccccucugauacuuauuuucuugucagacaacuuaaucaaacauguuucucaguucugguggauguuauaugauaucugacuuuauuugauaucugugacauuccuuucacuucaccccaccccaaaaugacaagaugucugcacaaauucauacauucuuaaauguacuuguuauauucacacauguacuggaccauaacuguguaaauuagaaaacauaucucacaaauuguaaguuaaaaaugagacugggccucaagaaaaggauuuuuuaguuuuucuuucugcaucucuagcaaguagcuccacuggcugacuucuagcacaccucgggagcuggaaagaacauuuggccucgguguccuguaccaguucuuaccagucauuccgaugcuggugccuuugggcaccauugccccaugauguacaguuuaguuuuuucagguuguauagaaaugcccagaaaaggguggguaugggggacuuuugguauagcauuggaaauguaaaugagcuaaguaccuaauaaaaaaugggaaaaaaaaaaaaaaaaaaaaaaagaaaugcccagaaaaggcaaguaagaugcuucugagauugcauucggaucagugacauguagaagacuugcuucacaucuaauucauuucuugauuacaguacccgagcuucuugcaucccagggguggacgggcugcucccugugguccccauguuugcuggugggcaggugugaggggugcaggcugggcuugugcucugaugcucucugguugcugucccgcugucucuggucgggcagccuggaggugcugcuggugucacaagccuuucugaggucugauuccuuguaggauuuugaagcguuaacuccgaacuuguuggccagaacuguagaaacaguagaaggugguggacugguggucauccuccugcggaccaugaacucgcuuaagcagcuguacacgaugacuaugguaagagcaagcgucucaacccuaacacaaagccagcugcuuuggcuggagcgagugagcaccuucaguguguggucugcauggcagaaaguccccaucaccacagacggauccuccccacgugugaggaggagcuucugagagccaugguugcuuucaggcagcuacagcuccacgcuggugagggggagaugccaugcagccguccuguguuuguuuuguggugcaggaccuuacuuuacagccagggcugguggcuuugaacucuugcuccccagguccuagcccccucagugcuagaauuguagguguguaccaccacaagccugggacugaguuuguguguuauuuauaggaacugugugcagauuuccuuacuggcccucaucuucugagggaaaacaaauaacuucuaguucuacuuuaaagcuggaagaauuuaaacaugaagagagguagguagugcccuucccaaacaagacaguaagaaguggggcucuacggacccaccagcuccauagggacugccaggucagucuuccauccccaaggccucguggcucaggcaugggcugcaucggcccuggcaucugaugagcaguguuccuggcgagguggacucuucagauccugaggcugccuucugucauucccacacccacgcuccuugcugcuaaagccgcucugauaccuucaggcauggcuggcaccauuaccccaggaccuuugcauuggcugcuccuacuggaaugugcuucccaggaaucucugcaugggaaugaccuucaacucuuuaucuuuccuuuuucaagucguaagguuacagguaugggccacaguggugggucaccauacccuuuuaagacuaggcaguuccaucugucacuccuucacuuccaucauugucuuagucacuguuguauugcugugaggagacaccaugaccuaggcaacucuuauaaaagccuuuaacucggggcuugcucacaguuucagggguuaguccauuaugaaggagagcaugcuaacaaggcagcauacauggugcuggagaaauagccugagagcuuacauccugugggcagagacagagguugggccuauggugggcuuuugaagccucaaaguagcauacuucuucuacaccuccuaauccuucuuaaauagugucacugccuggugacaaauguccuagucagggugacugucgcuguguugcugugauaaaaccccacgaccaaaagcaaguuggggagaaaagaguuuauuuggcuuacauuuccacaucacuguugauugucaaaggaagucagggcaagagcucauacaggacaggaaccuaguagcaggagcugaugcagaggccauggaggaguaaugcuuacugacuuacuccuccugguuuguucagucugcauucuuaaagaacccaggacugccaauccagagguggcuccacccacaaugggcugggcccucccacauuaaucgcuaauuaagaaaggaccacacaggcuugcuuacagcuccaucuuauugaggcauauuuucaacugagacucccuccucucugaauacccuagcuugggucaaguugacauaaaacuauccugggacaacuaagcauucaaauauaugggccuaugggaaccauucuuauucaaaccauaguuguuuuuuuucaaagcacuuaacggcccccuaacauuacuuguauuuuguguggccucugcuaguuguagaacaggggggggccuaguuguauuccccuggcauguaugaaacacucauuagguacaugugagugaauggcuagauggcguugaguccauguuaguuuauuuauucaucccaccuccugaacuugcuucuuguucauccuuccagucugcugcucaucucugaaaggccuucccuggccaccucaaguacacgcaucuccucauuugcuguccccauacugcauguuucguuuguaacacuuauuugucuuucgcuguuagaccauaaguuuugugagaacagaauucuugugaguuaaccagugaaccacaguuauguccggcccacuaguuggcacauacauuuagcugaguuacggugcuggaugagcuguggaaaaaaugagugguaggugagaggcaguucaugggguggagacuuugcacauggugucugaugcagcacacucggaagaguugaucuuauuucucuaggguuuguugaugucuucuaguguaauguuuuacguugcuuuuagaagauuuugucaauggauguugucuuguuuucuuaggaugugcauuccagguacaggacugaggcccaucaggacguggugggaagauuuaacgagagguaggucuacaggcugguuccugaaguugcagggaaucagaaagggaaaaauguuuuuaucuuggauccgacaaguuugcucuuguaucagaaggcuguaguucaggcuucuaaaaucuagcaaggcuugcuuuguuuugagacagauuuuuacuguguuguuccaacuagccucagacuuacaacuuacccgccucugcuucccgagugcuagaauagcaagacugcauccagauagcagugagauccugcuagcagugagauccugcuagcagcagccugugacaccaacuggaugaagagagagggcugcaggcagggaccggggaucuuguacuuaaccuugcugcuggcuugacuagcuuugguggcuucgcucuucucuuuggcucuuaguuuacucuucuguccaagggauguuuuaaccgucuuaagguugcaaccccuuaguauacaguuccucagguuguagagacccucuccccaucauaaaauuauuucauugcuccuuauaacaguaauuuugcuacuauuaugaauugugauguaaauaucugauaugccacucaguggggaucuugacccacggguugagaaccgcuguucuagcuguugcaaaacauuucagaggcuccaacaaaugugugugagccuucacuaaggaaaaauaaucaacauuuccuagacuuaccuggcuaaaagccuucuuaccauaugcugccucuuaaaagacgagugcucugugagagucuugcaggagagugauccagaucauugcuucucaaccuaugggucacagccccuuuggggguugacccuuucaagggauugccugugagcauuagggcuguugagaagcacugagcuagaucuguucaacugaguuuauuuuaccaugcaggcucauuuuuacaggcucuuaguagcuaguaaaacaauuuaagccuguggaccaugaccccuuggaggcuaaacgguccuuucacagggcuugcguaucagauaucuugcaugucagauauuuacauuaugauucacaacaguagcaaaauuacaguugugaaguagcaacagaauaauucugugguuguggguggccacagcaugaggaacugcauugaggacucucagcauuaggaagguugagaaccucucauugcuuuaagcuuuggaggugacuuugcccucuaggacguuuggcacuaucaggagacauuugaccaucaugacucgggauggugguguagagugccauuggcucuuaguauacaaaacccucaguggacaaaaaagucaucaugaaaaaggccuaucagcuccaagaugcaugcucuacugaggcuaagaaauccuccuggaagcgggguggugguggcucacgccuuuuaucccagcacuugggaggcagaggcaggcggauuucugaguuugaggccagucuggucuacagagugaguuccaggacagccagggcuacacagagaaacccugucucgaaaaaccaaaaaaggagaaaaaaaagaaaaagaaauccucuuggccuggaugagcucagggccuuucugauuucagucugugguccuuugaguguggugagggcaggaagagaacugugcuggugacuauaauagaagccucuuuucuuuaaugccuugggugaggggugggccaauugauccaggaacaguggcgcuugcucacgguagagcucccuuguaguggcgcuugcucacaguggagcuccuggcuugcuggggucuuggucuuccuguauaaauaugcuuagguaacuugcagagccagcugaaucaucucauugugcuccaccuggaaugugauauuccugaagaaaucuuuugaguucuugcuuagacagugccugccuucccugccaccucaccgcagcugccuugucccucagguuuauucucucucuggccucuuguaagaagugucuggucauugacgaucagcucgacauccugcccaucuccucccacguggccagcauugaagccuuaccuccucaggccccggugaggcugggugagaggaggaggggucuguugggcgugggcuccuggguugggugugggcuccugggcuggggcgaacugccuucucuucucugacaggaugagaaucucaguccugcugcucuggagcugcuggaguugaaagagagcuugcaggacacucagcccguggguguucugguggacugcugcaagacccuggaccagguauauguggguggguucaggccuacccuacccugaugcugguggcacaaggguaagauaguaagcagcacggaccauguuaggacguguuggcucugcaauaucagggcugugcuguguagaaccacaaagaaccagccagugagcugaggugaagagagggauuguaugcauauaggaugauagccuuguguccucuaauuucaguuguuuguauuguuuguuguuucucucucucucucucucucucucucucucucucucucucucucucucuuuuuccaagacaggguuucucuguguagcccuggcuguccuggaacucuauguagaccaggcuggccucgaacucagaaaucugccugccucugccucccaagugcugggauuaaaggugugugccacugccuguuguuuguuguuuucuuuucuuuuuuuuuuuuuuuuaaagauuuauuuauuauuguacauaaguacacuguugcugucugcagaugugccagaagagggcaucagaucuuauuaugggugguugcgagccaccaugugguuccugggauuugaacucagauccucuggaagagcagucagugcucuuacccaccaagccaucucgccagcccuguuuguuguuuucaagacagaguuuuucucuguaguccuggcuguccuggaacucgcacuguagaccauggugaccuugaacuccaauauucaucugccucugccuccugaguucugggauuaagggcgugugccuccaccauccgacugaggagaaagguuucugcuuauaacguauauagaagugcggggagcuugagguuuguuuuuacuaaagccccgucuagugugaggcugacuugugagaguacuaauagugugaguggaaacaccaacguguauuucugugcuggcuaauguggccagcugcugguuuauggagcuucugggccaugaugguuugcugauuagcaugccugaggccucuaagcugcuauacaugcagaguuccacccagccuuggucacaugaggagcacuggacucuucccuccugauaacaguuuuagugauaacuuccaccagucagaaugaagucccaauaggcugucuuaccuuuuaauucuggaagcacaauuaauuauaagcucuuugugcuggcuaguugcagccuccagguuguuuugaaccacuucuggucuagugaaagagagggagugucaggauuugagagaaacuguauuucuugaaucagcauuaucacaaaggaagcuuacucaggacaccgaagcaggaagguugccaguaguuuaggccaggcugggcuauauaguaaaaucauuucuccaaaacagggaaggaggcucaguuaguagagugcuugcauagugugcauaaaguccugggaucaauucccagcaaugcauaaacugggcaugguggugccugccugaaauccuucugcuccagagguggagacaggagguuuagaaguucaaggucaugcugggcuaucuuaaguugcaggcuaccuugggauacaugagacccugucuuuagggaaaggugaaggaagccaugcaaagcagccagcuagugcaggaugaaagcauacacaucagcagaacaggaagugcauccggguugauuccaacugucacugucucagucucccagagagagcuguggcuguuguauccaggagcugcuggaucagagcgugggcauuagaaagggugugccaccagcugcuagugcuccugacagugcaggaggaggucuccuuucuggguuucucuacaguuacauuugagucauuacuaaucagcauggggcagcugauuguuuuuaauuggcaucaucaugaaagaggcaggcaaaugauuauugauuauuccuguuuuguuuucccuuuugguuaugaggucugcucaugucuguauuacuugcauauuugucuuuuucauguuacccuuucacuuuagauaaauaauuuaggauauauuucagucuaguaauuuuuaauuagcauuuggaacuucucccuaaaauuuaaaaaguaaaauaucauucagcaaagaccgaugaguuaucacacuugaucccucggguguuucaucugaggagcuugguguccugaagugccuuccugacugcugggucuucaucuuagugcuucugcccugagacccagacuggcuccucaggacgacaggcacagcuuccuucacuccuuagaucucaucggggacccagguuuggccugauugcuaguguggcucccauguagaaguuguucccauuuggugccauguacuuggcugugugccaggcuuggcagugagcaagguucuugcuucagagcucauacuguauagcagugggucuuaaccugugggucucauacaugcagauauccugcauaucagauauuacauuacgauucauaacaguagcaaaauuacaguguuaugguuggaggucaccacaacacgagcaaguguauuacaagcucucagcauuagaaaggcugagagccccucugcuuuuuaggaugauucagauucuggguggaggaaauuaguuucuuccacuaaaucgguuuaguggaaagagcugugcagagcaaagaaaaaggaaaggaagucuagaggugugggcacaucagaaugaugcuuccagagacacggguaagggggugaaagauuguagagcaaagccuccaaggagcugugaaaugagucccugggcagaaugguuagcagcugcauaggcugaaggcaggaguguggguuggguuaggguuaggaaccagcaaggaggccaguagggcuagcagcaagaaggagguaggcgugggggauagacauuacuaaaugccacuaggagagcuggugacaguggaaagaaagcuuugugugcuuuuagcacacugugguagcaucccaagcuuauagaaggcucucuagcugccgagcucacugcaggcugugcugugauauggcuugaagcaggaagaguaacugaagcugcuugcuguuaugauggaguuagcuggaacaggagaauauggcugugagcagaauuagagggcugugaggaauggcuugacuguuuugaaggugucaccaaaaggagguacuagaaagucaggguugggugagaaaauggaggguauguuuaacccagaguuggacaguuaaacuccgguggggaggcuaguagguagaacuguuuuacaucagcuuaacgucugagaugucuguguguaaauggaucuuauaggaauccuaccuaaggguaugacaaguguguguguggggggguggucuacaguggagauagaaacuugagagcuuugaggguacuuugggucuugacaaagcugaggagccgaccaaggcaugagaaacauaggcaccaagcagggcuuucuggccuguaggaacuaauacccuuuuuguuauccucaacgucagccuaaccucuccacgacuggugauaagagccaaccccauagccuuucuggacauucgcauaauguuaucuuuguacaggccaaagcugucuugaaauucauugaggggaucucggagaagacucuaaggaguacuguagcccucaccgcugcccgaggaaggggcaagucugcggcccugggccuggcuaucgcuggagcaguggcauucggguaaggguuccacaugggagugugcaggauuugagucaggcaccugguggaguugucucugguuccucaucagggcuguccaccauguaacuucugucaggaucauggguauuugucuggaagcugcagcacugcuccccugggccacuaggaggcacuguaggcaguaccagagcucuuuuguuugcuucuuaaguugaacagacacaaaugcaaagaaaaccucucaucgugagagugucugacuagcuuuggugauugcacaaauacaggugaaauacauuaugaccuugguuggugaugggucuuauuuguuuucaguaagguauuauuuucuggccugugugugcuuugccaacucagaugauggaccuacaacuuuguccucccugugccgucuucccuggugaugcuuacagagucugugggcacuuuguauguggaugaaccaaggcccaggggauuacccaagauccuccugcagguugcugcuggcagagauuuggccuuggccccagcaccacauagcuccaugacuucauaauuuggaaaccucagccuagcuagugaugagugugaggcugcccuuccugucaggauacuggcuuggcagcuguguguggguucugcauguggacagcuauucuuguaguaugccuugacacugaugaaguagcccugggucagggcuugcuacuagcacaccgauaacccauuugucucaguuuugcagagguguguacucaggucuugguugcuuuucuccucucccaaaaaguguuccucccuuacccugcuguugucucugguuaucauuuguguugacagaagcagccaaaaaugauuccuuaauuuuauuugcuucuuuagaauguucuaagucucuuaauuucuaaaccaccucccccauuuuucuuuuguucugcagguauuccaauauuuuuguuaccuccccaagcccggauaaccuccacacgcuguuugaauuuguauuuaaaggauuugaugcucugcaguaucagguaagaaagucguguagacugugugcuuuagugcuagaguucugcccaguggucuguggaaugcuugcuuucucaguagugacucugaaacuugucauggguuugacucuuucuucaccaggagcaucuggauuaugagauuguacagucgcugaaccccgaguuuaauaaagcggugaucagggucaauguguuccgagagcacagacagacuauucaggugaggcucaucucagaccugcucugcaggccagccaggaucgcgcuguguggaccuagcugugugggguuugcccauuugugugauugguuugcccugcccagcaguggugugugagaauggugguguguugcagauuaucagcaccaagugaggauggcauucaggucaacugugggggaagugaugucacuggauugaaaaguuaaguuugucucugacugugaaaggagugggauugagagugugcccaagagugggaaagguggcucucaucaguugacguuugcugaguuacuguggguuuugagaccuacaucugcagcuggaacaaucacaucaccauuucaaaggaaaagagcuuugcagaaugugcuggggcucguuguguuuugcugauguccuauuucucuuuuaaacaacauuuccuggaaagcuccacagaucucuguaagcccaguuucugaaggccucaguguugcucagucucugugaggcucaugcgacaggauugcagaggcacaaggcucacuggcucuugcuggacagauucauugauugcuuuugacauuagauuggaaugggaagugagcgagccuaguaaacuuggcaguuuaugauccuugaaucuuaugccugcaguggcacuggguggcucugucacggcauacgaaggcagauggugacaccaccacuguuuaugccuuucgccuuuacccuggagucucuguuaguuuuauuagauacccucccccccccuuuaaaaauucuguguguggguauuugacugcaugugugucuuuguaccacauacaugucuguugcccuuuaagagcagaagaaggcacgggaucccuggaacuggaguuagaaauaguugugagccaccaguguggaugcucgaagugaaccugggucccauggaggaacagucagugcuccuuacugcugagccaucucugaagccccugggucuuuuucuagucuccuccuucugcccuuucagcucacugcugccugauucucucagcuggggacaggggggacugcagcuaguguggggugggucuuggggcuagggcaggguauuggcucugagaaaguguguccuucuagccuggaaauugagaagaguauugaguuaaagccagccugcuuccugguggcugcuuucuguaauuuuuugaaaugcuuauuuaguuaagaaucaaguuguggggucccaugaaagauuugugaccagaagcaaguaaggcagaucuccccccccucccccccgccccgucaccuccagaucagcccagucuugcuugcuuucuuacuaacgcuucagacccguagaaaagccccgagaccagacugugcguggccaguguucccgcuggaaccagcaguacugaggcugugcucuggcuguguuugugccuaugagcaggcaugccauacugcccuccagcugcccgccuuuccagucugcaucugcuugccacaucucuagacugaggcuugcaggucagguugauguacuuucaagugucaaaugaggugcuacaauuuguguuuguuuucuaggacaaguauagaauugcugagcuuuagaccuagcuguguagcugucuaguuuccugggauuuccccaaauucuccuuuacaaaauuugcuaccuucauaucacuuuuugguuuggguuuuuaagucucauucaugcuggguacagugcaguaaacuccugaguuuuaguuuugucuuccaguucacuguccuccugucucagcucccuaaguguacugauuacagguaugaaccaucacagcuguuuuuguugcugcuguuugguuugguuugagccagucucccugaguaacccagacuggccuuaguuuaauucacuguguagccccaggccaguguccgauccuccugcuucaaccccuacagcugcuguaagagcugugcaaccuuguccagccucucugggaauuuggcuuuugcaguuuacacacuuuugaaauuggauuaucuuaaauuauuuuaauugguuauuuauauugccuccguggccauuuuaaaacagcagaaaacucuaaagcaacugauggauuguuuguguauuuaaggaugagagaggugggggagaggagcggugggaagacaauggauuuaggagagaggagcugcaguccaggguuacuuuuggcuacauaggaagcgugaggcgagcucgggcuacauggcaacccccuugcuucccucaucagaaggaaaaagaguaguuggaaguugccuaccaucccagagguuggugaugucagggcagagaggacaaaucagagacccagugccacgugcaguaagaggugagccacuuaaucugaggcugaagaaaaacaggagauggaaaggagggaaaggaauacagccacugucagucaacuccguaagccaagcuguggacaauaugaccuuacccuuguuauucaccuuacuguuuacacaguaaucuugcuucuuccuuaagcagccauugagcagguuuuccuagugucuguguguguguguguguuguguuauguauauuuaugaauguguguguucagaugaguguguugaggagaccgaagaucugcauaggguguccuccuuguuugcucuccacuuaguuugugaaguaggaucucuuacucacugagcuugaguucccagguuuggcuagacagacuggccagcaagccccaggcagcucaccucugucuccugagcauggggguugcaggucugugugcugugcuuuuaugugaguguugggcaggaucugaacucauacccucauguucgugcagcaaaugcuuuauugacugagccaucuccuuacccucuucccuguuuuuguagcaaaaagaauaugaggcucugugagauggcgugaucuccuuccucauggucauguaaucagugauugaagugucugguuccagguguccaaccugaagcucauuucauucuugagcugccaaaaguagaaaguggggaguugugggaagagaggaaggggacagugcgguggacggauggggcuucuggaugagucauuggugcucacccggugcuguggauuuagauggcuacauuuacaaucuguaucuuuuccccacaguacauccacccugcagaugcugugaaacugggccaggcugagcugguugugauagaugaagcugccgcuauuccccucccccuggugaagagccugcuugggcccuaccugguuuucauggcaucuacuaucaauggguaaggugccugguggagcuguuugucacucuucucugugauccugcagauuaauaggaauguaaagaaugugaccuggccacgaaaaaugguucagcaucacuaagucuuugggaaacucuugcucuuucuaggguuucuucacugggaguuaccucauaaacucuuacuccucucugguuaaaugugucccaaaaaacugaaaaauuuugcuuaaaaagugccagcuauaagcaauguccuauaucuuagaauguacuuccuauaucuuaggauauagaaauguaauauuaaaauagauauaguuagcauuaaugcuuauacaugcuuauacuauucuucuuaaaacuuuaaaauagaguucaucuugguauggaaagaucacagaaaauaguaaacaaaagggaaagugucggugauagaaugcaggcuuagugucgccaagaccuuggccuagccccuagcaccuagaaaagaaguuucaaacaguaggugcuggggagaugacgcaguguguaagaguguuugcuuuguuagccccagcauccgcauaaggagcuggacaugcaguaaccccagcacuggggcaggugguugggcucgggggccagccagguggaucuggagagcucagugcucauccugacggggugguggggugggagcuucuaguuagugagaaccugucaagaugauaaacugagagaaggaaggaaaagaacucccaagaacugcucugguuuucacacguguacacaugaucucaugcacacguauacucugugugcaugcuucacaaacagaccacauaugagaaaucguauaaguguaacgucucacuuugcuuuugcuuuuucuuuuuuuuuuuuuaaaugacuacaauuuagauuuuauuuugcaaugagcgggaagcaaaccagagucuuuggcacuguggcgagcacgggaaguagagugcugugcaggacccaguagccuugcaaugggaugcuauuuagugggacagcacacagagagaguguguaguggucaguagaagacagccaaggcauugucacagacuugugaggguguugggagagagaagguaaacagaugcuaccuaggucaaggggugccugagggugccucacauggggugagacagagaacacuguaccccaguagcaugcuggucucguuggcuucuuuucauuuucuuucuuuauuuauuuuuuauuaaauuuuuuuuuccuuuaauauuuuuuauuagguauuuuucucauuuacauuuccaaugcuaucccaauagucccccauacccucccccccacuccccuacccacccacucccacuuuuuggcccuggcauuccccuguacuggggcauauaaaguuugcauguccaaugggccucucuuuccagugauggcugacuaggccaucuuuugauacauaugcagcuagagucaagagcuccgggguacugguuaguucauaauguuguuccaccuauaggguugcagaucccuuuagcuccuuggguacuuucucuagcuccuccauugggggcucugugauccauccaauagcugacugugagcauccacuuagguguuugcuaggcccuggccuagucucacaagagacagcuauaucaggguccuuucagcaaaaucuugcuaguguaugcaauggugucagcguuuggaggcugauuaugggauagauaccuggauauggcagucucuagagaugguccauccuuuugucucagcuccaaacuuugucucuguaacuccuuccauggguguuuuguucccaauucuaagaaggggcaaaguguccacacuuuggucuucguucuucuugaguuucauauguuucgcaaauuguaucuuuuaucuuggguauucuaaguuucugggcuaauauccacuuaucagugaguacauauugugugaauucuuuugugauuggguuaccucacucaggaugaugcccuccagguccaaccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuggaacaucuucuggguauaugcccaggagagguauugcuggguccucaggucuaauuuucugaggaaccgccagacugauuuccagagugguuguaccagcuugcagucccaccagcaauggaggagcccacuuugcuuuuucauuugcuuuccccugguaguucaugaugcugaagauuccuuucuuuucucuguccccuccuuccauuccuccccccuacccacuuugucacccucucuuccucccucccucccaaacuggggauugaacccaggcccuagcaugcuaggugagcgagcucuccaccaccaacuuaggcugcucugcuaauuuuccgauuggguuagucgucuuuauuauuuaugaggcacaagguuuauauucuaggcacaagacccuuauccaguacaauauuugcaagcauucuuuuucauuuuuuuguuuuuuugcucuggacaacaucucuucagacaugaaaguuuaaguguugcugcuuauauuuauucauguauuaaacuuuuuugcauuuauuuauuguguguguaugcuuauguguguuguaguauaugaguggaggucagaggacaacuugccaaagucaguucucuccuguauguuagcucuagggacuggcuucugguugucagguuuggcagugucauuaccuugcuggccugaauuaauuaauuaauuaauuuaauaaaaaggauuccuuuggaggaauauguccuguggggugauaaagaggaaugaaacacuucaaccuuguagcuuuuguucauuuuauauaaguagcaucugacuaaaugcuuagccauggaguauaguuagugagcacuaugaagugauguaguugaauccccagcagugugugcccugggaccauuugugccugugacuaccaacaaggaggagaugcucaaagauggaaagcuggcucagugagcagauuauaaugguuuaaguuuuuuuuuuuuccuuugagacaggguuucucuguguaaccuuggcuguccuggaacucacucuguagaccagauuggccuugaacucagaaauccaccugccucugccucccaagcgcugggauuaaaggcgugcgccaccacgcccgccaucuggcuuacguuuuaaaauucuauuuugugcaugcacgugcacaggugccuccuggugugcuuguucacuugaggguucugucuagaggucagaggucagccauucccaggguuuaauccuaggacacuaggcucgauagcaaguaauuuccucaaugagccauuucacuggccccggaucagaggcucaggucuuugcugucacucuugccuuacaucaaucaccuuuucauuuaauuaauuaauaaauuaauuaauuugaauuuuuuagauuuuuuuuuuaucuuacauguauuaguauuuugccugcauauaugucugugcaucaugcacaugccuagugccuucagaggucagaagguggugucagacacccuggaauuggaguuauagaugguugugagcuacacguggguacugagaacugaacccagacccucugcaagacgaacaaguguucuuaauuuccgagcugacucuacagcccuauuuuugauuuguuuuuuaucugugggugugugugugugugugcaagcaugagcagcuguggauuaggucggaguaccuccucagguauuagucuagccuucugcuuuguuugagaucgucucuuguuugcuguacaccaggcuagcugacccuuaaacuuccaaggaaucuccugccuuugccuccuaucuuguaggaacaugggauucuggacauauacuaccaagccugccuucaugugaacucuggacuuccaaacucaauccuuauguuuucguggcaagcacuuuacucauugaaucaucugccuaucccuaucucaccucuuaggugaaaauaauaaaaagaaucacuugggacauuggagaguacacuggccucuuuuacagaggacucauuuccaacauccacaugguugcucaaaacuauuuguaauuccauuuucagaggaucuaugcccuuuucuagcuucaguuggcaccaaguaugcagugguacacauguguuuacauguaagcaaaauacuuauauacauaaaauaaaagcagauaaaccugacaaaagaaucacuugagugguagauuuguuugauuuugauuucccacuugggaaaaagucucuguccaugucuucauauaacuucuguuagcaccgaccauuagacuguguagcauugcuccagccucacuggcuaaaugccuuguugacaucaucuuucaggccuuauuuucagaucacaguucucugaaguguguaggacaauccuuuggggaugagguuuaaagagaucaaguuuucuacccaaagcuacuaaauucacaccagugcuugaaucugagccuguaugcuuccuagccaaguugcaucuugguucaucuccuagggcucuuccuugggacauuuguaugcuaugcuugcuggaaguucagauuagagaggccgucuugguuucaucugccuuugucuuucuccuagcuacgagggcacuggccggucacugucccucaagcucauucaacaacuccgucagcagagugcccagagccaggucagcaccacugcugagaacaagaccacaacgacagccagacuggccucagguaccgagcaggccucugaccguccugcccaggaccucaugcaguacugaagcuugaugcugucugagaguccuaggaggugacaacaauccugagaggccaguggaaacauggcuugggucuuuggaucccuggagccuuuuugguccuuacucuaaaacauggguaggguauguugacuugguaaauauucaacccaaaacacguuaaaucacccccuugacauucuugagccacagauauuuggacaucaugucacagauaaagugcaggauuucuauuguuguuagaugcugaguguugaggaauuguuucuaaucguguguguuguggcugacagcucgaaccuugcaugagguuucccuccaagagucaauccgauacgccccuggggaugcaguggagaaguggcuuaaugaccugcugugccuggauugccucaacaucacccgcaucguuuccggcugccccuugccugaggccugugagcuguauccuccaucucaccagcccugcggggcugaagcaguuagagaaaggguuugggcuggauacaguggcauauaccuguaguccucgcccggauuugggaagcugaggcaggaggacacuguggacccaccauuuagguccagcucaaguaaaacagucagcaaugaaauccccgccuuuuuaauuugagacaggguuucucuauguagcccuggcaguccuggaacucacucuguagaccaggcuggccucgaacucacagagaucugauugguucugccuccaaguguugggauaaaaggcauucaccaccacuaccuggcaagaucuugccuuuaaaaaagguucuuuuguuguugguuuguuuguuuguuugaggaacauuuucaguuuuguuucucagguuucuccacuguaguuucugcuaagaacacuggaauucuauucccaaacuggggaaaaucuguauuuuuucugguguaucuucuuuugaguucccuguggucuauuuucguggcuuaacuccaggccagcuacuauguuaacagagauacccucuuuugcuaccacaaggccucugaaguuuuccuccagcggcucauggcucucuauguggcuucucauuacaagguaaguaaccugcucugaccugcccuuccgcagggagcaguccccagggcuucccacccucuugcuacucagggauccagguggccauuccacugggacuugaauguugaagcuggcagguccagugaccuuacuggagagguucccugucagcuugugugcuuuggacugugugggagcucaggggugagagcuggagggguggggcaguguugcucgucucuaagggcagcuuguccugcugaacuaaggagcagggaaccugagccuagaguacugaaaccugagaauccggcaggcugcuuccugggggucuagguaugguagcauguucgugaacacccuugaugggaggcugaagaguggguguuaauacgguggcaugcuuuccugaaauagcagucagcccuuucucuggagcaagcucacuucucaggugggaagucaguauugucaaguaacuacggcuccauguaacucagccagcguugagccugagaagacaaggcaguagguguuggaggcacagucucucugcagccguugugaagagucaccuugucacagggacaauaagcacuuugcuagguguccaagucgcacuuggcuuugagaaaggcagaacugcagucaccaucaauucccagucaggccugugagugaaggacuguaggcgagcaucccgcugaccaugugugugccccacagaacucucccaacgaccugcagaugcucucagacgcuccugcucaccaccucuucugccuccugccaccugugccccccacccagaaugcccugccugaagugcuugcaguuguccagguacagagcagagagaaacaugguguggcacugguuuggggaacuauugggcaucaguguggccagggaagcuguuggguccugacauggaucuagguggguaggucuguugaggcaggugaugugugcacuggagagaaagcuggauacaggcagcgcuggcuuauuucucuuucuugcacacaugaguaguguaaacuuaaaggcuacauggagaaagauguuuaccaccuggggggugugugucugugucauuuucccuucccuaaacuuggaguuauagaugucacacuugcagugugucaguguccacagugcacugcacugugcucuauuucauguuuauacagugucugucucgccacgucucugucuugggauuuguucugcuccauacagagcuguguguauccugugucuuaacugaugugcguuuaagugauacauuccacuugaccucuuguccucggucuuuuggucuuggggcuggaggaugucaguaaguucauaguaaccugccacauccuaaugaggucguguggucaguguggagccggaacccaggauaagaaacagugccuagaaaacuuaguuuggggucugucucagaugaugcuugggaucuggagcuagagcaugccuucccugccuugguuucccuaggugugccuugagggagagauuucucgucaguccauuuugaauagccucucucgaggcaagaaggcuucuggggaccugauuccauggacagugucggaacaggugagggagcggcugccccugcaugucugaggugagggagcggcugccccagcaugucugaugucagguugucuguguugcuaagucacugguuugugucucacaguuucaagauccagacuuuggaggccuuucugguggacggguuguucgaauugcuguucacccagauuaucaagggguaacauguccucucuucuuuuaaaccuugugugcugcucucuagugggcuccuggcagcccuuugggcagugugccuagcuguuggaauaaaaauauggauacaccagugacauuuuagguguacucugcucaggagaauauagcaagaacuugugggugggccagggacaagguuguugguguagacuccuuccuuucccuaccuguguuagaacguaggacuuguugaaccagguuguuuuucuauaacuuccuucugucgcuuugaaagccacacugaggagucagcugucgagcaucccuuucuggcaguggcacagccagcuaccguuagguccagguugcaaguggguugugguuggaggguuagacuaaccuaagaaccccacuguguuuggccccagagccagcuuugacuacaguggguuuuauugguagcuuuuuuccaaaugcaguuugaccaggaauaaaugcuuuagaagcaaggcacaaguagcuuaaacagacggagcgucuucccucugcuguaucuugugugugcucauagaugggauauggcagccgagcgcugcagcugcugcagauguauuaugaaggcaaguucccuugucuggaggaaaaagucuuggagacaccacaagaaauccgcaccgugagcagugagguaacaauguucuggcaaagccagaguccuaagucugagaggaugguucucuggggucuucugcguuugggcagccagccacuuucuucagcuuaacacuguagagucucagccuacucaccagugccaucugcugcugcagcagacacuccgggaguaaacgugcuuacuagucugcaagugugcugcauugcaagcuggagggcuccccaccagccucugucagcaucagcccacaucgcagaguuccgcuuugccuugcuugaggcugccugcacacacacgugcuuggugguuuguguaaugugcccgugcuugugggccuugacuuaccucagacucaggaggguuacucuccaaggucacaggggugucaggugacagaaccacaacuucacgcugcauuuucagaacccugccccugucccuucuaaaguguauuaggcauugcugaaccguggccuuucccugcuuuuggucuugggaacucggugauugcacauaugcuuuggcuuaucccuguggugaucucgggacucuugaguccuauuuggacaccauagggacacagaagacucuugccuguuguuguguaguguacuggauggcuugagaacaccacgagccucuugcuuugcuaagggaguaauggcuucuucuuaggcugucagcuuguuggaagaaguuauuacuccccggaaggaucugccccccuugcuccucaaguugaaugagaggccugcagagcgccuggauuaccuggggguuuccuaugggcugacccccaggcuucucaaguaagugccugccuguccucuggagccagcccacuucaguggaagacgacaguucuguggguggugucuuccuuugcagcuggggucucugucauugucugcugccuccuccaucugucccuccuccugucccuccuccugucccuucugccuuuauuucucaacuuccaggagucauaaauggugaccacccccucuaccccccuuuuguagguucuggaaacgagcuggauuuguuccugucuauuugagacagaccccaguaagugaggcuugggguagaggagggguuggguuuguguuugcaguuggcaccuccuccucuaguugucuuggcuccuccucgcugugcccugggcaggugcuucuguauuuguuaagguguugcuuguucagaggcggguugguacagagugauuccuuccugaccuuggcaggucuggugcaucuguggcuuugugcuccauuuucacguggcagggguacacacacggacugauuugucagauuguagauucaguccugcaggcuggaguucccuaaguguguauaacagaacugaguguuaaugguuucugaaggagagaggugggcagcagaugauugggagggugagaaacagcggugaguuccuggaaugcaguuagugucugugggaaacagccagugcauggggaagccugaagcuuguuuucuaacagguaaaagcagcaagcagugaggaacacugcuccucaugguggcaaaugcugguuguagcauaguggccuauccugcagcuuaaaccuaaaccagaugacuggaaggggccagaacugaagaaaguggucagggauagagacagauggagcuuggagagaaugccacagcauucucacuuuuuaaaaauauuuuuaaagauauauuuacuuauuuauuauguauacaguguucugucugcauuuaugucugcacaccagaagagggcaucagcuccuguuacagauagccaccaugugauugcugggauuugaacucaggaccucuggaagagcaaacagugcucuuaaccucugagccaccucuccagcccagcauucucauucuuaaauggaacuuucaagcugucuaguucaccacauaacaaaacauaggagagguuucuugguggguuucaaacaggacccuaauaguccagugaugaucacccuggguacucagcauaacuacuacugacguucacuccugcucugcggcacuuggcaucuccagguuguauguacuuggugaauagaugcauacuuagaugcugcugacaucacauagagcaggaggacagguggcuacuggauuugccaggacuggugcucagaauggaguagggcuuguuacaguuggugauaaugggagguggggauauaggcaugaguagacauuguuucccagaggggaagcgagcagagagcaggguagcuguggcgugugcauggggaggacauguuggguagaagagucuuggccuuuguucacuguagagacagggaaugcaggaagagagggcugacugcgagggcaggccuuguggggucaggacacugaaacccaggauuucgagguuugcuagcaacucaucccucacuccaggagggucauggggagugugagugcagcaguaagagagugaagauguccagucacuucuguuuucaaggcccacagugcugaagcgggcaagcacaugugucuuuuggagaaugcaaaucugguauucaaguuugguggugaauguccauuugaagucuggcaugugacauggagacucccgugcgggcuggcagggaguggagaugggcucgugccugucggcauacuuaucuagauagacagaugcgcucagcaguugcuugcagggaggacguaaaucugugagccacaaacaggccauaggcauccuuugaccuugucccuuugaccuuuguccuugucccuugaccugcuugcucugaccugucguugccguuagaugcugccaugcaguucugagaacuuauguaguaaaagguccaaaacucuguaaucuugcaccaugucagccccuagugaagcuugaagcauccagagucugagcaagacugucucuuacacaaagcauguauaaacauaccggcugccagcugggcgucugaguuugcugggaaguuucugcuuuauaaggaacaaaguucacugacagggugagggauugaagccugccuucauggccuugacuucagugaaaggagugggugcggagcagaaaucaggccuuaccuaaacuccugcugggccugcuccaaucccguggccucuuaggcggcugccuaccaugcgagcccaugggggcagggugggagcaccaugacauugguuccaagcaauaauguguguccccuagaacgaccugacuggggaacacucgugcauuaugcugaagacgcuggccgaugaggaugaggcugagcagggagcuuggcuggcagcauuuuggaaagguaaacgccagacgaguggagaggggacagugaggugacaggccagggcaccugcagauugcuaacugccuuucugugcccugcagauuuccgaagacgguuccuggccuugcugucauaccaguucagcaccuucucuccugcccugucucugaacaucauucagaacaggaacguagccaagucagcccugccaggugagcugucacccaggagcugagggcugcucuaguccacagucuccaugcugccugcuguuccccaagccucucuccugcccaggcugugccuggauuucagguguaagacagguucacacagugguuagcuauggaaccugggcucugaggggaacuagcucagucucggggcucuguguucgaguauuuaugaaauagcaccaagaauaugucucagccuucugacugguauauagaagaacuauauaacuauaaagcuauauagcuuuauaaaucuagaaagcauagaaucauuguuuaguuggaugaaaauuuuaaaaauugcauaggaggucaugagcagucauuuuguucuauuaacaguuacauuuauauauauuuuuauguguauaucuguggcuaugcacacguucuuauguguauauuaugucuuguggguuguauuuugaugggaaaaucuggguucuuugaccugggcagagcauguaaggugacccuggagaaagagugacaaauggggagaguggagguguguccuuagaacguuagggcacgaggaucuuucuuggacccagcauauuggugguugucugaacuaccagccugggauuauguuauugguagcaaggcaucuuaccacauuuacuuagagacuuaugugugccuuauuuugucugcaugugugcauuuguaccuggugccuguggcggucagagggcgucagagucucuggaaguugaguuauuguugguugugaauuaucacauguggguucuggguuuucugcaagagcagcgagugcacuuaacugcugagccguccagccccuuccugguuggccuugugugcugcguccuauccugugagggcugcagacugcccugacuggugggcucuuguugcaugcacagcccuaggccgggagcaucuggaggcacuuuuccuucccuaugaccugaagcgucuagagauguacucucggaacauggucgauuaccaccucaucauggaucuuaucccagccauuucccgcuuguacuuccugaaccagcuaggagaccugucccugucggcugcccagucgguaggucaccugggacuccaugggggacaagggaggacaguggagcuguuggugcugggcccuuagaugaguccuuggaaguagcuuugugccuuuagcccuggcagagcuaaugguggcccauccucacucugcaggccgaggcgagcaauguggcuguauuguuagcaagcagacugcuacacuuugaacccacacucucccugccaccuugucacccuaccagaaggccaggcuauccugcacuccggauauaugugguuuuuuugugaaguugauguuuuuugggacaaugugaacuaaagugcauuuuaggaaggaaggaguguuccugccuuaguugcaggauggaagaugccaaacccccacugcugcucucugguuucugcuucaucaaaugaggcagcuccauucuaggcuauuguaaugcgcaaggcuaucuuggaagccaguccagcugauucuccuuccuucaggcucuucucuugggaauuggccuacagcacaagucuguggaucagcuggaaaaggagauugagcugcccucaggccaguugauggggcuuuucaaccggaucauccgcaaaguugugaaggugaccuugguccaugggcaggauuuuggucuuuucaguaacauaacacauccacucuuuguuuauaauaaguacuaaaacuuagauguauuugcgcagaucuacacacacacacacacacaguggaaguagguggguggcgugucagccagugucugugaacuggauuucuucucagagaccccacugcugggauuuguauauacucugccugugucuaugcuugugcugugaucagcuauguuccuaaugucugaagcauugcuuugaguacuuuucuuugagacacugaagagugagugacagacccugcugcuccugcaucuuuucuuuccuccuguuguguuguccuuguagcuguucaaugaugugcaggaaaaggcuauugaggagcagaugguggcagugaaggauguggucauggagcccacuaugaagacccugagugaugaccugguauguccccgcuguagaggucccaguguuccccuuggccacuguuagccugucgauguagaccacccuccuccucugcuucggagcuguccugcaggcuggaggugcugguacacggcuugcauuucuguauccucaggcugagagguaggggaguuguucaccagcuugagcugcuguuuagagaauugcaggucagccugggauacagaacaacugaaggauuggguccugugcacugacuuaacuaaguggcacucuguagguccaaagccagugugguucucacugagugcgugagugugggaaccucgaggcuguugcugcaaauguugguuacccuuuugaugcuuuuccaaauguguauuuuauaggugggcacacuguaaaacuguaguagcugcucuuaguguugggaguguaccucaggaggaaguguuuccucccuguccccgcuucuccuucucucugaccgcugcucucucuggcuguggacuacaggaugaagcagcaaaggaauuccaggagaaacacaagaaggaagucgggaagcugaaggacauggaccucucucaguaagccccucccaucucagggaaucaguucuucccagucuccauggccuguagacuuugcuaaagguguccuaccacacaccccacaggcucauaacuguuucagaaguaccacagcugagaucugcaaucugucucauucccaggaucccagaguucuugucacuuuggguuuguguuacugccaggcccuuccaggaagggggugcugagcaggacaccucccaccuggaguagucccuuccucauguuugucguuuuccuucuguuccuguugaguguuacuugugauguuuccuuucuagccaccccagggugacagaucugacaguccugcugcuucaggccuuucccuguaacuaacucuaggcuuggagccacagaacuuguccgcagccaggucauugguugaucagauugagcaauaccauaaggccauuucagggucucaagcugguuucucuuugaugugccaagacugcuuuaucugaaagaagugagaggauucagaguagguuguuggaggcugguaggacaggggcugucccagugaggacagugauggcaggugguggcaaagguagcuguggcacacugccuugcccucuggucccuggugaccccuuuuccuucacucuuggugugacucuucuguccagugggacuacaccuggcuguaugcccgucaccccuucugcagcuuacaugcuagugcagcucuggugucuccuggggugggcaucuuaucaccuucuuauuuucuuuugagcagucucucuucuaacaggcuuugacauuccccucuucuuacagauauguaauucguggggacgaugaagaguggaaugaaguuuugagcaaagcagggcagaaugccuccauuguuaguuugaaaagguaaggagggccuggugucccacacaacugggcuguguagcuguuccugggaagcaggaggcaggagcaaaugcugauggaggggucaugguucucucuugaguucucuggggccaccuugguagcacgccuaaagcagacagugaccuaggcauggaucucuuccuuccuguacucagcgccagggacgacagggccagaguugggccagguguguccacugcagagucugucaugugagucaccuuguccuuccuucaggccagcaguucucaaaauccuuggucuuagggcucuuuuaugccuuaaaagauggaaccuuucuuuaugcagguccuuuuuguagcuaccucgcauagaaacugaaaacuauuuguuugaaauaaauaauaguauggguuugcauuuaaguuuuugguuguggguuugguguuuuuguuuuuguuuuuuccuuuuuucuuuucuuuuuucuuuucuccuugauggcgaucaagcacagggcuuuauauaugcuaggcaagucuuucaccauccagcuaagucuugagaaagacccaguuuuacuuuggccagucccauucaucucuggcaugcugggccccagccggcuuccggcgucugccucuagucuugugguacccgccuaccuugugcccucagagacaauggaaguaagagacagagaauggaacaggcaaggaaaggaucaguaugaaaaucguuuucacuuccucggccaccucggcauccugaggucacugaacaccguuucuccagugucucaucugcaaaguggugccuuuucauauagcaaauguuagcgcuccuuuaggacuagcaggagacacccugugcccagagccuguacacaaaaggcuagcauagccgcuucgggcuugugggaaggcugauuuguuggcaccgucauaauuaccaauuauuacucuccuaaagaguuuauaacguggaaauugucugugaugaaucucaaagucagguauugccccuccaucuccuuacaucacuccaggacuuagaggguucuagugcugauggcagccacaccuuccaggggccuucuggccugcugucaguguguccucugguuugaacagugugacaaaugcauuaggcucccccgggcucuagcuaugccagggguuuugacuaucacaaggcccgaggauaagccuacugugagaacacuggcucugagcucugcagagcgagccugagcucagcucccacugcgacugcugcugggagccucgugagucaucccaggggcucagaugaagugaagugcgcgcgguaagccugcccuuuccugaggcuugccuuugguuuuguuuuguuuuaagauuuuuuauauuaugaguguuuugccugcauguauguauguaugugugcaccauguguauaccugguaucugaggaggccagaagagggcauuggguccauggaguagcaucuguaguccugacacacagaaggcagagacaggcaggucucugaguuugaggccaccugugagcucuaggucagugagagcuacguaggaagaccccgaagacccuggcucggggaggaaagagagcggcauuuccucccucagucgcugagccgucugucuagccccugcccgucugucucagugguuccuccaugagguacuugauguaaugauguuaguggucuccuagggggucuguuuccagggaaaaggccguuaagagacucuuaucuccaaggguuucuaacaggcagguugccugaucaguccccaugcugcccuggcaugaggcuugccagggacucccgagucauggcuacugggaguuuggccacuguuuuaggaaaauucaguucauagcagugaauuaggaagaacucuggcuuuccuugaagaucccauguuugugcuaaaaagugccucuggggucaacugccucuggggugauaucuaggggcuccaugcagugggcaugaucucugucuggcacugagguagcugcuugagguauugggacaggagaccauucaguauucugaagagagccugggcuacuccacagauggucagggugggccugugugauguggucccgggccugcaugaagcugucucuaaagggccgcagagaacaugucugggugucugucaggugagggugguucuucaaauagcagcuugcaguguuucaggccuaugauguuuaaugcuuucuguuucuauccuugguauauuuuuuuugccuccagugacaagaaaaggaaacuggaaacaaaacaagaacccaaacagagcaagaaguugaagaagagagauaacaacagaaaggauaugaaacugaagcgaaagaaguagugaggugaggagaugccagacuucugagcugugcucugcugggccaggccaggcagcaguguggacagugacagugacagugacaagggccuucagcaaaggcaggcaccaucguuccaucuguaugcccgccgugacugaagacaaagucacucuugaacaggcugcuuagaacuuggugugggcaaagcucuggcauugucaggggcugucguuccacccaggucagucucacuuuggcuugcucccacuguggcugcugugcuggcuccuggccucccugugcuccagcacacggcuuucuggaggcacacgcugccucacugcagaccugucccgacacugaggcugggucagcaggaccucuccugcuccucccuucuaugucugccugcggcaggucugcuguccucagcgucccaggaaaggcuuagguaggcugcaacaucugagccccagaugccuuuugguugccucuucauuugggagagacuaucgagaaagacucuuacuacaaaaaugaggggagagagaauauuuuuaauaaaugaugucuuggaaggacca

SEQ ID NO: 949 - RNA, 1059 nt, Mus musculus
guguaauccuggcuucccuggagcucacucuguagacccggcuggccuugaacucagagauccaccugccucugccugaaugcugggguuaagccuagcaaauuuuuuaauuuucuauguuggaguaagaauauuacaaggaagccauugccuaaaacuaaaaguauugacaaauccugcuuacacuaccagaauuguucuacuugucugcccaccugaaaaauauucaaguuuaaaaaaauaaaaaaaaaaguuaaguuuuccuuucauggauuaauccauuaaggauuguugguggugcuacaaauauuucuagguaauguuuuaggcagaguaugaaauauuccucguuagggaagaacagcaagcagaaugguuuacuagugagccuuaccuccaaugauaaucaccaacuuuaaaaaacccuuaaggugaagaaccuacagcagaguauauaaaggucccaagacugcagacaaguaacaaaccuaaauaaagcaggcuccuuuagcagaccgaucagaucaaauagcacgccuuacccuuuccuuagagaguauaaauuuuaaauguuuuauuuuuauuuuguauucauugguuuuuuuaccuguaaaugucuguaugagguuaucagagucccuggaacuagaguuacaaacaguugugagcuaccauguggguacugggaauugagccuggguccucuggaagaacagcuagugcucuuaaccacuacucuaauucuccagcacaaggaaguaugaauuuaauuacacacaggaaagucuuucucucccauguuuuucuacacauccucaguaagagcccuccaauagcuggugggaaauuuggggcucaacuuugcuucugcuacuccuccucacuccuuuacugcacacccacuguguauggguaagggugggggcagugguggaggugggggcagaccaacauuacaaagacaccaggagccuagccucuaagaauguagucuguuacucaaauauuccugguuuacaacauuucaagauugagacuggcaaauauauauaugugcca

SEQ ID NO: 950 - RNA, 1059 nt, Mus musculus
uggcacauauauauauuugccagucucaaucuugaaauguuguaaaccaggaauauuugaguaacagacuacauucuuagaggcuaggcuccuggugucuuuguaauguuggucugcccccaccuccaccacugcccccacccuuacccauacacagugggugugcaguaaaggagugaggaggaguagcagaagcaaaguugagccccaaauuucccaccagcuauuggagggcucuuacugaggauguguagaaaaacaugggagagaaagacuuuccuguguguaauuaaauucauacuuccuugugcuggagaauuagaguagugguuaagagcacuagcuguucuuccagaggacccaggcucaauucccaguacccacaugguagcucacaacuguuuguaacucuaguuccagggacucugauaaccucauacagacauuuacagguaaaaaaaccaaugaauacaaaauaaaaauaaaacauuuaaaauuuauacucucuaaggaaaggguaaggcgugcuauuugaucugaucggucugcuaaaggagccugcuuuauuuagguuuguuacuugucugcagucuugggaccuuuauauacucugcuguagguucuucaccuuaaggguuuuuuaaaguuggugauuaucauuggagguaaggcucacuaguaaaccauucugcuugcuguucuucccuaacgaggaauauuucauacucugccuaaaacauuaccuagaaauauuuguagcaccaccaacaauccuuaauggauuaauccaugaaaggaaaacuuaacuuuuuuuuuuauuuuuuuaaacuugaauauuuuucaggugggcagacaaguagaacaauucugguaguguaagcaggauuugucaauacuuuuaguuuuaggcaauggcuuccuuguaauauucuuacuccaacauagaaaauuaaaaaauuugcuaggcuuaaccccagcauucaggcagaggcagguggaucucugaguucaaggccagccgggucuacagagugagcuccagggaagccaggauuacac

SEQ ID NO: 951 - RNA, 1000 nt, Mus musculus
auauguuuuuucuuguuuuuagacaguaaugcauguauuuauauauacacaauguauaaaugaaauccuuacauaagcauaugaauucucucgacagaaauaaauuauaagcaauacaauaaaaauuaagcuuaauuuaacauagugguuugcuuuuuuaaauaacuaaaacagauuuauaguucaacaaauuuuggucauuugaacacaaacuauucugauuggugcauuuuuuuaauacagcaauucaacacacccugaguuucacuuccuaguugaugguuaaaugcuaaucaccuauggaaauaaagauguuuaaaaugaagagccuugcaucuuggugucuaguucucugaaaucacugaauaggucagucaguuucugucacggucaaaggaccugugucuacuuugauuuggucuaugugacucuggugagauaacaauuugcuccaacgcagauaaccaacgaugaggugaaaucaggaugugcaaugcucugcccaggagucgacagcucgcucuauagcuucuguaucaucaccugaaauuugcaggcaggcauugaagagacuucagcuguuacaauacuuuuuauucccaaguuugacaagcgcccucugauuaagccacauguaagugcuagauacuuggacgcauguucuaaauacuguuuuccugcagacagcugaaugaguagucgaaauuuguuguccugaaguacauauaugcccugaugauuuguccuuagauugucgaucuguuucuugaauacuguaguccaaaaaucuuuacagaugaacuucaugaugucuaauucaaccuugaaccuuucagugucuuucguaaaccuuucuaucaauccuugucccacucggaaccccguguucuccagcuuaguaauacaccuuccauuuuccacuucccccuguucagcggacuuguaaacuccggacaccaucucguuauggagaagcaaaaacaacgccucguccgccauu

SEQ ID NO: 952 - RNA, 1000 nt, Mus musculus
aauggcggacgaggcguuguuuuugcuucuccauaacgagaugguguccggaguuuacaaguccgcugaacagggggaaguggaaaauggaagguguauuacuaagcuggagaacacgggguuccgagugggacaaggauugauagaaagguuuacgaaagacacugaaagguucaagguugaauuagacaucaugaaguucaucuguaaagauuuuuggacuacaguauucaagaaacagaucgacaaucuaaggacaaaucaucagggcauauauguacuucaggacaacaaauuucgacuacucauucagcugucugcaggaaaacaguauuuagaacaugcguccaaguaucuagcacuuacauguggcuuaaucagagggcgcuugucaaacuugggaauaaaaaguauuguaacagcugaagucucuucaaugccugccugcaaauuucaggugaugauacagaagcuauagagcgagcugucgacuccugggcagagcauugcacauccugauuucaccucaucguugguuaucugcguuggagcaaauuguuaucucaccagagucacauagaccaaaucaaaguagacacagguccuuugaccgugacagaaacugacugaccuauucagugauuucagagaacuagacaccaagaugcaaggcucuucauuuuaaacaucuuuauuuccauaggugauuagcauuuaaccaucaacuaggaagugaaacucaggguguguugaauugcuguauuaaaaaaaugcaccaaucagaauaguuuguguucaaaugaccaaaauuuguugaacuauaaaucuguuuuaguuauuuaaaaaagcaaaccacuauguuaaauuaagcuuaauuuuuauuguauugcuuauaauuuauuucugucgagagaauucauaugcuuauguaaggauuucauuuauacauuguguauauauaaauacaugcauuacugucuaaaaacaagaaaaaacauau

SEQ ID NO: 953 - RNA, 35522 nt, Mus musculus
gggugggcggggcaucccgggggcggggcuggggccgggugacaguuacauaacuaaccugugcuagcggccgccgagcgguucgggcggcgggggcgggggcggggccgggguggugccaaggcugcagcgggccgggcaagauggcugccguagaggccgagacggggcugcugacccuggagucgcugcccaccgacccucugcugcucaucuuauccuucguggacuacagggaccuaaucaaguaauggggcggugcucucggcaggggugggaacguggaaggaggcagggaaggaggcccggggucgcuggcuggacgugggcucccuccgcagcagggugacugcaaggcggccguuaucccgcauagcgccccggggggcugaaggagacucgggggagcggucugggcauccaggucuuaccccugcccaggccuagguccccgggaacuuagcgcccucucccucaagccucggcuaggccggguugcggaagagagagguggcucccugguccugcaccccgcggacccucgcuggcccuuuggggccuggucuagcgcuguggaaaggccacugucucggcccacgcgcaucccugucgcgccuggggucccugaugaccagagcccucgugggcagguagaacgcgcgcgagaaggccugcgaccuucugacucugaugccaucgugaucgcgggcagcauacacuuugucuugugucggcgacuuuuuuggcugucaguuucccuuuuuauggugggugguuggauuuuggguuuugucaccgacuuccggugaggccuuacaggugacugcaguuaccuuaggguuucccagaugaccagcauuuacuccaaaaauaaacaccgggcaugcgagaauucuuucagaaaccaggacuguuuuagcguggagggacaaaugguccugccgugugccccuuucuugucacccucacccccugugucaggauuguuuacauucuugaccgcauagccuggguuucuugugcuuccguauauauuuguggaggcugcaaaauggcccucucacauggggaagacacacuuuugguuuuugcuucauuacuggaaucugggcaucuauguccucuguuuuuaggggccuuuaagagguacagauuucuuggaguuacagguagcuaagugguggcagagauauuuccuggguuuucuguuauggccuccacucguaccugcuaagacauuugucuuuccaaaaaacacacuucccccuacucagccuguacuaacacacagaaaguuuuucuguaggaaagguuggccagcucaaauguauuucaucugaaauaguuuauugcuauaacuucuuauuuagauagccuucuuucuuugcuugcuugcugccagaguuaccuucuaaagaccaaucuggcugucauuuuucuuaaaagcccaugacaucccuguuuacaacacuggacccugaacuucugcaguauuuaaggcccuuacccaauagcuuauuaucuaaggccuuucaggccucuccuccacuaucauauuuucucagcccaucagauggcacaacacucgcacaugguuguguaugcucaguucccuguccggaauacuucacucuccucaguuuagcaaccuuacucucccacuaucuucuccaacuagaguuuguaguaauaaagugugcauugcuagaguguaaagauauuuauuuuuguauucaucugcucagguuuguuuguuuuguuuuguugaaugucugccaugugccaguuaaauguaggauuacaguagugaguuagagagauauggucuuuuuuuuguagcuugacuacuauagacaagauggaaagucaaacaaguauguaauuacaaaaggggccaaguauugggaaggaauauguauauugcauuggaaaggaauguggaagacaggcugaccaacucacaguggaagacaugaaguguggcacagugcacuucuguccuggugaagggaacaguauugagaggcugaugggucucuuaacaauaguguguccuguuuaacuagaaaaacaagaaagcagguuuugcugaagguagaaaugacuaacaggcagguugcaugaaguguggcugaugagauuguguagccucuuguaagaagagacuuuuaguucagagcuucugguaggaaucagaauuuaaagcugaagugauaugaccccucuguaaacauuuguggaagcgagcggagcugaauccuauuucgacuacagacucaccuggcauacugcaguuucuuucuugcccauuacagucaguccaacuuugccuagcauacaaccuguugccaagcucuaacaguuugggugcauauuugcuuaacuguguucgguugagcuguaucaaucuauugggagucuaauuugacucugagauaguauguugcuuucuccuuauuacucccaggguaauuauacuaacuuacacauuagguagacuuuaaacacuacugcauugcagcuuuguggguaguaaguagaaauaagaauuaacaauuacuguuuuaaucuuugauuuuuaucccccccccccuuuuauacuaacugaaucugguuacugccaguuguugcuauguuagucgaagacuuagccagcuuucaacucaugauccacuguggagaagacauugcaaaaaauacuggcugauaucugaguaaguauucugugaacauuccuuccuuuguggacguggucuagguuuuuuuaagaauacauuuuuuauuguuggaggcagggacugggucucuaguucaggcuggccuugaccuuguggcaguccuguuucagccucuacuggguugggguuagaagugugaacugccacacuuggcacuagagcagugguucucaaccuuccuaaugcagcgacccuuuaaugcaguuccucauguugugacccccaaccauaaaguuauuuuuaauugcuacuuuauaacuguaauuucgcuacuguuaugaauccugaggugaacaucugauaugcaggauggccuuaggugaccccguggaagagccgcucagcccucagaggggucacgauguacagacugagaacggcuacacuagagucacuuuuaguugauauacgauagauaauugcucaugucuacgggguaaaguauaacucaguggacauacacaguauauaauaagaaggcuaauuugcauuuccauuuccuuaaguguguaguauucacuguauuuggagcuuucugaagcccugcuuuuaguuccuuauaacauguuauaaaacguacaguacauguauguaaacuguagccauugcauacuaauauuuccccuucuaguuaacuguuuccagugaugcuuugaaccccuugccuuuuuccccuucccagcuucuagugcagaauauauaguuuugaauccugaccuuggacuacuauaguauauacugguuuuccuuuccaacccuaguuucuguuauuggguucagucaaaguuaccauagugccugaauaaaaauguagaugaugguaagauuuauaaaggagauguggaaggaaaggcaggaauaccuaauguguuucuucaauuacgggaagccaggggcacuaaaguuuuggggaauauauauauauauauuuuuuuuuuuuguuguuuuguuuuuuugagacaggguuucuuuguauagcccuggcuguccuggaacucacuuuguagaccaggcuggccucaaaccuagaaaucugcuugccucuccuucccgagugcugggauuaaaggcaugcgccaccacgcccaucucuggggaauauauuuuaaagcugaaagucuuagcguaccaagggaaaaguuacuaauggcugucaaguacugggaggaagaggaaggggaauuugaaguguugagaagugcucauuuuuuacuuuggggcaucaccugcuauauagauaaaauuuguaaaucaaggaccagagguauaaggauacagaaauauagaaacaguuucuguaaguaacuucuauuuauuuucauuuuuauuucuguaaauaacuucuaaaggcuuagaacuaaagcuuuuuuuuuauaaauuuuuuuauuuuuuaucacaagcucaguuuuuacagugcugggaugguacuuaggaccucacucaugcuaggcgagcgagcguucuacaguuauuuacaccccagccuuguugauaauagcugcauguauuuauauuaauacuauauguuaauaaaaaggugcuuuauucucuccugaagcccucccccgaaaacaaacaaaacaaaucaaauguacaccugggauccagugguacacaccuccucuacacuuggaggacuaugguagauccugaguuugagcugaccugaguuauacacuguuucaaaagaagcaauacaccuccgcuuuguuuuagccuuccuuccuauguaaaccuuugauucugcauuccuaggagugcuucugggugcccuggcuuucccugcauucaugugaugaugugaucacaugauuacaugccuccuggcugggcuuccgcaugucuccacuccuuucaccugcucaccacaacuugcuucaguuuauugccccucaugagggcugcuucagagccuuccuaugucuucuuuaauauuccuaguuugcacccuuaaaucuacccuccucccgcccccauucucaacucucuccuuuuggcuucccuuuaagcccuucgguggcucugcguuuucuguaggaaaaagucuaagcccacugggcgguacuuugaaguacccuugugguugcuuauccucugugaaguuuacauuucauucuuuaaaagacucaugauuggacuacuuuuuuguauuguuuuguuuuguuuuguuuuuugagacaggguuucucuguguagcccuggcuguccuggaacucacucuguagaccaggcuggccucgaacucagagauccgccugucucugccucccaaguacugggauuaaaggcgugcgccaccacugcccggcuggacuacuuuuugaaggggaaaaaaauguacauuuuuaaauguucucaauggccaagugaacacuuaagaaauguuuauauaauuaagcaaugaaagauguuaaaucauguauuugcuuugguuuauucuucucuggcugguccaauguagaugugcuagagcaauauuaugcuguuagauucuaaauauucucaaaaauaggacaacugcaugugccuuuuguauauuaauaauugaagccggguucagucacacacaccuguaaccucagcacuugggagguaaagagacagggaucauaguucaugccagccagagcuacguacucuguuucaaaagguuuguuuccaacugauaccuuuuuagaaguaaguugaaacuuacuuuguacugauauacuauucauauauuuuguuaagaacugggaaacuugaaaaaauuaggcagaaagugagaaaauaagugacccuaccaugacaguaguaacuauucauuuuuuaaaauguaucauuucuugcuaucuaguucucuuuguagccaaaaaaauaaguuaagaaaauaaaaaggcagaguuaccauaaacucccaauaaaguguguugguuaauaucaaaacuacaugcuaagccagguuugugguacacauuuuuaauucuaccauuugacagcuagaggcauguggaucugaaauucaaagcuauccuuaccuacaucgauagucgaaggccagccuguacuacauaugacccuaucucaaacaaaggaaaagagaaaaaaaaauguuaauaucauuucaaaagauuuuuuaaucuuguuuuuuaaaccuagggaagaaaaagccgggaagagucagugcuggagaucccucuucauagagaccuacucagacguggggagguacaucgaccauuacgccgccauuaaaaaggccuggcgugaccucaagaaguacuuggagcccagguguccucggaugguuuuaucucugaaagguacuggcacacagagucccccguccacauuuuaguuagucaagaaggaguaguuuaaauaacuucagaucuccuguguaucugacugacccaaccucuuccaggucaccauucacacuuuacuagccaagcaaguguaaugcugauauuguuagagauuuuuugauuggucuuggaaucuauaugguuauuaaaauaaaaagcugaacuacuucaucauuauauuuauuuuacacacacucucucucacacauacacacauauauuauauauauauauauauauauauauauaugaugcuaagauuguuugagaauaaccauuaugauuuauuuuuauuuuuugcaaugaugaggauugagcccaaggucucaugcauuuuaggcaaguauucaacaauggaacuauaccaccaguccuaaaaaugauuguuauucuuauugucauguguauauuuuugugguaugcauguguguacacagguacacauggauguacauucauguguggaagucagaggacguuacaugucuuccuggacuguccucugcucuguguacugaguuggguuucguccugagcucgcugacugggcuagugcaguagccaguuuccccagguaucccgucucggccucccagaugcuggguuacaaguugguugcgucccacgcucagcucauaugugcuuccugggauccaaacuccagcccucaugcuuaugugacaagugcuuuauucaccgagccauuccuccagcccaagauuauuucuuuuuuuuuuuuaaagauuuauuuauucauuauauguaaguacacuguagcugucuucagacacuccagaagagggagucagaucucguuacggaugguugugagccaccaugugguugcugggauuugaacuccggaccuuuggaagagcagucgggugcucuuacccacugagccaucucaccagcccccaagauuauuucuuaauugaaaacuuguaucaguacccuuuccuguuugugccugucaaauguugggucauuaggcauguaagauaacuaaaagagugagaaaaccuuuuuguuugguguuuacaaaguagugaaacuaagguuucaacugaggcugaucugaccccaggaucaaugcucuacuauauugccuaauuauggcuagaaauauuaauaagguauuucagugugauuuguuaauacccaugaggaugcacuauuacugcucaucugcuucccaccugaaguuuccagacuuacucacuagguggcgccaugcacaugcucugguuuugggaagcuagcguuggaauguguucuuccugacucauuagaacccaucuuucugaaauagcauucccuucucuucagauucccacuguaaugucucaugaaaaugucacuuucagaaaaaccaugauguguuuauuagaaggcagaauaaaugguuuuaguagauggaguagggugggacccuggagucccccauuaauaucacgacagcuuacccucuaagaagaccugaguagugacacuccccuagccuggggguagcugccucaagaggacagagaucaucugaacagaagucuucaguggugauaagucagauagguaauaguuuauaauaacuguuacuaaauacaaagguagacacucauuagacacacuuuccaaaaauccuguaaggaagaucauuauugucuuuuuguggaaauaguacuaguuuagggcauaaaagaccaaauuugccaucaaaagguaaaagguaaauucaggaauugacuuacuuugaaaguauaaucuuuacuucaguugugguuacagggagaggacugagcccauuuuguuuagaauaucuaaggucucucuuuuccgcaugagggcauuuagagugugagagugcaguaugguuguucuuuccgacagacucauaccuccuuguucuuucguccuuuggcauuccuaguuccugugccuguuguacaucuagcugucagauuucuuggccacgucugcucuaguccuaggugccaguucucaggcuugccaggaguuuuggaaucggguuaacugggaacaucuacagugcuggggaugcugggaauuucaggcucugaguucuacacuaaguuaggaaccuggcugcugacucgggccacaguccucauucagcuuuaagguuauguaggugucagguucaagaggaaguuagcagcagauaggugguagacuugggguaagggucauggagcauccugagguuaauuguguauuuucaaaucauauuuuccuuguauauuggcuuagaauugagcugggaguuuaguaauccuuuaaaggagcagacuguaaauauuuuagaguugguagaacugacccauaguuucugugacagagaccuguguuuaacucugcuguuaguuagucuguuguuucuggggaacagccuuagacaauacagaaacaaaagggaguggaaaagggaguggcuggguuccaauaagaaggauuuagccucucagcuauuauuuaccaaacccugauuaauuacuaguaccuucacuucacaucaaagaaaagauacaaagagaguuuaauaauuaguaagcagcagagauaaacccagucuuggcuucugauaaaucgucacagcuuccucucugaguagcugaggggagaagagaguaggugaguauuuacugaaagcaguaaggcacuuuauaaauaaauaugcacaugacauuucccuccuuccacagcucucgcuagugggcggcauuagcucauuguuuuggagaacaaggucagacagaugcaaucacacacacacacacaaauacacauauugagggagggagggagggagagagagugagugugagugagugagugagugagugagugagugugaguucacucuccacaguaaguaguagggcuaagguaaggaccagucuggcuuacuauaauauauugucucuucuaaucuuaauuuuacugaaauguaaauauauauucccuuauaucuuucuguuagcuagggguguuuuuacuucuuaaucuuacauauuaaguagucuaacauguagcacauagcauacaaauguuagccucuuuccuuaucuaccauacuccuccuggcuuuuauucagcuugguuucuuuucuaucaaacucuuuauuuuuuaccuuuucuuuuauauguguaugcagaguacguauauguacauguuagugugugugccuacuugugugcaugugaagaccagagcuugaugugccucacaucuacccuuuuguuuuauuuuuugagacaggguuccucuguguaaagcucuggcuguccuggaacuuucucuauagauuaggcuagccucaaacucaaaaagguccaccugccucugccucccacugagugcuaggauuaaaggcauugccaccacugcucagccuaccacccuauuucuugaggcagggucccucacugaaccuggagcgcauugauuuauuagcuggacuggucagccaccucucgggauauggaugucucugaguccacauucugggacugcaguuacucagcacaaugccuggcacugaagggugcuagggaucugaauucaaguccucauucuggcagagcaagaauuguuaccuuauauaauucuuauauacuuuacaacauacaauucauauucuaccuauauacacuuacauaaauauauuuauguuauauaaauaacauuaauuuuagacuaauuuagauuuguagaggguucuguauacgucucaguuucccuaguauaucacacuagagggcauuuaucagaacuaaacauugauugacaucuuguuacuuucccauuggauugagacgucaucagacuuugcauucaguccuuuguguucuccccggaucuaguguaaagcaucacaugacauagagcugucaccucuuuauagccagcaguggcccucugguucuuuccuugucuuuugugacuuggacauuuuugagaaguacucaugggguguuuuguagaaaauaucucagauugguuuugucugaucuuuucuucaugauuagagugguagguuuuuaggaggauucucuuuaguugagauguuugccaucauuagugauguuaaugcuauguaaauauguuuacagaccacagcgaguuauuuacagacucagugaguuauuacaaggucagugcguucauggaaacauuuuccagauguaguaguggagcccuaucuguccgcagaggucccucaugcccucuuucaccgagacaacacuguccugacggcccauccacccagcaguuuucucucaacuuuauauaaauuaaguggcuaaguauuuugggcaaauuaauuuuauuuugacugugaagcucaguagucuuuguuacagauacaacauaugcguagauugaguuuaugucaucuuacuguuggauaugaauauguggguuaucucuacuucugacuauuagaaauaacagcuuuuuaagaaaagauuuauuuuuauguguauguaguuucuuauuugucuguauaucuucauguguacagugucugcagaggccagagagggcauuagguccuccagaccugaaguuaggcauggguauuagccuggcuaccgagagcagcagcugcuuuugauagcugagccaugcuuccagccccucacuaggaguuuuacauugauguucaugaaagagguuggccuuuaguuuuccuuucuuccagagguucuuauuaggauuuuauauaaaauaaugcugaccuuagggacagaacuguaaaauaugugaggaagcaccgucucuccuguucccuggaagagcuuugguuacgguuguucuuacuucuuuuagucaaugugucagcaagccgcucccccuggaguucauugugggaaacuuuuaaauuaaggauucacugucuguuuagguccugaggcuuucuuuuuugauaaauuguccagaaaauugccuacuaucuguguuuucaaauguguuuggcaucuucucauguucaggaagcacauagcgagacagccuuuucauuucugagugaguuaguggucgccuccacucuugcgggguggggaccaaucaaaucucuuuagcagagaacuggcuuuuuggucagucuuuuuuuacuguauguuuguuuuuuauuucacuaauauuuugauuuuuaauuuacuaugauccccacccccugcugacuuauguaauagauuuuuuuucuaccuuuuuuuauuagacucccuaauauuuuagggcuauaaauuuccuucuagucauguuaguuuaucuuacauguuuuuuaaaauuaauuuuguguguaugcuauacacauuucaugugugcaugugugcauacauguagaagccagaggcaaugguggguaucuuccuuaacugcuuucugucccuucuggccuccuccccaggcccuguacaugugugcagcaagacacuuauagacacauaacuauaaaaauaaauuuuucuuuaaaaguugcguuauuucucucagccagaacuggaaaugacccaaauguucaaauauuuuuggagauuggguuuucaguggaccugggcccacagguccucaggcuuuguaguaagcaccguuauccucugggcuaccucaccugguccugauuuuuguuguuuuguuuguuuguuugcuuacuugcuuguauugguuuuugacacaggguuucucuguauagccauggcuauacuggaacuagcucuguagaccaggcuggccagaacucauagaccugccucuacgucccaagugcuaggauuaaaaguguaugcugcugccaccgcuacugcucacuucccauuauuuguuuauuuuuaaaaagacuuaaggucuaaagagauggcucagugguuaagagcacaggcuguucuuccagagguccugaguuuaauucccagcacccacaugguggcucacaauuaucuucauugggauuggaugccuucuucuggugugucugaagacagugacaguguacucauauaaauaaaauuaaucuuaaaaaaaaaaucuaaaaauucuaucuuaugugugugggcauuuuaucuacauguacaucugugugucauaugcugugccaauuauccuuggaggccaugaaagggcaccagauuccuuggaaaagaaguuacagauggcuaugagccacccaccauguggucucuggaaacugaacguaguuccuccgcaagaggagccagugcuagugacacugagccaucucucuagccucuuuuugucucuauuaguucccaggagauuuggugaaauuucccacugggcaguguuguaaaguagcuuagcaagaugcucagccuuugggguacauucacguacaauuauuucuccuugaauaucggcagugauagaacaaaucauuuugaucucuguuauuuaauauauucucauuacucaaauauuauaguucaguucccaaaugaauugaacuugaacuuguaucuugaauggaccuaacuuaacuaaguaaguucuuaaaaggcccugagucuuucagaaggcagagagauucacggaaaguuuuuccuacugacugugaauaagcaaacaagcucgcguguugaggagaaggcuacagaguaggaaggucaggggcuucuaggcacggagagccucacugaaaaaacugcagguugcugaauucugcaaaucccaggugagcuuggaagaggcucugaagccaacagauagguaagaugagcuagcagccccguggacaccaggguuccaacauugugauauaagcagagggucaguugcaccggagcuuccgaccuggagaaacaaauaccauggugaauuccuggcuugguuuccuggggggugggcucagugcucuccacccccucucagcuaagccuagaguagagaggccagguacgcaccugggugggagaggugcuucugcaggagccuugccugggcuggccuagccucacauuuacuugcaaaauaggcaaacaaaucaguuauguuuuaagccacaugcagcaguggaagagaaugcacuacuuguuaauccacucuuuugcccucuuagcgcugacauuacaaauauaucuguauuugggacuguaggugguacuucacuguugagccugcugucccuucucaguguaauuuuaugaggaaaaaaauugugugugugugugugcgcgcgcacgcgccaugauaaggacauaaaacuuuaaccuuucacuauugucuuuauggccauucucuauuaguucuaauaaagcuguuugauuuuaacucucucuucugugaucugagugaagccguccuagcuuugcucucugugccuacauuaagaugaguaucuuggguggauuuuuuuuuuuuuuuaauuucuuuggugcugaaacugaaacuaaggccuaacccauucuaagcucucccucugcacugcaugcuuuagcccuuguucuuuaccuggucucucuuucguuagauuauuugacuuauugauauuuauuuacuaauauuugaacuuaaccaugccauuuaaauauguucacucuuuauuuuuacguuuuuaauuauguuuaaguccuuugcuuucccuucauauuucccuuuuaguguucacaauauagauuaaaauaugcaucuuugacuuauggaggucuaauagaauuuaguauguuaccacuuucugacagugaaaaagcauuaguucugaucaugccccuccccguuucaugggagggucuuugggcuccagcucaggucucuaugcacguuagcccaucacugagcccaucagagagcaccuaguguuaagguuuuugugugugugugugacuuuaauuuuuagcguauuucuuacccuggaaacuuguggcuaggaucacaggcuuucgucaucauaccuggcucucugccuguucacugucaguucuuguuuuuauugagacuuagaucuuuugaguaauggcaaagcacuauauaggucucagggugauagcguuuucuucuagagauuuccuguugcuucugcugcgagucaucuuguuuaggguugauguaauuggaaagccugggcgucucaucugugaggacuggcuauuuccaguucacuucccuuguguaaccuggacaaaaccaugcuugcuuguuauuugaacaagugcuuuucucuugguggacucugaaccuuuuuuuuuuuuuaaucaacccuauauauuaucuaaagcugaguuuggcuucuuguuuuagaguuggcaguugcuuaaaaacaaggugauuccaaaugccuacauuggcucuuguguuuuuguuuguuuuguuucuauuuuuccuuuuuagaguucacuccuagggcuacaagcaaugugcaccccaucuggcugguuuaguuuguaggguguuugguaguggugguugauuguuuuaagguuuuuuucuuuaugucuucaauggacuuuuugccauaaucauuuaguugugagagguuuggcccagcaagugaggggcaguugcuuggaagagcaucacuucuuuugguauuuguagguuuuucucuugugacagcuagaaugcaggccauguuuucuaaugugcaauggagaauucaacuuaguggcuucucacaguaugaaucuacaucuaucuacugccuuccacuucccauaaaggguucaaguugaaccucuagaaugacgucagcugagagaacuuccagagcuguuuuuaaaugaaguauugaauauaucagguuuggaaaagugagacaagagcuuuguuauaauguaauaaauuaauuguucauuuccuuggugccccuuuccaauucuuugugccaguguuuuuuucccacguugagaggaaacaaaccucuuuuguuuaguguuuaaaauuauuuuccaauucagugucugguauuuugacaguauauuuuaaacggaauucacuugucauaagaugguuucauggguugacagcugaccuagacuacccugaagucugagugugcgcacacacuugcgucucggguguguauuugcgcacacacuugugucucggguguguauuugcagagggcgcacgugaggaagaccuggaugcugucgaagcucagaucgguugcaagcucccggaugauuaucgcuguucauaccggauccacaacgggcaaaaguuaguggugccgggguaagguguuugauguuuuaguaauuuucagaaauggguauuacuuucuagaaugaaucaaauuacauuuuauucauaguuuuucuuagcuaucuuuacuaaacauguauaagaaauguauguauggggggguuccuuccuuuuccuuauagcaguccauaauguaauauguauagauuaaguuaaaguuuaccaaaauaaaugugacuuauaagagcauuauuccugccagcacauuuuuaugauuaaaguaagaucugguugagaaggaagcugugggugcaggaggggaugugcaugugugcauauuugugcaugugugcauauuugugagugcauuugacugaauggcuugauguggugugguuacucuguuacaagcuagguaaaauguuuuaggaacuuaaugcacauucugucuacuauacaugcaaaaagcaugauuuguucagagcuguguacaccaaacuaaggaaaguagaguuuugucauaaucaagaacauccuauaacugaauggccuuuaaaaaaaaacuuuguaaguuguauucauggaagucuuuuuguuuugggggguucuuaguuguuguuuuuuguuuuugguaaaugaagaccauauaguagccaucacauuuauucacaauuuuuaaagcuauaaacuuugaauaugucuuuuuuuuguacuuccauggaauuaaacuauuucaaagauaauauauuuauaaaauaccaagaaugcaaaaagaauggugcauuguucuuaauggaaccugcuguugcucucuauguacuguguagcuggcccuugcuacuguguggauucuucuuuuucccaaccuuucucccccugcuuucucccccccuaacacugaauaggagagcaagaaagauaaaggacagaggacacacacacacacacacacacacacacacacacagagagagagagagagagagagagagagagagagagagagagagagagaggagaauccaugaaucuaauuucuuucccaacuguugcucccacuuuccagcccagccccuuuaaacugucucccaacaguacgcaacagucuguguaaacagucucuucucccagcuuucccaacauuagcagcucccaacuguaacaacuguucucuucugucugcucagcuccuucuccuggcucaacugucuccuaacacuauuuucuggaccaacugccuucucucgcucugccaccccccccccccccccccgccucagcuccauuuuuuuuuuaaauauccuaucguguuuccagaaauccaagaggcaaguaacacugaaggucauaggaucaagcaguucuaacaaacagcuaagaauucuuaaagggcacguugacuagcaacuggggauccuuuaaagggccagacacacaagauaaauaacacuacagugaagaauuaugggaaacuguuaaugauuucacaucuggguugagugugucuugggauucuccaaugagauccuacugauaauacaaagugaaguacucagaauacagaguaucaaggaugguucaucaacaggcagguuaaggggcuggagagauggcucagugguuaagugugaguccugcucuggcagaggucccaaguucccaacccccaucaggcagcucacaguggccagaaaucccaacuccagggacuugcaaugccucuggcaccuguucuuguguucucacacucucucucucucucucucucucucucucucucucucugugugugugugugucacauccacacauagacauacaacuuaaaauaaaaaguuacuuaucuaucugccuauccauacaccaucccaagacgucagacuugguaagaggacucuuuaccagugaccaguaguucugguuucaugagauaagcugaaaguugauccaagauaaaaugucagaaaaguuaucccuuuucccccauuaaauuagcuauuaauauauguguaugcauuuaugaauauacauaaguagcaaaucacagaaguacuggcaguucaguauauaauaagauagauuuuuuguuuuuuuaauuuugaagacaaagucuuacuuuguagucuauguuggccuuaaccucauuauaauuccuuucucagucuuuugaacagcuggaauuuuagguauuugccauuugcugagugugucugagcgugugugucuguguguguguguuuguguguuugugugugugcgcgcauuuaauuuuaaaaucuaaaucagaaucuuucugauuaaaagagugaauuugauauauagcaauguuagugguuuugauauucuugguuuagaauuucuaugcuaacuaguucuuagaaaguuaccaguguguggcugggcauggugacaauucuaaugccgaucaucucaguucucuggauggaggcugaagcaggaggauuaacucaaauuugaggccaacauauagcaaguaccaagccagcuaagacuccauagcaaguuuuuguuuguuuuaaauacaaugaaaaauguuugucaguaugaaauuauuuaucaaaaaaauaaauaaauaaauaaagcauagcccugugccucuguuugucucuguucugcuuuugaugguuuugagucuguguuccccgcagguugcugggaaguauggcacuguccaaucacuaccgcucugaagaucuacuagauguugauacugcugcaggaggauuucagcagagacagggacugaaauacugucucccuuuaaccuuuugcauacacaccggcuugagucaguacauagcuguggaggcugcagaggggcggaauaagaacgaaguguucuaccaauguccaguaaguaggaagcgugcucgauuguggcuuuaacauguauucagauaauagaaagguaugcauuggacacuuucagggaucuaaaauaggcuggagcaucauauauuuuauuaacuagagaacuacuaucuucacguggguuauggaauaccaaaaggaagcugugccacuggaucagcaguacaagcucgacagacauugcuuagauggaaagcuguuguucauguuaaggcauuuuaaguauaaguaaaguuaaggaacuuauugucgaaguccuuggcuauagauuaguuuuauaacuugucuuaguagaaauagacuauacguuuucauuuuauugagaggugucuucaaacauuuuauagacuaagccugaacauagaaauuacaauaguaggaacugacaaggguugcuaaaaucucuucucaagaagagacauaaguauuaucuaccuguccuguuaagggcccaauggcaaaccgaggcaugaguccaccaaaguucacucuggggacugaugacuauaugucauaggugagggacuacuuauaggcauguggguaccccucuuccaacuggcugcaucucagaagcuuuacccagcagguaugaggacuuccccauagcugaauagauggagcccagcccuagucuucucuuaccucuguauaugacagguguauagauggagccccagcccuagucuuccccuaccucuguauaugacagguguauagauggagcccaguucuagacuucucuuaccucuguauaugacagguguauagauggagccccagcucuagucuuccccuaccucuauauauaacagguguauagauggagcccaguucuagacuucucuuaccucuguauaugacagguguauagauggagcccagcccuagucuuccccuaccucuauauaugacagguguauagauggagcccagcccuagucuucucuuaccucuauauauaacagguguauagauggagcccagcccuagucuuccccuaccucuguauaugacagguguauagauggagcccagcccuagucuucucuuaccucuauauauaacagguguauguauagauggagcccagcccuagucuuccccuaccucuguauaugacagguguauagauggagcccaguucuagacuucucuuaccucuguauaugacagguguauagauggagcccagcccuagucuucucuuaccucuauauaugacagguguauagauggagcccagcccuagucuuccccuaccucuguauaugaccgguguauagauggagcccagcccuagucuuucccuaccucuguauaugacagguguauagauggagcccagcccuagucuuccccuaccucuguauaugaccgguguauagauggagcccagcccuagucuuucccuaccucuguauaugacagguguauagauggagcccagcccuagucuucucuuaccucuauauauaacagguguauguauagauggagcccagcccuagucuuccccuaccucuguauaugacagguguauagauggaguccaguucuagacuucucuuaccucuguauaugacagguguauagauggagcccagcccuagucuucucuuaccucuauauaugacagguguauagauggagcccagcccuagucuuccccuaccucuguauaugaccgguguauagauggagcccagcccuagucuuucccuaccucuguauaugaccgguguauagauggagcccagcccuagucuuccccuaccucuguauaugauaagagguagggagcagcuggauacucagguuccucuauggagaugggaugaucuuuuguguguagguagaggggguuguggggggugcaccugaacuuuucaagauggugguugcuuggcuuagaagacaguuauucauaacaaggaauauuugaggguugauuagaacacucaguuuauuuguuuuaucuauuuugcuuuauucccugagaucuaguaaggaacaagaauagauguauuuauaucauuuuuuuuucacauaggaccaaauggcucggaauccugcugcuauugacauguuuaucauagguaagagaaauauagaaaagucacuuuucccuucuuacuggauucaaaaagaaaaugaguugggacaacuuuugacuucuuugaacagcugccaucuuaugcuugcauuucuuaauauuuccuaguuuauaaaguuuugugucuaugcuuucacagaggggcagcccuugggcuuucuuuguauuuuguuuagaaaaaaaguucauauccuguacagauuuagguuuuuaauauucuuuacagaaaucagaugcagaauuguucugcaucuauaguuccuauauaccuuucaggcaaagaaugcccugauacagagcaacuugggaacgaagggguuuauuucagcuugcaggucacaggcugcauugugggaagucagggcacaacucaaagcaagagauugaaguggaaaccaugacugucauuugggggaacucuucagucuguauggaaguacagcucaccauuugcucuugguccagucucauccugcugaaacucagcucgcuuggggaggcguccuuuguauugacucugcuuuguagagggauuuccgacguaaacauuucccuauacacucauaauacacaagaugcucagggccagcucagugguugacuaugugucucgcaugaacaaggucccacuuuuaauccccagcacuaaguagagaaauaucucuuuuaauuuuaucuucuaauuggaaccuugaacagaaaaugaguaucuguuuuuuucauucugugacaugguucggguuucugauagacuucacaguaucugaaaaggucucauguuacacaugcugugccagcguuuacauuuaggccuuggcuuucaacucagucuuacuugaacucaaacaacucagugccuuguuucuaaguucagcacgaucaccgugucaugcuugugcuaauugucuucaugggcaucuugguuagaguguugucacagcuuuagccgagcagugcuggucuguuuaauuaagagcucucugcucaguaaggagguugcuguugggcucugaguuucuuucuuucauuuucauguuuuucugcuuugagacaaaauaaacuaucauucaacaaauacuaaggucugauaauuaaaaaacagaauuagugguauaaauugaacaucugauauucaguaaagaccuggguuaauugaaaccggguuacaaagaaauucauugaguaauauuaacuaguuacuaaauauaugcuagguauuuagcuguauuaucaaguaaaaugaugguguuuaauaguuacuuuguauuaccuagaauuuuuagcuuaauucaucuaacugcuugucauggauccuuuuaguguaucaggcagacagugagcacuggauugaugugauaaucauuguuuucugcuuugaguuggucagugaggggaggaccauggugcagcugaaucuguaaaaaugggcaucuggaccacuuugguauuaaccugaugcugagaauuuuauaaugucaugucucuggaagaugucuagacuaagccuggcuugugccaauauuuugaguguaugucaggauguaucuaagaugaauccugaucauugagaguaggagucugauagccuuccuuaaugcuuuucuccuagauguaacuauuuccuuuguucuguauaaaauuaauagacaaauauuuucaucacuguaccaaaaucaauuaauuugaguauaaaacaaacaauaaccaacauagguggaaauagcuguagaauucccuaacaaaagauaggcaggggcugaggaugguggugguaggggaacacaaaggaaauaauguagauagaauugagaacagaaggacuggagagacagcucagaacuuaaugggcaaacaugaggaucugagaucaagucccaguaccuaugugaaagcuugguguggcuuuugccuaccaugggcuugugccuaugccugucaucuuggcauuuuauagggcagagacaggcuugcuggaugccagcuuagcuccacauacaaaggaaaguccugucucaaggaaauagguggagagugauggggcagggaugggaugucuuucagccucugcaugugugugcaaacacaugcacauaauugaguauauaucacagucauaauaaauaagaauugggaaaagaaauuugucuaauagaauaguggcaaaauuauaacuauuucuaguuuugguaucaucccuuaaacauagcgaauuauaguuguuugcuuccucuguugauuuuucccuguacuuauucucccccuuauggcuuauaggugcuacuuuuaccgacugguuuacauccuaugucaacaauguuguaucaggugguuuccccaucaucagagaccagauuuucagguauuucaguuggggcuuuugugauugaaacaacuguaagucagaaaaggcuaccuauugcaaauaucuaucaugagaugagauuuggaagguuaagaaaugaacuucacuguccuguaucucuguuucauuuucauaucaaagccagaacauccauacauuuaaucaaccaauauuuuucuugucuugaaaaaucaagaggaaaagcuaaaugugauuuaguagcuugacaguagcuacauaguuucucuuugcaggaccauaaaguuugccaguuaauagguuuauugugaauagcaaguaaacuagcuccuggcaaacauuuauuuucuguaacuggguguuuuauuagaagugaauauagaugauacuagaucauagcagccuucauggcagaaacaguagguuaaguauaggucauaagaggcucaguauguuuacauucuucauauuuucauaguccauagucaccaaacaguauaguuaguuuucaaaagucuccccaauuuuuauagcacugaaaaacccagagaagccuuaguugguuucaaaauugguugcugauccaugguuugaaucauugaccaugauggcugucuauacugaaccaggggcaccaagguuuuccacuauuauaaagcuaaaguucaauuggguuauaucaaauaugacuuaaaguuuuaaaguauagguaagaagaaaaauguacuuuauucucuaaaccuuguaagaauugaagcuaguugauuuaaacauguuuaauuuucuucuuugcuagauauauucaugauccagaauguguggcaacaacuggagauauuacaguuucaguguccacaucguuucugccagaacucagcucugugcauccgccacacuauuucuucacauaccgaaucaggugagaguuguaagugggacugugugcuagucaguguguuuccaugacaaaaccccccgaggaaucaacuuuggugaaccaggacuuucagagccuacagcccauggccacuugacucacucauuucugggcccaagugugauaaggcagaauguccuagaaguguagacuaaugccacauagcaaagcuguucacuuuaugguggccugguagagaaagaaccaaacaagucuucaaccaucuuauauccgaaucguaagacucuugguguuucaagugccaccauccuauggcugguuguuguugcuccauuuggacaugaucugugaaaugaauuuuauggguuugguuuuuauuuuguuuuaugguccuaugaaucaaacuucgagccuuguccauguuuggcaaguacucuuaccacugagcuacagcccagccaugaagugcauuuaaggguuauuuuuauuuauuuuuuaauuaaaaaaaaagucaggugguagugaccuacucauuuaaucccaauauuggggaggcagaggcaagcaaaucucugaguuugaggcuggccuggucugggcuacagagcgaguucuaggacagcugaacuacacagagaaaucuuaucuggaaaaacauaaccaacaaaaauuauauuucuuuuuuaguguguaugaucgcauauguguggguacauguguaugcagaggccugaaguugacaucugucuuccucugucaccacccaucuuaguuuuugaagcaggucuugcaguuaaucuagaguuugcccauacaucuagaucagcuaucuaugaguaugggguuuauaagcaggcaaccaugcccacccaauauuuaaguagguucugaggcuccaaacaucaguccuuauguuuaugccacugaacuaccucccuagcucuaaaguacgcuuaaauguucuaaauuacaauuauaauuuauugugugugcauguguggguaguguccugugggaguugguucucuccuaucauguggauccugggggugguacucagguuguuagguuuggcaagaaaugccuuuauccacugggccaccuuaccaucuggcuaaggcacacuuugaaaaauaguuccuugaugaaguuuucagaaaaguuaauaaauuuucuauaauacaguguucacaaggacuuuggcagguuaugauuuuuggguuuuuuucuuuuuuugcauguguccugaguauaaaugauuguuucagauacugcagggacuagacuacuagguuggaauugucaaagcucaauuuuagauuuguaauguaaucuagaaguuaguccauugccaaacagaaaaccauguauuuaaaauuucaugugggcuaucuauguuaaauuuuaaaauauaauauuuauggagugcucuuaugugucacacauaguauuacauguuugauuaacuauaaaaugcuucaauuuacuguaguuaggaauguucugugcuuaggcagaaagauaacccaucgcuccaagcauaguuuagauauuuguuuuuacuuagauccugcuuaaaauuaagacuuuauuaaaauagaaauaacuuccugcccuuacaagguacuuagcaugaaaauagagacagacuccuagaggaagaaaauguuagccucuagaaacaaauuaaaguauaauuccaguaguuggcgacauuuuguuuugagcuuuuuagaagcuauagaaaaccagaauuguguuguauagguuuauaugaaugaaugaaugaaugaaugaaugaaugaguucuucagcaguuuuucaugacacucaaucuagaaagugucugccaaauggauauuuauuugaucaaagauaguugcuuccgcuguuuuugcauuuauuuauguaguccuucuauuguugguucuucaauucagugaaagcauuuuccugggggcauggaauuagccuaauuaaagcagugucuuugagaacuuagggcuaauguggacuuuggguuagauuuauuaauuuuccuucgaaguuuuucauaguauuaauucaagcgcuguaguacuuaaacaaaaaaggaagacaguacaucuauacccugcccuuuucuccaggauugaaaugucaagggaugcucuuccugagaaggccugucaguuggacagucgcuacuggaggauaacaaacgcuaaaggggauguggaagaaguccagggaccuggaguagucgguauguccccaagauuuacauucuuggucaguuguuucaaaaaaagguuagacuguuuauaaguuuauguauaaauguaauuaguggagguguuagccuaucacuuuaguccugagaugucagcuuuucuaaagccauaguaaacucaguuauuuagggauuucccuuucugugcaucaucuaggguucccugauuguuauucuuguguucauaauuuuuauguucugugaguuaggaggcacaggacaguaagaaaauaauuuuuauauugauaaucuuuaucaauuuuagaagugauauugaaauuaguagcacauauuuauuauugaugcugcucuuccugaagacacaaguuaaguuccuagcacccauauuagguggcucauaaccauguauaacuccagccccaguggauccaacaucugucucugugagcaccuguacucauguacacagaugcacauacacauacauaaacacauaaauauacauuucuauuauuuuuauuuauguauuuauuuuuggacucaggguuuuauuguagcuuugcuugccuggaagucuuuauguagacaaggcuggacaugaacucacagagaucugccugcaucuccugagugcugggauuaaaggugugcuucaccacuucuggcugcaauauaaaauaaaucucaaaaaggagagagaaucuagugcuaaggaauuguauuuaaaauguuguauguuuugucauuugacugcggauaugaggacccuccucuguaacuggugcuuauccagacugaacauuaggggugcacucacagccuuaugucuuagucucuugcugcuauaggaauaauauugccuuuaccuuuguuugagcuucugucucaacugugacacuuuucuauuaguuguguuuuaaagauucaaacaacuuugcgggaaaaaagugucccucuuaaauuuuguuuacuagauauuccccaccugcuaccuuguagagaauuuggggaauaaaaaaaugccagggacugaugaggucucagcagacaaaggcaagugccaccaaaccuuaguuuauccuugggaccuacaugauggaagggagacaauuccccacacauuguccucugcccuucaugugcagaaagucucagcccccaaaaaucugacuuaaaacugccaaagagggacggccccucaugaugcccaugucagcacuuuguuguaauccucuuagaguuuugggguuuuuuuucuaauugcgcaguucacuuucuaacuacuuacagagcauccagagaauguagucacuaaaaggaagaagugaauuuuauauuuugguuuauuguuacuguucucucugcaggugaauuuccaauuauuagcccaggucggauauaugaauacacaagcuguaccacauuuucuacaacaucaggcuacauggaaggguauuacaccuuccauuuucuguacuuuaaggacaaggucuuuaauguugccaucccccgauuccacauggcauguccaacauucagggugucuauagcucgauugguaaguuaauuuuuuuuccuagugcuggauauaugacuuuguucuaagaccaaccaucuuuguuuagguagauaaguaguuuauaaugaugucccuccuccaaaaaaaaaaaaaaaaaaaaguagacauuuugaggaaguaucuuaggguuguaguaauauauaaagggagaugaacaauacgcuuauuuuggucccuccuacuauuauccauuuugcagauuaaacuuuuuuuccacuguucccaacaauagcuguguggccugaauguauuagaagaugugaaggaccaaucagaccacuuaaaauugacuuuugucauuaaguguugaaaaaacaauuuccuacaguauuuuuacuaaaacuuccauuuaguaaaauaagcuaguaucuuauagagauuuucauagaggauuuauuggguaggaauauacuuuuagcagucuucuuggauuguuuuucacaucaaccagacguauuuuacaaaucucaaucuuaagguuaccuugugauagguacaacaguagcccuaauuugugggcuguaaaaugguuggagugugugaagugagcgcucuguuagauuugagaauaauauauucagaauguaccugaguuguagacauugaaugcuuagaagacgcccucccagcuccuggaguggguagguuugagguaauucuagaaaaguggacaagccaguaaccuuccuggaagaggacccauucucaucucucauuugaaagauaagaaugaugcugagcuguugugcacuguaugcaguguggugaaaaggaccuauacuaguccacauuugugaguaauguuguucucagcauggagaacuugcuacucucuggaauagacuuccauuuucuuucuuggguaaaggggaugagaggagggcuugagauaguguaucguuacguagaauuauucuacguuuggccucaaacucacuguuuucuugccucagccucccaagugcuagaugugugcaccaugccuacaccagaccagacuuccauucuuggccaacaccagaccagacuuccauucuugguuagcccagaaccuauaugagcgugguaccauccuauccuuaaaugguugauacucaucagugaagcugucuggaacuggaguuugcuuuauggggaaaauuuaaaauauggacuuaauuucuuuaauacauauauuuucuauuccaucuuguuucaguuuugguaauuugugccuuucaugaaauuuguucauuucaucuaauguugaauuuauuagcauaaaguuauuuacaauauucuguugauaucccuuuaauggcuauaagagcuguagucagauaaccuucuuuuauccuuaauauuggugauuuauaucuuuuuuuuagccacauuucuauugaucacucaaaaggaacaacauuuuguuuugauggauuuucuguaguuugauuuuuuuuucuauuucagcucuuggugcaguugucuuuauuucucuucuuuaccuuggguuaaauucacuuuucuuguagcuuuuaaagguagaaguguagauuauugauuguagaccuuuccuguuucuaagcacuguucuagcuguauuguacaaauuuugauauauuuugguuaauauuuaguucaaaauacucaagauuucccuuguaacugacuuacgacugcauagaaauauguuaauuuucaaguguuuggaagauuuuaguuaucuuuugcuuacugaguuuuaauauuauugugguuagagaacuuacuuuguauugcuaauauuuuuuaauguuuuaugaccccaaauuaugugaagaauuucuauaucuugauaaaugaucuuugugucuuugaaaagaauguauauucuaccaugugagaauuuauucuaugacaggccaagcugacugauuguuugacaauguuugccaagucaucuguauauuuauuguucuuuuuuuuaaacuuuuguuacuucagccauugaagagauuauuguugaaaucuuuaguuaauggcuuuguccauugauuacuuuauucuuguuauauaucugccucaugcauuuugaagugauauaauugugugccagugcuuaggauuguugucuguuuauggaaguaguucuuugauucuuauucagcuuuacuuacauuccuuguccuaaguuaagagcauugagguaaugcaugggcaggcaggcagccgagcagggucagcuugaugcuuuuguugcuugucuuuacuguuuguuucaguggauguaaaguacgggcuuuacuaaaaggcagugguucucaagccuuuggguuuccucaccuccuuagauguauaaaaaccauugaugccuaagaaccuguuuacauggucaugucaguauguaccauaucagaaauucaaauaggacauuuauaaaaguaucaguuccuuuuaaaacuacaauaaauaaacccuuuacauguucaacccucucaacuguauuuauuuauuuauuuaaagcuuuaguuucugcucagcuacaagaaaaaguaguugaccuguuuuacagaaaguguucuucuaaaaaauggagagucauuagaaaaaaugagaauugugacuuauguuacugaacguaaaaaagacaguaggguuguauuuauugaccuucuauuauccuccuugauauggagauaauagaauuguguuuuacauuuuuuuuuguccuccaccagucugaguaauugcuaggcuucauaauuucuuuuccuuuauacuugcuauauucucuguaaauauucucugcuuaguuuacugaugucccuguguagggcauuuguggugcuuguugacugagggcacuaugaacauucuggaugcuucuuuauguccauucuccucugcuccucucuuaccugcuguuuggauaguacacuaucaucugacuauucucucucuaaccacaguugauuccuuuaauaguucuuguuuucuucauuaauauaauaaucauacuaccugauaaucauguuuuaggauuuccaaagcccucccuaucccuccugcaaaacuuugaagucuucauuccuuggauuuaaaaaauaaucuaaaguuaaaaauaaugaaauaacauaaaagucacauuuguguauguuuucugauuguuauuguuaauauaauaaauccuacacgacacaguucuuuucuccuacauucucauuugcucucaacaagugucugaguacuguagcaaacaauauaaucaaaaccccugccuuggauuuuauauucuaauuggaagaaacaaacgaauauaaacucuugggucaaguaacaaaugugguagagaaaaagcagggcuaguacccuguugggcuuuguucuaaagaugugucaggaaaugucuugguaauaucuauguagaaauauagaagggaugaagugagccaaguagauuuauggaauaauauuuggccaaagaaauacuugguaugaggauucuuaggcaacugugggcuuaguguguuugauccaaggaggcgugaguguggagaacaaggggagagcaguuauaaaugaggucagaagccacucucaguacaugagagccugucuuaaaaaggagggaccagaguagugcuaauauuaaugcaguaaaagccauggugagggauuuugcugacaucaugcacuaaauuucuuaguacucagauggucagcugaacccuggcuguucagacacuucauuguguucagauguguguaagagaagauuggcagccaaguuaaugccacgacuugauuggggaugccugcuuaaacagaauggcauuccaggagacacugcaugcuccgacacugcaugauccgacacugcaugcucugacacugcaugccaugacacugcaugccaugacacugugugcuccucaucucuucuguccuagggucucccuuuucuuacaguguugaauggucuuaggaacgcaccucucuagggaaucagcaaagugacacuuggcugaagccgaguuugaaagggcaguaugccuuuagcuuaguucuccuucucccggaacaugugccuuugcuauccugagaccuagugugagaaguccaguucccaugaagcagccauagaaggcaugcagagauccagugucaagguggaaggaagugcccacuccaggcuccagauauuuggaucaucccaguccagguaccagacacaugagugaauaagcccuugaggugaagcuuggguccagucaccaaucagcuguagcaucgugagagauuugaagccugaaguauuccauuaagugcuucccagaucuccaaccacaggaaccaagagaagauugcugacuauuguuauuauaagcaacugaaaaaaauaaaauauuucuuuuucaaaaguagaggcuacugauguuuaaauuaagaugaugugucuuuggaauucaauaaaaaccuuuuaggaacugugcauaaaaaauuaaccauuagagaucauaucugauuaauauuuucacguguguccauaagcagauagacuuauaaagaauuaauaaaccauauuacuauaaguucauuaaaacuuuauuguggguuuacuaguggguaguaugccuaccuuuguauaugaauuaucaacuacuaugugaagaacaaccauugccuuggugaaauguguuuaccauuaaaaccauggugagcauuacuuaacaugaugcgucuugcaucaugagauuguguuguuuaggucugugaaaacuugugccuagcaugucuaguuacuuguggucuaggccauagaauuauuauaagaacugauggacauuuuucucaucagaagauuuucucuuuuaaggaaauggguccugaugaauaugaagagauggaggaggaagcugaggaggaggaggaggaagaaaaugaugacucugcagacauggaugaauccgaugagucagaugcggaugagaaugagucagaugagggugaaggggaggcgagacggaggagggucuuugauguucccauucgcagacgccgcugcucucgucuguuuuagcugcugcugaaggaagcucugggaugacacuguucuguuaaacaguuuugucaauaauguaaauaauugugcucagcauauagccggaagcucgcaugaaauguuguuccagaccuaggcgcuacaugacacuacauuaggcguuggaucgcuuugcuugacuuugugcuuguagguagaggaacaaaugggaauuguuuguuuucucuuccaggggucaaugggagagcagcucucuagcuaaagaacaggaguuccuuuguuuaaaaauauuuucuacuuaaaaacaaaacagaggugaaggggaaauuguuuuggaugaggauuuuauauguaacaaaaacacccacccaagggcagaaagagacugcaggaaggacugacugugcaaagaccccucucaguuguuuagacacuaacaaaauuuauacuuagcuuaauccacuucaugguuguuaacauuuuauacucauugggcaacuaaauggcuaaguucaauagggauaguuugcccuuacuuagacaaucucuccuugcauuagucuuugucacaccgaccugaguugcaaauuuuuaucauuacuuuuaauuuaaagucuucaacauaacuuugggcuuuaaaaguuaaaguucuuacgcuaugaccguucucacauuauuuauagauucaucauuuuaaauguaguuugugaaaguacguaggguguugcuaaagauucuucaugaugucucauguagucuaaauuuguaaauaugcuuucuguuuuguuucuuuauacauuugucuaacuuugugguaagugaucugaauuuuauguuaggguuaggauauuuuugugaaacauggauauuuuuuuuuugguaauuauauaauugagaguuuggaaugaaauccuucaagugucaaaaacuccuauuuugaaaacauuuuuguguaagugccuauuucccauagauaguauugagcuuuuguucuuaagcuggaagauggccauggugcuugcuggcuuacagccugaguauagcugguccauucagagcugacugcuggcuuugcuuacaccuggagaaaaugagagcgccauauucaggucuaagugccugcucucggguaccgugagcaaacuugcccuuuuaugaagacagaucagaauauuccaagucauuuuccuacuuauuuuucauaaaagaguacaaucgcaugguguuucaacagaagcccgcggcagccucaucuucuguauaccacaucuguugaauguaucauuuuucucuugugcuugauuaaaucucauguguuuuuguuuguuauggcccaaagcauacacagucuacugcuaaaguugacaguaaguugucaucaagugauuguccuagaaaugaaauuaaaaugaaggacuuugaagcggaagcaucaccauggcuacugcuuauuaagucagccgcuucaccauagcugcacccgcagaggacaagaacagguaggacguaaguuacuggagcaucugcuucauugaaggcaguacgacuauuucaagagaggucaauaucagaucuggagacccuuguuuguaaucaccugacgugacaaaaauguguccucaacagcaugaugaccacugccaaagcaggguuugccuacagcguugaaagagaagacuagaccugucagaguuccugagaacucuggguggucuaaaaugauugaagaucauuagagaauuugaaaggaagugauaaaccugcaaacuuguggguaaaggccgcuaacuuuuaaaagcuagaaaaguggguguggagagcgguuacucgccagagcaagcccuccucuauuccaucuagguuuguauaaaauacauuuuguggucuuugcacagugauaaaauuaccuggcaacacagucaccuaaugacucauuucuuaaacuauauucccacuguuaagugagaacauggcuguuaucagacuugaaauacuauucaggcuacccuuguuaaaaaauagucaacccuuuuaauuuaggcugccauaauaaaauacccuugauuauaauauaaauagaaaauauagccaggccaugguggcacauaccuguaaucccaacuugagaggcagauugaggcagaaggauuauagugaguuugaaauuagcccaggcuacaaaguaaaaucuugucuuuaaaaaaaaaaauguagcuauacaaacaagucguuaauaacaaccuaauguccuacauuuucauaaagaugcuuuguugauuagucaguauaaggaaggagacaggauguagacaacaaacauucagacccuaguaucaacccccuuuaaaaggacuuucccaguaaaguagcaauuaagaaaccaugacaaagcuggccccacacuuccuugucauuccuuguaucuuuuuucuaguacauugauggcccaacugugccugagcccagccuaauguuuguuauaguacuucaugauugcuuagccucccuucaaaauuugccuuuugguauauucaacagacuuuuauuuucugggacagaggacaauaacagaccaaagaaauccauccaagcucagccuggugggccaacaaauuaucaggauuacuaacaggaacauggaugauugacagcugcaacugaggaacaacauagcagccugggggaggacucacaagcauugggguuccugggaaacucaaggcagcugcauguuugaagaaucucuucuagcaaguuugcacugcuuauauaaccacugggagagguguuuggucauaaaucucagaaucuugaauccucugaggaguuucaugagccuuccuacucccaucaggaggcuguuucuaugaauaggaauuagcuguacaauaaaccuccacaucacacaaaggugugguuaguugacaagccucuguaaacuacauugcaaaaauucuuauucaugaaaguguuuagcauguaugggugcuuugcccucuguguauaucugugcaccacuugggugcccagugcccauggaggccacuagcauuauuggaugcccuagguucugagaguugaaacugaauggucuggaucuggaacugaagucagugcuauuaacugcugagccaucccucuagccccucaauaaacggaguuuaaccauuggca

SEQ ID NO: 954 - RNA, 1282 nt, Mus musculus
gaguucugaauucgucucugcuccucccuguuccagagacagccgaaucuucuugugcagugccagccucgucccauagacaaaauggugaagguuggugugaacggauuuggccguauugggcgccuggucaccagggcugccaucugcaguggcaaaguggagauuguugccaucaacgaccccuucauugaccucaacuacauggucuacauguuccaguaugacuccacccacggcaaguucaacagcacagucaaggccgagaaugggaagcuugucaucaacgggaagcccaucaccaucuuccaggagcgagaccccgcuaacaucaaauggggugaggccagugcugaguaugucguggagucuacuggugucuucaccaccauggagaaggccagggcccacuugaaggguggagccaaaagggucaucaucucugccccuucugcugaugcccccauguuugugaugggugugaaccacgagaaauaugacaacucacucaagauuuucagcaaugcauccugcaccaccaacugcuuagcccccguggccaaggucauccaugacaacuuuggcauuguggaagggcucaugaccacaguccaugccaucacugccacccagaagacuguggauggccccucuggaaagcuguggcgugauggucguggggcugcccagaacaucaucccugcauccacuggugcugccaaggcugugggcaaggucaucccagagcugaacuggaagcucacuggcauggccuuccguguuccuacccccaauguguucguccuggaucugacgugccgccuggagaaaccugccaaguaugaugacaucaagaagguggugaagcaggcaucugagggcccacugaagggcaucuugggcuacacugaggaccagguugucuccugcuacuucaacagcaacucccacucguccaccuucgaugccagggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagagaggcccuaucccaacucggcccccaacacugagcaucucccucacaauuuccaucccagacccccauaauaacaggaggggccuagggagcccucccuacucucuugaauaccaucaauaaaguuugcugcacccacaaaaaaaaaagagu

SEQ ID NO: 955 - RNA, 1034 nt, Mus musculus
ggaaagcugcaccagccuccugcccugggcgcucgucagcagaagcccgcagcagcguucccucagcagcauuugaaccugagccaggugugugccugugccugcuugggagcacuugggauuuacccucagcaguuuaguuucuuuuacuuuaauauuuuuaguuuuuaauuuuguguaugugugugguaugugugaaguuugagcagagauaauggggaaaauuacaggauuauuuuggaauuuaacaaaauuguaugugaauguuagcuuugccaaaaugcuauauaaauuguagugauuaauaacugggguaauugugcuagcugguaguggccaugguaacaauuuguaagaaauauggugaugcuagugugcugcuuuuccguaguaaaugagacugagacccagucccgcccucccgcuuuuacuuugaucaacaacaugugcugcuguucagucaugguuuucuuugugaccagguucagcauuucggaacugggcaucaagaauggaauggaaacuuugggcaucgaagacagcaagcauauauuccuacuaguguuaccaguaauccauucacgcuuucucauggaaguccuaaccacacagcaguacaugcccaucuggcuggaaguacacaccucggaggacagccuacucugcuuccauacccaucaucagccucccucaguagugcugcacccguggcccaccuccuagccucuccguguaccucaagaccuauguuacagcauccaacuuacaauaucucccaucccaguggcauaguucaccaagucccagugggcauaaacccccgccuguuaccauccccaaccauucaucagacucaguacaaaccaaucuucccuccacauucuuacauugcagcaucaccugcguauacuggauuuccauugaguccaacaaaacucagccaguauccauauaugugaaaacucgaaagcagucuauugaggaagcucaaugauacaaacguuugauuaaaaauaaaaacaugguauuuaaua

SEQ ID NO: 956 - RNA, 1906 nt, Mus musculus
uuuuuuuuuuuuuuuuuuuuuuuuuuuuuuugugaaccaauaaagcuuuacuaggcuuauguucaggaauaugggugagggguuuuucacgggaguggaaaugacucagacagauagagaaccaaggcugucacagugagagaauucccaaccacugggcucucucuccaacucccuacagugagagacuuccuaaccacugggcucuccuccagcucccuaguuuguuuuugucuuugaggcagggucuauguagcucugguuggucuggaacuugccacguagagcaggcuguucuuaaacacauacguacagaucuaccugccucugugcuaggacuaaaggccugugccaucacaccuggcccacuuuggguuuuggagacaggguccagugugagccagcaucgcuucccacaccuuauguagccaaggauaaccuugcacuugugaucucccaucucucccucccuaagcuggccuguccuaagcaagcuaaacgugugcauacucuaucuggaguggauccacuccgaacuguacacccuaaauacacgugcaaggucauguggaugacuacguaagccaacacacagagguaacugggauacgggcacccguggaaugugcaagaggagccaagaacaggagcauacuccauaggccccgcccucaagagaugcggcuggaggaucaggaguucaaggacagccucagcuaaggaucuaguuugaggcuggccugacuuagagagccugucuggauaaaaaaugcagcagauaaaaagaccugaacuaggaaacauggcugaaucucauugacaacggugagugggcaaaagaaggcucugcuggccuuacuuaucuuaaaggucucauuacuaauuuaucauuaguguguaggacugugugcuuccacccaaauguggaggucagaagacaacuugcaggagucaguucuaucuuucuaccacgagggucccgggaaucagucaaauuaucgugcccguugccaagggaucuugccagcccugaugacaauaaugcuaguuucuaaaaagaaaaucuacauuuuucaggucuuugaaucugcaccugucucugaaguaaguaucccauccaagggagacccaggaccagggagguugucacaucccaaaguuaaggacuggcagcacuugaaccuuuuuucucugggcugagcuuagaagccugggcaagccauggggugaccuucaucucuccacaggguaagaaacucacugaccacucuguccuagggcucaguuugcccaacucuaggcuggcucgaaggcagcaaugcugucccaagcauuguugcaucuggcugcaaccagcacugugcaggaaaauaccgcuuaaguaaugccagauguggggcaucggccucugcuucuuucuggguuucaagggcacacaagcccacaacugccauuggcuccaagaggguggcuaaagaaggcagcaguauccagaaacaaugcagccaaguaggcggcuuccugggcacugggauccucugcgagauauucuuccaggccguccaggaguagaagggauggaguuggugcuggggcuucaugggcagaggccagcagcuggagaagcucuugaauugaggauggguacuggaaucgaaccuucuggagccgccaauacucucgcgcuguggguguacugagcggcaggcucugaaggggccuucgcaucacgaagaggacagacccgcagccuuccccugccgccucaagggcggcugcaaacagcagcgacgucugcgcagagcgcggagcgccgagcaacagcaauggcggccaggcaacgccauccucuccaggccuugccgcccagccggcauccagcacccgccucagcgccuccgccauc

SEQ ID NO: 957 - RNA, 75166 nt, Mus musculus
cacugucccggaagugaauacggaagcgccucacacccccucugccggcuggggcgcagccauuuuaauucaaaucugagugggcggcggcggcggcggcggcggcagcggauuuggcggcggcuuuggcucugagggacagggguaguguuccugguuuuggugggguuugccuuuaguuuaauuuuccuuuucuagcuucccuuugccggcuggugcguacguuguagucccccgaggccaugucaggagacgcagccgcggagcaggugaggaacgggagcgguggggccucguggcgaccucuucucucucuagcccugugggugcgagcaccccguucgcgugagcaagggcccugaagagcuagugagcccggggaucgggagcgcaucccccgaagucucccagguuugggcuucucuguggcguucguacgaauaaguaugggacuuagacaauggcagagacgucgcuucgcccuggccauugcaguuucuucggucgggacgguguauuucauaccacuuuaguguuccgguagucccagauuguucuaacguguaucugcgcuggcaguguuuuccucgucugccccccaguccucuguccccagaaauaacgaaaucagucuggaaaauucggcccccgagagagcgaagguaaaaagagccacggcucuuccgagcuuugggggaauuuuguggauucgcuuucuuccccucucguuuaggaacacuuuauuuuugcuuuuacgaccacgcaaacauugcagaauuugguaaacugaaaacucgaaaugugcuuuagucacuguaggcaccaucuguuuggaugguuagauaugaaugauacauaaguauuuuacaaaugggacuuuuagauaggagaucucacccuuuugcuguuuggcuguuuguuuguuuuggauagguuuucacaguguagcccugacuaggcaggaccuucugacaggauugcuuccuuggccuccaggcguccaucuccauguuugguucuuuugcucuuuuauauccuaaauuuuguaggcuaguguuuggcuuuuacuguaaaaaacaaaacugaguuuuugaaagguguguguuuugaucuugauccacguauauuuaguuuuaaaagaaaacaaaguccuaaauuucuuauugcuauagcaaugaaauacgcuuguauuuuuauuucuuuucuuuuucccaaauccccagcuaauaaaauagaaauuauuggagguugacagaugagguaaaauaggacuguauguuaaugaaguguaggcaaauuagaacuuaauuacuuuggugacugaaacgcuugaggaccaauuuaauuccaagucuuggcagugcuuuugcauuuuaucuaaagucagggugcccacgaaugcagugucuuugaacuauuuuucuaaaacuguuuauuuuacucuacucuuaccgggcuggcauuuuuauuuucugaaagugaaggagugguguugagguuucauuggaugugucugaaauucacuguuuuauauaaauuuguaaagacaaaaauuugccaugcuuuuguuuuagaacuaugcggguuuuaguuuuuguugugggucauccugcuccaccccagcuagagguugaaccccgggccuuaugcaugcagggaagcaaucaaccacugaguuaaaagccuuaguaacacagugugugauguuuucuaugagaacugugaugagacuuuauaaaccuccauucuccaaaccccuuuuauuuugacaguugccccuauguaggccuggcuggcauggaacuugcuacauagaccagucuggcuuugaaccucugccuugcugagugcuaggaguaaagaugguacaugcacaucuagccuuuuuuuuuucuuuuuuaaucuaggaguacugugcaacucaggcaggucuugaacucauugcaaucuuucagcuucagcaucuguaacaggcauuccuccuuugaauuuuauugugcaguuuacaacaaaaguugaagggaaaacucaugaacacucauuauaauuuucaccaaauccagcaggguuacagguuuugucugucugucugucugucucucucucucucucucucucucaggguuacagguuuugucucucucucucucucacacacacacacacacacacacacacacgaguguauauauauauauauauauauauauauauauauauauaguauugcaaguauguauucauacacauauuucuuguggcuuaaaagcuaggaacuuccucauauuaggcaagcucuacuauugacauauaccucuaaccuugacauauuuucuuucuccauacacauuucuuugaaaguugacuuaucacauuucaguccaaacuauuucaacauucuuuuauauaaugacauuaaugcuuuuauguaacuaccauaccauuauccuacucaaaaucuaguaaugccuuauuggggagugagggggauugcuuuuguugauguuguuguauaacagcucuuggaagaucaggcaaaccuccaacucagagaucugccuggcucugcuucccaagugcugggauuaaaggcauauggaaccuauccuggcuucuguauuauuuuuuugagauagggucuuguauacuuugagggcaaacuggcucaguuuguagcugauaaaugaccuugaacuucaaccucccaaguacugaucauagguucuuuccagugcaccuggcucaauaaugauguauuucuaacauguccauauucagauuugccauugccucaagagugugauuuauagggcuauggauguugcacaguugguaagagugcuugugucacacgcacaaggcucuggaauccaaccuaaguuccuaagcacuaauuaagccaggcuuugacaaaagaccuguaauaccugcacucaaggaguuagaggcuagaggaucauaaguuuggaguuauuguuggcuacauaguaaguuuaaagacuguaugagcuauaaaagacuuugucucaaaaacaagacaaaacaaaaaacaaccaaacaucaaaauauaaucuagguaaaccacugaauccuguauuuauguaauugcuuaucucauaaacaaucuguuagacuguaccuucucaccuauguugucuguucgaaaagacaguuaucauuuugggauuuuguuaggggaauuuuugauggugcuauuuaauauaucuuuuacucuauuucucagagaauguauaguuaggucuauucuccauuuuaguaguuuugaaagguuaauuccuggauagaauauaguacaagucauuuaaauacucuuguaaauggauguaugugagagagugugaguguguaugugagggcucgugugcuuggacuuguggagcucagagggauaaccuuugaaaguagguuuucuccuuccacucuguagguccuagagauugaacuaaggcuugaugaccuuuacugugucauuuuuugcuagcacaaaaguucaugugugguagcauauaguucuguauucccagaacucagguugagacagagaggguaggagaccguuguggaucauggagacccaugaagucugaucccccuggagcuggauacagauacuuguaagccaguguagaugcuaggaaccaaacuuggcccucuggaagggcaauauucacucuuuuaacugaugagcccuuucuccaaccccauuuaaaaaauggaauucugucuacaaagcaaacaaagacaaggaagcacuuuuucugauuauaccacuaccaaugauagauaauguuugcuuccuugguuguugugaugauugccacaugucuucauuggacuguuuuucccuauuaguaaccuguuuugauacuguccucaggaaccaucaguugacaaauaccauccuccugccucugccuccuggguacuagguuuacagggggauguguuaccuggcuuuuuuuuuuuaauguguuuuucauuuuuguauauguaucacguguacuccaagaccuuagaaggggcuuuuugauccccuagaaauggaguuacaauugugagcuaccauuuggguauugggaacuaaaccuggguccuuugcaagagcucguaaccacugaaucauacccccagccucuuagucccacuacagauuuuacaugggaaggaaggaaggaaggaaggaaggaaguaaaguguaguguauuuaucauagagcuuuuccuuugcccucauugcauugaaguaaaucucaguugcuguguuauauuauauaacuuuagcugaaguaguaauuacaugauacuuuaaaaguguaauggguuuuaaaaugugaauuggcugaacaguucuuaguguuuaaaacaauggccagugaaaaucuggagaaauuaaauacuaaaaugacuucauauuacuggaaggaugguucgcuggguaagagggcucucuauaauuuagaagacuggagucaguucuuaaugcuuacauaaggaggcucacaaguaccuguaacuccaaccccaggggauccaauguucucuuggucuccuugggcacuuguacacaucucaugcacauaaaugaaaacauuuuuuuaaaugacccuuaauuauaggugagaaaaaccuaaauagaacugaagacuacuaagagacaagcugugauccuagcauuuaagagacugaagaaggaggaacuugggguggaggcuauagucugaacuauacagcaagucuuucucagaaaaaaaaaaaaaaaggaagaauaagaaaagcaucguuuugugacuguucuguuucuuuugaggggugugugugugugugugugugugugugccugccauauagaccaagcugauuuggaacuuguggugggacuccugcuucugccugucuuuuuuaaccagaggagucaugagucaguguuuuucugcuagugaaaaauagcuugcagaggcuagagaaaacaggaaaaauauaaugugguacacuucuuaaugagaagaagguugaaaaaucuuuacaguauuauccgaaaccuaguuuauuuuauuaguacuuagaaucuguuuaaaaguaacaguguuaccaaauaauguaaaagucaggguagauaugaggggagaagauugggaagaaagcaggauaaugaaauauaaauauguuggguaguauauuuuuuggacccaguuauuuuuauauguauaauaaaauuucuccguuauaaccuuucuguguuccucuuguuuuaaaugauuuuugguguaaaacaauuuugaguagguaaauugguuugauuuuaauauuuaggaaaaccagacuucuacuuuauuuggcaguaauuguuucuaaggguacuagaucuguccuuuguucuguuuuuuguuuguuuguuuguuuacuuuuuagaguuacagcaaaaaggaacuuuuuuucuuuuucuuuuuuuguuuuguuuuuuuguuuuuuucaagacaggguuucucuguguagcccuggcuguccuggaacucacuuuguagaccaggcuggccucaaacucagaaauccgccugccugugcugggauuaaagucgugcgugcgccacuacgcccggccugcacaaaggaacuuaauagggauuguaucugcucuuucugaauauaaaggaaaauauauacuagguagaauggcaaaaaucaguguucagguguuuuuauguuuuacuguugcuaaaagccaguucauuguuuuaagcuuuuuuacuauaucccauagcugcauuuuucccuuaagacagaacccaauuguaaauuugggucauuuugucugggcaauuggcaguuguaugggaaaaacucuaaaaggggaucagggagguuuuacuuuuuuuuuuuuuuuuuuuaauuuaguuauagggugucuuuauagucgaggcuagccuggaacucuugggcauugaguacuggaauuucaaguauaugcuaccuuacccagcuauuuaagcuauuuuugauuugagaauuuaauucuguaaauauugaauaaaauuagaaugucaagauguagauucuuuaaucuaauuuucuaauguuccucuuaaucuagugaacuaauagcuuggcuacuuuuguuugaaagagccuugauggucaaauuccaaaagguuaaguuuuugcuuuuuuuguuugcgugucuuuucccgccccuccccuccccuccccuccccuccccuccccuccccuccccuccccucaccuccccaucaaaagugcuggaauuaaaggcaugugucaccacugucuggcuauuuauuuuucuuuugaggcagaaucuuucuauauauuccugauaggccuggaacuuacuguguagacaauguuuuuggaagaagguugcagagagaaaugacuucaaauauguacugugcaguuuucuuacuauuuuagcaaaaauucaguaaggaucauuuggguuugguacuaccuuauauuuuuuagacucaugauauuuggaaaaguauuuagaaccaauagaauagauaguaguuauguuuuaugaugucccugaguugauuuuugucauuauauugaacauuguacagugaacaugcuuacacaagcuauauguuacaucaugggguuuugagauaggaauauauguauacauauauacauauaauaccuaggaguucacugguguaaguuaauggcuaauggcagaauccuauuaacuuguugcucuaaagggcacaauugaacaaaacagugaaaaauaaagugugcaagagcaaaugaugcaguaaggagcauugcuguuagaguauguuagaguacuugccuggaauacuaggcauuaaguuuggaauccagguggggauccaaaaaucuauggggaaggggaaaguagaaagagaacggaagcugcuuccuggccuaauggggcauacugguugguguuuuccauuguguuagggguagaacucagggucucagacacacuagucaugcauucugucuuguuggugagacagggucuuacucuguaaccuggauugccauagaauaaacuguguaguuuaggcuagucacaaucucagagcaguucugccucacucagucuccuaaguacuguuauaggcaugaaccaccaugcuugaauaauacuguuguauacuaaacuuuuugacauggucuggcuauguagcugauguugcccagaaacuccugauuuucuugucucagcuuucuaagacagggucuaacuuuguagccccagcagacugcagagaugcaccugccacugccuuuauaguacuuauauuaaagguaugcaauaccauaccagguucacaccuuaguauuuuguuuguuugagacagucucacuuuguagcucugggugguggccuggaauucacuacaagaccaagacauuguaauccuccugcuuuugccuccugagcaugcaccauguuugguuacuccuuacuuuuucaguuuuuuuguuucuuuuuguuguuguuugauuggcugauuuuuggguuuucaagaccgugcuucuugguagcuguggcuguccuugaaauugcccuguagaccagaccagccaggaacucacagauuggccugccucugccucugaauauagcauuaaaggucugugcuaccaccauacuuugaggguuuuguuuuguuuuguuuuguuuuuuaaauacuaaaaacaaaugaguauguguuauucugugcuauuuugauuaaaaauauaucuaaguauuuaaggcagcaacccaguuguucuauuguacuauguguuguuauaugugcuagaccucuguuuacacuagccagcaucacuuugaacaccagcauugaaacuaaugaucaagaugucacuaaacucaaaaguggaauuuuucaacaucauuauagaguccuuuuugauaugugacauugguuuaaauacuauaccauauacuguuucuuauaguugaguuagggagucauuuuugucaauuuuuuaugugcuuuaugaaaauacaggugucugugugacaguuuucagauugcuaucucugauucuauugauagacugaaauuuuuuacuuaaaauagcuacuaaaaagagaaaugggcuggagagauggcucagcaguuaagagcacuggcugcucuuccagggguccugaguucaauucccagcaaccacauaguggcucacaaccaucuguaauaaugagaucugaugcccucuucugauguguucuaagauaacuacaguguuuucauauacauaaaacaaauaaauaaaucuuuuuuuaaaaaagaaagaaagcauguacuugaagugauuuuaaguaaauugaagcuugaaaaccucagaauuuuagggaggaggauuauuaccuuaaauuuauucacuagcucacacucuaugauagucucaguauagaaccagcuggucuugaauucagguuuuuagcuucagcuucugaagugcugggauacaaguugaaccaccaugcccagcaauuaauugcuuuuaaguauauacuugauaaaaaugaguaguaaaacuacaaaguauaugaauaguauuuuacugauuuuccuucuuaacucucccuaaauuauaguuaauacauucaauaauggaaaauacuuuaugagaauugugguucaucucugcuuguuuaguaggccauggaaaagaguuuauuuuccaagcauagguuuaacuccuuaaguccccaucccuucuaaaaaccgauauccucuuuuaaaaaaaaaaaauauauauauauauguguguguguauauauauauauauauauauauauauagagagagagagagagagagagagagagaagggucucuauguagcucucccugucuauccuauccugaaauuuacagagaucuacuugccucuguuucucagguacugggauuaaauaauggcuugugccacuaugccuggaucauuuauauuuuuuaaagcuuuuguuuguuuguuuguuuuuuucgagacaggguuucucuguauagcccuggcuguccuggaacucauuuuguagaccaggcuggccucgagcucagaaaucugccugccucugccucccgagugcugggauuaaagucaugugugcggcuuuaaaaugcuuuuuaaugauauguauguguguuguguauauuaguacaagugcuuucagauguuagccaucagaucccucuaaagcuggagugaaaugccugacauggguucugggaauugaacuuaggacuuaugcaagaacaguaaguguucuuaaccacugagccaucucuacagcucccccccccauuuuugauauguauuacuuagaugaagccagucucuuguuuucagaucccauuacagaugguugggagccaccaugugguugcugggaauugaacucaggaucuucucuccagccucacacucuuuuaaauuguguguacacauauagcccaggcuggccuuugaguugcucagucucccaaguguuaggguacaggugugagcccauuugcuugccuaaauuaauuucuauuucacuuuucacuuagacccccuauguaucagccccuccaguuuacccugaauaauuuuuuggagaaaaacucuguccuccugucucuuuuaccucccuaguacaaacagaaaaauugcauauuuucauuuauuuuuguuuuuaugaugcugggaauuaaacccagauccucauucauaggcaaaugcuuuagcacugaguuauucuuuuuauuuuuuuuuaagauuuauuuauuuaauauauguaaguacacuguagcugucuucagacacuucagaagagggaguuacagaugguugugagccaccaugugguugcugggauuugaacucaggaccuucggaagagcagucggugcucuuaacuucugagccaucucuccagccccaaguuaccuucagcaucuauaugucaauuaacaaccaccaguaacuucaguuccagaggaacugaugcccucaucuuaccucugugggugauguaugcacacaguacauagacaugaauacauauaaggaaagcaucuauaugcauaaauaaagauaaauuaagacaugguuuuuuaauuaauuaauuaauuauauguaaguacacgguagcugucuucagacgcuccagaagaggacaucagauuucguuacggaugguugugagccaccaugugguugcugggauuugaacucaggacuuuuggaagagcagucggugcucuuaaccaauaagccaucucaccagcccaagacauguuuuuuuaaaucagauaggggacuaauauccuauauauauaaagaacucaagaagguggacuccagaaaaucaaauaaccccauuaaaaaauggggcucagaacugaacaaagaauucucacuugaggaauaccaaaugccagagaagcaccugaaaaaauguucagcauccuuaaucaucagggaaaugcaaaucaaaacaacccugagauuccaucucacuccagucagaauggcuaagaucaaaaauucaggugacagcagaugcuggcgaggauguggagaaagaggaacacuccuccauuguuggugggauugcaagcuuguacaaccacucuggaaauccgucuggcgguuccucagaaaauuggacauaguacuaccggaggauccagcaauaccucuccugggcauauauccagaugucccaaccgguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuccuagccaaauggauggaccuggagggcaucauccugagugagguaacacaaucacaaaggaacucacacaauauguacucacugauaaguggauauuagcccaaaacuuaggauacccaagauauaagauacaauuugcuaaacacaugaaacucaagaagaaugaagacugaaguguggacaccaugccccuccuuagaauugggaacaaaacaccauuaaagggguuacagaaacaaaguuuggagcugugucaaaaggauggaccaucuagagacugccauauccagggauccaccccauaaucagcuuccaaacgcugacaccauugcauacacuagcaagaauuugcugaaaggacccagauauagcugucucuugugagacuaugccggggccuagcaaacacagaaauggaugcucacagucagcuaguggauggaucacaaggcucccaauggaggagcuagagacaauacccaaggagcuaaagggaucugcaacccuauagguggaacaacauuaugaacuagccaguaccccggagcucuugacucuagcugcauauguaucaaaagauggccuagucggccaucacuggaaagagagacccauuggacacgcaaacuuuauaugccccaguacaggggaacgccagggccaaaaaaaaaaaugggaauguguggggagggaaguggggaggguaugggggacuuuggggauagcauuggaaauguaauugaggaaaauauguaauaaaaaaauuaaaaaaaauaaaaaauaaaaaaaaauacuugucuuacuugagagccgaggcucaagcaugggcuuuaagcuugcuagacaaauguucuaucuacuacuaagucgcaauacccaucuccuuuccuucuuucaaaagaaauguuuuauguuuaugaguguuuugucugcauguuugcugguuccaugucuguguuggugcccuuggaagccagaagaaggcaugggauccucuggaacuggaguuaagagaugguuaggagucaccaucccgcgugcugggaacugaacccaaguuuucuggaauagcagacaggacucuuaacgaaccaucucuucagccccucaggugcuuaaaagaucacccagauaaauaauuuguugguuggggaguagcucaguaguagaguuuuuacugacaugcacaguaccuaaauuugauuguucuguguauaaaacaaucacagccaucuuuuucuuguaaaaguacauuuuuauaaaauacauagugauuuggcgggaguaggggggguucaagacaggguuuuuuuuguuuguuuguuuuugguuagcucuggcuguccuggaauugacacuguagaccaggcuucugaggucaguacuuugaauauuucaaauucauuuuuaauuucuaauauaagcauugauugagaaagccuacaucuguaagaagucucuuuguauaucuuggcuaggcagagugaguacuccuugggaugcagaaguaggugggucuugaacuguauagccugggcuauacaguaaaaugcugucucaaaacaaagaaaaaaaauaacaauguacuuuuaaaaggguggauuguauggcaugugauucaugucaacaaaguuauuacuaaaaauaacuuauaaugaaacccgauaauuaauauaaugcauaauauacuuacuauaaccuucauucuuguagucaauuguaauauacguuguuuuuuuuuaauguauuuauuuuauguauaugaguacacuguagcuguacagauuauugugagccuucaugugguugaugaauugaauaggaccucugcuugcucaggucaaccccagucgcucucucagaaagauuuauuuauuauaaauacacuguagcugucuucagaugcaccagaagagggcgucugaucucauuacgggugguugugagccaccaugugguugcugggguuugaacucgggaccuucagaagagcagucagugcucuaaccugcugaguuaucuugccaaccugugauauaaguuguuauucauaaagaaaauuaaaugauggauagagcuaugggauuuaguuuagcuuuuguuguauuuauuuaguuuagugcuccuacccuucuuguuuggcacuaguguugccugaacacaaaagcuggaauuuggaacuuuuuuuuuuuuuugagacaugguugcacuauggaguucuggcuguucuggaauucaauuguguaaacaggcuggccucaaacucagacgcaacugcuucugucucugaagugcuugccacauguucaaggcuacauguucuuuuguugagcuguguaguugcagccuuagucucuauugagucugugauaauuaacuacugcucauucaaacaggagcuucucugaccaaaccuggcaguagcacuaauauuugggcaaaaccauaauuauuuagagagcaguuuugauaaguagauuaugcccauuuagcaaaaacaguuguagcuuccucacaaaggccugugacuuuacuugucaugucuaugacaccaugucucuguuuugcauauccuaggaaacaggaguuuuccuuuguuccauagugugacacauaagccacacuaugccugugcuuaauguuacaagaaguuaguuguaaguagcuaacuauuccuuugaggugagugcuggggucugaacaccaguccucaugaaugcaaagcaggacaaacuuugaacaaccauuuccuuaaccuucuuuuauuugugcuuuaguauuaucauuaucauuaucauuauuauuauuauuauuauuguguguauguguggugcucgugaaugguauguaauugugagugcauaaaagucaggacaacuuuucuggguuccagguauugagcauagguuaucaaguuugcaauauugccagccugcuuagugccuacuucuuacuuaauuuuaaguguuuuuguuuguuuuguuuuuuguggcugugugguuauggguguuuugccuggguguauguaucucugugcacuaugggcaugccuggugcguaagaagaucagaagaaggcauuggaucuccugaaaguagacuuacaaauuguugugaggcucaauacggaugcugggauuugaaccauuguaagaguugcaagagcuccuaaccacugaaccaacuuuuaggcuguuuuuaacccaugauuugaggccauuuaggaacuuuuuuuuuuuuuuuuuuuuuuaaaucuuccagucuuuguuuuuauuuuccguucacucuacuccccaugauggggucuuacuucugaagccuggggcuuauaauagaucugccuuccaaguccuggggauuagagguguguguaaccacgccugacuguaauuacuguuuuaaaguuaccucaaaacaacacuucuugguuauuuaauugcuuuguguauauuuauguguuuuguggccugguauguucccagggaggccagaagagacugucagauccccuggagcuggaguuacaggaauuugggaagcaugugauuguagguguaggaucggaaggauuggaauguggguccucugaaagcagcgguugcucuuaauugcugagccauuucuagccugcuugguuuuguuuuguuguuuuuuugaggcaaauucuuucuuuguagcacaggcuguccuugagcgcauugucauuuuuuuaaccuccuccguucuaacauugcaauuaugagccaccaugccccucuaaauuuuuuuugauuguuuuuucaaguaguaaaccuuuugaaagaauucucuacuuugucaagugcagguacuccuucaaauaacaccuagaauauacuucgcauugagcaaauauuucucacguggauagugaaaauucagaguucuaaggguaugguguccuaauaaguauauguuauguauaugugcccccugccagccuaaauggcgauuguaauguguuacuacuuauacuuaacuguuuucagugacuccaaauuucauaauuugacugauucagacauggcuauuuaaauuauuagucuuauauaugagccacuaggccaguagcugacuguuuucuuguauauuguuguauaguaguuuaaguugcuagaaaucagcaucagauauucuuguuagauuuuggucaguuuggucugcuucagaauaucaguguuaguuaguuauaugacauuucauuuaucccauugaauaaauuucauuuguuuuggguuuuuaaaaaguuauuugcccuuuguccaucagugguuccaggugaacacaggcuuucuuuacucuaggcagucacucugcuauugaacuauuuaccuggcugcauucucucuguuuucuuuuuaagucagugggcuuucacauuauugacuggacuuuaugcuaguaagcuuaguggcugcuacugcccuuucauaugugcuccccucccacacccgcccuucugaaaacuucauuuuagagacaaggucuaacuguauccuugacuggcuuggaauuugcccuguagaccaggcuggucucaaaagccuacaaagauccucuugccuuugccuucugaguucugagguuauguaccccaugcccgccuguguguuguuuuucuuauacuaauuuaaaacuugauguaguuaacuuuauuuaaaagcuuaugaaaaacuuaagaugcaucucagaauauuguguaguucuguguguguguacuaaagauggaccccaggguuuugcaaaucuaaacauauguuuuuaucacaagcaauauuuuuaacccuuguuuuuauuuuuggggcuuuuuaaaaauaauauaaaaagauuaacuauuuuggugaacaaaaaaguggaaauuugacuuuaucuugauaaaauggauuccagcuuuuuuguuuuuuuuuuuuaacauuugcuggaaaucaccauucugauauaaaaugcuaucucuauuaguguuuuuccauauauuuccauaguuuugggccauauugguucagugauuaauuuguuaccauuaccaaauuuuaguuguuuuaauauguggcuggaguuacuuuucuuaacacuagucauaaagcucuuauagauuaguaaaggguaauuuugauuuagauuacagaagucuuagaauaucuucaagccagugugguggcucauaccaguaaucuuagugcuuuggaggcugagacaugagguucaccagcuuucagugccagccugauuacagagugagauccugacucaaaaaacaaaauauauaaauaaaaauuauuucuaaguaaauucauaucuuucaguaguuaaggcuauuuuauuucuaagaagagaguuuauuucucacaggcaauuuuauucuaaaaggaagacuuuuaaauuuuuuccuagauuguugcuugacugaauuauuucucaauaauucacuuauaaaaggaagcagugccagauauauuggcguaugcccuuuaucccagcacuuaaauccuggcagaggcagguggaucucugugaguucaaggccagccaaccuagucuauauauugauuuccagggcauccagagauuaugcuagcauuuguagauuucuuuugaguguaauuuuucauuuuaguauguaggaauauuugaaacaauuugugaaauaguauuuguauucaugcugcuugguacuaggugcugcuuuuuucguucauuuuuagauaucuuuuuuuaguguguuuuucaugcucauaucaugugcaccauguauguacuuuaugccugugcuuuggaacuagaguuauagacaauugugaacugucauuugugugcugaggucugaacccagguccuuuggaacaccagcaaaugcucuuaacuguuaaggaaucacucuagugccccucuuuuaagaggugugggcacgcaagugugcaaugcuaggauuugaacuuagggccucagauguuuggcaaguucuuuaacaauaccagaaaacuauacucaaagcacaaagaaaauuuucugcaaugaaacuaaaaccagccuauuaaaugacugagaagaguuggggauacaugaaauuaagugguaaaauacuugucuaacuauauguaaggaccugguuauuaaggcuccggggacugggguggggaaguauggggauguuuggagaguauaaguuuuuaaagauuuacuugauauguuuauguguauaucugcauagguuuacauguaucucauauauuuaaggugcucagagaagccagagggcuuccuauauccuagaaaugaaguuauaaguaguugugagucauucuuuguggguucugagaacugagcucagguccucccuaagagcaacaaacaaucuuaacuugugaacuguuuucugguuuuguuuuuaagacagggucucaccuuguaucccuagcuagccuagaauucuuuaccaucuaccuucuuguaccuccuaagugcugggaucaaaggcauauauauauauauaccacuaugccuaacuuggcucuaauaccaccaucuaaaugggaucaacaugaguaucaguuucuuuuuaagacagguuguaauucaugcucuucuauccucagccucuuaugugcuacaauuacaaauguacacaucuaugccugauuuaauauauuuuaaguucucuguucauugcauucaucuuuauauguaacacacacacacacacacacacacacacacacacacacagccaagacagugucauauagcacaaucuggcauagaguucgugcaaucaaggauagcuuucugcugcuuuuccuguuuccaccucuugagugcuggaauuacugguguguacuaucacacccaguauauguggugccugagacuucacgcaugcuaggcagacacuaaaaauaaagcuacaucuuaaucucuuuuguguaguucucuuuaugcuguauaaacaaacuacaaguuguauccuugaacaaaaaugaucacucacucuuuuuaugcaguucuggcuguccuugaacuugcuauguagaccaggcuaaucucccucaagagauccuccuauuucugccucuucagugcugagauuaaaggcauguaccaccaugccuaccuguaacuucugauaaaauauacuguucauauaguccacguaaugccuucuuuuuaaaaugacauucuaggggcuggugagguggcucaguggguaagagcacccgacugcucuuccaaagguccggaguucagaucccagcaaccacaugguggcucacaaccauccguaacgagaucugacgcccucuucuggugugucugaagacagcuacaguguacuuacauauaauaaauaaauaaaucuuuauuaaaaaaaaaaaauaaaauaaaaugacauucuaauacuuugcauuaacauugaauagaugugcuuguucuugacuuaauuggacauauaauuucuaaagcaguaacuucaguuuguuauucuucuuuuucccccuucaggcagcggaauaugucccagagaaggugaagaaagcggaaaagaaauuagaagaaaauccauaugaccuugaugcuuggagcauucucauucgagaggcacagguuuagugauauaggauuacauuuccuucucuauggguccaaucacacuacuugguucugcaguaauauuuuuauacuccuaacauuguaaaugcuguuuauugguuuucaauuuuagaaucaaccuauagacaaagcacggaagacuuacgaacgccuuguugcccaguuccccaguucuggcagauucuggaaacuguacauugaagcagagguuaauauuuuauuuauuuuuucuuauauagcaucugauggcaauuacagcuuacacuauagugacagaaaagaaguuaggaacauaguauaaucaggacaaggaggauuuaaaugucucugccuuuauuuuguaaaauagguaugaaagaguaauuaaaaugacuuugaaauuugggucuuucacaagcugaugauuguugcauuuuggaguugcaacaacauuaaaacaguuucaaugguguuggagugcuuuagccuuuuauuuacuugucaugugucaauuuauugccuccugugucauuuauuuagaacucauuugucuuuuccuauaacaaacuaauacaaaaauacagaaauguuggcuuaguuuuauagaguauuauaaaugucuggugaaaugaaacauuuuggagaguaauuauuucacauuauaauuuuaugagaaaugcaugguuugucaguuuaaggacuucaauaauuuaauuuugccauauuugauaaagcuuauauucuacaggaauaagcuaauaugacucaaacuuuuuaaccauaauguaucccaaugauacugauuucucuuuccuuuuguuuguuuuaacuugaagucagacauguuuauguuaaugaguaaugucccauucuugauaaugauuaaagaaaaaaaaacccaaaaccuuauuuuuuaaagacuggaguuaacagucaaagcuguaauaaaguguuaaugucccagugucaauuggcacuaaguaaucacucacagauuauaaauuaauggaauagaagggagaaauagaaauaguuggaauagccacacuaagcuggaaaugaugacauuucuuuuauuuauacuaauuuaugcaguacuuuuaauauuuuguaauauaaauucucaacauaaguacucugcagcucuaacuguagcugaaauuugcucuguggaucucuuuugggccucucuaucaucagugauacugaauagacuagcacaguaucaccuuuggugcauccucagaguagucacaacagccacauauuuauacaaaggcucagcuguacucaacugaagcuguacguaguuuggauuguguuauuuugggggaucagaaauuacugggcaggaacauuuguguguguguguguguguguguguguguguguguguguguguguguguguguuuugcauguuuguguuuguaugugugaaugagacuguaacuuaggaggagucuggaaguuuggcucauaaccaugucuuuaugguuucaucuaugguacccucuggaaccauuuuguuccucuguauauuuaaaucaucaaaguagaugggcuugaaacucaguagaccugucuugaguaugcugaagacaaugcugcuuucuacugccugauaaaaccaagaaccugaaucacaugcacucguuuuaccuccugaucuugacuuuacaaacacauuauaguuuguauuuaaaacucacaagaaucaagcaugauuaugaucgaaagauaauuauuuuuggaaaacaaaguaggaccuucugaguuaugaaauucuccaaaauucagaugcuaagucaaacugaaacuggcagugagguuuuaugucuguaauuauaaacauaaaaaaguuuguuuuuccauccccauuucuucccuaaguauaaaauacaaacuguauucugaaaagaauugcgagagagaaaguagacauuauuccaagggucugaaaguuauugaaauaacaguuuguuucauaaaacaguucagagcugcuaggaggaguugccugguuuauuuaauguuugcagcuauuuacacucagacacacauacacacacauauauguauguauguauaaauacaagcacaaaaaauguguauguauaaaaaaacuauuauugagaaaaaaaugauaccaaauauauguguguuugcuuuuuuuauauuucugguuuaggauuuacaauguuaaauuaaaugcugguuucagaaauaccuaagcugucuuucucuuuccugguuuacucuucuuuucacauuuaucuuuugacccacacaagaagcuaaaauuuucuuugaucaugucacucagugugaccuuuauuuuuguugaagacauauaaccuauuuacaguacuuauaaugcuauucuauacuguuucauaacauccuguaugcacacucaagaaaauaaagcuuuguuaauacguuguuguaacucgguauuucaugguguggcaauuaugauauuacguuuguuuaauucugcuaaacuaaucucuagcuaaauacauuagggguuuuuuguuguuguuguuguuuguuuuguuuuuuuuuaacuacuagaacaaacaucuuuaguaaauaugcuucuuuaggaaaaaugcuucccauggaaguuucuuguaaauucuguuuuaauacagaaagagcaaaagaaaacaguuuaaaaguuauuucaaguuugaaaugugaauuaaaaauaagaguauaucuaaauaggccgggcagugguugugcaccaccuuuaaucccaaaacuggggaggcagaggcaggcggauuucugaguucauggccagccuggucuacagagugaguuccaggacagccagggcuauacagagaaacccugucucggaagaaaaaaagaaaaaaaaaaaaagagggcuggcaagaugacucaguggguaagagcacugacugcucuuccagagauccugaguucaaaucccagcaaccauaugguggcucacaaccacccguaaugauaucugaagcccuauucuggugcgucugaagacagcaacaguguucuuaucuauaauaauaaauucuuuggaaaaaaagaguauaucuaaauagcuauaaaaaagcuuuucucauaucagugacaguauuguauacauuuauugauguaaaauacauguuuuuacaucagugggaucuuuaauuuguuacuuacauguuuguuuuccuguuuugcuacaguuuaaaaauauuggagguaaauucuccuaguggguggacauuuagaaucaaauugaguauuuuuauaaaguuugaaaauuagacuaauaaucuuacugugauauauaauauuuaggaccauuuuuguccucaaaaugcauuguuuuucuuuugccuuuuguaacuucuaucucagaagauuuuagaagaaaaucaagaaauaacaugauagugaauuaucaggaacagugucuaaauaugacugccuaguuuuuauguaaaaggaacauuuuagaguaucugcaucuuuauugacuugccuauaaugucuugagugaauucuagucuucuuuuagcuuaagaaauacagcuuuuucuuguucaguauuuuagggucuuuuagccaggacgagucccagugcucuuuacagagccaccuuauugggaauuuaagcuauuacggaaaugaggaacaugacauaguuuuacuauauucccuuaaauuucucucccuauuugugguuucuguaguuucucacauaauuaggugaucacugugacaacauguaagguacaauauuuuauuguuccaaguaauuugaauugagccacauucauaagacuuugcaaacggaaggauggucucauugguagcugaaggaggaagaaguuaugcugcuggucauagcaaugaugcaccuugcugucuaugaaagcugugauuuaauaaagcauguagagaguugauggcuuuucauuuaaagauuuaaaugugaguucuuugaucuauacuuguuuuuucuuuccuauaaauaguagguuuuaaaguauaauuuuacuuuucucaaaauaaccuuacuuggaaaauggaaaugaacccaggauggaacaugaaugacuuaaauaaacuucuccauucuugauucuguuuuaaugccuuuacauaccacuuuaaauuacuguauuacaauguuuuguaucuauucagcuuuauauagcccuauauuuaaaaaucuguacucuuuagaucuacuuuuccuguuuguaauaaauguugguccaugucugugugauuauucagauuuuacucuaaaacucuucuuauucuauuguuucacaaauucauaaauauagagaaaaauaauaggaauuacuugcaaccauaacagugacccgauaucugaaagugcuuugguuaauuauaguacuguuuuacaaaugaaagaaguauuugcauacuuacuguuacaaauagcaaauuauuuuuguuuuauugcaucuuuuuccuuuuacucacucauugguguagcacucauguuuaaguguugucacuguuauuagcagucuauaguuuuuuucuccugugauccaggcuuuucauacuaaaacuuugcgaaagauaauaguucagauaauaguuucuuuaaauaaaaccuauaauuuguaucaucuaggaaagauucuuuucucugacauuuagccauuucuuguuuuuagguaaaguauucugcuaaaguucuuuaaaacuuucaacuuuaauuucauauuaucuguguguaugccugcucacacaugugccguuacuugucugugaaggucauuagacaauucucuuucuaccaguagggacuaggaaucagacuuagauugucaaaccugguagccaugccaagcaaguuuacccccugagccaucucaucaguccuggguuuuuuaacuuauaaagcagaauuauucacagcacuuaaguggcugaaguaggcauauugucacaagugcuagaguagacagcugcuaguaauuuucauccuaguuuggacuacauugaaaaagaccugugucaaauacucaaaaagaaucugaaaauuaagaaaaggacuaaguagauuuaugauauauguacagaucuaaaauuaacugaacuagaacucagaucauucaauuugaaguuuuccugaaaauauuaguguuuuagccugaauuuacaccuuuguggaauagcauaguauguaauuuuuuuuaacucagaauguaggcauaguccuuugggauggcucaguaguuaauaucagaugggacucugguugaggaguuuaguuucuaguacuugcaucaggaaacucacaacugccuguaacuccagccccagagaauccagugaucucuuuugcauuccagugucaacugcacucaaguguacacaauccccaaacagacagacauacacauaaugaaaauaaaaucaaucuuauuuuuaaaauauuuaggcuuuauguauuaugacuguuuuguauguauguauguguguauguauguugugcaucguguaugccugguguccagaggucagaacaagccaucauauucuguagauauugcaaauuuugugagcuacccuguggauucugggaacaagacucaugucuucuuguugcucuuaaucuccgagccaucucguguguguguguguguguguguguguguguguguguguguguuuuaauuauagaggauaauuuugguauauggguuccucccaucccuagagaugagauaccccaauaugcuaucuaugaguaaacaaaacaguucaguuguuucacaauauugucuauucaacuuccauauuuggaaauagaaauaauuuuagcacacaggagacuuuucgagguuccauaacuaugaacauguagcaguugacuuuuauuaaaaagcaaaagggccauguaaugcccccuuuccuucuguuuucccucuuuaagacaugauaucucagacucuugcaugcugggauuacaggccugggccacauggugauguuuugaaugaacuuugagcugguaggauguaggcacucgcccacaagccuggccgcuugaguucaauccauuacaggcauagucuaccacacugaggugggcuaguuuguuuuuaauuauugcauauguggaguaccacagcauucagagaucagaaaacuugggaguugguucucucccucccacugauuguuucagggauugaacucagguugccaugccuguaugacaaggaauuuuauacucuauugucucugugguccuauucuauucugagacugucacuaugaaacccaggcuggucucagacucuacaguccucccuguccucccaaaugcugacauagacgcuacuaugccucaguaaaaagcugcacucuuaagcguauuacugaacugguuuucucuuagaaaauuccuagcaagaagcaaguaguuggcuaguauaauagguuaaagucuauggcugcugcuccaucuacugggaugcacagccauuugcaaagauagugaauguuugucuuggcugcaccuuguuggaaaaaaaaaaaaauccacccgcuuuucuuaggcccagggaggcuuaauguggguaaguugcuauuuuguauguauuugacuucggggggauaaggguucaauucccagcacccauaugacuucacaauugcuuuaagugcaguuucaugugaucugccuuggaaggucccagggauauagguggugcacagauaagaaugccagcaaaacacacauacauaugaaauaaguuuaaucugcuuuugugucauaaacugauuauuaaauguuuguacuuaaaggggggguagcgacgcuaauuucuccagauugccuuucaaguugugagucuccugccucugcuguccaaguacaaggauuauagguuuagaucaccaugccuugaaaauggaagcuuuuuauagucuauuuuacacuuauuuugaaauuauuuaaucuuaaauuggaugaacaucucaaacacucccaacagauucuuugcguugauuggccaguuucuaacauuuccccuguagucaauuguaggauguuuaauuacauugggagucccgagauugugaacuggaaaaagcuguuucuuguggugugccucagaccuaacacacaccuuuaacccaagagcuuucuguaaacuagaguuaaggucaacaauaggccaagcaaacaaccaguuggcagagugaacuuaagaaaacccaagaaagaaaagaagaggguucuugaaggguauuuaagauauguggaaaaggaauuuuuuugggggagggggaugguggaguaauaaauaguaggcaguuuuacugugagaguuuuacagauguagguugcagaaagaauaagccuagaugcaggugaagauaaagugagccagagaaugagaaagagcagauuagaacauugccaaaguuaguuugaggccaagcagagcaguucagaagaaacugaaagaaguuaacauucagcuuggagaggaauuugagcuaaaacagcugagcuaaacuaaccaguuacgaguugagaaagaacaaacaaaggugagccuauuuaaacugucccagagacugaaaacauccuaggcuuagauaagauuguaaggcuagaagcuuccagaaguaggcguagguuagcagauugaggcaguaagcauuggagauaaccauuacuacaagggaauugaaguuacuguaauagucaucccuugauacccguggagguccuagauuccaaccccacaauuguucaagucugucuuaucuauauaaccuaaauagauuucauuaaauauauuccaauuucucuauguugcucuauuucaugucugaauugccauggaaauacuuauacucuuguuaaugagggacacagaaaauagaaauauucacuaccagugaaauuuuuuuugaguauuuucaguccuuggguacagguauaggauuugcacguuuagagggucauguaaucucagauacuugggaggcugaggcaggagaguaaggcuugucuggucugcaguuugaguacaaggccagucugggcaauuuagugagacuuuguguuaaaaugaauggaauguagcucagugggauuuuccuucuguagccuuggauuaaauuccaaguacucaaaaugaaauguucuaagccagcauugugggcagugcccuagucuuagcacucaggaggcagaggcagauggaucucugauuuuugaggccuaccagggcuagagaaagacccuguuucaaaaauaaaaauuauuuuauguaacauuuaauaagucuuuuccuuuguguuauguguuaugguuagucuaaauuuagcuuuuugaugaauggaaauuuuaauuuuugagauucuuaauuugagcaaagcuggggauuuaaauuuaauaauucuaauuccuucauaugggcucuuaaucauugucuacugagaaacugcgaguaaguaugaaaguagguauguugcagguuaauaauaauacaugggcugcaugcagaguaguggucacgagcacugucuacucugcaauuccagagguccugaguucaauucccagcaaccacgugguggcuuuacaaccacccauaaugggaucugaugcccucuccuggcacacagguauaugugcagauaguacacaaauauauaaauaggcaaaauaaaucuucuuuaaaaaauaauucauuuuuuucuugcuauauuuuauuaccuguguucauguaagacuuugaaaauuuuaggugcacuuaaaaaauaguuuacucaaccacaaaauugcucuaaaagaauuuucagcaaaucuuauagacgcuaucagaauacaauauuuuacaugcagccucaaauucugcuuuauuuuaaaacauuuuauuguuaaauagccuuagcuggcuuuggcuucccaaaugcuaggauuacagaugugagucacuauauccaaccugcuuuauaaaauuuaucaauuucuuuguacuauuacguauacuuuauuuuucaacaucuuuauuguaaauauuugauuucggagaagggugauuacagguuugaaccaccaugcccccuuuauguaaugcuagggaaucaaggaaucaaaugaaggcuaagugaacacucccagccuccuauguacuuuuuucaagugaagauuugaugauuuuuuuucuaaacauuuuucucucauacauugucucucuuuugagacaggauuacuuuuuguagggcuggccauccuggaacuuggucuguaaaacuguggaccaggcuggccucaaacucagauucgccugccucugccuucuagaugcugggauuaaaggauugagccacuaccaccacucagccucucauguuuacuucuuuuuuuucuuuaauauuuauuuauuauauguaaguacuguagcugucuccagacacuucagaagagggcaucagguuucguuaugcaugguugugagccaccaugugguugcuggaauuugaacccaggaccuuuggaagagcagucggcgcucuuaaccacugagccaucucaccagccccucauguuuacuucuuaagauaagaaaauguuauauaaacccuccaagugacaauaauggcuacuuuugagauuacccacuuuuuuuuuuagacgucuuuaggauaugaguuacuagguuuuuaccuguaccugcaugagucuaauuugaaauaguuaaaaagaacuuuguacccaaaggggacagacaggucuuucagggguuuguuuaagucuuucaaagaauuaggagagaauacauuuguuauuuuaaccucagggauuaaacccagggcuuugugcccuacuacuguccccagcuguagauauucuuaacauuccacauuuuuauaagaauaacaaauccucuaauucuguuuuaguaacaggaaucauaauuaaaaugauaccaguguagggaauguaaaauauguuaguauacucaugugucuucuuaccugugccuuauguugcacauaagucucuaccaccauuagguuacccuuuuaauaccugcuuacuaaacaguugucauuauuguuuuuucuaguuagaaauaucuugcaaaauaaguuuuugauaggauaaauucuauggaauauauagugggaauuucuuuaaguuauuugaaguuaaugauagaagccuuuuaaggaaaaaaggaaauugaaaguuugacuucugucuuuagaguuuuauaaaagaguucuguagggaaagagcaccccauauuuauugaaacuauaucagcauuucuaguuacuugacuuuguuucauaccuaaugcagacuccuaaguuaugggauuuauaucugugcacugccauacugacuuccuguuacucuugauuuaugguuuauuaggccucuaaugagugugccauuuuguauuacagagaguggaaaucccuucauacagguacuuuaaacuacuauugaguugguucugaaaggccauuauauuuuacaacuuaaguuguauaccuguacaacuuucaguuuugauuuccaaguuugaaggauuguauaauuuuacuuuuaauguuucaaaguauuuaauggguagaaaauuauguaguaguuaugcuuuaagaagauuaugugacagggcagcauaggcaugguggugagcaccuuuaguccuagcacuaccaucauuugagucucugugaggucaagggcagccuggucuacaaagugaaucuuggacagccagagcucuuuuacacagagauaccuuguuucaaaagggcgggugagguaggguggaggggcuugggguaauauuuuccaagcuuuucaccuucugaauauuuucagggauguuuccuaucuauagguacagaguaaaugauacuaaaauuuuacuccuuuggauucauuuuuacuuuuaaguguuaaaaacuaaaagacuauaaaaaucccuuucugcuuguuguauuuguuuagauugagaaaaacaugaauaucccaaagucuuauauuuugagagacgaaaaauguuuguauacgagcucccaacucaaaaaaaaccacuuugucggugucuagcugauccaucgacacagguucuaaguugacuuaauuuuguucagaaaauaacuaguuucauuugcuguauacauuuuaaaauuuuuuauuuuacauguauggauauuuugccugcaugcacagauaugugcacuacaugcaugccuggauccacugaaacuguaguagcagacaguugugagcugccaugugggguacugggaauugaaucuggguccucuagaggagcagccagugcucuuagucacugagccauuucuccagccucugccauaugcauuuuuagaucuauuuuuauauguagggguguuuuguauuuauguguaaaggugugcaguacccacagaggacaggagagggugugagaaugaaccaccucuucaaucauguaauaugcauuuuauuaaugaaaaaaauauaguguacacugaaaaagaucucaaaggaaagcuaauuaacacauaagcauaccaguuguuauuuuuuauccuaguaucaaaaguugaaaccuagcuuuaaauaaaauccacagcuguuaugaagucuucugaaauaaugugaaugccucuggcguaccugaagaccuaaagggaaccaaaguauggcaugguuaaaauuugaacaacgaaaagcacaggaguagugugguauccaagcuucuaucaaaaagugaagcugaucuuaccagauucuagauuuuacuaaugaugagggagguauuaauaagaauuauacugacuuucuaauaauguuguauuuguucauuuggggauaaugucauacuauaccugagaagcuuggaacucaagccaaacuaaccucagucuugagucauccaucuuccucugccucuaagacccugggauuaaagguuuguccacacuguauagguuuuguuguuguuguuguuuuguuuuguuuuagaaagacuggcagugugugaauacauuacuuaagguaguaagaagcaguaagggguuuuugauuucugaauucaugggugacaauuguuuuuugagauagagugucucuuuuuagcccuagcuaucauggaacuaugcagaccagguuggcuuugaagcuacaaagaccuugccucugccucccaagugcugggguuaaaggcauacaucaccauaccuggcaugaguaucgccucuugaucacauuuaguuacuuuauagaauacccaaaaacauuagaauaaccuggauuauauuccaaguaaguagaaaguauaaaggcaggauuuugaauauaagcuugacuauauauaguauaagguaaaaccuugucuuaaaaagauggggaggggugauuuaugcugggaaauuacaugccucccaauucugaguuguuauuuuuuaaauuagguauauggguguuuugccugcauauauaucuacaccacauauguaccuguugcucauugaggucaaagagggcaccagauucccuggaguuacagaugguuauaagaugccauguagguucugcaaaccaaauucucugguccucugcaagaacaaguguucuuaaccucugcagcuuucuggccccaaaucaugaauuguaauuucuaaaaauuagaauaugacaauaguuuuauuuguauaauuauaaaauuuuauauaguugauucauacagauuuagaaaaaauucugguuuuauacuuaggcaauaaagagacuuugaaaagguguuuuaaaauaacuauauaugugcacacucauaagcagaugaugacaauaucagaguuguuuucuuacucuauguggggcugugggaucaaauuucgguugucaugcucagggccaggugacuauuugcugaaccauuucaugugcuguuccuuuuaauugucuaauaucccuaacauuuaauuuuagagaacaauucuuugacauuuagaguuauuucucucacacucauucaguucccuccccuuaugucuucuucgcaucuucucuucauuuccuuacugaauugcaaggcugucuuaguguaguguauccuucugcuuuagucccugcagucugagauuuuagauauguccuggcuuuagaauuauccuuguauauaacaaagggugggaaguauuuuguaagauuauccauuaaacauuauacuaaccuaaaauuccaaaaacugacugacugugauuuuaagacuaaagucuuuacuggauauaguaaaguuuaucugcauugaaguaaaaauccugagacacauuauaaaaguuuguguucaugucuugucaaaugucaugaguuaaauugcugaauuagaagauaaccauuuuaacuuuuccacaucccauugacaaguuaugacugguacuauguauuuccauaaugccaauauguaaccuaugagugaaaauuuuucaaaaauguauggaaaguacgggccuacgacggcagaucucugaggccaggcugauuaccuaguuggcuaggacuacagaccccgucucaaacaaaccaaacccugcaggauggcguagcagaccauggugccugccacuuagcuuaaugauuugagugcaguuucuggaacccauaaggugaaaggagagaaccaacauccauugagcuauccucugagcucauacaauggcucaagugcccacacucauacauuagauaauuuaaagaucuacauuaauucuaguuuuaacuuaaacacaacacuuaagaguucaaaaucuaaaagaguagcuuuugguuuuacagaaaaacauugccuguguuuaauauuauuuacuuuuguuuuuaaaucuuaaggcuuuuaauccaaaccuucaaacauuaaagauuccaaauugcuggccuuuuuuaguggacuuaauuauacuaaauuugggacuucuauuuugcagaaaauauacuugguuaauagaauuuuguuaaauccuaacuuuuuuuuuuuuuuuuugguuuuucgagacaggguuucucuguguagccauggcugucuguccuggaacucacuuuguagaccaggcuggccucgaacucagaaauccaccuaccucugcuucccugccucccaagugcugggauuaaaggcgugcgccaccaugcccggcaauuuuuucccuuuggaauuucacuauuucaagaauguugcaguaguuuccaagacaguuugcauauaauuugagggggaauugguguuaaugaaguauacuacaggagaguauuaaauaacaaguuaggauacaucuuuuuucugaaguuaagcugcuggguaaaguuuuuaacagcaucuuauagcauugaagaauuguccguaacaaggaauugcaaagagcaaagcuucauugggaggacacggaaaaggaauucaaaggagugauuaaucacugucuugagagcauuugccaaacugggagaaucugaucugcaauuggaagucuucugauaaagaccugcugcauuggagauucaguggcaugucaucuuuuaagaguucugugccaaaaagcuacacugagaacaaaaguggugaaccacaguaagucugugucauuuacaaacugaaaaggaugaaagaagcuucuuugaucugaagaauggaaugggaaaauccugacaugaacagugagaccaauuaaaaaugauguagcaauguuauauggguugaguauugaaaaaaaacaaaaaacaaaaaaaccaacacaucacuuuaaggagacuuggccuaaauugugauacugaugcuagguagccgucauucgagcuuuucugggggagugcacuuucauaggaggccucuacauaucugagauaucgaacacuuuggugguucaaagcuaagcauguaaagaacuugccuguaguagcugcagacuuaguuaauggauuauacaccagugaaagaauaaaggagaaucaaaggaauccauuuuggagcuuuaucagacuaaaaaaaccauuucuuaacauccagaaguaagagagagacaccaaaggcaagcagaaugugaagaauuuucuagaauucuagacuucagccaauagauugcugaugcuuauugaaucccaggaaggauugagggugggggaaagcuauacccagacaugagaacaaaaguuagcagcaacaaaaagccuucagaagugaaugcagaaugucugugaccuucagauggauggucagcuucaguuagcuuuacagcuagaggaagcaagaacacagugggacugccucuucaguuugcugaaagaaagcaccugaccacuuaauucaaauuacuauauggaguguguguguauuauauauguauguauauauauauuauuugccacgguuuauaaaauacuauuaaaaauguauuuuuuuaacauucuuaauaguauaucucacaagugcuaggguuaacagaugagcgauaucauaaccauuuuauaugaugcuggggaucgaacccaggccuuuggacaugcuagacuuggacuuuucugaguuauauucucuguuguuuuuguuguuguuguuguuguuguuuaaucuuugcuguucuuaaguuauguagauaugucaggagguauaugugcacauaaguacagguaccuacagaauacagaaaaggguccuuggagcugggguuagagacugugggugcuggggacagaaagccaauccucuauaagagcauuauaugcuccuaacugcugagucaucucuucagccccuugacuuuaauuugcccuguauaugccacguguuuagguggcugugaugggcagagauugucugaucuagagccauauauauguacugagaauugaacuuaaauacaaacaaguacucuuaacuacugaaccaucucccuaguccaacuucuuggcuuuuuaauaaaagauuauaaauauuuuguaaauauuagguuuuuuuuuaacauuuauuuaaguauguguguauauacauacagugcaugcaugcuaugucuggagaucaaagggagaaauugguuucuuuuaccauguagguuucaggaauuaaacucaggucuucaggcuugggaguaagaacccuuacuuacagagccauuuuacugacccuuguaaacuuuauuugauucauuuaauccaaacuuuguggcaucaagcaaguaacuuuuuguuuuguuuuguuuuucgaaacaggguuucucuguauagcccuggcuggccuugaacucagaaauccgccugccucugccuccuggguacugggacuaaaggccugugccaccacgcccagcugcaaguaacuucuuuaagaagauggcucaaauuucauuuauuuuugaauuagugugaaccccaggcugaccuugaauuuguguuguaaucccagcuagccuugaacuaucacccccccuacaccaggcaucaaaggcuggaaauaugggcauaugucacuauuccuaguuucaauucuaauagauguuuagaagcugaacauaagcuuuacuuuaaauaaauaccauuaggagauggagaaauaccuaaggaguugaaguguugugcaagcaugaguuuagauucccaaaacccaucuucugccagauacaguggcaugcauauguaccugucuaaucucagcccugccaaggugagauaggagguggagcccaagacaauucucagaaguauggguuugcuaaucugauuaaacagugacaaacaagaggcccuaucucaagauagaagguaaaagacuggcacuagcaguugcccacugaccucugcauggauccaugauauagguaccugcauauaugcaugaacacacuaacaugcaugcuaacucuauaaguugaacaauuuuguacauccaauuucagcauuauaauagauguuuuauuucuuuugugcauucuuaaauguuuuuguaaauguuuugagagcugauugacaguauguuuaaugacauuaacauaaaaaauaagaacuaauggcauuaacauaaaaaagaacuaagaacugauugacaguauauuuaaugaauuuaacauaaaagaccuaagcaugaugauuacacuguaaucuaucuacuugguaggcuggcuggaagagccucacuucaaguccugcuuaggccacaaagcaaguucaaggucaggcuuuacaauuuagccuugguguguauguguaucaaaauaaagacaaaggguugagggauauacauuagugguagagugcuugcuuaacuaacaaguuuagucucauguaccacaaaaauauagcaccaaaaaagguauuuaucuccuaaaggacaucuuuagaauacaugucaguaagacgcaaagauccuugaggugcaaagccuuuuucaguaacauuguucaguuucucaagaacuuuaagaugucugauguguuugugugcaugccuucuuuauuuucucccuaauagaugacuauuucauuuugggcuuuuagucugcauucauauguguaucacguguguaccuuccaucaguucuccuggaacuggaguuaccaggaauugccacaugggugcugagaauuaaacccagaucaucuggaaaagcaaccagugcucugaaccccugagccaucucuccagccccaauuguggauacuuuuuauuagcacacaauauacugucuuagguauuuuucuccugugcaugaaaguguugaagugcuuccccaacuugcuuuacugcagguuuuacuccagugaguaauacauuucaccuccaguuguaugaauauagauuaaauucccagaagugugggacuagagcaauggcucaguuuguuaagaacauuuggcugcacuuguagaggaugugaguuugauagccaacauuuauaugguggcuaacagccaucucuaacccuauuuccaaaagguuugacauccuuuuuuggcuucaggcuuguacugcuucaagagcacacucacccaacaagggaaaugcuucaggcugcacucaguacaguggcacaaacagaucugcgcaaaacauuuauacacauuuuuuucuaauuccuagaaauagaaauauucuaucaaaggcucuagaagauuuguucgaaauuucucaaguccaaaugguucuccauucaggcuguuaaaguuuaaaauucuaguacaacugauaaucuuugacagcacccaguuucuuaaguaauuuuuagacaauguguuauuacaccuuuuaacuuuuccaguacuuugggguaauaaauuauuucacauaaugaaauugucaaaauauaucugguaaauuaaaggucauuucagggaaguuuucauuuacauuuucucuuauaaagaagauugaacauauuuuuguauguugagaguccuuucaauuucuuucucugauagccaguuuaucuuaguucauuuggucaucuuuucccccauauuugcacaagcauuggguuagucaaaggaaauuuucaacuuuaguacaacuuuauuagagauuuugaggguuuuuuggaaguggagggugcagaggguucaaauggucucaugcaauucaagcuggccuagaacuuauuuaggcagagggugaccauagacuccugguaaucauucuuccuccuacuucccagguccuaacuuugcaggcauguccuggaggcuuugcuuagaaguucaaaugcucuggcaguauucuaaucaucaguguguuuucauauguauugccuuugcuuguuuuucucaugucaguugugggagggaucaauaugggacuuaagcauacuuauugacauaaguauuuuucagcuagauguuuuauacuuuuuauguuguuggucaaaccccuaaaggucuuucuuauucauuuauuuauuuauuuauuuauuuauuuauguuuuaauuguuacuauuguuuguuugugugugcgcacacaccgacuacacauguggagaguuuggagaucauaggucaacuuuauggagucagaucucugcuacccuuaaguugcugccggaauugaauuugcaguuaggcuuguguggcaggugcuuugucugcugagacaucugaccaacuuaugaucauuuuauuauuaccuuuuaagauuuuuauauuuuuacaauucaacaccagacaugagaagauuucaguguuccugugaaauacuuuaguauaguuuuuaaaguaccugucucugcugguuguuuauaacuuucuuuucuuuuuuuugaugcuggccagugccuaaauaugcuuucccuaacacuuuggguacccuucucuuugggaaaguuucuuuccucuugcacguggcucuuuaucagcugugccccugaccuccaugcuuaacugacauggcauggacuuuucuucacaguugccaaaguuuacagcuuguuugccuugaauuuuaaaauccggaauguaauuguucuugaucuccucccucccuccaaaaaagaaaguuugugagaaagacuuugacuucuugugagacuugggucauuuuauggaaaaugaucgacauuaaaaucaugaugaaaucuuucaguaauuagagaucuuuugaaauaacuauuauauacaaaaguuauauuuugcuuacuaacauuaaacauuucaauucuuguuuuucuauugguaaucaaaugcuaaguaauagaaucugguuuuccaaaaauauaacccacccuauacaaugaaaaucuuaccuguacaauauuugucucuagauuuuauacuuuguauacauauugugguaggacaguggaguauagggaagggucagagaaaugguuuuguacguauuccccuggccucaucaggauuagguaaugacugagaaagagcugcugguacucaauucaauacuaugcaauuuauuuuucuguuauuuuuauuaugauaauuugaucaucagauccauuuuggauucacaaaaaaguuuacauuuccuuuuuuugucuuuguuuuucuuauaaggaaaguuuuuuaguuauauuccacuuucagucucuaauuucuccuuuuuauggcuaagagauguuucuagaacuaaaaaccguuucuauucaguagaaugaaugaguaauggaauugacuuuuauuauacucauguaaauaucuaaaucauggaaaccuacuagauguaagacuccauuaugcaaacuuguaguauagcucaacaguuaaaaagauaccuucaaccaacccugacaacugaguucaauccaugggguccacguggugaaaggaaagaacugauaccugcaaguuguccucucaacuuccauacauuaacauguggcaugucugcacgcauguacaaguaaaacaaauugaagagaguuuuuaaagcuacugucuuaagaauuaaagaccuuauaaugaacuuuuagaaauuuauacauuuuuacauuuccugauguacuuaagacaguaguuuaugacuaugcaugcuaacauaugcuuccuuuuaaauuauuuauuuauuuuuguuuugugugcguugauguuuuuccugcauguauaucugugugagggugucaaaucacuuggaacuggauuacagacgauugugagcugccauguggguguuaggaauugaacucuugugcucugcaagaauagccacugcucuuaaccauugagccgucucuccaguccugugaccuaugcuuuuaauccuuguagaggcugccauauguuggugaguucaaacccugucucaaaaaaaacaaaacaagauauuguauuuuauaaguaauuuuggccauauugcauaaauaugaauguucgcauguauggguaugcagacagcugguagaguuuuaacuauauugacuuaguacugucauacacuguugugggagcuacaagaaaacuuaagaaauccuaaagggguuugugugggggucaaaagaugacuuggaguucuucccauccacuuuguuccugcagcugugcugcugcacgcuucaggcuggcuggccuacuaccuucagguggauucuccuguccccaccucuccuagcacugucccaguauagaauuacaagugugugucacuggcguguaugaguucuagguuuaaacuuguauugcuaggcuuuuguggucggggcuuuuaccugcugagccauuucccugguauucaugguaucucuauaauuacauugagcuguguguguacauguuuuaaucauagcacucaggaagcagcuagaucucuugaguucaaggccagccaaaccuacaaaauaagacccggaaucagaaggaaaaagagaaugaucuugaaucauuuguuuucugaugagugagcagaauauccuuggaugaguuaguggacagacguugaccaucacagacuuucauucacacuuauuccugaagcuaguacauggauaaguaauuguaggaucaaaagacuaauuuuaaaaggcaaacauaagauuauacuuucagggaucauuacuauaguuuauuuaaaaagcagacauuaugaaugguaccaaguaaaaggaagaugggaggaaaagcugaaccuguucuaauuguuaaaagaaaaacuauuucgcaccuaugugucugucuuuuuauccgucuaucucuuuccuuuuuuuagacaaggauuucaugucuaucccagacuguacuaaaugaauucaucauccaggucugagccacuaccuagcuaccuuuagccuuuaaccuaaucacucuaacuucuaggccuauaaaaucuugauacuuuuuaaaguauuauuauuaauauuaggcuagagagauggcuaagugguuaagagcacguguugcucuugcagaggaccaaaggucauuucccagcacccaugguggcucacaaccaucuauaaccccaguuccagggcauccaacaauguguguguguguguguguguguguguguguguguuugugugugugugugcagauaaaauauucauauacauaaaauaaauuuuuaaggguuuuuauuucugucuguauguguacaugcaugcaugcagccacagagaccagaagaagauauuagauuccccagagcugggaugaaauccaguuuugugccaccuaauauggaaccuggaagaacagcaaaugcucuuaaaugcugaauuagucucuauaccccacuucuuaaugcuuuuuuggcagcuuuuauuuuucccauggcagaguauuuuucuggugcugggaacugaacgcagggccucacaugcuggaaaauacuguuucccaguuaagcuguagacaugguagcauacuuuuguauauuuaaaaauucacuuguacaguucauacugcugucuguuucaggugaaugcuaauuaaccaguuuuauacauucauuauuuccaguguuuugcuucauuagaaacagcuggaugugguaguacaugccuuuacccagcacucaggauucagaggccagccuggcuuucauaagagcuucagaccagggcuggugagauggcucaguggguaagagcacccgacugcucuuccgaagguccagaguucaaaucacaccaaccacaugguggcucaggaccaucuguaauuagagcucugacucccucuucuggaaugucugaagacagcuacaguguacuuacauaaaauaaauaaauuaaaaaaaaaaaaaaaagagcuucaggccagacgaguacacaccuuuaaucccaguacucaggaggcaaaggcagguggaucucuugaguuucaggccagccuggucuacagauauaguuccagaauagccaggacuccacagagaaacccuaucucaaaaacaaaacaaaagccagccagaacuacauagugagacccugggggcagggugugugugugugugaaucaaauacagcuuuucaguacuuuuauacauucacaauguuucuuuaagccuaccuuuuauaauuuguacuucacuaucaaagauggcugguaagaucuuucaaacugggcuauauuaugauacuuuggaauguuuuuuaaaaaauagcuaauacguauuuuggguacaaggaaugggacugaauguauaacauuggcacugaagaugauuacguuauuugaugagcauuuaaagguauuuguaauuuaguuaucccuauaauaaaaucagaaaacuaggugcauagauugagaggauggguguuggaucaugauucaacuguuuacuuaagaguguucaaguagcaguauugauuuuaaaaaaacauggaauauuuuagaguauggauauacuguuaagauuuuuaauauuuguaagguuuauuucauaguugcaggucuuuggugauugcuaaguucuugagugggaaaguugcuuuuaaaaguagaagaauguaaagucuggagaaagcucagcuugguuaaguucuuuuuuuuucauuuaaagauuuauuuuauguaugugaguacacugucacugucuucagacacaucagaagagggcaucagauaucaugacagaugguuaugagucaccaugugguugcuggguauugaacucaggaccucuggaagagcagucagugcucuuagccucugagccaucucuccagccccuaguucuuuuuuguuguuguuugguuuuuguuuuuuuguuuugcuuuucuucuuuuuuuuucccaguuaaguucuuaauaagcaugcacaagucauaaaacauggcaaacauguaauccuagcacugaggaggcagaggcaagauaauuuugagcucaaggccauccuaugauaccaguuaguaagacacuguuucuaaaaaguaaacacugaagguugauuaugcuuugaaggguaauaauuggguugaugaugacaaacuacucuguuuuguuagcuaaauaaagcugaacauaaauguucaaugauaaguauugcugaugcccucuuaaguuaggacaaaauuagguuuaggcccaagcuuugaguuugggugaaaucuguauacuugacaguuauuugacuuuguuagcauggguaaucugagagcauuuaaaaguaggcuuauggugaggauguuucuaugcauagaaaaaugacuaugauaguugaagagaacuguuggaaaucacuuugaccaaagccaaccuaacucccuugauuauuauaaaauuuaucuggaaauaaaauauuagaaaaauaaaacaugugacagagaaauugucucagccuuccaaguaugcaguuuguucuacaguucucuuauauucauuuuguaccauugucucuugcacucuuauacaugcauacacaucaacuacuugguguguuauuuuuaaaacagccucuugagugcuuugacauuuaaguuuuccauuuacuauuauaugaauauauuuccauucuucaugugguuuuucuuuguuuguuuugcuaucuugucagggcuaccauguuuuccaggcuggucucagucuucuaagcucaaaugauccucuugcuucauccucucaaguagcugagaugcaaaugugcaucagcauaucuggguagucuuuuuuuuuuuuuuuaagugugcuuauuugagacaucauuuuguguagcauaggcuggcuucaaacuuguucuguagccaaaaaugacccugaacuucugaucuuccugccucuacuucuccagagucugaguacgugugugccaacaugccaaguguuuuuuaauucacuucaagagaacaaaagguuggacaaauaacuuaguaaugccuacagcccauuuuauuuggugcuagaagucaacccaagaauuuagugaaggcuaggcaagcacucuacaaacugaggcacauaucuaccccuagccagccucuauuguaaaugugcauacuugguuuuugguuuucuuaaauuuuauguguauggguguuuugccugccugcaugucugugcacaguguguaugccugguaccugugaaacccagaaggaaacaucaaaugcccaggaacggcugugaggugucauguggguauuaggggucaacacuaggucuuaugaaagaacaggugcuuuuaaccacugagacuucucuucagcuccuauaauuguuuuaaaauaugugugggggguggaguuuugaggcaggaggaucauuaauugaggcuagccugggcuauagagugagaaccuaugucaaaaauaaaacaaaacaaaaaccuucagucuuggaaaagucaucccuguaccucauuuuuuuuuccuuaaacuggaucauuuuucuuuuuuuccuaauuuguguguguguguguguguguguguguguaugcacgcgcaugcaagagaaagagcacuugugccauggcaugcaugaagaaauuggaggacagcuuucuggagucaguuuucucccucuaccauaucccagggauugaacuuaagugggccaguuuaccagccauagaccugacuguuuuucuaaccgugaguuaaugcacauaaacuuguugagugucugcuaaagucugcuaaaugcugcagguguuaccaggauuuuguuucugacuuuaaguccuaagaacuugaauugcuucgacuuuaaaauuguuacaaauaaugaccuuauuuccagauccccuugucuuucuuuuauguacucuccuucaaaaggauguggcauuucccaccacccacuaaaucuuuuuuguuuuauauucucugacuacuuugauauuacuuuccuccuuguucucuucuuaucuugguacucuuuauggaucuuccuuuucucugucugggaauagauaauuuagaaagaguccuggugaggcuugauggcacaagcacuaaucccagcacuugggagguugaagcagggagaacucuugaguucaagaccaaccuggucuauguugugaguuuaaagacagccguggcuucaaagaagagauucugccucccgacccuccacccccccccaaaaaaaaucaaaaaguuuuucaugcuuuuuuaucaugucuuuauuaagucaauguuguuuuauuugaaaauggucuauuugcuggcaugcauuucuaccuuaguuacaguaauuucauaauuuaauacaaaguaacuuuaccaugcaacagcucucaauaguucucuuguuuguuccauggaaaacugcuuauucuguuuuccucuguauugcuggcccaggccaauauuucccaauauauaaauaauagcuauucuuguaacuaguacucacgguaccagaaauucuacagucuccucucugaucugugaaccccaccaccauuuuucuguuaaaccauuuuuucccaugauuacaugaucaccugccagaaaaaucacaguaacauccagguguuuugugucccauuuuaacucugcuuggcucuuuugcccuuuuuguuagaucugcacuacaauuagccaaccuguuuuuccaauauauauucuuacuuacauagauauuuuuacucuucuacagaaaaccugagacuccuguguuggcuuauacaaaccugcuucuuucucaugguggccuggauuccaucuagucauuagagcccuuacuuguuacaaacucugcuuuucuuucccuuuccccuggauuuuauaggauacagaacauauacagaguaauuuaaaguuaaguucauuucuguauuguucuuaauauugguuuuauguuuccaauuaaguuauaagaucuuuaauagaauuugguuaaaauauucucauauccacuugguaaaucacaagaauacaugaugaacacuuuuuugagagagguguugggaaaucaagucuagaacccugcacaugaaaaacauguuccaccacuugaacugcagcuccuagccucagacauuuuaguugacuuaggaaaguaaaggguuaaauaguacucugguuuguacaaauaguccaaagggaaguaaauuuaguauaagcauaacuuuauaaaaaagagaauaguuuaaaugcacuuaauuauaauucacaagggucuggaauaucugguuaugauuuuguuaauccgauuacagugaagugcuuaauguauaugagucaucugccaguguggcaacccauuaaaucuuguucuguacaccacuauguuaugcacauuuaucuguaaccuuuaucuuuuuauuuuuuauaauguaagcacucuaccacugagccauaccauacccuuagcaccauuuauagcuauaauaggaaaaguauagcuuucuuaaguaauaaauguuauuauaaaaaaaauuaggaacuauagauuggcaaaacuuacaaauugccuuuuuucuucaguuguuaaauuaucuucacuacaacugaaauauaacuccaugagguaaggcccaauucuguccaccagugcuuggacaugaagguggagcaggaaagaccugccauaugguguucauguaguugccuacugaauacaguuugguuuauuuguacacacuccucucuuuacaacuuuacuguaaaacuugagugaggaacaaaggaaaacuaucccaacaacuuaaacaacuuaaaaacuuauuuguauauacuuauuuauuuugaguaggguuuugaaauacauucuccuuauauagccaugacuguccuagaacuuacuuuguaggcgaggcugguaugugugaucuuacugccucugccucgugaaugcugggauuacagguguguaucacuaugccuggcccauucgcagucauuguuuugcaaauuccuuuuuuguuuuguuuaagauuuauuauauauguguguguguauauaugugagauauauacauacacauacacucauguguguguguguguguguguguguguguguguguguguguaugcucuaccugcaugccagaucccaggagagaugguuaugagccaccauguaguugcugggaguagaacuugaccucuggaagagcaaacaguuaaguacugagucaucucuccagccccugcacauuccuuaaaacuguuuauauuuuguaauuuucaaagauacuuuucacuguauuaggguauuaaauuaaaaaauguucaaaauaaggauuuauauuuaggaauuuauuuguuuugagguucuugauuagaguuagaauuuuuuuuuauuauuauuauuauuauuauuauuauuauuauuauuauuuagagacaggauuucucuguguagcccuggcuguacugaaacuuacuuuguauaccagccuggcuuugagcuaagagauugcuuacaucugccuccccagugcuuggauuaaacaguuuuucauaauuagaauuugauaucuucaccccucaaacucacauuaguuugauucauaaaauguaugaacuacacuugagaguggaaaggauucugagagcaggguagaaguauagauugcauuucuuuucguuaucacuguaagcaacugccauaagagauccuguuugcucaguauuguccaaaaacauuuauuuuagcuucuuccaaauagugaauuugcaaaauccccaacaaaaauguauagacugagauuguuuugccugguguuuuguuuuguuuuguuugugacaaaggaaauggacuugcuaugaagccacuugaacuuugugaucuaauucuguaggucugugugguuuguuuuauaugaaugcaagauaugauaaaggccagagcuguuggaucaccaucucuaaggauaauuaaguuauuuuacagaagggugugaaguagaauaauaagauuaaugaaugugacugagauuuuuuuuuuucuuuuuagacaaggucucacuguguaucucuggcugggcuagaaauugcuauguagacauaccugacuucuccaaccccaacacacccccaggugcucgaucacaguagugugcuaccuugcuugagacuaauaauauuuauuaaaugugcuuuuguagguaagguauuucucacuacaaauuuguacuuuuuugauaauugguggauuuuuuucagcaccuggaccuucccgguguuuuauaauuucaguccuuggaauagccuuuugaagugaauauuaccauuuccuaaaauguaaguggcaaggccaaugguggcaaugauuaaauaguugauacuguaugaucauauucuuuucacuuuauuacaaugcagauuuuauucccaaagcaaauuaaaaauaauugcucaauuauuuuugaagaauauuuuuaaggugcugcuguaaagauggcucagcagucacuggguguuuucuaaagggcuugaguuguauucucagccuucacaugguagcuugcaaccauauauaacucagcuccagggaaucggacacuuucuucuagccucuaaggguacugcaugcauguggugcauagacaugcaugccacuaauaccuauacacauaaaauuucccuucaaauuuuuauaauaagcugggcagugguggugcacaccuuuaaucccagcacuggggaggcagaggcaagcggauuucugaguucaaggacagccuggucuacagaguaaguuccaggacagccaggccuacacagagaaacccugucucaaaaaaaaaaaaaaaaacaaaaaaaaaaaaacccaaaaacaaaacaauaacaaaaaaagaaauuaugaugggaauuuggcacaguuagaaaagugcuugccuugcaagcauaauaagaaucugaguuuaaaagcaagagaaauggcucaggguuaagagcauauauugguucuugugaguuugauuuccagcacccacauuaagcagcucacaacuagaauuccaguuuuagggaaccaacaccucucugacuuccuuggucacauagaaacacauauauucacauuaaaauauaugcuucugaguuuaaauccuuagaggccacauaaaacuugaguacaucauaucuggaaucuuaggcagagacaggugauagaucccuggcgcucauuaacagcuagccuaguccagucagcaaacuucaggaacagugagguccugcuucaaaaccaggacagaggggcaaugagauuguuuagcagguaagagagugcuuugcucaugaagccugaugauccagguuucaucccuaggacacacaugguaggagaggaaagacuccacaagucuuuggcacauguacaugcauacacacaugcaugcauacacacacauggacacggacauggacacacgggcucuuauaaacaaagaaauaacgagauuauaucgcaguauuuuuaucaagguuggcuuacucaguauuuacuuguugaauuaaugacugacaaucagugaccauguacuaagugccagaaauuuaacuuuacauuugucaaaaauuucauuuucugcuguauuuguuaugcuaauaccaauuaaagaaauaaugagccuggugguggugcacaccuuuaaucuuagugcucaggaggcagaggcagguagaucuuugaguuccuuagaacucagccuggucuacagauggaggaccaggauagccaggguuacacagagaaaccuuucaagaggggaaaaaaaaaaaaaaaaaagaggaaugaaaaaacaaagaaucaaagaauucaggagacaagaccauuuuguguagggaaacaacaaauuaugcacagaccuuuugagaacgugcauacuuuaucacugugacaguucugaaaacuguuuaacagccuuuuauccagucaauguuuuuuucauggucauaaaacaucauaaaugauuuuugaucauuguuucguaaagaugaauuauguuacagacauuacuaacacauacucauuuaucaugaucuuauggaagucccccuuuagcucauguagcuaauucacuuuguaugaguacacaguaauccaugauauggguaucguaauuuauuauacugccuacauugugggcauuuaauuuaggcuauuuauguuugcaauaaauagucuuguacaaauacuuuauauaaucuacugcuuuuguuucuuugagauggaccccaggaauggaauuguugagucacuuuucuuugaacugagguaggguuucaugugucucaaguuggauuuaaacuugcuauguagccaaggacagcuuuaaauuucugauccuccugccuacaauucccaaauguugaggugacaagcaugagccaccauaucugauuuauguggugcugggaaucagacccagggcuuuauaccacuaggcaaacaugcuaucaacugacugggucuuuuuauuguuuuuucuuuuaauggcuguuaccaguggcuucccuuaaaggguaugucaugacuuguccacuaguguauaacuuuuccuugcuugucuuugauagaauuaauaucuuuuuucccuuucugucuuuuguuuaauuuguuuuguucuugagaugggcucugucuacguagucacucuguagcucagacugaucucaagcacaccauccccugcuuauuacccuguuaaaguuuuaccauucuggugaguguagacugauacauaagaucuuaguuugucuuucucacuuuggaaauuuguacauauugccacauguuuuuuaacuuuaccucugcugggaguuguauauucauaucccuggauagucucaacaauaaguaauuugguuuuucugaccaacuauaagaacuauaaauaauuucaucuacaugugggaagcuggugaguuaaacuuaccaucuuucacacuuaccuucaacuccacuuuaagaugauuagauuauguauggccuuagguuuuauggaugucucggagggaaaagaccaagaagcugaccugcacugagacuuugaaccuguuaauuucuuuucuucucuucucuucucuucucuucucuucucuucucuucucuucucuucucuucucuucucuucucuucucuucucuucucuucucuucucuucucuucucuccucuccucuccucuccucuccucuccucuccucuccucuccucuccucuccucuccucuccucuccccuccccuccccuccccuccccuccccuccccuccccucucuucucuuccucucucucucuuccuccuccuccucuuccucuuccucuuccucuuccuccuccuuagauuucuuuaguuuuaugucuaugggugcuuuaccuuuguguaugucuaugcgcuaccaggauacagugccuauggaagccagaagguaucagauucuuuggaacuaggguugugagcuaccagguagaugcugagacaaguacccugcaagaacagcaagugcucuuaacugcagcccauacuggguuuuaagaaacaacuaaccugaaccaaauaggcaggcugagugagaccuuccuaccacagcauguuuuccugguugcuugguagaggacuaacagcagccugcuugcugucuauaucuacuccucaccugucagaucugccagcacagcuccgugagucagagaacaaaauguagcaaccagaagaauguaaauuaaaauugacacaauaggcucccaaaacagcuacuguagaaggacaauugaaaaguaugugauugauugauugauacaaaccugaugccagaaaccauuugugaaccaaauacagcacgguaaguaggaaauaggucauacaaagacuaauugcuugaaagucuagcagacagacuuugaauaaagaaguaaagcuaacauucugagucuauagucaaaagaccuuaaauagagaaagaaaaaggaacacugaaagacaaaccaugaguuaaaaagaaaauaucauuguuuuguuuguauugcuuuuguuuuucaagacagaauuucucuguguaguccugccuggccuggaacugguuguguagaccaggcuggccugaaacucagagauccaccugccucugccuccuuugugcugggguuaaagauguaugccaccgugcccagccuaaaaagaaaacaaaauuuuuuuagaguaaaaaagacauaaauuuacagguucacaaacacuuuugaguuggauuuaacacccacucuaugagaaguaccuauacuaggcaaagaaucugagacuagaugggucaugggccuaagggggaacuuacuacaauuguucugacagugcauugcaauaaaacgaccagagcagaacaucacuuaugagauuaacacagagacccauaacuggacagugugcagaaaauugagagauuuuggaguauucagccccgcaugggaugucuuuauuguaucucuacccucaaagcucagggaucuaaguagaagggguagaaagguuguaagagccagagaugaggguaauucuaaggaaacgucauuuuuccagacacaacagggcaaaugcccauagaucucacagagacugauagggugcacagacguacacaagcucaaaccugacaaaaucucagcacagaggaggggaaguggguacaaaguccaaucccaaaccaaaaagcuguuuguaaaugauagguccugggagagggagugacaacauaucagccauacuccagaguagaccccauacucaggaguaguuaguuggcuaacacaaaucaggcuccauaguuuguaguggcuuuuuucuucuuuuuuuuguuuguuuguuuuuuguuuuuguuuucuuuuuuaagagagagagggggaaaauaugaaguuggguggcgggaaggauaugggaggagucuggggauagaaaagaauaugauaauuagcugggcaugguacccaccucuuuaaucccagcucccugaagacaggcaaguggaugucugaguucaaggcuggccaaucuacacaguguuccaggaaagcuggagcuuccacgugagaccuugucucaaaaaagauaauauuuuaggagucucuuggacaauccugaccuacggcucaaaagaggguuucucauguugaguguugggguuuauguuagaugauccaagaaacuccaaaaacauagacuguuguuaaaggcacuucagaugcaggauccaaagaccccugaguuggaucuaaacugaaagccauuuuccugagggcuagcuuucaugguaucagaggugccucguaagcuuccaaaggucggaaacaaccaauauugcuacccagcuauguugccuaugaaccacagugaaguccagcaugguacacaacccuaaaugugcaguaguggcauacaaaccuuagcaccagcuaauaucucucuaauuggacuuuagaccuguucaauaauagggaaaugaugccugguauugaaaaccuaggcacacuacacaaggcuagugaauucauggaucuuggaggagaaccucuacuaaaccagcacaaucccuaacuacauucuaaagauuuuucuauauaaccacagagaaguguaguccucacugcuuauccaagaaaauucucuuugccacagagaccaacacagaaaaccacaaucaaucacauguaaagcuuacugguaaaucuguagcacagcuggaccuuagaaggguuagugugggaaaggggauggaaagacugucuccuaggaagcugcacucauagguuuaccaacaugacugccuaaacauuagcugaauuaggaggcuacuaaugaaagcucugaaguccucagcccuacacacagaacuucaggcaacuaaggaaugcugagagcagacaaguagucuucccuggggaagaguuaccaguugguuauccaguaucaaacggccaguccugaaaauacaaggaauaucaaacagauugagcaaguugugcuauauauuuaggaauaucuauguguauguaacaacagugaaaaagugccaugaauuaaaagcaaaaaaaaggguauaugaggggguuuggagguagaaaaaugaaaggaaaaaaugguguuuuauauauauacauacauacauauuggagauuucucaguaaauuccaaaaaauugcuaguuuaaagggcauacuuaauuccaagcaaaaguuuguggcaguuguaauaaggugauaaguguucacuuuggaaaccaguucugcccuucacagcaugguccugugauuggaacuucuggaucacauguguauacccucauaccugacuuauuuguuauuuucaaggaaagauuuauaagguugauuaaaaaauggucaaaauauuagucaaaaauucagaaagaguguguugauauucuaaaaagagcaacauuaauccuuuuuuuuguuguuguuucucuucagauuaaagcuaaaaauuaugacaagguugaaaagguaaguucucuuaacuauauuuugaaguuuaagaguuucuauaugaccaaaugguaaauaaauaugguacgaguuggaguggggaagaguaaggaacaaggucaauaagcaaauuaugaaaaugccucaaugaaauuuauuucauaugccaauuuaaacuaaggaaaauauuacaaaagaaaaauaauuauauuuauuuacuuauggcucuggggaaaugaaagaaaaugacuauacuugugaaaugcaugggcaugauuuugauugucuaaacugaaaagaggauuauuuuuugccuuuaaaaaauuuuaaagaauuuuuaauuuugccuguguguguguguguguguguguaugcaugcaccacaugcaugccugguacccacaaaaguagacaucugaacugcuagaacuagugucauagauggucaugggcugccguauagauguugggaaucaaaucaagguccucaaaucaagguccucaggcagugugcucuuaaccacagugucaucucuccaucccucuuauuugccuuuuaguuauaagaaaauuaauuccuaaaaagacugacuuuguuuuuuaauaugcuguuucauucuuacaaauaugaaguguauuuacccggacgcugauauuauuuucuuauauuuaaagcuauuucaaagaugccuuaugaagguuuugcacauugauuuauggaaguguuaucuuucauacgucagagaaaccaaggguaaacugcccagcuacaaguaagugaaaucauggucuuaagaaugcauagugaauacuuucaaaaguaaauugcaaaaucucuaaugugcauuuaaauauaaguaauuaauuagaaaccacacccauuaaugcggaagugucuuucuuucucaguuuucauucucucuuguaguuucuagcaucccucugaaauugauacuuuuauuaaauguugugauaauauuauuauuuguuagaaauuuaauggccuaaaagugaugcgauugucuagaugaucuuuuuauacaaaauucucuauauuacuuuguccuuaugucugaaugugcacacguguguaagucauagguauaauugcaggacuuggaucucuuuugccaccaggaaggucuaaggacucaggucauucgcauauaccuacugagauaucgccccaagauaauauuucugauaacugcuuuauuucuauguauucuuccagaaggcuaacacuguaaagaauaaaaacuaugcauccaaaguuaaaaaaaaaaaaaaaaagaaugcauagugagcuggguguggugguaccuccuacaaucccagcacugaggagacagaggcagguauagcucugaguuucaggccagccuggucuacagauugaguuccaagacagcgagggcuacacagagaaacucuggagcaguggcugguaucaguguauguugucucuagaugcagucaucuccacaugccucacaccggcucugucucugaacuauaguuaggaagaaacuaaguacugaaaagucagaauucuccaagaaaucaggaaaugugguuuaaagaaagccacuggcacuuauauuccaccuaaguacugacucaucuaaauuuuucucugcuaagcacugugcauuuacaacaugauagcacuuuuuuuugacaggcuugucaaacuuuuucaagaagcuuuuuaaugcucaucucagcacauacuugugaaguuauaugguaccgugugccgcuuaaaauaucuaacucgauaguuuacucuguucuacaacugacaccugccugucuucagugacucuaacuuggauguccucuuauguguuuugauaauaguuuuagguuuugauuggcuccugauuuguuuucaaaaaaggucuugcuuuguagcucagaguaguaugggguauauacuacauaucccaggcugcccuugaacucacuauguaacccagaauggccucuaacucaggguagugaucuugucucagcuucuugggauaacagguaugggcuguuauacccaacugguaaaaaauuuuuuaaaguauuuuucauguucauuucagagaaaaaauggcucaagcuuaugacuuugcacuagauaaaauuggaauggaaauuauguccuaucagguaaaguucaauuaaauaucuacacaagggcugggaauauaguucaguaguacuguacuuacccaggaugcaugggacucuggguauacaccuaaaagugaaaguaucaagaaagauauuaacuuuuuguuuuauuucuuagauuuggguggauuacaucaauuucuuaaaaggaguguaaguauugucuuaauuuuuaauauauaaacaauugauuuagcuauaauacaauuaaugauauuuuuauccaacuuuagggaagcuguaggaucuuaugcagaaaaucagagaauaacugcuguccgaagaguuuaucaacgagguuguguuaauccaaugaucaacauugaacaacucuggagagacuacaacaaguaugaagagguaagccaagcccgaggguacuacaagcuggccauuccaguuauuaccuauuguaaaugcagagaugagcuucuagugucaggugccugaauguugguguuagugucugcugcugcuacuggcuguuguuuuguugcacaugauuaaauccuaagcuuuaugcauaugagggaaauauccuaucauugaacuguauauuccuagacacuuuguuuuguauuuauucugauaauuuauuuuuuaaauaguacuacaauaaauauuaauuuguaaguaucucugugauauguuggcuucaaguccuuuugaucacuacucaagaauuguauagcuggaucauauaguaggucuauauguagcuuuuuaaagaaaucuguauguugaauuuugaauuaauuuacauucccaccaguaguguauaauuauuccuccuguccacaucauugccagcauucauuguuuguuugcuuaaugacugauuuaacuggauaagauagaaucucaugauuucaugucuauaaaaauucuagggccaggagcuagaaagauauaccucagcaguugagaguacuggaugcucuuccagaguucccagguucaauucccaguaccacauugugguucacaacuauuuguaacuccaguuucagagaauccagcucuuuuuuauggccucugugggcaccauccgugcacugguacacaggcauugcucaggcaaaacaauuaugcacauuuuauuaaaagaagaacgugaaacaaaccaacucuuguccaguaagauggcucaacagguaaagacacacugccaugccugauggccugaguucaguacucaacccacauuauaaaaggaaaaaggccacugcuggaauuuguucucugaccuccagcaugugcuauuguaugugcacccaccauccauccacacaaaguaaagugaaaauguuuccuauuaauagaauugcccagcccacucacaauugacuaaguagauacuuuuguagggaugaaggaacacgugugucaugauguguguagaagucaccggacagcuauaugcagucaguuuuuuccacuguuaccuggguuccagggauggaacucaagucagcaggcuuuuaugacaagggcuuuuaccuacuacaccgucucucguucacgucuacuuauucuuuccaggcugcauguguaguuuagugguaguguuuguuuaguuaccuagcaugcggggggcugugggcuugguuugcagaacuguaaaaaacaaauauuuuaaagaaaagaaaagaacaguuaauaaugauauuuuuccuuaggguaucaauauucauuuagcuaaaaagaugauugaagaucggaguagagacuacaugaaugcuagacguguagcaaagguauggaauuuuaugggcuacuuuaauuuaauguuaacugaaucauuaauuagcgaaacuuuuccaucugauauuacucaugauauuuucaaucauuucaagucuuaauuaauaacagcuaauuauagcuaauagauaccugucugagaugaugauuuuugguuugguuugguuuuguugaggacaggaucuuucuauauagcaauggcuguccuagaacucaugaaacaaaccagucuggccucacacucauagagaucaauuugccucugucuccuaagugcuaaaaucaaaggcauggaaaaaaugauauaguuaaauugaauauuaaguuauaguaaaugacaaaauauauguuggauuuggaagaaauuguguguguguguguguguguguuguguuuauguuuacugagcaucaucucaccuaaggauucccacacauuaggaaauguuuuacuacugagucacauccucaguccaaaaaguauuuuauucguuuguuuguuuguuuguuuuuuaagcagucuugcuauguagugcugacugcccuaauacuuuguagcccaggcuucccuugaauuccugacacuuuuccugugucagcagccucccaagugauagaauuacaggcaugcgcuagcgugcuuggcuagaaacauucuucaaaacagagauuuacauggaauuauugaaguaguugauauucucccuucauauuugcuuaucugaaaauuguguuacucuguagucaguguauuuauaauacaacauagcucucugguacagauuuugugcuguguacauaccuuuaaguugacaauaacagugcugcagaaacucacucacucaugcucuuuuacaucacacaucugcagggauagucuauguuauucugcugaccacuccgaggugucugguuugguuuuauaauacucuauuauggcuuuccugacuccuggguguuguuuuguuguuugaauguuguuugaauucuguuucucgagacaggaucucauguagcccagguugacuugaaacccacuguguauuuucagauaaccuugaauucuaaaaucauaauaaaaagugauauuagggguaagagagcaaacauuuuaaacaaauuguuuccagcugauggaguaacucccuauauaucugagaugcucuaggcucaucaacaaccuuuaaauguuuguuuaggaauacgagacagucaugaaagguuuggaccgcaaugcuccuucagugccuccucagaauacuccucaagaagcucagcaaguggacauguggaagaaguacauccagugggagaagagcaacccucuucgcacagaggaccagacccugauaaccaaaagagguaacccgaguagcccgcgagggacuccagcuccugucucugggacuguuuggucuuagccucauggacucuccagcucugcugcugcuucucccacccaccacucuugccuguugcucugcagguuaggcuggcuuccagcucacuguguagccccgaugaccuccaacucauccuccugaauuaacuuccuggguguugggucacaggaaugaaccaccacgccgaggaggcugcaguuuguguuuuauuguuguuuuguuuguuuguuuucugaguccuguggguuuuuuuuuuauugauaaucauuucuauagcucuaccuucaugaucacuuuccccugguuuuauuauauucaaucugaugguaaaauaacccagcaaauuguucaucuuauauacuauacuuuuuaguucuaugaauuuccaggaaauguuuauaauuuuaauuucuuuauugagauucaugugucauaauguguguguguuuguuuuguuuuacauuuuaauuuuuaauuguaugcauguuauguauguuuaaauguauguguauggauguuuuggcugagggaaugucuuuguaccauuuacaugccuggugcucaaagagacccaaagaacccucuggaauuggaguuacagauaguuauggcugcuguauggggguugagaaucuaacccagcucgucuuaaucucugaggcaucucuccugccucuguaaugugucuucuuuagaugcuugcauaggauucuuucaauagcugugaaguccuccuuggcucauuccuucagacagugggccuuugugagaucaguuuccuuugacuuuuaacugucacuuuuucauguuuuguuacccauauaauuuuuucucuuuaaacauuuuauaaauauaugaauaauagguuguaaagacuggagucuguugucuucucugaguucucuuuaaaaggaaguugaauuaucaucuguuuggacuuuguaugauaugaaccucaccucugcccuggcccacucuggucugacuccugcuuuauucugucaugcacauaugugcagggguuuugucauuuguuuguuuuguuuuguuauuguuuuggcuuggguuuauuugggguaggugcuuuauuucaguuuucuuauauaauauauguauaugaaaacauauaaacguagacacauugauggagauagagaagugcuagggaucuaacucaaagucauauauagauguauaugcuaagcauaugcucuaucaaagagauacuuuuuguuuucaguuuauaauuuuuaauuucagaagaguuagucuuuuggguucuuuuuuuuuuguuuuguuuugcuuuauuguuuauuucuuguuuuucaagacaggguuucucuuuguaacagccuuagcuguccuggaacucacuuuguagacaaagcuggccucaaacucacagagauccaucuaccuccaucucccaagggcagggacuagaggugugcacuacugcugcaaaucucuguuacugcuagaauggaauuucacugaauucuucaauuuugcaggcucgcuuaauggcaggacuuuaugaguacuguuucuuugccuacaucuauuuugggggcuuggagauuaaagccagaaccaucuacaugccaaacaagaauuguaccacugagucacauuuuuggcaacgucugcagauuuauacacacccuucccucuguccuaucucucacugacuagcuucugacacucuggucuucagauacuagucacuuagugaaguuacucaggauuucuuucuuccuguguuuuguuuccuuagauguguguguguguguguguguguguguggucagaggacuuucaucaugacuguccucuguguagacuauguccuucuuaaauguuggaguuaauuaucacucauuguuaaagaccaugccugagucuaauaaucuagcuguggugcuugugaugauauuguuagugccuuuuaucuuaacugaugucguguguuugucuucccuuaguuauguuugccuaugaacagugccuccuugugcugggccaucacccugauaucugguaugaagcugcccaguaucuggaacagucgaguaagcugcuugcagaaaagggggugcguaucccuccccauccucuuuuuccuuuugugauuuuaaucuagcaauaagauuuacugacaaauacagcaucaguuuuaguaauaaaguuuaaauacugucuauauuuaagcacaugcaggcaaaacaauaaauggcagaaggggaggagagacuagacauggcuguggguagaauguaaggaaaguagagugguaugcauggaugaacaugccauaauaaaacucauuacuuuauaugcuaaauuuauuaaaaaguuucuagccgggcagugguggcauaugccuuuaaucccagccugcucuagagugagcugagcaccaggguaaccagggcuacagaaaaacccugccucaaaaaaaaagggaauauuuaaacuuaugucagugugaacuuuaguaacacucauaauuccuuagaauuaaaauuugauagcuuuuaaaacuaucaaaaugacuugucacuuaaagcacuuaaaugguaauuaauuuaaaguaugggggcuggagugcauaacugggugguagaaguuccuggcccuagaaacucucuucugcucagaacaagaagaaauccuuaguaauuguauaauccuuaagcgccagugcguauuuguuucacaguaagcacguuuuagcuuugacuccgcugcacggcguuacugagugcgugcuuucuuuuccucuuaggacaugaacaaugccaaguuauuuagugacgaagcugcuaauauuuaugaaagagccauaagcacguuauuaaagaagaacaugcuccuuuauuuugcauaugcagauuaugaagaggugagaagagucagaagauugggaacugaguuuguguguguaugugcguguguauguauuuguguguguaucugugucuguguauguguauguguauguauguguguguaucugugucuguguaugugcguguguauguauguguguguaucugugucuguguauguggcccucaaacucaugauucuuccuaaaccuggugaauacuagaauuuuaucuacugcuuacaauuuuacugcaggacuaaaauuuuuuucugguagccucuuuguuuuuguagccagagaugguaacaauaaacaguugugaguccuugaguucauauacguuuaugugcaguguaggugucuuguguguguugugggagcaggaguacagucuucagguucuguaaagcucacuugugagucuauauuaauauucacuucucugccgcuuuagagucgcaugaaguaugagaagguucacaguauauauaacagacuucuggcaauugaggacauugaccccaccuuagugaguaaccuaacucucucuuuccuaccaucauaaucugacuuaauauaacaaaaauuuaauuccuuuuuuuuuuuuuuuuuuuuuuuuuuuuuuuugguuuuucaagaccaggguuucucuguguagcccuggcugccuggaacucacucuguagaccaggcuggccuugaacucaaaaaucccucugccucugccucccaagugcugggauuaaaggcgugagccaccauugcccaguuuuuuuuuuuucuuuuuuucuuuucuuaaaauuuaauucuuauauagaaagaaucauuguacuuaugucuuauuaaaucaugggacccucuauauaaaacacugcugggcauuauggcugacacuuguaaucucaguauugggcaguguagacagagggcaggaguucaagauuaucuuugaauauauaguuuuuuaaaaauauuuauuuauuuauuauauguaaguacacuguagcugucgucagacacuccagaagauggcaucagauuucguuucagaugguugugagccaccauguggugggauuugaacucaggaccuuuggaagagcagucgacucucuuaaccgcugagccaucucaccaguccccugaauauauaguuuaguggagucuacagagagaauuccagguucugaacagccaaggcuacacagaaaagcuuuaucuugcaaaaaaacaaaaaaguauuaguagugaucacuguaugaccuucugaugauaagaaaaagaaaaaucacugcauuauacagaauaauuauuagaauaauuuuguguuauauaaauuaugucauaauaaaaauuaacaucugucccuaaugccuggugaaaguaguuuauaauucuauucuguaguuucuuuuuuuuucccaauuuuuuuauuagauauuuucuucauuuacauuucaaauguuaucccgaaaguccccuacacccuucccuacucuguuguuucuuauaccagaaacauuagcauagaacucagugccgugguaguagaugcugugaggagcauauucugccuaauuuguagaauauaaauauuuucuuuucucauagguauauauucaguauaugaaauuugcaaggagagcagaagguaucaaaucuggaagaaugauauuuaaaaaagcaagagaggaugccaggacccgccaucaugucuauguaacugcagcccucauggaauauuacuguagcaagguaaacacuggcauguuaugucagugaauucuacaccagcagguuuacacaggaaauugccuuauccccccccgccccccccccacacacacacagagaaguccuacuuuuuaaguaauugagcuccauuuuguaaaggucuuaaguuuaucugcauaaaauuacauugauuuuuuuuuuuuuuuuuugguuuuuuuugagacagguuucucuguauaacccugguuguccuggaacucacuuugugaguuggccucgaacaagcuggccucgaacucagaaauccgccugccucugccucccgagugcugcgauuaaaggcuugugccaccacggcuggcucuuuuuuucuuuuaauugauugauugguuaucuacuguagaugauggaacccagggccuccugcauucuggauaagcucuuacaauuuuuuucaggcauguuguggggcaguguucagggauugaaacuuggugaguuugaguucuaccacuggcugaccgauuccaguucacccuugguuguuccuguuuguucauuggacuuuguuuuguuuugaagcacauaucacuaaguaucucaggcuggucaaacucuugaucuuccagcuuuggcuguaagcuccaguacuaggaacacaggcagugcaccaccacaagcaacugugguaaauaucauagacaagaugcugacauuggcuguguuauuuuguuuaugguccugcuggggauugaacucaggacuuugagcaaucuaggcaagugcuuggccaccaagcugucugcccagcucuguucucaauuuaaaaggacagguucuuguuucauucccuaggcuugcccugaaguacaagcauaaaacucauacucugaacuuaaccccauguuguuuuuuacuuagcucaccaauuuuaauucuucugugcuuugccauauuuagagguugugggaauauuuccuuguuuuuguuuuuuguuuguuuuuuguuuugaaaaaguaucuugccauguaagcuaaaaugaccuugaauuugugacaauccuccugucucuuaaucuuuacugcugagauuauaggugugcaccaccaugccuacuagauucuguaguuuugggguuuuuuuuuuuaaauaaagauuuauuuauuauuauacauagguacacuguaacugacuucagacacaccagaagagggcaucagaucucauuacgggugguugugaaccaccauguguuugcugggauuugaacucaggaccuuuuagaagagcagucagugcucuuacccacugagccaucucuccagcccuagauuuuguaguuucaauauucuuuuguguacauugucuggcauuucauggaaaccaguacugucuuuucuucuaggacaaaucuguugccuuuaagauuuuugaauugggacuaaagaaauauggagacauuccagaauauguuuuggcuuauauugacuaucucucucaccucaaugguaaguugauucuagacucuaccaugauuuugugguugugugugugugugugugugugugugugugucuguguuggggggguggggggguuaagauucacuuacuaguguuuugccuguaugucaugucuguggacccguuuuuuuuucauugcccuuggaggccagaagaagguauuggaucauuuggaacugaaguuacagucagcugucagcugccaugcagguguugggaaccaaaccuagguccuuuugaagauuagcauauguucuuaacuccugagcuaucuccagcccaguccaaucccgccaugguuucuuaacauuaaacaaucugaaauuauguuuggguuuggguggcuuuguuuucuuuuuuaaaguguuguaacuccaacauccaccagaaacagcuacuugauaggcaggcaggaaauaguggccuaucagccaugaauucaguauuuuccuucuuagacagggucuuacuauauaccccuggcuggacuaauacucgcuuuguagaccaguuuggcuuugaauucacagaaaucuaccugccugcacguuugucaacaugcccaauuuauacagugcuggcacugagcucaaugucuugugcaugccaggcaagugcauaagucaggguucucuagaggaacagaacaaacacauacauguauguguuuguauguguguaugggguuuaugagaaugauuuacaggcuguggugugccuacuccaacaauggcugucuaccaaggaaagucuaagaauccaguaauucuuaaguucaugaggcuggauaugucaccuggucuucaguauaugccagaaucuugaagaaguagacucuaaugccaguaaaggaauagacuguccagugaaagcaagaauagguccuuuauauaggcugcuaccauaaggugugguccagauuaaagauggauggucauaccucaaaagcuauggguauacacagguauacccaggcacuuggguuuuaguucauuucagauguggucaagguaacccccggaaagccaucauagcaggcauucuaccaacuaagcuauccccaguccuaucaaccauggaguuacacucccugaauaacaggagauuuuuuuuuuuacacuccacagagugauucugaaucagaaagugcuaccacaauuaaguggagcugcaaagugaguuaagagacagaguugucuguguuccucucuggcuacucugugaaacucaucucuugucucccagggguaaacagauacuuaaaaccucuccagcuaguaauuggugaauagcuuugcccaguggaugggaagcauggagaacaguggcagaagaagccuguaaccaccaagcccaaaaugacgugugaggcuauggggugaaucuguaaagaagcguguucauugacaucuuuauuuccccacuuuguuggauaaauaguaauauagccauucuuuaugcuaaauaauuacccaugugucucuauaaaauuauuauaauuauuaauaguucaggagauauaaucuuggggcggggggacaacuagaggagcuugagaaaugacccaacaguuaagaacacuuguugcucuugcaaaggacacagguuugauccucaacaaccacauggcagcuuguagguagccauagcuccaguucuaggggauccaaaaggcaugcacaugguacauauacauuuauguaggcagaacagucauggacauaaaauaaaccugaaaaauaaaagaaaaugaucuuguaugaaagcuguuuuaagagaacucguauuuacuugucagauuagguguguaaauuuagaacuguacuuuccccuuuauagggcugagagcaucaagucgagcguuugcaugcauuuaauuuauauauggaguaugggaagcagugauuguguacaugguagaggugaaugugaaugucacagcagagcccugaugacgcacagcggggcgugacgaugacagcccaaacuccagagcuguucugagacugcuaguuauugagcaaaugaguguaccagugcuaaacagcgugcaugccagauuccagaggcuuaauucuaacaaaaaauaaguaagaauguaaaauauuauagugauuuucauguuguuuacauguugaaaagacaguuuggacgugcuuggcuauacuugauuaauuuuacccucucaguauggcuggcaggguuuuaaaugacauucgacugcauuccacuguguggcugugauauccuaggacucagagagagcacgugaacugggucgugaagaugagcaauaguuagccagauaaggagaacauggugagcacugagcagggaggaggccgugugggacaguaaagaggaugucagagcaaagcgguuacagcaagaauaaaauguaauaguaaauaacaguuuaaacugugagacggggcagauggcucagcagguaagaauauuggcuguucuucuaaaggacccagauuugagucucagcacccacauuguggcucacaacuccaguuucaggggacuccacacccucuucuggcccccacagggacugaaugcaaguggugcacagauacaaaugcaggagaaacacucauacacaacauaaaaauaaguuaaauuaaaauuuaaaaauauaccaagucacuugguguggugcaucuggcuugaugccauuucuuuggcuaaauucucaugaauuuaucuuuuauaugcacagccaguaaauugaaugucugugcuaauaaaauaaccaaaccagucaugaugacggauuuaaacauaguuuauuuugguauaauuuagacaucaugaauguauuuauuuuaauuguucaguucaauuauugcuagacucuuaaguuugaauuuucaagaaaacucuugcuuucacuuacaaaugaacuccuaauacuuaaaauuuaauccaguuaguauuucuuguuauuuuuugaaagacaaaauaggacaugugguucuguccucccugugaucugcaucgcacugugugcaaaccaagucucaguuaaaggucagaaggccuggcuucuaguaacagcuuuguuacucaacagugagccacaccagucuagguggagaguguuugguguuugucugucugaaacaggggucuauguaucucuggcuagccugaacucaggauguagaccagguuggccuaggacucauggagaucugucucugcuuucugaauugugagauuaaauaaagacuuccuccccuagucugacaagcucaguaauuuugaaccucccaauuuccuugucuguaaaaaucauuugugacaaauuauuuuucugcauuagauuuuuguaaggauuaacugagguaaaguuuaggguucuguucugcuuugcucuuacaaaauauuauuauuaaacuguaaagcuuucuuugauuuaacauuuaaacuuuuuuaacuacccagaggacaauaauacucgaguuuuguuugaaagaguucuaacgucuggaagccuuccuccugagaagucuggguaagccauggggacacuggcguguggugcauggacacuggcguguggugcguggacgcuggcuauggggcugugcuugagggugaaguucaggagacauuucuuuucgcauuuuaccuaccugcaguauuuucauaguugcuuaagcuuacauuuuuauuuuauauaugauaagaauuauuuugagauacccuuuuaauuaaauauuuugcuauaucuuucuacuuuaauauuucuagaacuuaauauacuagcauucugaaauuuaucucacuaguggaaugcggagacuuuuauacugagagcugguuuccauguuacacgcccagcgcguggcuuugacugugagagagugacaggguacaguggcacugccagcauauucaggcuuugcuucucuucagcuccaagcucgaccaccuagauagguggacagucuacuuaggccucacuuucucacugauucacagacaugucuaccagaguugggguucugcaguuuccucuuccugggacuucauugguacucacgaucuuacuuuaggugccuguggcauuuaaguaaucugagaacauuaaaacggugauuuguacagccacgcagugguggcacaggccuuuaaucccaauaaucuagaggcagaggcaggcagaucucugaguucaagaccagccuggucuacagagugaguuaaguccggacagagaaauccugucucagaaaaaagcaaaccaaacaaagcaaacaagacagugauaugugcaguuuggccucagugagucaauauuauauaguagauguuggaauauauuuuuauucauauguuaaaugaagaauaucuuuuaaaacauaauucauuccacuaagcaaugugaugaagccacacuauagaggaaaaauuauagaagucuguugagauuccuuuuccacaaaguuuauccucucucugaugccucuuauguaccucaaguaggaagauaauguguguguguguguguguguguguguguguccaacucaggaaagaacuugaauguccaaauggguaaaauguugugguuguacuugacuuucaauauuuaggaaaaauaaaauuaaacaaauagggggaaauacuaacaauuguuaaaccuaaaacaaaaaaucuaugacuaagaauugguuauauuuacuuucuuacagagaaaucugggcucgauuucuagcuuuugaaaguaauauuggugauuuagcuaguauacucaaaguggaaaaaagacgguuuacagcauucagagaagaguaugaaggcaaggaaacagcuuuacugguggacagauacaaguuuauggauuuauacccuuguucugcaagugaacucaaagcacugggcuauaagguauguacucagcaccaagguagcuguggggucuccacuuccccuauguuuuuaagaguucaaagacaauuuucauucuaaggucaauucuuucuucuguuacuaagacaaaaaauucauugauuuuguuguuguuguucaaaaguaacaagaaaaugaaaauuaaacauuugagagagaauaaauguuuucauuauguaccuggaauugucggugccuugugucugacagaugauggaaaaaagucuuaauguaauuauuuuaaaguaauucuuaucaacugaugaauauuuuugauagagcuucaacuaaacauauuacuguuguguaguuugucaagauaucaaaaagggacauagccaggcaugguggugcacacauacuuauaaaccuuggauuuacaaccaggaaggcaggagguuugcaaagccagucuaggcuauacaaagcaaaacccauguuuuugcgugaucugcugcuuucuauagcagcccauaggggaacuggcuucucuaagagugcugcucuauguagaugccugacucauaaacaaacuggugggcacacgccuuuaaucccagcacuagggaggcagaggcagguggaucucuaauuuucaaggccagccuggucuacagagugaguuccaggacagccagggucacacagagaaacccugucucaaaaacaaaaaaaaagaaacuaacuuagucccugaaccuuaguguucuuaaggccucagaaauagcccuuguaccaaaaucaucggcccgugguuucuuggcuuuucugugccacugucaugaacaaaggccaagauggaacccaagaccauucuuggguuggccccuuuaaaucagcuggcaagaggauccuuagccaucacucuuuuccucgcugccuucuuuugguccuagucucauucucucucugaaccagacaagaaaacuuugaaaagaauuauacauaauuagauuuggaccuuuccuuugauggauguucccggucugugccagccccauaauccuguucugaagggauuccuuauaacacauauucuacuguucaaaaaugaacaguuuuuaccucuacuggcuuuuuuuuuuuuucagugcaaaacuagacauauuaagaauuauuagaaaagaccuucuuuuuuccuaugauaaaaaugguuuuaaauaguuuaaugaaaauaaagagagacagcaagaugguuuaauaggucaaggaacuugccaccaagccuggugacuugaguucaaccccuggaacccacaugauggaaagagagagucaacuccaccaacuuagacucuugacaagcacaugugcacacacacaaauauaauuuuacaaagacuggaagacagaucauggccaggcuugaugguacaccccuuuaucccagcauuccugagacacaggcaugugugucucuuacuuucucuaaguucaaggccagccugccagagcuaaauaaauagugugcccuaucuuggaaaaaggguggggguugacuauuucuaacuagagcuacuuuuuaaaugaguuuuccagccuguauuuccauuucuacuuuguauuuagggagaacuagagugcacugcuaugugguaguuggugguaauaaguuguacacuaaccacagcgagcgguuucacuguacuacaugauagcagugucaccaacugugugccagcagauuuggaggacugaaauggacaggaccuguuaaaggugacugugacauaacuuggagagggcccugcugguuugaaaggagaagguggacacccaaugcucucucuacuuccuauuagcugugagaucuucuuuuaagcuccaguccaugcuaggaauguuacugauuuccucaaagagugaauacaaucuggcuaagaauauauguucaagauauguuucuuuucuccuguacauuggaaggauguucacugcauuagcgaacugcugugagccagugcagugcuagugauccccaucuuggcuuucaugaagcaagaaucucacuuaacccaggcuuuucgcuuuuacugagauguuaauccaguggaaggaaaguaucaaaaagcaaagcuuuaucuuagcugggcauggugagaggugccuuuaaucccagcagugggaagacagaggcggcuggucucuguaaguuugaggccagcugaguuccagaacagcuagggcuacaaaaugagacccugucucgaacaaacaagucuaaaccuuuuccuucacaucaccccacucucuucuuggugccauucuuacaacucuuuucacaaagucuuguaucuaucuugcaaugauccugccuggagacagucuagugauucuuagcugggguugagguaaauuuuuaaaaugcaaccuucaaagugaauggcuucccuuguuguguugaacaaucuuuaucaucaugagauuuccuuucuccuucuccauccuuccugugcuuauaacccaauuauuccuacuguauccucaagauuguggaacugcacaaugcucuguaagacccuuuucagguuuaggauucuucuguucugcauuuucaggaugucucccgugcuaagcuagcugcuauaauuccagacccaguuguagcuccuuccauagugccuguucugaaagaugaaguggauagaaaaccugaguacccuaagccagacacucagcagaugauuccauuucagccacgacauuuagcacguaagauccagaacucagacguucguuugauuucaauccaaggugugggagggaaguaaccuggccuuuuccacuguaaguuaacuauuagacuuggggucacagugaguugacaguaaucuuugaacugcaaacacuaagaauguuuaaaaaaccaaucaacccaagccucugaacacugcagaccucaguugcccauuucacacaugcugcagugugcagaguacucgaccaacuggaaacucacugcaguugugagugguuaguagccccucuagguccucuuugaacaagacccuuuugauuaaaugugcuuuugaacaagugacuucaaacaggauuacuaaacacuguaacucaaaaguaguaaacaaaaaugucuuuuagagcagaccuggcuggcuuuacaugaagucacuugucugauucccagugaccuaagacugacacugaauuuccuguccggccuauuucauuuggucacuugguuaaagcacuacagcccuuuguauguguucagaagggagcggcagggacauagaaaguugugugcaggucacuugacuucagcuuucucacauagaaacugugcccauguuucaugccugcuuucucccucagcuccaggcuugcacccuguccccgguggaguguuuccagugccuccugccgcuguuguuuugaugaaacugcucccaccuccuaucugcuuccagguuuguucauuguacacacugguucucugggucgcaguaauuauauggguuuuuguuguuguuuuuguauagugggagguacaacagugaacuugucagguaacugagcugaaauguacucgugucaugauaggguccuuuuguacaaguggaugagcugauggaaauuuuccgaagaugcaagauaccaaacaguaaguaacagaagcucauuuucacugcggaaucuacauuguuucccagagagaaaggauuguucucuucagcaaagucucuaaagccaaguauccagucuacagaggugcaggaacagccuggaguaagcugggccuucugcagugugggcauauacucugguaacacacaaucagaauccuggcacgugugguggugcacugucuaaucugucuuagcauuuucucgguuuuaauggcagcuguaacuuaguagcagcaacaccauuccaugcuugcugacaggcuauggaaugggcagagcacucuucuauaguagcaucgucguaagcgauguucuuuuugcuccaucccaacagcuguugaggaagccgugaggaucaucacugguggggccccagagcuggcuguggaaggcaacggcccaguggaaaguagugcuguacugacuaaggcugucaaaaggcccaacgaggauucagacgaagaugaagaaaagggggcuguaguccccccuguucaugacauuuacagagcacggcagcagaagcgaauacgaugagucggcuuaaaccuaccugccucugagagaaaaacucuuacccaggacuccuguuuugccucuuaagucauauguuuuaaagagacaacacuuuguuacaagguuuuggaaacaaaguuguauugucauuggugccucugucauaugguucuugagaaaaaacccaagccuguguggauuuugaauuuggagcagaccuauccucuaagcaagauuagguuuuaaauaacaguacaaaaugacaacgccacaucuuguuccuuuucaagggugucuuguaugugccacuugaagauuuguaaguuuuccacaguuuuauuuuaaaaacuggauggcuuaugauuguaaaacauuuucacauuuucugaaaaacguuuguucucaguuugcuuacguaguccugccuuacuguuuguuuuuauuuauggcagaauguauggcgacuguuuuguaguuauaaauuuuuaaaaggguccuuugaaaggaauaaaaggaccucaaaaacaugccuccuccuguuucuuuguauguuuguguacauggggagcgggcguccaaacguaaacacacagaagccaacagaggaugucaggugucucccucuauaacucucauucccuugaagcuguuucucacuagacguuuuuugauuggccagagaauuccuagggucugccugu

SEQ ID NO: 958 - RNA, 2022 nt, Mus musculus
uauguucagguuaaaaguagaugaaauaccaucagaagacgaugggacaguguugcuguccacaguuacagcccaguuuccaggggcauguggccugugcuacuggaauccagugucucaguguaugagagguguccaacugguggaaggaauucugcaugccccagaugcuggcuggggcaaucugguauauguugucaacuaucccaaagauaacaaaaggaaaauagaugagacggaugcuuccucugcagugaaagugaaaagagcaguccagaaaaugucugaucucauaguauugggucucccuggaaaacaacagaacagguucugaaagacuauuucaguacuuucggagagguucuuaugguucgggucaagaaagaucuuaaaacuugccacucagaaggguuugacuuuguucgauuuacagaauaugaaacccaaguggaaguaaugucacaacgacauaugauagaugggcgacggugugacuguaaacuuccgaacucuaagcaaagcccagaugagccuuugagaagcagaaagguguuuguuggagguuguacagaggacaugacugcugaagcucuucugcaguauggagaagugguagaugucuucauucccaaaccauucagaacuuuugccuucguuaccuuugcagaugauaagguuguccagucucuuuguggagaggauuugaucauuaaaggacucagcgugcauauauccagugcugaaccuaagcauaauagcaauagacagaaagaaguggaagauuugguggucauccagguggcuuugggaaucagggugggauugguaaccguagaggggguggagcuggcucgggaaauaaccagggugguauauggguggagggaugaacuuuggugcuuuuagcauuaacccagcgaugauggcugcggcucagguaguguugcagagcaguuggguaugaugggcauuguuagccagccaacagaaucaguugggcccaucugggaauaaccaaagccagggcagcaugcagagggaaccaaaucaggcuuuugguucuggaaauaauuccuauagugguucuaauucuggugccccccccccuugguugggggucagcaucaaaagcaggaucgggcagugguuugaaugggggcuuuggcucaagcauggauucuaagucuucuggcuggggaauguaggugguggggggugguuaguagguugguuguuagguuagguagauuuagaauggugggauucaaauuuuucuaaacucaugguaaguauauuguaaaauucauauguacuaaaaauuucagauugguuuguucaguguggaguauauucagcaguauuuuugacauuuuucuuuagaaaaaaaagagggaaaagcuaaaugaauuuuauguuuuguuauauaaaggauuaaaauacugagugggugaaagugaacugccguuugccuaauugguaaaccaacacuacaauugaucucagaagguuucucuguaauauucuaucauugaaauuguuaaugaauucuuugcguguucagaguagaaaccguugguuagaacuacauucuuuucuccuuaauuugaaucccacccuaugaauuuuuuccuuaggaaaaucuccauuugggagaucaugaugucaaugauauuugauucuuuugguuuuguuuuuaacacugucuuccuucauauaugaaaguacaauaugaagccuucauuuaaucucugcaguucaccucauuucaaauguuucuggaagaaacacuucauugaaaguagugcuguaaauauucugccauaggaauacuucugucuacaugcuuucucauccaagaauuugucaucacgcugcacaggcugcaucuuugaugccccaaaugcaaagaauuaauagcagauaauuccucuuuuugacccuuuugagauggaacuuucauaaaguuucuuggcaguaguuuauuuugcuucaaauaaacuuauuugaaaaguugucucaagu

SEQ ID NO: 959 - RNA, 17485 nt, Mus musculus
ggaggaaguaguacugugggccccgcccacgaggcccgcccucuguggcugacccggaagcgguugugcguaacccuguacggcaccgcucucuuuuccggucggcguguuucuggaucggagcgucuuccgcagcccggccuucaccaugagcgucccggccuucaucgauaucagcgaggaagaccaggugcacgaugcugggcccucggggcaacgggugcgggggauucccgggacggagcccgugagggggagcgcgcucuccugaccugggucucggcgcgugcgcggccgaggguccggaugcgggcccggugggcgccagggcucguccgcagucgucgaugacgacccagaacuuuucggggacagggaccagcgucugcuaaguucgcguguggcccgcaggagcaacuuugagcgugugaaugcgggccuuccgcggccacaggcgacgguggcaugcauuuuacuaguuggcucgcguuuucuguucccaggcggcugggaggcaggagcaucuggcgggccauccuggacacuuugaaguucacuaauugggguuuacaccuggguguacaggacagauggcuucuccuuuuucuguaacaggagguuaauuguugggaugacagucuuuuaauuuucuacaacccaaacuguucuucgugagcaugcauacgcuuuuauaauacccacugacagaaacuugggguuccauauguuacacaggagaagaaaggaaguuaugcacacauagaaagaugccgcauuaagaguauuugacagcagaggaagcuagaguucccaggcauugacuaguauuuaccaaaaagguacuucaggccaggggcugaauagagccuuggcauuggccauauuguagagugucuuguugucagcaagaaugauauaaaaacauuaaacuuaacuaauucuuagaaaaagauuuguaaagcaggaagugaacaaaugcuuucuuuacaucuugguuagauuauauauuugugucauaaagaaaaagaaugauuucugcuguuauuuugcuuuuucuaauaugacacuugaguuuucaaaauaucuuuuuuauaauaccaugccaucuucuguauaaaauuacuaugcuauuguuuggaaaaauaauuccaucagaccuaaggguuuguuagguuucugaggucaccaaacacauuugugggauuaaaaauguugguuauuuuccccaaggcucuuuuggcuuuguccagacaauuugacauccgugcuuuuucuuuccccaacccccuucuuguuuugauauuugggaaguguuucacuauggcuuguuaaaccuuggcuggccaggaaccuguagagaucccccugccucugccucaagugcuguggucacaguuauaugucaccucacccugcccaccaccucacccuggcaccugugcauuuucuaauggaacgcuuuauacugugauucuuuaaguuuuuauucuguuagcuuuaagucaucuacauuucuguuucagugcaugaauguuaaaccaucgaaggaaaaacguuguuaaagauccuaacuagagaguaaaguaggaaacauccaaaugacuuauuuuaguaguuauuuugauaguaccaaaagugcuuucugccucugagagugauguuauguuuuaagauauuuguuauacagugcauugauagacaauuugauacacauacacuuucaugcaggcugcacugacaggcauuaucuuuuuauauugguaucucccaaaaugcuugucucaaaugguucucaaguuauuagcaaaugaauagacuauuguccggaugaugacugugauuuuaguagugcuauuuauauauacauuugacagcuauaaaauuuucacuuacugggggaaaaaaaccucuucaacuuugccaagucagauugauguaucuuuaguccccaucccucccaguggagaccgcuuaaaugaaauaaguaaagcauuugcuauagacuggaaguccaguggauacagguggcaggaaacugaauaugaucuuugugaacuaugugucugcguggacuuuguagagggagggagggaaucaacacaauuggaggguaguuaguuagcacuugcauguuacuuuggaagcagggcagaugaguuugauauuuguguuuuaucauaacuugauuuuuacaaguggaucuagagauuuagcaacccuguuugauucauaggcugcugaacuucgagcuuaucugaaaucaaaaggagcugagcucucagaagaaaacucggaagguggacuucauguagauuuagcucagauuauugaagccugugaugugugucugaaggaagaugauaaagguuuguuuuaauucauucuacaaaauauuucuuacaaguucucuaccuuaaaguuuuucuugucaguuauaugcuuugguuugagacuuaagauuuuuaagcaauguagaagggaaagaauacaaucaaaaauaauuaugaagauauuuuucaauuaaauauuuucaguuaguuuuaaauguaauauuuucauauaauuucaggguuuuuuucuguuagaccuauaaaguaagccguucugggggaaccuuuuaaaaaaacggaaaaaguguguguguuuguacauauacuugauguugaugguuuuaaaaugaacugaagcguuuggauggacaucaaagaggguguuauuucaaguaauauuuaauuuaauauuuaauuguucagcugcugcccauugagauacagcuucucaauagucaguauaguuucuguacugugaacucugaaauauuuguuaaaguuuaaauauuaaauuuuuagagcgauuaauaucucuaauacuugaaaaugaguuaagcagcaggaauauaacagccauucacuucuaaauaauucucuacaugagguacaaaguuuucuucaguuguugagaccuccugaccuaaaauccagcuaguaauuucaagaugauuguguauuaugccaauggaaaucauaaagaaaacguggauguguaaaugcuggcgcuacaguggugcuggugaggugagaguucauggaugcuguagucuuaaagcucucccugaaaucaagguguucucuaacuuucacaguaggcaagcuauguauuuuaagcaucuuuguauugaaauacuagaaaugugugccagauuggacgcgcugaagguugugucugcugacugugcucuugaugccuauguagauguugaaagugugaugaacaguguggugucccuccuguugauccuggaaccagacaagcaagaagcauugauugaaagucugugugaaaagcuggucaaguuucgggaaggcgaacgcccaucucugagacuacaguuguaaguuuuagacugcaagaccuagguggagaaauggcucugcagagugccugaguuuaguucccaacacucgugucagauggcucagcuuccccuaacuccagcucuuggagauccaguacuucuggucucugcuggcaccugugcaccuacacacacacacacauauacaaaauuuuaaauaauaaaaguacauuuuuuuuuuaaagauacagcauucagagggauguuuguaugguauaaauuaugauuguuagaagcaggaauucuggaauuggacugucagcagcuuucugucuugggcagucacucaaccuuucugugccccaguucccucuuuagaugaaguuauuauuagugcugccuuguauuuguggugagagcaaauaaccucaauuaguacuuugguuguuuguuaaccaggcucagcaaccuuuuccaugggauggacaagaauacuccugugagguacacaguguacugcagccucaucaaaguggcggcaucauguggggccauccaguacaucccaacggagcuggaucaagugaguguugugcuuguaggaagugaagcuuacuuaggugggaacucagguaggagcagcucugugugcccucaacuuugucuuuguuucuccuuugggaaguguggcccccgguggacucagacuugauguguaguucuggaugaacuugaacccaucuuccugcuccuccuuagugcugagugcacuaaacugaauaugugcuccucaucucucuuaauacauucucuccuucccucaaucgcggugcaggugagaaaguggaucucugacuggaagcucaccacugaaaagaagcacacccuccucagacugcucuacgaggcgcucguggauuguaagaaaagguauuccgaagcgcugcgcugacucccagcucuaguagaugggcguguuucuugaagauaaguugagcuaguuguuuuuaccuuguucuccacagcaucagaaaucuuuagcuccugaguaauugcaaagacuuaacugagcagcauaacuagagagcuggagaugugguguaguuaguagagagcugggaggaguggggccccgaguacacacccggaaccacuuaaaaccagauguggugggugggcuucugauccuggugcuggggaggcagugggauucauccucugagguguauacaaagugaauuuaggaccagucugggguacauaagucccugucuuaaaaaauaaauaaauaaauaaaauuuguucucaucuuuaaacuuuccagaaaggaaaaauugaauguguucuaaaacaguuguaaaccccaaagcuguauaugauguuagaugagguuauuuaauguuucgaugguuccagggugaugcugucguuuuuguuaagagguggugugggcucugagaaagagaaguugcucugagcuaagaacugcagaauuaaaugaguucuuucuucuuggguuccggcaagguguugguguaaaggcuucuuucuguucaacuccucaaacccacuggccaaaauaccgucuacucaguauccuagcuuuaggugccugcagacagucagccauguugucuggcaguuuaaaugaaggcuagcccuggcugcuuuaccuagcuuuuucuuauguguuuaauacuucuaacaaugaugacaacaacaaaaacaaaaacaaaacccaccauucuucaguuaauuuccuuacacaaauuucaccauagcuuuuagugcuaguauuagcaagaugaauucacuuguuaugugguacauugcaaauauuuucauacuguuuaagaaaaauaaggauaugauuuugaugugaagguugauguguuuuauaauaaguaaauagugcuuaccuuuguaaucugugcucugaagcaguggguaguuuacucuaugguggccugguugugacagcaauuuaaccaguugucaguaaaagguugagaggaauuaguuuuacuuugaagacuauuuaaaauggaauacaugcagacuauaagaggcacguguauuuuaguauacaggcuguagaaucaggccucugggcuucaaaccuugaguuuauuuguauggcucugagcagaauagacugcuuaguguagcuguaguaauucaaaaugaaaacaguacuucuuaccucagguugcuaaggacaucacauggaguuuuaaaggcuucauuacuacacagacacuugucaguguugaacaggacuaucuuccuguugcccuugucaguguugaacaggacugucugcccuguugcccuuuucauuuuuaagcuugccuuuaggagcugaguugguuuuucgaaugcagugguuuuaggugauggguguuaugauugccuguaaguaaggugcuugcuggauggaguuggaaccuccucucuggaggauuucucuuuagcauugcuuguuuggcucucagucuguuaugauggaaaggaaauaauggcguuccagggcuauucucagagaagcgagauaggucaauaccaucuaccaggacuacuggauauguccugguguuugcauauuacaauauacuuaaucacagcuaugcacuuuucucuuuuuaaaaaguuuuaugaggcagggagugugcaggaggggcacaggagugagugaauaucaagaggacaguucucuccuuccaccuuuccauuggcuccugaaggccuuccacagauguuccccuuugcagggcaaauaccuuugccuuugaggccucucugguauucuucucucagucauugcucuccgucuucccuaccuauucuguuguauuuguucucugugguuugcuugcuugcuggaguuauggaggagccaaggaccuaguguaccuuaggugggcugguucuuuguguuggugguuuauauucccugcagcacacuuggcaucugggcaacacccgugcccugacgugggccaaucacccagucacugcaagcucaaaugucucugagggugcugcuaccuugaacaaucuucuuauucuuaaauguuaucuacacauugaugauuucuaguuuuuaccucuucugcugcuucucugaacuucagguguccauuccuaguuaacaucucccauagaguguaugaaaggcaucuuagacuugauaguucuaaaaguagauuuuccuccagaacucaagaaauuaccaucuccauuuuuccaguugcuuaagaccaaaauuuggacuuuaucuuugacuucucugucuuauauccaucaacaaacccucuaggcuuugaguaaaucuaaagucgaccaugucacuuccauugcuaccaaauggcuaagccacuguccuuucuuacuuuauuuaaauuaaccacuaaccaguccuuguuuugaucuuugucaaacuguucuuaacacagcugacagaaaguucuauuuaagauggaugaccagacuuucuccucuagagagaacccucccgggcuucauucagaguagcaggacaaagccaacuuuagucccauggcacugccuuuucccagaauacugccuagguauccauguggcuccccuuccucaugucaugcaaugguuccagguguuggagggccuucucugccuccuuuguagcuaacagcccuccucaucucuguuacuauauauuuccuuuuugccaacaggaauacaauauauuuaauguuuaguuuuguccccacuaaaagacauccuucaugaagggucggacuuguuacuagaacaguagccaguaggcaauuguuauauaugaaucagaugagucacuguugcuaacaucaucacagccaagcaguggcuacaagaggcagagaugugagucgcuguccagugcuagcuugaacuggugaggaugugccuuccaaaggcacgcagugugaaauuuccuggaucucguuguaagcauauaagaacucuuuuuuuuccuaguuuucugaacugagaaugcauguuuuagaucugauccuuuauucuguggaacagaugcaaugcaguguacgccacuguguguucuuggucuuuccucagcaugugccugcgcucccuccaagcucuucuguuuaguaacuagucuccuuuuacuucagguucucccucccucccucccucccuuccuacuuuuuguuuuauguauguaccugaagguauguaugcauucaggugcccuagaaccagaguuagagucaguugugggcuuccugaugugggugcuggaaccaagcccauguccccugcaagaguaacuuaugcucuuaauuucugagccaucucuccaggcccuucuucacaccuuuguaauaaaaauccaugucuguaauccaagcuguuuuacuaaaaacuugagaucuauaugugugaauguuuucuguuugaacuucuguguauagcccauggcaccauguacucaguguaaccaaaaugaagugacauuucuuuucuuagucucuguuccuuaucaguaaaugccaagaugaugguuucauuccuuccucucugcgucuucauucuacauuucauuccugccucucugcaucuucugugauggccauaccuaguuauuucugcuucuccagugcucugucugcaaacaucaccauugguuuucugcauuguugcaaaacucuucaaaguagucuucuguguucucugaugagcaugauuuuuuucuuugaaauuucauuauguuauauaguuuuuuccauuugcuuugauccaguauggaauccuuaauguggcacauaguuccagcauacagucucaccuacuguguuaguggauaaugaaagcugucucaccaguuuuauagugacagacuacaaaaaguaugcuuaaauauucucucaauguaucucuugcacacacauugcacccgugccauauucuuauuuuucacaccuuaaacaagggaacuucuaucaggucaggaucaccauacauuucccagucuacacaggaggugguaccugccucuauaugacucauaaggacaugguugcugcuuuuuaaaaaauguauuaauguauugauuuguguggggugcgcguguguaaacacaugcacguguauaugccuguguacaugugccauggugcacagguggacgcugaaggacaaccugugggaguugguucuuugcugccaccaugugaaucccagggaucagacucaggaugucgggcuuggcaguaagugccuuaaaccugagccaccucuuacaccuauguuuuaaccuuucuaagugguugagggagaaaaagccauaugaaggguaauauuccaugacaugaacauuauauggaauccaaguuugagcauaugagaacuuguugguguacaucuauugguguucgugugcacauucucaagcuagguuggccaggaacugaauggauagaacagagacccauuagcuugccaaacauuuaaaaacauuuacucucucagccuuugcaagaagcugccuauuccauucagaauggucugcuuuuuaagaggauuuuauuguuguuguuguuguuuauguguguguggguauuuugccugcauguaugucuguguaccaugugccugucuaaauuuuaaagagugaugcuaguuagcuaagcccuuauaugacauaugccauacuauacaguuuaaauggaguacuugauuuuuaguaaaaagacuuguaguuguacuagauuaaaauauacugugguuucuaagacuagaaggcauagugugccuggaauggagaauagauaaacuauagugguacguggguuucuuaaugcuuuccuuuggauuuuuauaauuauagauagcacuguguuuuagacucuguguguguguguguguguguguguauacauacacaaacacauauauacacauaugcauucacacauacauacauacauacauacauacauacauacauacauacauacauacauacauguuugacaauccagguuaucuggcuuggcagcaaaugccuuaaaccugaaccaccucacauggcuauguuuaacauuucgcauacauauauaauauacauacaucauugaacuuaaggcaaacacaauuccuacuguguuucuuagguugaguguaguuaggaagggaagaaaucucuagaaaaagaaaaggggaaaccccaguguuucucagcuuagcaacagugucugaacuagcugaaaguccauccauuaaagggaguaagaaagggcaaagguaaaugcugggcuugguugcuuaguuuuuggagguacuggggcuagaauccagagccuuucacacaguuggcaaguacuuuaccauugagcuacauccccagccaggauaagcaugugagccuccaaagugaaugaaugugcucaggaauucuacccucuuaugagaguaaagacugaccauccacaugcuuguaaggauauuuuacaucugaaagcuauuuuaagcagugauguaaaugcuugauguuggcucagcagccacacuguccuaacaacuuaacuugagccuuuaugccuuugcccggcaagucauccuacccugucuuccaccuuagccuguauuacagcaaagacuggagggucaagggagauuuccuauuuuagggucucagcuuaccuaacacaccuucagagacucuauuugcucuauaaagccacccccacuuacugcccuuuuuuuuuucccuugccuuuuauuuucuucauaguacuuaaucauuuauuaguuuuccuuaguuguuugacagguucugugaguuuuuacuuuuuuuaagaaacagccaucuuggucacuguuucauauauguaucaguauuuuuaggggagagagugacuaccaaaauucagaccauugaaaugaucucuuuuuagugaugcugcaucaaaggucaugguggaauugcucgggaguuacacagaggacaaugcuucccaggcucgaguugaugcccacagguaauauuggacagugcuccagugagcacuuaaccaucgacuuagagaugagcuacagacuucaguucagcaacugacguaaucucuguaacaggccagggcuagucaguagcauguucaggauugauacugcaugugaaacagcgcuugggaguuacuguacaggcuuguguugcuagaggcuaguaaguacaaccgaagaauuagaacucacucucuggucaguuuuuuucuuuuuuuuuuucuuuuuuuuuuuguuuauuuguuguuuuuucuagauaggguuucucuguuuagcccuagcuguccuggaacucacuuuguagaccaggcuggacucaaucucagaaauccgccugccucugccucccaagugcaggcaguuucuucuuaauaagguauguagaugggagaaaguuugguuacuaggcaaaauuuagccguuugcuaaugagaaaauaaggacuuugugcugugucauuaacauaaaaugaggcuagaauuagguuuuuaugaaauuucugcacaggguuauuauugaauauguacuuggacauggcagggguucugcuuuggaguuagacugccaguguuuaagcuuuuaccacagaacuuaauuggcauuugcuagcugaguuucuuguuuuucuuaagugucuuucaugaucucuaaaauggucgugagaacagugagcuguugcauuccagcugucagagcacacccucagugaaauaguacugaccuguuuuaaccagaauuuguauccuguccauccuauauugaauuuagauuauuaaauuaaauauauuuuaugaucuaccaaauaaccaacaagcuaggauuucaaggccuugcuuuuuguuuucuuaccaagguguauugugcgggcacuaaaggauccaaaugccuuucuuuuugaccaucuucuuacucuaaagccagucaaauuuuuggaaggcgagcuuauccaugauguaaguaguuugucuuuuggucugaauuguauucucuccagagucuguuuuuuuuuuuuuuuuuuuuaaguauagaauagaguuuauucagggcaugggggggggaguuaagagaguaguagaggcagagaaagggagagagaggggaggggaguugaguacaagagcaaagcaagagagaagcaagagauggagagaucaagagccucucuagagucguaaaugcugaagcagcagccuuguccugucuguguccaugcaggagguuacuggagagcuccuacgcucucuugggagcaggcugguagaaccuccuuucuccauccacugaacacugcuccuuuagcuucugucuuggccuggccauuuugaacuucauuaacuacauuucuuuuuauuaauauuaccagcccaacauaaaauaaaaagccacagucuuggucacuaccaaguguuggucaaauaaccagcauuucggaggcuggggcaaggaggucguaaguucaaaaccagugugagcuauauauagcaagagguucguucuccagcaacaaaugaacuccauguucauaguuuugaagcacaaguaauuauuuuauauugccuuccacuugggcuaagugucuuagagcuuaguguacaaugaacuagaugauguuugggcaguauacugauaggcuucuacauuaaauguggagaauuauuguuagaaguuguaaaauauccugacuguucauauagcuucugucuugauguugucucuuaucucuguaguuauuaaccauuuuugugagugcuaaauuggcaucguaugucaaguucuaucagaauaacaaagacuucauagauucacuugguaaguguuggguauugauuggguugguuuuguauuuguuuuugugguuuuuuuuggggguuuuuuuguuugguuguuuuuuguuuuguuuuuuugagggagagacgggaaugcgcauggacccaucacaacuagcagagaaguacuuauuuuaaaagcuuuuaagauuucaugaugaaaggcuaaugguuaugauugacacacacuuuacguuauuguuuagacacaugcugauguguauaaaccauaguugcaggaucauaucagguuucgcuccccuuuaauaaauaauauuccauaaaugguugacuccacugccaaaaaugaauguauagugguauuuacacaguaguaaaaguucuuugaaaacaguauaagaagucuugauuuugucuuugauguucuuuugguuucuuugguuuuguauuuuuauuaacaugcuauugguguggugugugugcacucacauaugucuggauaucggaagacaaccaggaagagucuguucuguccuccucugcugguucuagguaucaugcucuguugguucuagguaucaugcucuggcuuggggcaagugucuuuccaggacaagccaucuugccagccuuugaacagguuuuacauguucuuaaacuacuaguuuuuuaaguuuuguuugaaugcuuaugucaacugaaauaaagggacuuuauuuuucugguagguagcaauuaaaauacaguagaaguugauuuguguuucauauuaaaauggaugauuaaccuuauuggcugugugagguguggauacugaagaggacuauugggaguuacuugacuaagcucauguuguagcuugguuaacuuuauuccuguuaccuguacauucuguacagccagugguuuggggggaagguugaguuauuuguacagcaaaugguuuugggggaagguugaguuauuugaacauacaguguuugaaauguaccaagacuagaugcaugaaugucuguguagacuacuucgccaggugcacuagacccagaaaaccacauucugucccaguuaauuugcuuuguggcaugaagcugugugauggaauguuaaugucagcaaccucuuuauuuacgcacuaaggcaaaaggaguaguaauuaacacuuugacacucccccaucgauguguaauugacuguuucaaaggagcacugguucauaagcuauugcaugcauuaaaacugcguuuucuauauugcagcauuuuaagacaagggucagugacaaugcagaaauugcucaaugaugcacauuuuuuuauuacugcauuaagguuuugacauauuaguaaugaauaaauguuuccauaaaauuagauuuuuuauaacuuuaaaauugaaauacgauggagagcccugagccuuccucugggaagggagcccaguucaugaaccaaagcgccgcugccuuuagauuuguaacucaggcuuccccugcauaauaguuugcuuuuucagagcaggcauccuaaagacuguacguuuggguccuuauuuaaaaguaauggcuauaaaugugguuuuuaggcugaaauaaaugauuuuaugcaguucauucccaggaauaauuuucauuccuuugauauauuuucauuuauaguagggguccugcacaagaguaucauuaaacuauuuuuaaugcuauuggugugggugugugugcacucacauauguauggauaucagaguauuuuuagggacuagagagaugucucaguaaguaaagguacuugugcaaguaugagaacuagcgucagauugcagcagcccuggaaaagcugggugagucuuuguuauccagugcuggucuugcagaacaggcagaucucaaggucugcaggcgaggcaggcuaacugaaugcugggauccagguucagugagagcccuuucucaagcgaguggagaagggauagcagagccuacagcuuuacccacugucuccaugagcacacacaccuguaucugugcgugccauuuuuaaucagacccucagaauuugagaaguuauauuguuuuuucauaaucagaggacuuuaugcacauauaacugagaaugcuaagggauuuuugagaauuuuuuaauauuacuugauaggaucaaauuccuagcugcuaguuuacuaugccaacuagaaaagaaauuccuuaauuugccuuuuguuuuugaacaucuucaacuagaaaucugcuuuuuuauagaugcuuuaagagaaaugcuaauguuauaaguauuacauuccacagguggcaucaguuugucaaaacauuuuuuuuuaauuaacaaugacaacuugggccaguuguaucauuaucuugugucaaccaaauugcccuaacaugucuacauguaaucugguguuacccaguucuaccuucuugcuucagaaaguuaaucaccaucugauuugcauuugcuaauuaggguuaaugugcacuaauugauuuuuuuugaugcuuguaaauuaacauuaaacucagcaauacuuacuuguguaccucauucauuugaguuaugaucauguuuuuguugaaucugugccaaaucagaagccuguaucgcaauuacagcuaauuaacagaugaucguguccuguauuaacaggcuucccuagucuuccacuaauacaugaaugcuaugucauuuuauucauguguguuuaaauaauuuauaauacacuuggaauaauucugcuuuuuaaaacuuguuuugauaauacaguacugucaaaacaaguacauaauauucugcuguaacucccugcuuacagccagcuaaagauccaaauagcaaacaccuucaauccagcauucgggaggcagaggcaggcagaucucugugaguuugaggccagccugcucugcauggcucauuccaggacagccaggacuauguagagagccccugucucaaaaaaaaaaaaaaaaaaaagaaaagaaaacaaaaaaaagaaaacaaaaaaaauccaaaggucuucauuauuuugaguuucuacacuguaguauagaugggccuaaauucucuggcuauaauuccacuucguaaacuaagucaauuacuugaucuuuggguuugauuuuaguuaguuaguuaguuaguuuuaagaacaacaagauagcuuauuauauugacuucaaggucuaaaggguuuugugaucuuaauagcuuauaauaguguauaucauuagaaauuauauaaauauuaaaugauuuauauaauucuuuggccuuaucaaacaugccuaucuguucaaaacauacuuguagcccauguguaacuuuagaccuaaauacauguauucugucauugauuacuauaaaauacgauaguuuagaaaaaaucuucaguauucuaagguccaguauaauuugucagguuuguucuauguaagugcucacacauagugacaacuacuacauguaauuguggaagccuugcauugacacucaacagaguucacuguucuguaauuuaggcuuguuacaugagcaaaauauggcgaaaaugagacuccucaccuuuaugggaauggcaguggaaaacaaagagauuucuuuugacacaaugcagcaagagcuacagauuggagcugaugauguugaagcauuuguuauugaugguaaggcaguagaaagaacauugcuuucuagaauaucuacgauguggaucauuuuaucuugaaaugagcguuaugcuaauaaagcuggguuguuugguaguucaaauuuauuugaaguagaaugaaacggcuuuggguuuuuuuuuguuguuuguuuguccuaauuucuaaaaucucacacuacguaugaugguuagaagcagggauguuucccugggugugcugcugcaugcuuguaaugcuaacauuuuggaggcugagguagaaggacuaccacaagucaaccaagacugucucaaaacaaaaagaagauagauuuuaacccacagcuuccaguaggacaggaauauggauauugauuugugauccucaggauuaaacacauaacugcaaguagagugauguaacuguuaaccaagccuuucauuguaaaaguuguacaguuaauagaaugcguagaacuugguuucuguacuuggcuugguuucuaauaaucuaaguuuccaguaguuaucuaaagaaauaauacauuauuugguaauuaauccuccccauaagucacuguaaaacagaauagaauucuuuguuuuggccaggucaaaacugugcccaggcuagccuugaauucaagacaacucuccuguucucggccuccuaaguguugagauuauaggcaugagucaccacaccugcauuuucagccagaauccccaguaaaaacauuauaacacugaauaguuaguucuagcaguuaucagacacuaaauuacauaaccuucuuguugcauuuucuuuauuagauucaaagagcuguuuuuguuuguuuguuuguuuguuuguuuguuuguuuaauaauguuuccagcacuguaagaguuuuauacuggucaauuuggucauaccuuagcuguuuuuuucuuagaacuuguguguauagcuaacauguaaaaaaaaaaaauucucuuucagcuguaagaacuaaaauggucuacugcaaaauugaucagacccaaagaaaaguaguugucagguaaggccuauaauauuuuguuucuguaggacaauuuagucuguucugaugauuuaccuuaaauguuuagagaagcaagguaguguucuuacuguugacuguaguuaaaacuuggcuguuugucauaauuuuauuaagguucagcugaaugugauuagcuuauuuaaugaaagaguccuauuuuccagcacauuucauuuaauagcuaaguacuggcuagaauacuaaugacuucgugucugcuuuauagauguugagacgagaucuauguggucaugcuuaaauccuccuucaccuuuaaauuguauuuaauuuuaauuugaagaagauucaacuguguaguauuuugaaagaauauucagcacuuaagguuaauuaauauuuuguucuuaauuuuuagucacagcacacaucggacauuuggaaaacagcaguggcaacaacuguaugacacucuuaaugccuggaaacagaacuugaacaaagugaaaaauagccuuuugagucuuucagauaccugaauuuuuaugaaaaugauuuuguucguugagaaaaaaaguucuaaguaaaacauuaucaacugaaauuuga

SEQ ID NO: 960 - RNA, 13711 nt, Mus musculus
gcaaggugggcagaaaggguuuauuuggcuuacauuuccauacugcuguucauuacugaaggaagucaggacaagaucucaaacacagcaggauccuagaugcaggggcugaagcagaaaccacgguggaugcugcuuacuagcuugcucccugugccuugcucagccuggguacuuauagaacccaggaccaccaacccagggguggcacacccacagcgggccacagagggccagacucuccccccauugaucacuaauugagaaaaugccuuccagcuggaucucauggaagcauuuccugaacuaagacuccuuccucucugauaacuccagcuuguggcaagaugacauacaaaaccaggcaguacaguguggccuuggggcuuggucucuggauucgaggaagccgcacagucaguccaggcuggguaaagacuuugcugcauggcggcguugguauccaccauguucuuguccaucacccaugcucuguacacaagcccaggaagcucucuacuuccucagcguggacucagugucacuguacuuugguuucucauuaggacauuguuucuaucucacccaaggaguucaucuuagcaacaaagucagugaggguggaggacgagguaaaggggugggaagagguggagacaaaagaagagugaguaaagagguaggcaguucucagaagggaagcagagccacauccuguuaggcaggcuccacaggcaaugcuaagaccugaauuuuccaguuaaaugucucaggacuacugugaaaacacgacuuugaguucucuaacugcagagaagggcgugaaguccagagggaugaaaucagcaacuacacauguauucugaacuugucaguaauuacugaguccauuccgaucuggaccacggacucuuuugauuguuugauuccagaggaagaaaccacacuugcuauggagucaaacaccacaagacacauggauagauccucaaaggcauccuuuauucacuuuccucccaucuacaggguggaauuucaccuguaaguguuacuccagcuaguuuggucaauggcugagauguucaccuugcccuguuuccuuggcauaagcugugcuagaagcaggcucagagauucaggacucaacaaauaauaaauccacuacaucugaucccuagccucacagccagggagggacugcauuuccauucacuauuuaaaaaaacagacccaccucauuaacauguaaaaaaaauucucaaguauauuaagguguugaccauggucauacaguuuuucaaauaccuagcauccaucuuuuuccuaucccuaaaauuccguuuuuguucacauuaucuuuuuuugauugcuucuuaguguuaaaaacaaaacaaaaaccccaggauguggguuuauugugcacauuagcaggucuauacaggaaaacgcacaaaaguuuauauaccauuuacaagacagcuccaaguauagaagauuugaaauaccaugccugcuccaaggacaauacaaauugauuccuucagccuuuaccuucaccaccguuuaacaguggcaacuaaaaaccccaaaauuuaauaguucaaauacacagcgguuacucuguacagugucccacccacccaccuugaguuacagagcccuuucauggucucuuccccauuaaugaguuaagugggggagaggagucuagaaaaaucaugcuguagcaauguauccccucagaggacugcaauuugccaggaguuuaaugugcuucacgggaaauccuacuggaauaaauaaugaugguuauuucccaguaaauauggagugaaaaauaauuuuuaaccccaaucugagguauaaucccacuguuaagggacacaacugcuauacccuugacaacuauagcaaucacccacuacaccugcagacagccugcgacaguuggccacaccagaaccagugucuuucaaaguucaucaugauuuuuggucaggucuuccccguaguugguagcuuggcuucccacaaacauguuccaguuguccagaaucuccuccuuggucagcaucucguccugagggaaacagaagagccgucagggguggcugggggcucccgcgggucagcgcacuguccacuucguuucaccaaucugagggguuucaaacucuacaucuaaacguccagcaguguuccuuucucaucuccugugacuacagugcaaagcuccaccccagaaugaaauccggcugccuguggaagcugugcuggagcacugcagggaggaccugggaacucaggagacagacucuacaagcaauguggguguucucaaaacagcccagcccccacuccccucucacagccucacugugucacauguaggucugcagagcucagaguuuagggccauuaaagucaggugaggcaggcauuuuuuucucaaucuuauuuauuuccucauuugaauuguaacaaauuauuauuacuacaguacuagggacugaacccaaagccugacgccugacagccaagugcauuacgacugagucacaaacacucccagcccauuugcuuggauuccuaucaguggauauggaaaugcuggaagucauucgagucccccaaacacacaaacaaaaccagaaccccaggaaguuucuugagguguuugaccuccaaagggauggacucccuaugucagaaauguuuuauaaauauuugaugacuugaugaagggggaaacaagcauacuggguaaauuucuuacaccuaugacccggcuauaccaaagaugcuuuaaucuuagagggugugcucaguaaucuuaguccacggcccaugacggacuaugcaggaaagauggagccuugcucccugcagcugucaggguacugggguacuguacaggaaguaaacaggugauggccaaaaggaaccaaugguguugcugacaaggcccacaaacccuaucuugaacaaucuacuuccuguugaaucaauggcucugaacauggaagcuaccuuguuuuugucugacucguacaccagaugccgggccucggccugcgcauggucguaguccugagggaggauccaguggcgaaucucauccuuguccagcuucccauccuuguucagaucucggaagucguugaacugcucccguucagacaaaacccagucuggcucagggccauuguccucgugggaaaacauguccgcuagaaagcaaagcuguucucagucacagaagacaaccaggaagggaaaaaccacuaaagcuugacccgugcauuuucugcaagggugacagcccauggagagaacuaaguggcauuggugcagagcugagggacagccaaugacaggaggacuugguuagagacucggguucuuuaguucaguguguaagcccaaagcuugugaaauggagauaauaaucaggaagucauauuucucaagaccagaggucuacuuuagggagagccucuauuccaccuggcaccauaaaggugaaaacaagguuaacacuuuccacagccccagcuccuugugaaggaguccaauauacacuuucuuuucaugucaauuccuuuacagucugaagaagucgcuguuguucucccauuuuacaaaggagaacggggugaggauauacccaacagcuccucugaacuggaggcuguacaggucuacagcaggcuugcugccaacgccaucuuccccucuguggucaucacuauggcuugccucaucucccaagggcauucucagacaauuuuauuucacuucucuaacaauuaccguaagaucgaucauucucuuaacuuuauaaaaugccagggacaaagagaagggaacacucauacacugcuuucaguuugcucugguuugagacagggucucacuauguugcugggcuggccuggaacucacuaaucgaccaggcuaccgcgaacugucagagauuugccugccgagaacugggauuaaagguguguaccaccaugucuaguccucacucacucuuuaauuuuuguccuuuuguuuuguuacugccugcucacaccccacagguuucucuaaaggaaacaguuucaaaacccuaaguagagaaaaaaaccuucaauauagaagaaaaaaacaauaaacaaaaccaaucuaacaaacaaacaaaaaaccccaaagcucucugugauacaaguuucaauuugggggaaaaaacuacaauguuucaaaguaggaaaaaaaaaagguucuuugucuagaguucaauguaaagggaaagucagucaucagauugaauagacacuugaaagaagggggaagacaagaaaaaccacaagcuagcccacauggggacccaccccuuuaauccuagcacuagagucaaaggcaggcagaucucucggaguuugaggccaaucuagucuccaaagagaguucuaggacagcuagggcuguuaaacagagaaauccuguguuuaaaaaccuaaaaccaacccaacccaacccaaccaaacaagcaaacaacaaacucauggcugauauaugcacacuguguguguguauguacgugaguacauguucccauguguacucaugugugggugugucaaacaaagguuucuucauccauuacugacuucaccuuguauuuuaagacauggucucuuuuaaugcacccgcaguucacugacuggacaucaagcccgaguccugcugcuucugccucgagagugcugggauuacaggugugugccacaccaccagacuuuuuauguaggcacuggagaucugaacucagguccucauguguguacagcaaacacucuaccaacugagcaaaugcccaccccugcauacugucuucugagaagugacuaucacaugagcuaaucugagcuuccuucaacccugcacgaaugggugcuguucauccuguuacagauaagaaaccgggguauagaauuacagggcucucugagggucacacaaucagcagaugggaaagcuggggcucugaaucccagagccuuuccagugugccacacuagcaacucccuuagcuugcccaaagugggaacaccccagaaaucaggucauagccagauagcucuuugccucagucauuaaggugacucuaguuuuguacaauacagaugcuaacaguggccuccucagugugagccuuccucuugagaggcucaugaaggaggggaguguucagauccucaaaccugucaccauggcagcggugacugaauuggagagaaaggcucccugauacaaacaaaccaugggcaugugggauuagcagugugcacucuccacgcuccucaugaacucugcauugagauggugccuggcagggcuacaauucugaguggcuuugacuaaagggagcauuucauuuuguggacugugcagaaagggagaaggguauuaugugugguaaucgaauuuucagcagcuaauaguaagaaagacuuuaugcaugaacuuuucaggcuagggaccugauuucuggaagccaguauucuucuagcagucuucagaggaagauguagaacucucagcucuuccuacaccaugucugccuggaugcugccaugcgccugccuugaugauaauggagccaaauguaguccuuauaagagcugccuuggucaaggugucuguucacagcaguaaaaccguaacugagacauccuccccauccgcuuuagccuuacuguguaucugcaggcucuccaauccacuuaaaggcaguguaacagacuggggagggcuggcuggccuccugugguuguuuucucccuccccucccuccccccaccccccugaaaauuuaauuacucacuuggcaccaguuggaccuaugcaacaaauaggacuggaggguccucucuguugggagcucccagcagugaggccaucagaucacgggugggaguggguggagaagaaugcugcccuaugugcacagcucagccacugcagcccacacucaccgauguacucauccugguccacaaaaccauccccguucuugucgauguccuccaggguuuccuaggaagcaauggggaaacaacccaagauggccauaugcuuugagacuccacugccugucuucuuucucuggcuuuuacagcgcuugguaaacuuguucuaguagcucccagacagcccauuuacauuaaaaaacagaugaugguugguauccccauauccucucuccacaauuuaaagagcagaacccucuccucaaaagaaagugucuguaaacucagccugcucugaugccuacaagaaacccugccacaccaaccgauacccaccaccaggcgucaccuuaggagucugagagaguccaggaugagaagcccccgauuagagggacuguaaaaacagauuccauagugaagagcuaggacccucagcuggugcagagacauauaaaacuauagagacuuaaacauuaaagguguaacugacuugugaaaguauacucuaauuaauuugauuuuuauuugucaugcuauguauuguccuguccaccccuacccccacaucaauaauuaaguggauuuauuguccauugccccaacaacucaaggacuuccugaaucaagaagcuagucugaguccagagcacuaaaucuugcuugaagucaaacaauuccccuguggcagcuccucccccacacuucaugaguuaucacuaaauggauguugagugaauaagagaaauaauucuuggaccccugcccaguccuuggggucuuggacgucaugaagcaaaguaugaggcaggaguggccacugucacugaucagggaucuaaagauauucuaagcuauuuaugaaaaaaaaaaucuuucauuaacagcuccccagcaguuggaacugacucuguccagggaauaggugacggcauuuauuuaaaugucaugagaaaugaagacacauggaauccaaugggacacuauggaaagcauugacuccuuauaagccugguaucugggcccucuguucucuacagacuacagcugaaguagcagcagggagaggacagggggagggggagggggagggggagagggagagggaagagacuacagcagcaacaaccacaacaaugggguagagcccagcucacuaaccccugaguccauaucuaaauggcaccucucagccucugcauaacuaagaugagccagaccauauccuuuuuucugagcugauaguaaagacaggcuaucacaucucuuaauucugucucuguccuuuaucugccaccuaacauucuaagauggcagagcagaggguagaggucaccucccaguguuuagaggggagcuucccaggggaucuauguaggacuaucuuuaauagacaaugcccaagaaaggaacaagcauuuucguguuaauuggcuucggccaggguguuugauacaacagcuagcuuacuuccuggacaaacaagagaucugacauauucaacuucaguccuuccccaauucccagcaggcugaaagugucucuuuuuggaaaaagggacaaggugugggaacaguuuccucccuggucuuuucgcagucugucuagacuuucacuguucucaccaggacuacaaucuccuucauauguucaaacuccucugggugcagaaaggcagugaacuccucccgaguagcugucaggucgccgucaaggucugaagccuuaaaccuccucucaucucguggcagcaucuuuuuaaagguguggugaucagaacuaucauggaauucagcgggguuuccugcaggacacacacagacuuugugaggggggugggggcgggggcucuguucgggaucacauacucuuuacacacaaacacacaagccaucuugauucacccacugacuucuuuaaaacauugcuauucaaaaugacgccacauccucucucccuccaagucaccccauaaucgaccuuagugcccagcagggcuuuacagcaagcgcugaagagcacagguuuuagaccacacaaggucagaccucuauuuacagacuucuauguccaucuauccgguuugaucuaggauauacgaggauucccuaugaucuaggauaucuaaaugcuucagcuagcuuucaagagagcagagucuggcuuuaauuaccuuccuuucuccccaagccugucucccugcuguccaccaggcacuuggagggucugcagcacaccccucccuccguucucuaaugacuaacccaagccccacccaccauguauguauuucugugccucggccccccuccccacauucuuucagucucuccaaauggaaauccaugcuucaaggcccaguuuccacucucuuccccagugaagcccuucauugaauuuuguuuccugaugauguuuugggccuguuucauccuuaccacccaacuucagcagcaauuagaaacugucagaagcauuuuuuuuucucuucucuguguguacuucugagagcuaaguucaagcagggcccugaccuaagaugccuuccccuaugucagucaggaaaagcaacuuggcacauucuucguagguggaggagaauguugcacaauggguuuuacucggaagguugugacagcugggugaaggagguggccaugaugagucuccagugaccuuguucuccacagugcaaucuccaccauggccucuuacccagguaguagccauagguggccugcuuguauucuucccaggagaucuuuucgucuuugucccuaucauaauccuuccagacuuuagcgacauuaucauagauguaucuuuucuguacccguuugauccaaaguuucagcuccucaguaguaacaaggccaucaccaucacugucaauucgauccacaauuuuccuguaguuaaaauaauaauaaaaugaaacaauaagucccucaaggccacaaucaagacuugucuuggcccagcaacauguccagcaauuugcagucuuaaacauuauaaaauucuaagacagauucagccaaucuuccuuccaaagaugauaugccuucuccucugggaaaccauggccaguggcagagaucacuaaaguaccacgccucuacauucugaaacccagauaggaacucugaauucuucucagcucaggacucuggagaucgccaugaccaccugaugagaccuggcaggaagaucuauuagguauaacuguguugagcacauacucuuuagcuuuggguacagugcaacaacaggaaauucuauguuaaucagaagauaagggagcuguuuguuuuuaaauccuacuaucuuauacucggggauuugaaacuuaagaagcaagagaccaauccuguuggacaaagcaaccuccaccagaaagcuggcccucuggcagcugaagaaacucagcaacucagcuaauagggugcagaccacugugcucucuuggguucccaacuccaccuugacuuaggguccagggauuucaagcuagacucuacgaaggcauccuacauacuuguucaggguaaaauucaggcuggaaacuuaacaucuguccaucucuacgucaaacagcuucaagcuaggcgugccauuucugugcgggacuucuacacacccacaagcuauugcuaacacaauguuuaagagaaguuccacacaccugggaugaggucauacaggccaaugaggauucagugucuuucuuuggggcuagaauucaaucaaccccagggauaaauuuugucaguaguaguucugauuaacaguuaacacugauuaauuuaaagaugggaacugaauuccuuaguucuuuauaaguaguuugaccuguaccucuuaacuuuuagugggaaagguaaagaauguggggaggggaaaccaggcaacaucucuuaccugaacccaaggagccccacuccucucucuggaaguuguggacacgauuaacaacuuuaaagugucccuucaaguacaauuuaacagguuuggggcugaaagacuacaucucaugcaucuucaggcuucucugggggcaacucagcuggacacagcagaauucauucaauaccgugaaggcaggcgcugcuccaauccggaggacauaccgccaacgcugcccauuggcuacccaacaccacugagaaacagauacucaggccaaggaaggcucaauggcuggaaaucacuggaacccucuucuguaaaaagagcagcauuuaaucuacaccuaucaacauccagggccuagcuccgcccaacacaaagcaagagcauuagaacuguuuacuggaauuacaggaguggucuugaccucucuugcaaagucacaagaguaaaaucuggagaaaggaaauggaauuuagauagacucugaacgcaugagucaggacaccgagaucuuccgguggcucccauuaucugugugaccucgugcaauugagucucugagcccaaguucccccacuaugggcagaaccgcccaagugacaagaccugugauaacugaagaggaggaagguaaggugccuuuccucucucgggacaacuauguaggugaagggugcaaguaaaauuccaacucucagcaaguaaaagaaaagaguaaggucuccaggaggggcgaagggcaaaugggguuccccugccugccagcugcuaucaaggaaacaagaaaaaccagauacucgguggacaggugaaccacucccaacuuuagacauuggaaaguaauuuaaguuuuucuaagauuauaugaggccacugagacuguaacccuucaguguuuccagaaaucugaaggaggacauguguuuucaauagauggucaaaugauaagacacggaccuagccauguuaaucccucagcagcccagacuugaaggggggcuguugagaaagaagacuuggagaggcaacuucgcccuuagcuccaggcucgaucagucauuuccaaaagugucaguccaauucugacccaggugaccuuagucaggaaggggcucaggccagggaccuagauguuaucuuugguuccuuccucaacaaugggucaaggucaaguaagggcuaccauagucugcaucuuucuuguccuaauacccagaugcaucaacccccaccgucccacugcccaggacucuguaucugccacgguuacacucuggcuccacugccaggcugguguuuccaacaagauuugggaucaggacguccuguccaccacaagcaaacacugauaacaucucuaccuccuugaggaggccgucccucugaucuuuacuuucccuccucuucuaccucccauuuccucuucucugccucuggaggagaccagcaccccucccgccccaccaaaggguuaaaaccaugauaagcaagcaggccccucacuucaggaccaccuuucuauuaccauauacccagcagccuuugaaccaucucauaagcucugaugaaggaccaucuacaaaaccgggccccucucuccaaccugaagccccaggggcuccugcuaaacccguggaugaugucaccauccuagcaacccugaaaguguuugccugcccuccuccacauuggauggccagcaccuuguaccugccagaugucacacaggauagccacugcaaugcuugcuacaugaauaaaugaacaaagccaaggucuucauacaaggauuagacacagagaacuccacucccccuucucuugggcacuucggcuaauuacccugagguagggauuaaaugaagccagaggcccuaagccuaaguguuuccaguucauaacucccuucuccuccucuuuucuaagauaaugcagaauggcugcaaccagggaccccagaauaaaucagucuccaggccucagagcaguacaauggugugaauuuaucaauggucccuauuguuaaaagucccaaaaaagaagagaaagugcuucccuaccaaauaaaggacacuguuuggaggugacuuugaaguccaaaggucuuuuuuaucacaacaggcagguauucaccuacacaauggguaucauuaauccuguccugcugaaugcccuggccccuuugucgaacagagauggcuguguucuuuucaacuguagcagaacucgaagauccuccucccccaggagcagguucuggaagcucugguggcccacagggaggauggcuguguuccuccacagcccugccuucaccugguccucacuagcuccuagucccucugcacaacggucaagugucuccugggcaccaggguagggguacugagaugaugcccggguuuguuuccugauuccaggcuaaacucacaaagccccaccauagccauuuugcagguuuucuuuuuuucucgcccccuccgcccccaaucaguugccaaaaagcugagugcuucuucacccauaaugcugggagcagaggccaaagaauccguuuccagcucuguaccucuugcuccaaugagccccuuuaaaaaccugauuucugggaugacuggucagaggacaagaacauccagccugauuuagagacaggccaagaacaagccucuccaucucuuacacauuuguuugaucuugagauguuuuuaagcaagucucaagugccucucucuggacuaugggaaagaaccagguacuaaaaggccacagccaacaaacucuggcucacuccagucacuucugcugaaaccuagaugagggggcgggcccucucgcucccugcuccggaggccucugccacguucucgccucccugugggaagcuaucccggccgggugugguggcgaccuccacacgggggucugagcgcccgcuggcaacuuugugccucugagccucagcucuggccucgccccugagaccaacuggcgcgauuucgcuuucgcuuugcgcuuguggucccgcguggcucccucugagguggccaugggccccugcgugguccccgggcggcccgggccgcagccucaccccagccucuccuugcucucguccgggcuuagcugaucgaaggucuuggaguccuccuugcccaggaaggccucaugaucguacuggaagcucugguuguccucgggcggccgcucgcccagcucugaguccggccgaaccacgcgcuccuugcgcaccgugggcuuggcccgcagcgccagcaccagcgccagcagcagccccagggcgagucccaagcggccaccgcgcgccauggucgcgagcaaagggaggcugcggggcagugggggcucacagcgccgcugccgcuguccccuccccagcgaggggcgcgcccggcuggcucgaggaggcucgggccgccccacucacgcgcccauuggccacggcgccgccgggggaggcuggggccgcggagccacgucgccagccaggguggugggcgccgggcuccgguuucgcuucggccccuccccgcuaucucguugcgaggggcggguccagaugauggggguugcggacuggaggguucucugcaagaccggaaagaaguacuuugagaaaaugcaacagauguuuuggggugauagcucgucuucgcuuuuagaaaagcagcgcuuccacucagcuuccagcugacagcccgaacuucagcccaaggcuggcccagagaugaacauuuaaguccgguuaacaauuugcauug

SEQ ID NO: 961 - RNA, 62557 nt, Mus musculus
uauugcugaaaagugcggugcguaaagcuggagggguguacgcggcccugguccgucugaguccuggccgaggaacuucuguugguguuuggggccgcagguggguaccguccuucggcauucuugauuugcgagugccuacguucacgaguuaaaaggaaaggaaagagaagcgauucgcccccagggcuucuaaagccacugcgaguuggcgcucuccccugcuguuuagcagagagacgccucuuuuugccucucucaccucuugggucucuaaggaaaguuauuccccaucccuaccacccccaccacuaccucuccucgaaaccuugauuucccgaaugguugagcugucuggacaggaguaacugugacuucaguggcuggugagcucuugggcuuaaggcagugagaacccaggguuagguggguuggguuaagguagacuuuacuuagaaacuuccguuuaugaacuucgagaccauugggcuuucuucccccacucucacagacuauaccuuucugacaaguccccgugagcagcuuuucuuaauuuuaauuaguguuucuggaaaucucggagggucuuuccuaagcagugugaauggcaaguguuacucugacaaccuuguucacacauuuaauugucacuucuccaaagcagcugcaaauaacggaaacuacuugaaguuucucuccccuaaaucugaguggaauuagauguauuuguaccuuauuuuucuaguaauuugaaucugaauggagaggguuccuacuacacuaugaguuuuauuugugguagaaaaaaaaccauguaauucagaccugauuuuuuuuuucauaugugaacuggaggaggaauugguuaagugauuucuagaagacauccaagauaagcaauguuugaacggaaaaagagaccuaagucaauacuugugucacuuaauuacugcugacagugaugggugauacaugauauauggauugauugauugauucauucauucauucauucauuuauuuugagacaggaucucucuauguagcccuguugguauauaacucacagaagucugccugccuuugccugagacuuacaggugaaugccaccacaacaccuuuacuuacgguuuuuucuuuccauucccucuuucccuuccuccuucccacccuuucuuuuuuccugcaucauauuugggcuugggcaggagacuauaaucccaaacaguuggaaaaggagaaucagauauucagaguuagcaucagcaaaacaaauaauaauuaaaaaaacuucaaacaaauauaagagaaucauaugggggggcaacaaaguuugugguuuagcagcacaucaaccagagagauuugauaaagguugcuuguuuucauuucagauaugucacacuggugacaguagguacagcacaugccuuuauauuuuuaaggcacucagauaacugcuaagcacuugcuuucugcuuaaacccagucuuguaauuuuuauacaaucuuauaauuuuauuaaaaugguggauuccuucucuaauagcaaauaaagaauuccuauccuaguucccagucuuuguaguuuagaugucaaacuccuuuuaggcagauaauauacuuuguuucuuuugauuauccuuuauuauucuccauaaaaacccaacaccaguuagagucacaguaggaaauaugacaauuacuguauauuuguguuuggucuuaaguggauagcucugagaccaaauaguaaguaauuuagguuuggcagacaauaaaaucucuugaaucuucucaucucuuccaugaguaaaccaugagacuggcauuaaugguugagcacagcuuugcuagaagcugaaauuuaauuucaaauacuuuuuauauguuacaucauggucuuccuuuuccuuugagccauuuaaaagugccaguuauguggcacuucuuuguguugccccacagaaguaaguggcagcuggaggguuacacagcugucagccugugugguggacucuucuaucuuucucuguucuauauacuuuauauucuaaaacccuucaaggucuuaguauggucaugcuccucacugucuccaguguuuauuuauauuaguuuaaaaaauacuauuguuugagagcaauuuuugaagaaauauuacuaaaguuguccuuuugaagcagacucugcuguaggcaugauccuggggagagaagaccacacagucucuuuuaaggcuacaccccacauccuauugccaaaaucuacaagaacuuccuaggacugccaugacgaacugacauaaacuuggcuguuugcagaaaauguacuuuuucagaacaucagagguacaaacuaucaucaggaugaccugagucccaccccuacgacccacgugguaggagagaaccaaugugaacaagcuguccucucacuucucuugccauagaugcuaugacaggcacuccuuucccaauaaauauauguuucauaguacaccaguacacuucauguuaauaauaguacuagcaagugcuaaauagaugaguuucuuucuuucaaaguuuauauugcaaauuguuaaggauauuguuugugugcauggcacauuaguaauaacaaaguccuauugacuuaaaaaaguuuguugccuaauguguacauuaguauuaguauauuaguauauauuaaaauaguaguggccuuuaacugauugaaacaagagugaaaugaaauuuaggugauuaaauauugacucuaaaauguuuagggagggcucagaugcuuacauaacuaauaaaauacuuacaugaggguauauaaguguauuugagacuugcaauacaaugcgauucagauuagcuauagugccugcaaauagaauaaauauauuuaagcagauaaaaucccucuaaauuauauguauuugaaguuggauaauuaucuuauuuguuguaaacucugaaaagccauauauguaaacacauacaaagcaaacuuugacauuucacauaggaauagagacaaaauaauuugucuuuuaagucauaagaacugauauagaauuauuauagcuaacugcaucauagguuuuaaaacuaaaauauuuugccuuucaauuggucaugauuuuuuuucacaacagcauuauaaacuauuuaguacuguauuucaauuuuaugauuagccauacaugguggcucagugucuuuaaucccaguacucugggggcaaaaaaaaaaaaaaaaucucugaguuugaggccaguacagucuacaaagcaaauuccaggacacuggggacuacauagauuauguagggagacccugucucaaaaaagaaaaacaaaacaacaaaaacaaaaaacauuagauaugcauacugaccuggaaaagcaaaagaguggauggcugccuuaucaacucccauaacucugaccgcagagcuucuuagcuuuucauguaaccugucuucuaacuccuuccuuaaauucucuuuuggauaaaagacuuuaauagucccauuuaauaaagguccaaugguauugaauauccaaauucaagacuccugcugccccaccaaaaggaagacacaacucacugagaaauaucugcuccuacuuuacaauaacuuagcccagcacuggacagagacgcuuucacauucacaauuuggauuuacugcuuuaggaaucggaagccauggaugacccaugcacgcuuugagaccuccgucagaucugggguuuccuggaaaccuaccauaaaguugaacaaauuguagaacagacuuaugguaaguagaauuuuuagaauucaaacaccccuugauuuccuuuauggguuucguauucaaguuaaguccuuggcuguuguaaggcugcucccugcuggacacaaugugacuuucuaaagagcacuaaaggcacuaaauaggugagcaaagaacugcucugugccccacccccuuggugggggcggggacauuguuauagucacaaaagugcuagacuguugccaccagguuaauaaucuacugaagucuuaugggaggacgaucuucucuuguuuccuuauuuauugguuguuucuuguuuaguugugucuaaaaguuauaaaaauauauauucagagauaccugucaguauugaccuuaaaugacuuccucaauuguauauccuuugugugugugugcaagugcaagucaguauacuguuauagcaaugauaguuguaacaauuuuacuuccauaugcuauuggagagaaaaugauuugugucuacacaauaccauuucccagcaguugaaacuacuucaguguaauuuaaauuagaucauauuggaucaauuuugaaugagcaacuuguguuuuauauuuuaaaguacugguaauuaaacauuacuuggugucuacccuguuccagccaccauguuugcucgaacauauggaguauaccuacacagagugacaguaggucagacuucaaauauuuuaucugcagcuaagcuaucacagacccuuaucauauauguauacaaaguccuaaaguugauuuaaaguuugauuucuucucuaauauuagagaagaaagaaacugucuucuuaccuucaagccaaaauuuuuugaggaguacaaucugcacaaaauuaucugguuauaaucugggauuuuuaauguaaguguacacuuuuuguuugaaaagaaaaaagaggcagaaauaacauucaauacauaagugaaaguggagcagaauaauugaacuuauauucuuucaaggucuccuguauuuuuauagcuguuguaaaacaugucuccuauauuuuuauaguuguuguaaaacaugugaaguccauacuuaauuggaauuaugaagaauuagucauaguaauaguucuuuguuauuaaaauauuacuauaauaauuaguacugcagaccaagaauguaaauugauguuaacaagagaaugugccuuuuucuuuuucagcaagaauguaauaucacagauaauacauagguuaaacuuugcauuguguaauauaagguuauaaacauaggcaaagcugggcggugguggcacacaccuuuaaucccagcacuugggcgacagagacaggcggauuucuaaguucgaggccagccuggucuacaaagugaguuccaggacagucagggcuuuacagaaaaucccugucucgaaaaaccaacaaaauaaaacaaaacaaaaugaaacaaaaacaaaacaaaacaaaaacacaggcaaauaugagguaauugugugauaccuguacagcagucccaagccaccauauccucauagcaucacuugcacuccccagcacuaaugcuguucuuucucucuuaucucuccucuccccucuuuucucucccucuacaucuccuuagugaugggagucuaacuauugauaguuucacauuccuggacucauuagcuauaauuuaccgugucuggcuuagucuuucuuuucuuuagcgguaauaaauaaucuaccuuuuguuguaacuacuuaaauuauguuuguauaauuuuuaauuuucauguguacuccuaagcaauguguuuauauuuugccucuuuuucuuauaaaauaguaucuauuuucuuauuucacucacauuuuguuuuuuaaaaacuuuguauugauucuuugugaguuucacaucaugcaucccaucccaauuaucuccacauuccuucacaucaacccucagcccuuacagcuuccccccaaaagaaagaaagaaacaaacaaacaaaaaccaaaacaucucauuggggaagcuguagugugucacagaguauacacuuuuguucacacaucuuguaaaugcucauugcaaggagucauuggucugguuugaggccucuagcuucugcuaugcuggauccucacugggacuccuccuggcugucauguuguugcccuguauaauggagauccuacagcuuuggaucuacaggaccagccccuucacaggcucaugcaguucauagaugggguagauguuggacugggccacccgaaagcuuugaaucugagccugggugguagcugagucagccugccagcucuccugcacccacaccacuggggcaaacuccaacacugcccuggcuugcucacccaaugguacauccuacaaggggcggggccuacuuucuugcucucacaucuucaggccugcuuaccugcauccaagccaacagggucaccgguauucauugcagcccuugagggguggggccagcuguguugcaacccuuggacaucaacauggucucaggcagcagcccagaucagagacauccucauggccuuugguggugauaugagccacagacuucaauacagacaccugcuguuguauggcugggaacccagacauggccaucagaugcaacacaggcccagacuucaccaugaccucaggugacggggcaggcuauuugcaucaggcuguucacuccauccuuguaccuccaguucugccucucuuuauauagugcucagacccuucugcuucucuuucucucucaucucuccaccacguacuugcacauaguaguggcucccacuacaggcagaccucugggugucucccaccuaccugugccuccuagugugauagcaggugggccucugggucaacauugugauuuaaaggaucauccaugaaguguguuacauucuucauucuuucacauuauccccuugcugugacuacaaauugagauauucuacauuuggaauuuaucuggagugucuacucuaagggaauuauuaaaagucauugcagugagaauuuuugaaaauuccugguuacagucacuuuuuuuaaauguagacguggauggcuuaauguuuuuuuuuuuuuucaaaccaugugaccagcaugcagauacaaagaaagacauuuuguaaucauuauauaagaucacucuauggcacaugcuggucacuuucuccuucuuccacaaggauaaccacuuaccugauuucauuguggggguuacuuuaguuauguauuauauauauuauauuuuacacauguguuauaauuauacacauacguauguauuauaauauacacauauugauaauuauacuguauagcuuuuguuucuacuuuucuuugcucaguauugugagauuuaaccuuauuacagcuaguuauaguuuauuuucauuguuauauccuaguauauggacaauaacuguuaauucaucauuaguacauauuuggggagguuuuauauauugucacuaugaacaugcuacaguguauccuguguguaucuuuaggagugaacaguuuguguaaauucacauccaaguuugcacaaucugcuaucuccuaagauagcugugcuuguucacacacucauuaagauuccaggugcgccacacauuuucuagggcuugaauguaucuaucuuuuuauuuuucaaguucuaguggcuaugaaauaauuguauuuguaauuuauaaucucuugagaguuaaugaacuggaguacuuuuuucauauauagauuggcuguuugaugguuucucuugcacagugccucaccuccuuugcacacucuccuauuugcucuguuucucuuucacuggcaguuuuuuauguauuuaaaaaugaacuuauaauuaaguguggauucugauuucucuuacucagauuuguucuucaguuuucaguaguguuuuugaugaacagaaguuugcagauuuaauguaugucaguuauguuuaaucccucuccuuguuuaaagacauauuugugcauuccaaggauaugauauaugugauguucucuaagcauauuuuuguucuguucuuuaaaguguuuuuuguuuguuuguuugguugguugguugguugggguuuuuuguucuuguuuuuguuuuguuuuguuguuuccagucuaccuagagcugggaucaaacucauggcuucaggcauacuaggcaaacacucuauuaacugagcuauaucugcaacuguuguucuguucuuuagacuucucauucuagucuguauuuucuuagaaggcaauuuugcuuuacuguuuggacucaagacuaucucuggagaaagagccacacaaaguggacuuagguggugaggugucauugucauguacuuucuacaaagcaacuccuuaagaaaauuggccuguuugucaacauuuaccuuuuguguuuuguuuuuucuuuaauugcugcuuuguguuauuugucuuuaaggagaaucugcuggguuguucagacaggaauuucuggaauaagaaaauaaauguuacaguucucaauauuaaugacauggauacucauaaguauuuguuuaugaaauguaaaauuuugugaagaauuuguugguaauccuaguaaccuagauuaaaguauaauucucucuauuaaagauuagcauauuaaauauacacuuuuaauugaaagaaaaauuagauuuuaacuuuuugucaccaaggcaaugaauuauguauuaaugcuggcaguuauauucaaaaauuauaagugucuucuaaauuauuuucaauagguccacaugauuaccauuuguggcuaaguuuaaguauuuaugagaccuucaauuauauuuuuuuucaaaaugucacuauauggccuaaugugugauauuauuuacauuacagaauuaucuuuuugaauacccuaauuauuuaccuuuuaucuagacaguaauguauauuaguaaguuaauucuguuguguuacuuuuauauuucacgagauuaauuucccauuuuaagauauuuuaaaauacacucugaucacagugcauaaaguaaaagaaagguagaugacuagaauugacuucucacuaagcauuuaaauguucuucacuugucaacuacaauuuuuaguuuaaaguaucaaauuaacuauuauuuuauccuggcuuuuauuuuaauucaugcauuuaaaaacugauauucagauaaaagauaaucucaaaauaaaucaguauauuacuuaugaguggagcaacacauuagcauuggguucacaauagaucauaucgcuuuuauuccaucguacaagcuuagcagcacaaacagaauaaucaacauauuauuuggcugucaugugcugaacagaaaccagagaucacaaggagguuuucccuagcuguggugauggccuuuuuguuccaagcccccaucugggagggccaugguguguuaucauauggaacgcgggcuuuucuguaaucugcuuagcugcacugccguuugaaucuucauuccauguuuguguaauuuauaauuuuaaugagaccauggcucuugugggcuuugagauauauuaaaagcucuuuugugcauaugcuuuuguucuugcuuaauaggcucaguguauuuaaaacugaugaauuuuuauucaugaauuuggaugucuggagauuaacuuagagugaauaucauugcacucaucuauugaugguuagaaagggguuuuuguugcuguuguuuucauuugccuguguguauguguauguguaugugugugugugugugugugugugugugugugugugugcaccuauaugauacuuguaacuagaaaaaggcuaaacuuaaauaauuuuaagaagcuaaaauugucaugauuaaacaauaaauagauuaaauuuuaaucacguuauucauagacaccaaauuucagcaguaguguuauauauuaaguaaauauuguaaaggaauaauuaugaaaaaacaaccuuuaaauaaacuaauaccuuaaaauauucaauuugcaucauuuuguuaaaaucacacuuaaauacucagcagagauagacuuuauuuugaucauauggguugucuauggucauuauaaaugagucauucuauuuuuugguugcuaggcauauguuaggcauuuuaaccauuuuuagguauucuuauuuucacggaauuauuuuuaaaugaaagcuuaaaagacauuaauugauaugaagaaaagauuuauaaaaagcagcuuacuaauaauuuacaaaauugaucucuuuguuuuugccaaaauccuggacuauacuaaaugcuucagucucuuuaauugcuacuuauauguugacaaauuuugaauauaaacaauuuuguuguuauauaggaaaaagaauuaugguccuuuauaaacccagacauauuuuuaagcuguucucuaaugcacugggguauaacauacagaaguaucccaggaaggauauaucuauuuuuaaaucuacauuuucacugcaacaggauuugagaggaugaaaagauucugaaaaaaaaaaucuguauuuacuauaaauguugacauaugcuuguaauucuugcaagucugauucuugcaguucuguggcugaaucaggagaaucaccaugagguugaagcccccugaaacuaacagugagacacugucucaucaacaaauaaccaaguggcccaaaccaauccuagauuuacugguuuugaagcaucauuuugcagcuuaacacaucaugaauccuauuaaguuugcaauagccagcagccaaggaaaucucuuaccauuuccuuuaaacuugaaacaagagacuuaaaaacaacauccuauucugacuuuaugcaguuuauccaucacuuugacccuguuuucccucaacccucugcucuagugcuguauuguacaguuucguuuaguuuaggaucuguucucaguuacuuugcauugcuaugauaaacacccugaccaaaaacaguuugggaaggaaacacuauguuugucguacuuguccuuaucacaguccaucauugagcaaagucaggacaggcauucaggcagaagcaggggcuggaaccaugggagaaugcugcuuacuuucuugcuccucauggcuugcucagucuguuuucucacaucucccagggccaccugccauuucucacaaugggcuaagcccuuccacaucaaucauuaauuaagaaaauaucucaaacuuauccacaggccaauuugauggcggcaauugggcuucucuuuucccagauaacuugugucaagcugacaaaagcaaaugaacaccagaacaagcuauugaaaauauaugaacgccaacacaguauuguccaguggcaauuuaaugugaaccaugcaauguuuuucuuaaccagcuauauccaaauauuaccuaacuguucaacauguaucaguagaaacuuuuaaaauguuguauuuucccauguuuuguauuguauucaaaauucauuguguuguauauguuaguuuuaauuggucacauuuaaaguauucaacagccacaggggacugcacaguguauuacacaagcauauuacauauugacaaaaauacauguuguuguauuccuuauuauucuucuaauaguauguucaagguaucuaaagaauauacaugagauaugaaauugaauuaugguuauuuacaguuuuguccauaauagcacugaauagaaaauuagaauucuauugcaugacuccugaguacugaccagguaauuuguagauaggcuuaaauauacugugaugacggcuuaaaauaugcugugaugauaucaugaaggaggaauauuauucaaaacuccucgguaacugaaacuuaacaaauaaagccagauuucaaguauaguaaagagcauguuuuacaacagucacacaagcaguuuuaauauguuuuaaaguaaagcugacuccuccuuuuaugcccucaaauuuuuccagacuggggcuuguauaaaugggucggaagcuuucuuuuuauauguuuacuuauaaaaugauuucuaaaugucucuagaauuuuuuacauagaaaauucucuguaugguacuauaaagagacauuauuucacugagacauacuuuuaaauauguaauuaugaguuauaagaccaugaauaauaaguaauaggagaugauucagccaucuuacaaugugguuauauaaugauuauagggauuugcuuuaaaagaacauaauguaaagcugggugguaguggugaaggccuuuaauuccagcacucuggaggcagaggcaggaggaucccugugaauuugagggcagccuuguuuaccaaacaaauuccaggacagcuagggcuacacagggaaacccugucugaaaagcuaaaaaccaacuaaccaaccaaacuaguguacccacuuuauaaagaaauguaggcccaaguuggcugaaugacucagcacuuacaagcauguaauguuuuuggcauaggacccaaauuugauugccagcaucccugucaugugguucacaaccaccuaaagcuccaacuucacaaguccuggcacuuucuuuuggcuuccaugugcacuugcacucacacguauacaguccugcauacacauacacacacacacacacacacacacacacacacauaauaauaauaauaauaauaauaauaauaauaauaaaaauauaaaucuuaacaauguagaugucaacauaaauaguugacuugauagaauauagcuuagagaaaauaauacauuccuuguauuuuucccacuuucugaauuuugaguaauaugacuuaaucuuugcacaauuuaacuuuuauguagguacuagccaaugccuguuguauucuuugauucacuuaaauuuuauuaacuacucucugugacuuuuguauuuaaagugcugacauaaaauguuaaacccuuuuauaaacaauaccucuaguuucuuggagaugauaaauccauccauugauuuccuaauuuuauuauguacacagucaauuguaauccaagauuacagcaaacaagauguuaauuuuaagacauaaucuauguacauuucaauuacagagcaugauguuacagaagcacagaauaaaaaggaguaacauuugugcuauccucacaggagcugucaauaaaagauguaauaggggauuuaggacucuggaaauggccaacuaauuuaugugaaucuauuuuauuucagcuagaaagacccagcucuuucucggcagugcauauugugcagcccaggcugucuauacagaaccaggcggcugcauauggauagucccuugauaucauucacuugcuguguaaucuuauuaugcaaaguucuaaucuucaccuagaaugaaugccucugggucagaauauagucauaucaggguuuuugaggucauguuuugugauccuuagcuuauucuucuaaguagggcugggauuuaaaggguauuccccagacacuagcagagauagacagcagacccugcugccuuuuuggaagacaagaccaacaugaggucccugguaggauuaaacuugauuuguagcuguaggauuuuuuaacagauguauuauuggacagggaauagggggccaccagcacagcaaaauugaauccugacuggcauucucagggaguaugcugccugcuaaaacagcagcugcauguggguuugacuucuuucaggugaagcgacuuccagucauuuggaaaggaugggaugaaaaggaaccuuggugauaauuuugaugucugcaagauuuaguaccaguguaaugggauuaucgguaacaccuucacugcagaaaaagccaccuggcguucuaacuggcagcaacugagaacuaauccuuucccaucucuuagaugucauucacgaagcucaaagcuguuucugcccugcuaacugugauuaauuuuauaaacaacaacaaaaaccaggugaucaaggcaaagaauguaucuuuuuaauauauagguguaaauaaugugacuuauaaacucugugacauaaaaacugagcaucauaugguucaaaauguauuacauuguucaaauguaaaacuuguuucgugaugucuuauacuucuuuuaguugagugaccaaguaauugcuguucguaaaaguuuguauaugauauuaaauauuaauuuauauauuuuauauuuuuagguauagggccauuauugauauauaaaauguguaucgauguaagaaauugaaaauaauuuguuuugacauacauuuuaucuguguuugauuguuugaguugcugaugacaaacauuuaguaauuuaaaauauauaagacacauuuaugauauuuaaguaacauuagcucaaacuguugaugaaauggcucuuugugagaaauacaugauguaacauggccaaggcugaaaauaguuaaugugauguugaguggcucuuucuagagcucagugguucucagucuagcuuucauucagcaaauggaguaguuauuugcucuagaaucaguccauccuuuaauuuuuuaaaacauuuuauuucaaccuagaaccuuaucaaauacuuuguuuagagguguuaauuguuuuaauauucuucucuuacuauucagaauaaacugagagaaaaugaagugaaguuaucccaucagucacccaaacaguaugcaccauaacugccaagagaagaaaagagaauuaguguugucagugcuaugaucucagaguaguuaaauuaaaaauauuuauucauaggacuugacuuguaccuuuuugugcuucuugauccaguagcuuuacauuucaaaaauagcuuauaaaaaugcauuuuagauguuuuuaaacuuuaaauuuugacugacugugggugacuaacauaccuucaugauauuauaagaguacaacaugaucacuuacauuauagauguacccauagcaucugagugcacguaguuagugccuuucaucuucaugcacugucuuuacuggaaagcccucaaguagaccguaagugugacucgugucuugccuacucuucccugcaagcauguuguuugggugugaccaguuucaaguuacuacauuguaagugugcuucuucauuuucucuguuugaaaugaaugggaaagcucacacuauuucaccuaaacuguauucuacuugaaaaauuauuuauuuaaaauuuuauugugggaaaaagcuguccauaaaauaaaggacugaaaucuuucuuccaucaucaugaaauuacuuguguaggccagggaguuucccaucaucucggauaauaauacaucagcucuaguuaauaauacugugugauugggguuuguuuuaaguaucaucuuuuaagagaaaaaucuauaaguuuccuuuuaaaaaauguauuaaaaaaaggaaaaaaggaaggaaggaaaaaaggaaggaaggaaggaaggaaggaagaaaggaaggaaggaaggaaggaaggaaggaaggaaggaaggaagaaagaaagaaagaaagaaagaaagaaagaaagaaagaaagaaagaaagaaagaaaagaaccgaaggagcugaagugaaggaaccccuugcagccccauaggaggaacaacaauaugaacuaaccaguacccccugagcucccagggaauaaaccaccaaucaaagaguacacauagaggacucauggcuccagcugcauaugcagcagaggauggccuuggugggcaucagugggaggagagacccuugguccugugaaggcucgaugccccaguguaggggaauaccaggacagggaagugggagugaguagguugaugagcagggguggagggaauggggugggguuuucagagggggaaccaggaaacgggauaacauuugaaauguacaugaagaaaauaucuaauaaaaaugaaaaaaaaaaaguuuccuuuuuaaagcacaguaggaauuuaucauuguuaagcuauuuauuaaguggcucuucagaguuagucuccuuuucuuuuucaauuuuagguaucauuugcauuuuguuguaauuucuuuuuccuuaagaagaccuaaaauaagugcaucuuaacuaaauucaacaugcacauguaaggucuucccaauuguacacauucuuuugcaugaauauagguuauuugaguguagcacucaguugguaauuuauacauuugauucaucuugaaaagguagaugcuaauuuaauuugcagcauugaugacacaaugauguaagagcgagcugagguauuuugugauauaaaguaauggaauauaagguacaagaaaugagcgguauauuuaaagggauguuagauuuaacaaagcaacauugcaaauacugccccuguuacagccccuguuacagccccuaccaccaccacacacacagugucccuccccccuccuccuuuuauccucagagagggugggcccucccuggugcaucaacucucugcaggauuagggcaucaucucccacugaggccagacaaggcagcccuguuggggauuucacagucaggcuacagcuuuggggacagccccuucuccaguuguuggaggacccacaugaagacugaggaaagugacugaaguagucuauuauauaucucauuauaagucuuaacugaugaggaaaauuuauagagucaccccaaagcugacacuuuaaaauaagaaagauuaaaucuuauguuucugaaaauguugaacacaccucuaugccucaaaugucagccaaagaccuuuuuuggacuuuuuuccuaaggcuuguuaaaacugucucuuugcuuacaaggaaucauuacuagggccaaauugguugguauucaauuaugagguuauuuugaugccuuacacaaagugaaggaguguucauugccuuaaaccugagaaggaugcuagaauuuuuuuuucccucuuggaauaaaauaaaggcuuaauaaaauccucauagauugugggaucagaguguucugaauuuguaguuuuugaacaugagaaguaaauugggcaaaucuuacaguuaauuuuaacauuuauagauuuggucaauucaugagcaguccuaagggugauuuugcuaucccaagaguuugaauuguguuauuggagaggcugcugugugaaugugagugacugagccguugcacaguaugugcuaugcagcacucauguaucuugaugagccuuugcuccuugucaaaguaaccuccaguuaggaaacagaacagugaaugcaugugauugcugcuuagucccuuucuucauuuguacagucuaggaugauccccucugggguccucuguauucauaccucauacuuuuaaagaaauauucuguauaacauauccagauucuauaguugcuuuguuuuuaguaagaaauuagccuuuuguagcuacugucacaacuggcagagaaguucuucugcuugacuuguucaauaauuaucuuucugucuuaccacuuuuucuuucucucaccacuagucuuaugauccccccucucucugucucuucagaguauuuuauuaacucuuguuuuaguuacuuuucuauugcugugaucaagguaacuuaagaaagaaaacauuuggggggggguuaauuauuccauagggugagcccuugaccauaauggcaaggaacauggcaauaggcaggcagucauuggaguggaacaguaggugagagcuuacaucuugaucuauaagcaugaggcagagaaagagagacagagagacagagacagacagaaaauaaguaacuggaaaggguaugggcuuuugaaacuucaaagcacacccccccccccaccuccacaccuccaguaacacucuuucuccaucacugcucuaucuccuaauccuuccgaaucaguuccacuaaauagggaccaagcauucaaauauauggccuaugcuccuuucucauucaaaccaccacacuuuccaaguuaguaauaaaacucugcuugcccauaaacucguccuaucuuuuucccccucacuguagcuguucucaacaaugauaguucaguaucuuagggggcaugaagaaauguuaggaaacauuuugacuuaccacagauuggaaugaaaggacuguugguagcuagaggccaaggaugaugcuaaaaccuauaacucuccauuuuaauucuacccaaaacaaguuaucaaucccugggauuuuaaaacaacaacaacaaaaaccccaaaucaaccaaccaaaaacccaaucucauucuugccuaccuuaaacaaaauuccuuucuuuuuugcagcuaucaaauauuauagcuuuucagccaggggauauuagucuuugugccuguaucccacuuucauucuuggauuugucugccuugaauuugcucaggucucauacaugcuguuauaaucucugugaguucauguguauuucauuccuggugugucugguuucauguaguccucugccacucuggaucuuaaaaucuuuccacccccucuucuguggugaugacugagcuuugggggaaagggugugauauggaucucuuguguagagccaaccacucugccgucucuuguuuuuugcacacugaccaacuuuccauuucugugucacaguaucgucuauaagaaaugugucugaugagaguuaagagaugcauuaauguauggauauaauacuaagucauuaggagucauuuugauacuuucucuauuuaguagaauaauaguaccaggcucuccuuuagggccucuguccgaucuaggcacagguacuugacaugauaauggugccaggggaaggcagccuuaaaucuaaccaagaaaugguuaguuacuccuauaacauuuauaucacuauugugaauuacucuugcucaggggucacaguuguguaagauugaugauugcuguccucugauagccuacauagcaucuuuuagcauugugacaucuagccaauaaggaugguccaggacugcaaacacuugguuuuuccauacuugaugauauaugugauugcaucuucagcaauaaggucuuacugucuuacuuucaucuggagaguaaccaggagcaauugcaauauccuguaauguuugguggccugugggacccaauuggccagcaacugcugagaaguagcccauuccuggcacuaggguuuauauuugccauagcuaaacuuuuuuucagaguaaauguauauauuaucuccauguccauaucuauauacuucuucuuuuuuuguuguuguuuuuguuuguuuguuuguuuguuuuuuguuuuuugguuuuguuuuuuguuuucuuuuugagacaggguuucucuguguagcccuggcuguccuggaacucacuuuguagaccaggcuggccucgaacucagaaauccaccuaccucuagcucucaaaugcugggauuaaaggugugcaccaccaccguccggcuuaucuauauacuucuuaaacauuuuuaguaaucuuuauuuuuccuucuuuuaaagugauauuuuacaugaauuuuaaagguucaguuaugcuacaaauaugauucuuggagcaccucuuggacuuuuuaauauguuuuuggccacuuaggugcagguagaaugaaaguaucuauuucuggaaacaaacaaaccaacaaaaaacaguaaaaaaaucuagguugacagagaguuaagucucauuauuucuuuguucuugguuauuucugccucuagccugucuauaacugcuacuguuaauagaaaacagaccuuuaaguuauuauuuuaguuuucuguuguuuacugaagaauauaauccucauugaaaacugaaccauauuucuaauucuuucuuuucuaaaaccuucuuuagguuuuaagucucauaaacaucauuuuauauauuuuacaaauauauaaaauuuaacauggcuaccauggugccuggauuuuucugucccaaauguggauauguguaaccuguguagaucgaccuccacuuaugucauagaucuagaauuugagccauccaugauucuuucuuguucuuuuccauuuauuuucccuccagauuuucucaaaucuaccaguuuugguucaccuccauuguuaccauuaauuacaugugcuaauacguuuugccugcccacugccccaugcacauuucugcucucauccucgcugcgguccuucuccacacaacagcagagcagucuuaaaaguugucagagcagucauacuauuccgcuuaugauuggucagugggcuccuauuacucuugggauaaaaaucccaauuucugugagacuucgauugacuuuuccugucacuugaguaucguuuucauuuuucauugaucaguuuccuuucaguuuggucacaugcuugcuguugucugcuuauaauuuucuuauauuuucucuuagaccuuaauauugauggcauuucucuuagagaacucauuccugauacaucauagacaguugacucauuguuuccaguuauuuuaucauaguuuuucauuaaagaacucauuuaauauauuuauucuuuuguguucuuuguguguaugcuaucugcuccaguaaacuauaagcuuccugaagaccguuuaccauuguacacugcugaaugaacguaaguuuguuaggccuggaacacagaguagugugauugaaauuuguugaaugaauuaagacaugaagacacucuuuguugcacaaagagucuaucuaaaagguuuauuuaagcaguguuugguaguacauacauaaucucaccaauuaggaggcugaggcaagggaauuaugaguugaagacucagggaaggcaccacacacaaugggcuggccccucccccgucgaucacuaguuaagaaaauguccuacagccugaggcauuuucucaauuaagguuuccccuccugaugacacuaccuucugucaaguugacaucaaacuagguaguacauaccacacacacauucacauagguuuuuaggaacuuuuuaauaucuguuuauuuauauacauaaucagcaauagaaggaaacuauaugaaaagauauggcaaaugugagaguuauccuaaauaaucagugcuaaccuacuauaaacaguguucugucuagcaugauguuaaggaauuugauguuuggcugaguuuggugauacguagcaguaaucaaaggacuuggagggcugagacaggacgaucaucuuuaguugaagaaaauccuggacuguagauuaagacuguuucaacacucccuccccagcaaaaggaaaagagagaaaaauuaauauuaaacagacuugguagcacauacuuauaauccuaggucuugggagaaagaggcagaauuagguucaaggucauuccugacugcuuaaugaguuugaagguagccaggguuacacaaaaccauauuuuuguucacaguaucacuuccucaggaguucugauaauguucuuuauagauugagcuucucuuucuuggcuaaaauuaaggcuuuuacauuguacuugagugcugugcacuuuacaauaguacucuaccuauuuucuguuuuguuuuucuuuuauucauuuuucccuuuuaucuuuugacuaagcaucuuguucuguggcccagacugucuugguucuugucauguguccaguuugguucaaauucagugcaguuuccaagggcuguggucucaggaacgcugcagauagggcacacugaggaacucgaugcugcuuuuuccccuuucauuaaauguauggguuuugguuuuuuuugagucuucaagcuuguugucuuggauauguggacuguguagauaugucuaauaucuugaaucuaaacuagguauuuuauggaaaaagcaucguuuagauaacagcaucaucccucaugauggagacugaauaguaggaucaguuuuuucuauuuacaauguucaguuugaucuuuuguucaggauaguguuugcuuggucucuuuuuuccuuuucugcuuccuucccuucucucuccccucccuuccuccucucuuuccucccucugucucucucucccuccuuucuuucuuaggccuguauauaaggaccucuagcuagccuggaagcacuauguaggucagacuggccuugaacucugaguaaucucuuuguuuuugcuuucugagugugcuaccuugccuugcuaaagguuuuucuucucucuuuuguuuuucuucuuucugugucugccccccccccccgacccccacccccagugucuuucucuuugagacaguaucucuauacagcccuggcuguucuagaacuuacuauguagaccagacuggccucaacucauagagaccuuccugcuucugcuuuucaagugauaagauuaaaagaauacaacaccaugucuggcucugaucuauuuuuauuaauguuauaauaggcacucagaaauugcucuuuccaaaaagcauugacuuuucuuuucguuugguacauuuaagcauauuaaacacuccagaaguacuuaauauuaucuaauuuaccaccuaaaagcuaaaagcacagagaugaaucauuauuuuaaaccugcacuugcuuuggagucuaacaguagcugggccaggucuccugauauaggccuuccuucacaugaaagcauuuauccuuaaauagagacuauacccuugggcagcagcaguagaaugaaaaaaaacaaaaaaaccaaaaaccaugacugcucagguauagugaaggagaaaguuuauuuuagguaaaagggacaacauagccagaggcagaaacauuugagagaguccagaguggucaugauacugagcugugugaagagaguagggaggacaagggagaugggagagaaaggaaccaggugggugcagcagucaagaguacagaagguuaaaaaaaagggcagggggagcagguuagguaagcauuuaccaaaauggcuugauuauacagggaagagccucuagaggaagaguggccacccuugagcuggagaguuugagauagagaguaggguaagucagccauacccuauaaaggugaauagaggguugcuuggagaaccugucacccaggcccacuuugauauguuaaauaggcaccucagcuauuugucccaguguuugagacuuaacaggcagcagcaaucauccuacaccaaggugagaaccuccacugacauuaguggaucauucaaaggaccuuuuauuggauaccagaacucuaauggagcaagauuuggauuuuucuaugucaaauguggaugguugaggcucaggaaagguugccucaagcagccuguccuguuugcaagcaauuauaggaauuuugagggggaggggaauauuuuuuuucuuuuuggggaucauauuagcauuucuugcucccuuuccuuccucugaaaccucucauauacccauccuuauucccuuucaaauucauggccucugcuuucauuaauuguaguuacaugcauauguguauauacauauauauacaaauauauuuaaauauaaucugcucggucuguauaauguauaaaacacacuuguauauaugcuuucagagauaaccauuugauauuggauaacugacugguacgcucuucccguggacgacaaugucucccacucucagcauuccuuaguagccuguaauucuuuuguauaggguuuagggcuugugaguaucaacuuugguaugucugaguucauuguuguuuuuguuuaccucaugucuuguugaacaaauuugaagaaaguuuaguuuuuauuggggugcauccaagaucuggccagcgacuccuucuuaagugggguuaaagagaacaucucugaguuggggccccuucuaugaaguaaaaucaggaauaguugcaaagaagguuuacagaguacaguggaacaauauggaaauacagagaagucuccaaaaaccaccauaugguggccaggugauuaggcaggagggaggguauucucaaaaccaaguaaaggucaugaguuggggcaggacaggcaggcuucaugaaaaagacuuaaaaacagcuacccagcucuuggaaauuuaaauaaauugaauaaaauggaaauuuauuauuaauaauacagcauaauggcuccugccuucaaaauggaggcaaggucaucaguagauuauggauauucugaggaaaauauacuccuuuccccucucuacacaaugcuucuguucauggaucuaugauacuaccucacuauccuuuaauccucucaaucuugauacuaccuagagcuaguagccuccuauuccacaagucagaccuaguccucugccucugccaguucaaaugcuaguuccccacaaggccuccuuacugcugacuuacuguacguaagucagguucccucagauuccuccucaagugugaucaucucaaagaaauguuugacagacaugccgacuuuaucauaugaaauauuaugaagagcagauaugaacugccaaaugaagagaaaauaacagggucuugaguguaagacucucuuuaugaagcugcgauaccaucuaggagauuaguaguggugguucauuuuuuuuccaccuauuagagaaaaaaagucaggaaauguuugaaaguaaaccaaagcuaaaguuuauuaaaagagggaaaucuuauuagaauuuaaaagaaaaaaaaccaaaggugccuguaaucucagcagcugcuuuaagaugagaauggaggcacuggaaaaaccaaaccauuucaauugagcuggcguggagguuggacaagcagccacaugacaaggagaggagcuuuugagaaaggacaucagaaaguacccgaagaggcacccuuaggcucuggccagcaucggaaagaagagucaagaaaaaagaaaaagacaccuguuuuucugagucaggacuuaggaaggcacacagacauggcugaccauccucaucggggcugguagggacugugcuggucaaggacuugaguucugggaaggaaacaguuuuggaaacaguuguaaggagucauucagagggagggaguagauacugggaaauguuuuaauuuaauuaaaauuggaauagcuuuaaaaaucuauaguauugauggcucagcagguaaaagggcuugucgaaccacaaaagccagaugacaugaguuugaaaccccgaacgcaagguggaaggagaaaacuuacuccugaaaaguguuuccugccuuccucaugucugucacggcaugcaucugcccacaccgacaugccuuccucaugucugucacggcaugcaucugcccacaccgacaugccuuccucaugucugucacggcaugcaucugcccacacugacaugccaguguguguaugagaguguguauguguacacacacauaccuacacacacacacaaauaaauuaacaguauuuguguacaguauuucauaguacuuguggguucauuaaauuaguacucaguagcugccagcaauagcaggagacccugcacuguccuacuguguguuacagcugggacucugaaaccucccccaggugaagcuaggauuugugugcuacaaaaaaggauuucagcauacauggauaagaagcaaagucagauguuauuaagauuuuauuuauuuaguuauuuauuuauuuauucugagacaggcuugcucuguguccuggaacucacuguauagaccaggcuggccucgaacucauagcuccaaaggugugcaccaggauggcuuggcuuuuauuaagaauuuuaaacauagacuuaagcucagcuauuaaauaaggaggagagagacauauaauagaauaaugguacugucucuuuucucugucucucuguauguaugagaguguguguguaugugucacagugggagggggagggcagauucauucaaguuuaguaguggcuuucuauaugauuuuagagguuguguuuaaagauuucaaggauugagugaacuguuuuggugaggcuauccuuaccaggaccuuuuccuuagaaaugagguuauggggugguuuuaugagaugcugguuaucuuaagucaugaacucagucacuuauaugaucaguaacaagugaaauagacugauuugugucaacuauacugauuacaguuaguucauuguaugucuaaugagacauuuaacaguagguuucuuucugaauuguuuuaagaaaugcuaaucaaaaacucuuugaaauucaccaucaggcuggugguagcagagucaacaucaaaguaugcuucgugguguucugggaaaggcuuuucgacuugcuggcuauaccauucaguauggcugcauagcucauugugcuuuugaauacguuggugguguuguaaugguaagugucuacauuuaggauuuucauuuuuaaguaaaacauuuuuaauggaaggaaacuuuuuuaaaaaauugcuugaagucauuucaugaaaauuaaaacauaaaaucuuucuaaguauugagguaaaagguguguuuggauguggguguccacacaccuguaguccagacacugaggcaguagauugugaauucaagguaggacuaggcuccauacugaguucaaguccaccuuggcaugcauaauaagacucugucacaaguaucuccuacccaucccuccucagccacaaaucaaaacaaaccuugucucaaaucuagagacugccauacccggggauccaucccauaaucagcuuccaaacgcugacaccauugcauacacuagcaagauuuuaucgaaaggacccagauguagcucucucuugugagacuaggccggggccuagcaaacacagaaguggauguucacagucagcuauuggauggaucacagggcccccaauggaggagcuagagaaaguacccaaggagcuaaaggggucugcaacccuauagguggaacaacaauaugaacuaaccaguacccccccuccccccggccccagagcucgugucucuagcugcacauguaucagaaaauggccuagucggccaucaguggaaagagaggcacauuggucgugcaaacuuuauaugccucaguacaggggaaagccagggccaagaagugggaguggguggguagaggagugggggggggaggguaugggggacuuuugggauagcauuggaaauguaaaugaagaaaauaccuaauuaaaaaaaaaagaagaaaaaacaaaaacaaacaaacaaacaaaaaacagugccagugagagcccagcugguaauguacuugccacuaagucugaugccaccacaugggagaaaaagaacugauucucacaaguuguccuuugacucugcaggcaaucuguggcaagaacacacacacacacagagugaugauaagaaguaauauaaccaaacaaacaagcaaaagagcauguuugcaccugcaccagaguaaaauguaaaaaccauugaauccuuauuuuuauguucuguguucagcagggcacaaacaaucuucuugauaaccugaauauaaauaguuaucauuugagugcuguugugcuuucuaggaaauagucgaugcugucaacuucuuacauuacacugucuguugcccuuguguaaggaauucauuuuacucaagaggaaacucccaggcucagaaagcucauucuagguccuauaguuaguagauucaagacauagaaugaguuuaaaauuacuuauaacuaccaaguuuguuacuaaagcuaaugauuacucugauaagaucaguaguaaacauugguuggcuuucccccaaaaggaaaucugaaaucacaucacaaaucugaaaacucaaaauguucaaauauuuguuauggaagugaaacaauauuuagcugaccagacagcgaauagucuuuuggggcuguuguuuuuacauaccuaauacucuucccccuuaagucuuuuuuuucccccugaggcaguuucucuguguagcccuggcuguucuggaacucacucuguagacuagccuggccuugaacucagaaaucugccugccucugccuuccaagugcugggauuaaaggcugaccccuuaagucuugacaaugacacuaguacuuuuagaagcaaacuucauuguuauuuauuauuuuauuuaaauguuuauuauuuauuauuuugucuuuuugaguaaaagagauaauugauagagacuguuguuuauauuuuaaguggcaauuguuacuccaguguugggcauaaaucaagauuguucuuuucagauacacagaugcuaaugucuuuagaguacaucucauugcguugguguuuuucaguagagaauauaagaugcagccccaucguacuaaguaagcauuugccuggaagaggaagaaggaugucaguucucagagagugaacaguggaaaguugcuuuaaaaauuuucacaaugggcccuagagauguuugagaaaacuaaggaagucuaucauucaugcaacaaauauguaucaagcauuaacauuaugcugaguauucucuuggcaguggagacuuacauagcugggaaacugagacaagggcccagugcuccucauggaguucaguacuauagggugggcaaaaauuagaagcaaagauacuguuauuuuguguaugucuuauaaaguaaugacaaacgauuaaaauguggucuguuuuaagaagaucauuuauccauuucucuucuauuaagccugcccaaaugguaucucuaaguuuaaaagagauuugaguucaaaagguuaccuuucuuuucaguguucuggaccaucaauggaacccacaauucaaaauucagauauugucuuugcagaaaaucuuagccgacauuuuuauggcauccaaagguaaauuucuaucauaucaugaauauaauaauagugaaauguauauaaacuguauuuuucaguaauuuugaacuuuguguuaaaaaauccuuuuauggguaauaaguugacaacaaucuugaauguuuucuguuuaguugagaacauuuuaauagucaacauguacagugucuguggucacugugucuuuucccuugccauucagcacaguuaacaguccuuauuagaauauaugugaaagccucauucucuuuguagguuccuaaaauguuugaauucagaaaacauuuaagucagagccuugugguacauuguucacucaucaguguuguacuuaguauugauguccauccugcuuauuuuccguacagaaccaugauaaucauucagggauuuguaaauuauggcuuuauaugugucugagaaugaggaauuugguccaauguaguuuucuagauugauaaauuauugaguaccacuuggaaaauacuuuguuaccaaauuucccaaagcucuguuccaagugguucaaaaccuagugcuacuauuuauuucaaggaaugcuggaaguuuaagcuccuuuugaauggaggucaaauucugacuuuguacauuuucuaaauuguaucucucuaaaaguuuuuauaguguuagaaaaagucugagccagcuuugaucuccgugaccuacaaaugcuucccacuacugguauuuaauguagaaaggcagcuccaccuuuguugaaguccguuucccaguauuaaaaacuugagaauaguaugaaacuguuuuucuucaguuuggacgcucacugacccuugaugccauacacaaaauucuccuagucaagcuguauggucuaauagagucccagggaaauuguucagaccuuuuuccuguaauaaccucaagaaacauacuugucgauuuggggaauguaaaauaaaacugcaccaccggcuuaguuauuuccauuugcuuuuugacuugccaaaauagccuggugacuuacuguagcaugaaggcaaguugcuacugcaugccagggacauuauaacccuuaaauguccucaacaguaaacuggaccagcugauaguuuuugaauaaauaacugugauguuuuacuuaaaauacucuuugcggucaggugaauaaaauaaguauauucgggaaacuaagauucuuugaagauuucauuuugugcucuguucauucaggggucucauuaguguguagaguaucuuggaaucuggcagucauaugaaacaacaaaauaacuuagaaccaaggcaggcagcugguacugcuuugaaaagauuacucccuuccuuuugucugcuguagcuuaggacugagauuucagugggaugaauuucugacucuuauugcuccuguuauguauaggggaaggcuagacuucuguuuugugcaagaauaaaagucuguacauguggcaucuaaaguacacaggucuuuuguccauuagcuucagggauucuucauacuugaagcagucuccuauugcuauuuuuuauaacauauagcuaaugggcaucaacuuuauagguccuguuauauauuacagcagugaugccaugagugacacauugacaucuggcuugugucuuguucaccaccuaggaggcagaaaggccguuuaugaccauauuuuuaauuuaauaauuuguuuuuggaauuuugagauagaguagcccaugcuagcaugaagcuuccugucuaguccaggcugucuucacacucauagugauccuucugccucagccucccaacugcugaggaaauuuuaagugucgguucuguuauuaaguggguuuuaaaaacucccuacaaagaaggcagaaguccaaagaguauguguuuugauuuaucuaugguauguaucuagcuagacgagaagaaauauauuaauaguuucaauuaauguugaugucugucaaaccaaccuaacuaaauuaagacuucaguguugcuaguuagguucagacuuuaaguguuauauuguuguaucaaauaacauaaacugcauuaacaagccaugaagauuauuuccucuuucaaagacacacuugauagucuuucaugugaacauuuccacugacauuucaaaaaacaacaacaaaaaaaacccagccaaacaaacaaaccccaugcuuuucuggcccaguuaaguaauugaauggcuugauaccauucagcuuuagaaaaagaagcuucacaauguagcuguugucgauacuauuugaauugucuuuaaaauucugauaaaaugguguccuguauucuuuuacauaaaaaugugucuuaugaauugcuucuugauuuggcuguuggggaaaauuuuuguauuacuuuuucuuaaaccuaaucuuauuaaugacaacuaguuagccucaucauugguccuuuccuuguugcuggggaccaaaucuggggcuucuuguaagccuguauuguucuaucauugaacaauauccacaaccgucuuaauuugggauagaggcuacaaaauacuuagaaguuguuuaauauaguguggcagcagucaggauucuuuauucuuuuucaguuuugguuuauuaaggcagaauauuuucuuguagcccagauuuaccuacaacuuacugcauagcccaaguugggcuugaucucucagccuccccagugcugggauaauaggagugcuuugccuuggcuguuugauaauaaugccagugauuagguauuauuauggcuuuuauguuguuauauauuuuauaaauaacaucaaaguauauaaaguuauauuuagaauuacaguuacuaaauauauuagauaucgaaaaauguuagcacaauuucuauaucccuuuuuuaugcagaaaaaaaccccauuacauucuauuuuguugggauaucauucuuauccccccccaccccacacacacacacacacacacacagccggaauaguugugcagguguggauguuuugaaacauaguuucacucugugcucugauugccuuugacuuugcuuuauguuuacacucuccuccaaauuauaacucuuuccuucuuggguuuugggcuuacaggcaugcaucaucaugccugaaauaaaagcucucuuuuuuuucuccuaccauguauaacauuaucucuuccuuauguaacgauucauauuguauaccuauuuuacaguacaugcuugcuuagcuuuuauuugguugugucuuguuuuucccucaaaugaaagucuguccuguaaauuaugacuuaaaugaauuauauaacauauauuguuauucuuuaguuuugaauuuuuggaaaguagauuguguuucuucauuuuuggugcucuagaauuggauacaaaaauaauacaugaugaaaauaauucucaugagaauauuagagaguaucaguaauuuuauauggaauuuuuaugacauugauguguucugacucuaaauaucaguuauaauaguuuacaaacaugauaaauauuugagggucaauauaugaaaggaugaagggugugucuuucguucggucauuuuaccaaguucuuuaagcaauccuauguaugugguuaugcuugguaaaauacugauacuuuucuuucucucucucuucagaggugacauuguaauugcaaaaagcccaagugauccaaaaucaaauaucuguaaaagaguaauugguuuggaaggagacaaaauccucagcacuaguccaucugauguauuuaagagccgcaguuacguaaguaauguuucaauuacaucuuuuauuuugcuaucauagucaauuaauauuaacugaguacacugaggaaacaaaauggucugucacaguguuugugucgagguggaugauggcuccgcaguuaaggacacauacuguuuguucuuccagaggacccaaguuugagccccagcacuccagaagacucaacacuuucauauucuuuaggcaaaggcauucacauacacgugcacaccgacaagccuacauauacauaugcacauaauuaaaacugauaauuuaaaaccauuuguaucuuugacagugggugucacugugcccuccucauacauguaugcuaguacacuagugcuuugaugauauucaucucccauuccuccugccauugcagcucaucuaccuuucuugccagcaaguuccccuuuuacuuuccucuucuguuuuaguuguuauuuugguuuaauuugguuguugguaguggugauccagugaauuuuacugggguugcuuauaagagcauggguggguacaaauuuauuuauuccaccaguagguaccacuagagaaaaugucuccucccaguaccacuccacaaaucauuaacugcaauagcucuucaaguuagaucaggucuuuugaaguccuacccacuuuaugacaggacaucuauugaugcaccuaauuuugagcaggucucaucgaguaguuagagcuuuugcaaguucgagagugaauagccauuuuauguccagaaaaucguguuccauagcacuccaccccauucucggcacuaacauucuugcugccuucuauuccaugaguccaagaggggaucauauagauagcucacucaagguugagcauuuaacguucacuuauccucagugccacgacaagccgugacucucuuguguaacugaucuccacugagaaaagaagcaccucugaucacagcugagagggaugugauaaaacggcaugaucaaaagcagcuuggaagaaagguuugauuugagcuuacaacucccagggcacacuccaucacugugggaagucagggcaggaacuuugaggcaggaacuaaaacagugcaugaaagaacacugcuuacuggcuugcucuucauggcuuacucauccugcuuuuauacauaaguuaggacuacuugcccaguauuagcaccaagcauagcugccuggacucuuccacaucagucaaucaagaaaauguguaguagacuugacuauagagucuuacagaaacaucccucucaauugaaagucuucucuuguguuaaccaacagagggcauaggcauaguuacuuugugggcaaacaaacaaaaauguugaugauaauuuaacagauauaucauguccauuuagcaaaguaacaacuguccuuuccccauuaucccaugaccuuccaagucaaguugacaguaccagaagugaauucuauccuguggagcagaccccaaaucuaguuagaaagcauuugggugccuccauaauauuauacauauuauacaucuuguuugaucugucaguaaauguugcuugaggaaagaaucuuuguauuugaauuuaagaaaauauuucauuaaguagaguuuaaauauauuaaaacagcaacagcuuguucaugguaauauuuuacauauucuaguucuuucuaaaauucuauuuacauagucuuaaaauggcugucaggagauauucauuauauaaaaaauaauaaugauaucauguggaaggaaaccagcuagacaccaccuucaccaguggucaaggucaaccuuuaucuguacuaagacauaccaauauaauguacauuaaaacacaaagaagggcacaugacuuuuaugacacuuuuaucaaacaauaacaacaaagcaacuuaauuauuaucaagagaacacauccaauuauggguugagaggauucuaggcuacaguugacuagugcaucucaaaaaugucaucauugggugugguggcacauguagguaacaccagcacuggagaugcugaacaggagaaucuccagagugaguucagggugacuauaaacuacauagcaggacccugccuuacaauagaauggagggagggacauagagaaauuaaauugcauauaaucagcuucccuuuacacauagaagauugcggagugaguaggauugaagaauaacaagcagauguacuguguugguucuucuccgaguuccaugcuauuaucagacagcuuaugggaaaagaugugauggccuuuucuuuacucagcauauacucucuuugauaacuagggcuuaauuuucuacuuuaaauuuuguguuuugcuaucaaauuauacaaaugucuguuaaccaacuucaccucuauucuucccuaaaauacguuaauaauugaaguuugucuucaucauuguuccuucauuuagaaccuugauagcuugauuacuccaucaagacaguuuguccaauaguuuauuagucuauuguguaccauugaaaauggagucuggcucagccauguaaaugauuuuugacauauauugcuauagauuuagacacagaguaauuguuaggugauagugaugaugugaagaugauagccuggugucggguaauucguuuuucuacuguggcuuucuguaugaacauuguauccuuuuauucuuccaaauugucaauaugucauaugcuuuuauccucacaugacuauucucauaccaugagguauucuagugauaucuaaguuguuuuagcaaaaagaaucuacuucagaucagaaauaguuuugucaagagucagaacaacaaaaaaaagauauccuuauuauguacauuaauaccuuaauuuauauaugccaguuucuuuguuaaagucaguagacuaggaauaucggggcuaaaagguuuacaucaaaauccuugcucugaguaaucagagaagacaaccagagaauuacaaaaugugaacuuuuagaauauucuguuuaauauucauccaauuuuauauguccaaugaaugagcaaguuagaggccaccaccauuguuuucccaggaguguucuauugacuuugguauuuguaagggcaggguacacaagugaaauaagcuuuguaaaauggcaaacucauuuagucacuacaguugcgacacaauuaaguagggaguaguaguauuugucugauaaaagaaguacauaauggggagguuaaauagacuaccuguuucuuuucuuuuuucuuuuuuugguuuuucaagacaggguuucucuguauagcccuggcuguccuggaacucauucuguagaccagacuggccucaaacuuagaaauccgccugccucuaccucccaacugcugggauuaaaggagugugccaccucuaccuguuucaaacaggaguuguguuuuaaacgccaggaucuugucuucagauauauaugcccaccaggucauuacaucucucagaauaggcucuacuuuucuauuauuucaacucccaucucaucaaauuauucuuuuucuuaaauuuauuuaucuuuuauauuuuuaaaaagaagggccauuauuucuggucaggaauaguauuaguuguucaagaagguagguuuugugugugugugugugugugugugugugugcuuaaaauuaauuuuauucucauuugucugucugugauugugugcuauguauaaaggucucugaggaggccagaagagggagcuggguccucuggagcuacaguuacaggugcuugugaaucccuugcugugggugcuacaccaucuuuccagccccagaagccaauauuuuuugagguuuuucuagacuuauuuuuuuuuuaugucucaagaacugcauagcuauuacagaaccacuuuaguaggugugcccuauugaucaggagauuucuaacaaaaauucauccauguguggaauacucugaaaacauaccugaagccacuugugacguuugccccuuuagaguauuguucccuuuuaggcuaucuugggaauacacuaguauuguauuuuauaagauagcuuucuuauuuuaccuaugcauuccuuuaggaaaaccauucauauuaaugucaauugaacuacacaguaaagauaacaguaugaaguguguuuucuauuggcggcaaaaccauuuauucuauuauguagguggcuuagccagcaaaacaccacaucgucagugacgccuagaacaugcuguguggcauacaagagaagucguguuguccugguuaagugguauggaccuauuuuguccuucuagcuaguaauggauuuacuuaagaaaggaccuuugcuggcucaggacagccucuuagagcagagacuggcuaggaauucuuguucuuccuguguuugcuuuuagacuuauaugaaauacaacucguuuuuccugaacuccagaaucucauaucuaacauaaauagauaguaguuuauaccccgacuuuuugucuccuucauuggguucuuccuaccaccccucuccacccuuaugcuuucuaaccccucaagacgagguagaggggaaaggggcauccauauuuauagacuauacuuccugcuuauuaggaucaucaaguuccuuggggcaaauucaaucugugcagucaggagaucuccagcuagugauucaacaggagcaacggccaccaccuuucugauacuuuacauucucugaagagcucccagaauccccaacacagacuauguucaucuggcgaaaaucacaguccugcuagaacaugagacaaaucuuagcuguuauagacagucuaaagcagcuccauaucccacaccuacgauuaaaacaaaaacauauccacauaacauuucuguguuuuaaaaaauuccaaaauucucacuagaguagucaucucaaacuuaguauuucagaaacuaaaauccuuauauucuuggcccagugggugccuccuucuacauauccuucuacauauccgcuguaguaaacacucuauucuucugauuuugcaagccauggaguuuggacucauccuugaguuuucuuuuuucaccuuacugcgaaauccauuagaaacuguggcucuaugucuaagaguaauucagaucgugucuugacacuugcucauggaagacaagcugaccuuugcugcugucacagugauuucggcacugccaccuuuaaaauucuucccauguucuugcuuuuuuauuccuucauggccuauuccccaaauaguaacugagucuguccuuuuagcugucgaugccuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguugugcaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccguucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuuguagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuucacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucucuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccauuaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagccucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgagucucgagucgagcggaagggacuugugccccagaucaggcccggguagccugcuucccuauguaccgcagucucaaguuccgcgcgauuggauuggggcaggcacugugguccacucaccagaggucuuagggucccguggggagucccgugugggcccuugcggguguugggcaagacucugcuggcaagguagcccggggcucgagucucaagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuuguccugucgaugccuuuuaagaccagcugucauucuucugcucaaagacccucagcuuccuuuuccugauacaauagaucagucuuagcagugccuacaacgcccacuauuccuuuccccugcuaccuuucuuguaauuagcgcuuuaugggaacauagugguacucauucauuuauauauugucucuguucaccuucaccagaauagcagaauugagcaguugacagggacaguguugugcagggucucagcucuuuacucucugucaaguuugcugauugccuauucuagauaaggcuaaugccagagaauucuuuugauuguugcugauucuucaguaugcaacuauuauuucacaucuauuagcuucuaucagaguacuaggaauguuacuguuugcuuuguuuugaagacagggcugcacuaaccauguuugcucaugaguauaaaccccaaucuucagaggcagaagcaggagguuaaaggucauccuuggccauauugggaguucaaggccaacuuggaauacaugagacccucucucaaaacaaaaaaauaacaauaauaacaaccccucacccauguaaaggcagggucucauuuagccugugccgcucuugaacuuguuuuacaaucaagguuagucuuaaaaccacugauucuccuaaugacacuuccgaaguguaagguucucagauauguagcacuacaucuggauauuuucaagcuguuugaagguuggaaaaauguauuaugaguaggucaugcucuaauucuguuuaccuucuagucuaguuugaucauuaguuucuauuguggaaguggaugauacugcuuucagaaauguagcuuuuuuuguagcucauaacaccauguuacugcuaaucucagcuuggucugaucuucacaaaacacuuaaaagcugggccaccaccucacagaaugacagauggaaguugagaauauuagaauuccuauuagugugugccacaacagaaugcugaguaaauguuugcauaacuaacucaaucuggauuggauuguacguuuuagaauguuuaauaagcacacccaaaaucacauggcucagaauuaaguuacauuuuauuuauuuauuuacuuauuuaucuaauguuuauguauauauugaacuuaguuuaaauuacacauaaagauauggugaaauugaauucuguaugaccuacauuggccucauuuuuuaagguuugcugccuuagaaaggcuauggugcguuaguauagcggcagcugaauugcccugugcagcucagugccugcucacuaggcugugugguaauaaagcuuucuacauuuaccuugaaguacaugaaugugcccuuuagguuuauguaccuacuaugguacuuuguucuuuugaucuuugcuugguugacagauuacuaaaaagucaaguuguugccugugguaaacuugucuuucaaccaaaaacaucuacuuuccuguaguuguguaaaacuaugaauccuuuucauuucuuaaaaaaauacuauugcauuuauuuauuuauguauguauguauuuauugugugucucugugugugugugugucuguguauaaggacagcuuguaggaucucucaucccaccauaggaguucugggaugaaacucagccauggcagcaugugcccauaucuucugagccaucuugcagucccccauauucagauauuccaagcaaugcuucagugucucaaccauaacagcuuauauguguuuaugaaacgucagugcauuucugagauuguuguugcacgcuugucugaccucagugagaggaugugugcugaggggugguacucauggagggccuccccuucucaggggagggggagggggagaguagugauugggaagagaggaaggaaggggccugggaucaggauguaaagugaauaaauacauuaauuaaugaaaaaaauuaagaauguauguuuucacauuuaauuuauaguuaucaaaaaaaaaaaagaaagaaaacgagguaaagcuuuuugguugucuuuaauaccacaagauucuaguauuguacacagaaaguuauccucacgaaauuguaauauaauuaagacugagugauagaagcugaauaaggaauguaauguugcuugugccuccuuuuugucaaacuuagguguguuaauauuuauguuacugauuaaaauaaaagagaguucuuuguuucagaaagagcuaacuaaauguacucaggaugcauugguggaauuguguuaguacuugaaaaugcaccugcaaagcaggaagaaagcuaggaaauguuuaaaucaaacugacaaugagcaaaacaaccucaucaauuagauagcacuagaaaauggccacuuuauauaguuaaugcuaauaguccuguaagguggacuguauaugcuuagaauucaauugaaaccccugaguauccuaaugcuaguuuucuguuuguuaaaagugucauuugccuucgcuaaauguugcaaccaucuggucuuguauuaaccaguuauaucauuaacagaaaaaguacuucugugugaggagaggaaccaucaggugaaagggcuuguuuauuauaaguugcugauacacugaauucuaggucauuuagauagaaggacuaccuaauaauaccacuuacuacacucuaucuaagcaagggacuugcuauuuugcaaacucuggugauaaaagcuguaccacacaucuauuucucagcaacagcuccaagcaaucaaucagagcacacuacuaaugccuuaauugcagcugguauggaggacuguguuuacucucuugcuaaagugaaguucacuauggagauggccuggcucuuucauccuauagcuaacacaguucagaagagaaacaucacuaauaguuuacuagucugaagugcuuuuugcuuagauguuaacaguaaagaaucaucucuuaggccucucauuucaguguuucuggugccuucucugaacacuuucacaauaguuuaaacuuaacaauuauuuuagaauuucguuuuacagucuuuuuuaaagauuuauuuauauauguauaugaguacucugucuuccuguauaacuccacaacaaaagaggacaucaggucccauuauagaugauugugagccacccugucauugcugggaauugaacucuggaccucuggaagagcaaacaguacuguaaaccaucaagccaucgcuccagcccuauaguccuauucuuguauaucugaaaauauguucauuaagaucagcauucguggugaauauugaacacuaaaaguauuucagugauuuauauuuagacaguaguaauacuauuggugaaaauauacuuaaucuaauacaguuauauauguuucaguguauaaguuaauugaugcuucuucacuuuaauguugcccaaauguaacugagaaagaauaagaaagacugaaauuguaugcagcuggucaacagaagugcugaaccccacuccaaacucuguugugauuaaagauaaauguuccaacugucagauggccuccuacugucugcuggggaaauauaaugacuguugcuaagacagaauagguucaaaugucuuggaagaagaaacuaaugaaauacuugcccugcuuccuuagaaaauuaaauuuugacagguuacaugugguuucuuugacccagaaucuuagcugguaaaaguauucucacuauacuaaacucuuuucuacccagaauaagacuagcuaaggagaauaacauaaaaauaaaugugcauguuuuaaagugguugcacauaguaaaauaggaagaaaauauuugcauuccgugucauuguaagaagaaucuagauaguugaaagguuuucuccugauccuuuagagguucuacaggagaauaacauaucacuacaugugacacaguagugcuugugucauugccaagugugcacauaaaacuagcaggacaagacagccaagcaguauaaagaaaauacaacuauggaugaguaauuuagauaucuaagguagaacugaaaauucucaucugcuucuuccugcaucugaagugacuucaaacuugaccugauuucccaaaauagcucuggggacauauacuaaaaaagacuucugccccuaaccaauauuggucccugccuuaauuaggcugccucaugaacagccaggucccugaacuuagaagagagggcagaagggugaaaugacagagaauacuuugucuugagaccuaggagggaaaaguggagcauuauacacuugguaaaugccaaaaguauugggggggagagggagauggagcaccaugauagagaugacaaugaaaagauaaaacucaguuccuuauauuucucaagcagaagaauaacaggaagugacuuaauuuauaaaagaucauacuaggauuaauguagacuauuaaaagacuuuucaauggaaauuccuggagauguggaaccuguuuaauaggcugcaaaugagaucuaauuaggguuguaacacgaaaaaaugcaaaguaguaacaguaucacagagauauugagaaaauacuaaaaucagauugaacuugggaagaaagggaaaccaaaaggcuucaaauuaauauccaaauuauuaguuuuagcggaagguuaaauggucccgugggggaagagauuagaagauacacacaaauuuaagcaguuacuaagacuccaaauauaagaaaagaaugcagccagaggauggggaggaguguuaugacauacuggcuuugaccuuggcauggcugcugcauuauucaacuuacagcagcuauggcuaucauaauuaagacccauguagaauuaagccagccaaguucauggcuaagguuggguagaugacuuccagaccucaggcuuuacugaggaguuacggcagaugacagcugcuagcugcugggagaaagaggauaauguugcucucuuuuucugcccaccuuugcuccuuagauggaaaacaguagacagcuuuauuuuuacuacaacugcugggcgcugaaucuccugcccuaaucuuaucagcuagcaacuagcuccggccaacucucuugguccccacccucaguggaggcugcaggcccuagguaccccgaaaccuuacaugguuguuuaugcuucuuguuccaaagccuggcugaaagaccuccucuuucacugugucucuucucuucuuccugggaccaaacccaucuuuacccuuuguccagcaacugacuuuugccuucuuuauugaccaaaugaugaaccaauuauggaacuagauuuuaguaucaucuccucacucuacaauuaucuaauauagagugcucaucccugaaauuauauauacaccaacaucaagagugcagcagacuguauucaugcauuuguguauguguguguguguguguguguguaaaaauaauaaagaggccuucaguucaaaagggauuaagaucgacaugggaggggcuagagaaaagaaaggaaaggggaaaugauguaauuauauuuuaauuaaaaauacauacauuuaaaaauaucaccugagcuaggagugguagcauguaucuguaauuccagcacuuuggaaacugaggcagaaacauugucaguuugaagcuaauaugggguauggaguaaaacucugagaacaacauaaaauuguuauuugucauccauucccauaauucccauaauuuacuauuuuguauucccaaagcuuucauucuaaauaauuugaaagauuuauuagaauugcgcuuugaugaauaagauacaaguaggagagucuaucaaaaacaagcauucaaaaugccuuuguaaauaaugcauaaguaauaucaauacaacagaccuacauaaucacuuuuaaucaugucuacuuuuaagagaauggacuuuuuccuacugguggccaucaguuuuaguauaaauuuguuucuuaaucaaauauucuucaugaaacaguuaugccuacacagguacaauaggacacugaaaagaaugacaaaaauuccucuacagcaauaaauucauaccaaaaugaguuugggcuuuggaaagaauuaggugacaugacaagaauaguugaagaaauggcuaagcaguuaagaacaccagcugcucuugcagaggaccugguucaauuugcaggaccuccgugguacuucauaaccaucuguaacucuaguuccagggaacugagagcccucuucugaacucuacagcuaccaggcacacaugcagugcaugcauguauacacgcaggcaaaacacaaaucuaauucuuuuucuuuucuuucuuuauacagcugccaugguagugcacaccuaguuugaggccagccuggaauacauguaguuaauuccaggccugccagggguacauagauauugucucagcccccuaaaaguaccuaaaaucagacgcauauuugccaauuuuguauaaugugcaucugauuugccagcuauuuaaagguuauuuccccgcccccccccaaaaaaaaacaaaaaaacucacuauuuaguacauauuaccguauucucaugacucugaaguaacuuaaauuuugguuuuuugcauuugacuuuuuuuuuuuuuuaguccgugccucacuauaguucaggcuuucauucaggccuggaacucaguucaugaaugaccuugucuaccuuagacccuuuagcaaucccuccuuauuaucccaugugccaccaugcucaacuggaauauuaucauuaguaaauuacuuuguuucauuauauagggcuauaacauggcugcauuuuggaagucuaagucauaauuaagcaacagaauaugcuuuauauacauagauauagguauagauauuugacuaauacugcuuacuuagaacauaaaauuuaaaugucuagcaauuguuagauuaaaugacaugagucuacauuauguagaguuuuuuuucaaggcaagguauuaaggauuauauguucugagauuuaaaaugaaaugcuuuugagacuagucuccuugcuguaucacucccauuccauuugcuaaaacagaaacaaaauggccugaucugaauggcugcagaaaguguauguuuccuguauauuacacgaaagaaaaugugcaaaaaggaauuccuaaaggaucacuccucuucuugccuucauguuuuagugcacuuauuagaagaaccauuaugcauaagccauagacagggccaaugcauaccaugcuuauaaaguauaagauuuauaguaaauaagggguuagcuuaaaaacaauuuaagauuuucaguuuugaaacaucugaaaaucaauauauaauaucuuacuuuuuagucaaaaaaauuuuaaacuagguguucuuugcuuaaucaaguaagugaaugauuagaguuuagcguaugugauauuugauauuuuaagcucucacauuucacuugaaucaagaaacacaccaccuguggcuugcugggcaaagcugccugugauagacacccauagaccgugggguaauuacguuuguugcuuguacuaaaaaggaggcacuuaagcaaaccucagugaguauagccaagaacuacaagcuagauccuuuuucccagcucugagauuagcuuuuaucaugguucaugaaguaaacauugcagacucauaacagucucaaaagaaagauaaucugacuuagaaaauguugauuaugggaaaaagcacaaaaaaauaacuaaaauucagaauuugugaaacauuguauuuucuagcccuccuuauauaagguuaucauagcuuuuaaaaacauaauauauuuuacucugcuaucuuuuccuguucauacuuuaguauaggacugcuguaaacuucuuauguugucugauguaacuguaguucuuauauguauuacugaaagcagcaggugucuacuguauggguuacaggcuagccugcucucacuguaguaccagagacaaaaacacuuuuaaaaaauuaucaguaaaguuuucccuggcucaccuuuaaauaguaucaugcugggggcugaaggaauagcuccauggcuaagagcucaccauugccuguaaccagcucuaguguauccuaugcccaguucuggucuccauggccaccugugugcacgugagcauucuaacagggagacgaaauguacauacacauacauuaaagauaaaucuuuaaaaguaucaggcagcugugcauggugaugcacaccuuugaucccagcacuugggaggcagagacaagcagaucucuugugauuccagggucagccuguucuacaauagugaauucuagucuagcugaggcuaaauagugagacccugucucaacaaaacaaacaaaacccaaaaaaaacaaagcauuaauaaagucaagcugggaauaguaguagauggugcauaauugaaauuccugcacuuugaaagcugaagaagaguauugugaauucaaggacaggcuggcaaacauagugagaaacuaucggggaaaaaaguucaugagucacccaaagguaaaacgguuuaagauaaacaugcauauauauauaauauuuuagauuucuaggguaaugcaugcuauuauaaaauauaaaauuugagacauaaaaaacaaggacuuucugcuuuuauacacacagucauuaaaguuacuuuuucauugauucaguuguugacaucuuuccauuaguuuguucuuuauuaacauacuuugguuuuuguauuuuaaucaucugucuauuauauaaaugaauuauauuuuauuuagccucugcuuacugaccaacauuuauacuauugcccguucugagacaagagaaaucugagcagaguaaacauuugccuuuauuugugccuuuuugguugauugcuuuugagacagcgucucuuauagcauaggcuggccucagacucugugcccaagcaugaccuugacuuuauaagcugccugccuguaccuccugagugcugagauuaccaccauccguuuuagauuguucuuuagcuagaacucagggaaugguggcaugcuagagaccuccuguugaagagcuaucacuccaaccccugucucugucaucgugaaagcacuguuugauugcuagcugaggaugcaaagauuagguucuuacaugguugaaaucuauggaucacacugccaggaaggcaggagcuacaaaaagaucuccagggaucuacauuuauauuccuuugguugacagauaaauacuaaaucguagcuauucauggugaaauucaguaauaaacaaaggcgaauaacuagggagcuccaagacucaguuccuagaaugcaugcaaaaccaggagacauuugaguuuccuaagccagugugaacaagccagagaaaccuggaaagauugugcccuguaguacugugagaaggagcuccgccaggcagcuugaauauaaggcuuaaagugaguaggcugaucuuuuguaguaacccccuucagcaugguauucucugaagacuggcagcaaauccacgcaacagagggugucuagcuaagucacaaacagcuagcuccgugaagaaagcaguaaaaggaaagccacacucagaagggaaucagguaacuagccccgaaagacacaguaaaaugccauuuguaaugguuuucaaggaaccagagcauacguaagcaugaugggguaaaaauggcaaauaaagaaucaauacucguccuguuugaaauucuuucacuuggauuugacagcagaauuauaacuacaaaagaucaguaauuuugacauaucucucaaaaaauggacaaaauaaagauacuuacacacagaaauuggggagaacuucuaaagaaaguugaaaacuuacuugcaaauagacuuacaaaaaacuugaaaggacaguccucaaacugaaaggcaaaggagcuacacguguggguucauaacaauacaaagaacaccaucaauaagucagaaaauguaguacuuaucuuuugcagugcuuggaacuaacagggcuucacauucuagggagacccucuaacccugagcuguauuuucagccuaguuuuguucuuauuuguaaacugcacuuagacaccuuacccacugaaauagcauauacaaauacaaaacaaugcuguucugguacuaauaagcaauguccauucaaaagaaaucaaaaaauuacuccuauucaaaauagcuuuaaaaacaaacuacagccaaacaaccuacauccaccaaaaacacuuaguaaugaagcugacacaggaagugaaagaacgcuauacugagaaguucaaaguccugaagacacggaagacaauauuggaauaugaugagcaguacugaaauauaaugauccccuucuuauggaucaacacaagauagugacaugguuauaccaccacaaacaacuuauagauucaaagcaauauccaucagaauucuaacaccacuuuuuuguuauggaaaaagaaaaaguaauuguguaauucauauagauccucuauagucaaagcagaccugagcaaaaaaaaaaaaaaaaaaaaaaaaaaccaaaaaaacagugcuggaaguuaucacaucgccaauuucaaguugcauugcagaaacauuuuaacaaacucagcaugguacucguucaaagacagacaugcagaucagugaccuagaacugaguacucagauacaaaccuguacaccagaaccaccugauuuuauuuuauuuuauuuuacuaagaugccaaaaacauucuuuuuaagaaaugauguuaggaaaacugggcagacacuuccaagaaaaacaaaacaaaacaacaacaacaacaaaaaacaacaaaacuagauuaaucacccugcacaaaaagucauuucaaaauggaucaaaacuuuuuauuuaagaccugaauugggaaaguauugaagaaaaagauguuagccaggcaaugguggcacacgccuuuaaucccagcacuuaggaggcagaggcaggcggauuucugaguucaaggccagccugaucuacagcgugaguuccaggacagccagggcuacauagagaaaccuuaccucgaaaaaagaaaaaagaaaguuuaaagauauagauaugggcaagggcauucugaaacagacuccaguaagucaggaaauaacuaucaaaaacuaacaaauggggauuacaugauauuuaagaaaaacaaaaauaaaaauaguucuauacagcaggaaaaugaucaagugaagagacaggcuaaagaaugagagaagagauccaaaccauauaaagaacacacacaaacaccaccaccaacaacaacaacaacaacaacaaaaaucuauuaaaaaaccagacaauccaauuagugacugagcuaauaagugaagagaaaauuuuaaaaugaagugcugcaaauggccaaucaacaugauaaaucuuucaucaucuuauccaccaggggaacagaaauuaaaacuucauuuccaucuccccccaguuacgguggcuaucaauuauacauauaggcaaggaugugggaaacaaggaacauuuuuauacugaugaugggaauguagguugaacuagcucuguggaaauuaaaggaagugucuuuaaagagacggaaacagaaccauggcaugauccagcuauccuauuucuggguauauacccaaaggacccuaaggcaacaaaccacauucauguuugcugcaguacaguucacgguacccaagauaaugggauaagccucucuacuguugaagauacaugugcauuauaaaagaaugguguacauacauaaugcaguuauauucagguagaaagaaugaauuuguuauuuccugggaaaauagaugcaaguggagauacccauaugaagagagaagucuguuacaggaagacaaacuguauuuucaauuauuugugguccuagaauuaaagaauucugccuacagcaaacaggagagcuagcccugacccucaccugcugcagcccuuggaagagcaggcucugaaccaugccucggcagcaggguagcgcugacccaauuugggagagggguugcuggugagccuacagagugcagaaaaauaggagcaccagugggcuggucagcacaaauaccucucaggcccagguucagagcuuugaaucaccccaacccuacaucuaccccauccaugaacugguggagugcaugaaggggcugguccuacagauccaaaacuacaggaucuccaugacacaggcagcagcaacaggauauccaagagcagucccaaugagguuccaguggaguggcagaagccagaguccuuguaccagaccaaugagucagugcagugaguauuugcaagcaaaugcuuguggacaaaaagccauacuaugggaaauggugugacacacuacagcuuccacaaugagaguuuuucccccucuacuggggggcgauugcaaggguggaggacagguacaaggggagggggaauugaaugcgauuguggugcaugauaugaaauucacaaagaaccaagggaaagugucugaauguaucaagauaaaaagauacauacuuaagaaguuuuccuuuuaaucuuacaagcaacuauuaaaacugucugaguauaugaagauuaaagagauccuaacuuggauuggagauggcucagcaguuaagaguacacugguugcucuuucagaggcucuggguucaauuuccagcacccacuuggcagcuuacaacugucuguaacuccaauuccaggggaucugacacccucccacgagcauacauguagacaaaacaugaauguacauaaaauaaaaauaaauuuaaaacuaucccuacugaagagauucuuuuauaagagaugcucuuggauuaaagggaacaucagcaaugagaccguuuuggggguuguuacaugaagcauuaaaucgaaugcuuuguuuuguuuuggagguaggugcuggggacugaauucagcgucccuuauaugcuaguaagcucugucccuagcucuuauauugucuucuaaauacaugaaagagauugggcaucacucagaauugcaacgaacccaguguucauuggguaauggcauuaaccugcugaccuacgcuuaauucuuguacucuacaagguagaaaaagaguagacucauccuucaacccagagguguauacacucacacacacacacuguaaagcucaguuuuuaaaacugagacaaaaacaaagauacagaggaacuauuucuuaccauuaagugggcaaaccuuugaugacaauaaaauaauaaaaaaauuaaaucauagcauuaauaucuacuugcuuauuuugucauaaaaucagugaaaagagaacaaaagcaguaaacaaaagcaggcugggagguagcucaguugguagaguacuugccuagaaugcaguaggcccuggguucaguucucuagaccacauaaaaucaggcaugaugacacaugccuauaaucccagaacucagcguggaaacaggaauaucuugaguucaaggccaucuccuagacuacaguuugauaccaggcuaccugagacccugucucaaaacaacaaaaccgacaugaaaguuggauguuguuauaauccaguaccccaagcaagggugcaaauguggagggugggaccacauagcaggguggaauguaaauaucaugggcccucagauagguagagauugcccuacacuguaguguaauauccuauuuguaaaacaucuuucuuuuccuuuuacugguaucucuuauucauacauagcaccaguauuaugacugaggaacaaacauucuuuaagaaacuagaaaucuaaauacaagagcuccuuaucuuguaucuucuccaaaagugcaguagguacacuuggcuuuccauaugcugugcucauuuauaugugacuucagauacacuugcuuuucuacacugcacugccugucggucaguuuaugacuaaguaguucuagacauguuaucagcuccaggaccugaagcuagcucauuuaaucaagauauccuagaaauacaaucuuaugaaaaugaacucaaaauuuaaaugcucauaauauacaaaaauaacauugucauacaaaaauaaaauuaugguauaucuuaauccaaugaaaucuucccaauagauuguuuuggucuggucaauaagucaacuuuucuugcauuaacaaaaacuauaaaauaaaaacauaaaaaugcaguguacagauugcugucagaaagcaccuucuaaguuucuauugaauggauuuuuagugggugaauaucucauauuggaagaaugcauuuuugagaaguauagcuuugaaaaaggauuauaauugaguaaacauuuauaccuuuuacuaguuaauauacaagacuuaucuaguagaaggucacugucauuaauuugcagcugaugguuuuauaauagguccuucugguucuugauggucauuaucaacauauaaggcagugacgauauggccaguacaaaggcaagacaggggucuuaauuagaacucugacaagcccacugcaauaaaaugaugagauuauuuguaauugaugucacaauucauuaccacuuaguucaucaugagcauucuaauaggucuggccucagaacuggccccaggauguugcugacuggcugcccugcuuaugcuguuacugcaacaggagggcacauuuucagucagcagccuaaugaccucuuuugaagucuauuaaauuaaugacaguggcacacuguuuucacuucuuacaaccuuaguuugagguuucuacaaauuaguguuugggacccagauaauaaagagaucuuuuuaaaauguagacaccuuugauauuuagucauuuaguagaaaugaaagcaaaacugacauguauaaaggaagacaucaggauauauguuccuccuccaaaugaagucuuucuuucauauaggguuuguguagcucauccuagcuuugaguucaugaucuccuugcuucagucucccaagugaggagaaucuaguuguacaccacaguuccaggccuuuguuuuuugugauaguccccuguugaguuuuucuuguuucuaaagggccugcuuuucuuuacuaauuccaggugccaacaggucauguuugguuagaaggugauaacuuacagaauucuaccgauuccagguauuauggaccuauaccauauggacuaauaagaggacguaucuucuuuaagguaugcuuuaaugccuagaacaccaccuuuauucuaugagcuggcaggggugagggcaucucucuaauuaaaucaaaucuaauuugaaacccauggcuuccaaguugacuuaacuguugcagugacugcauuugaugaacauuuuaccuuuacuuaagaaugauggacaaaacauuauccucuccccuuccuauuccuccacguccuguuccuagggggaauaacugaguauuuuuauaauaaaauucaaaauaauuaguaguagccuagagaaccuuugaguuuacagaaaucaaauucugccaugugugacuuuuacagccauagucacaucaugccagccagcacuucuacagcagcagcagcacaggcucagucuacuuggaaugcagguggacccagguaaauacagcaagccuuaggcagguguauggcuguagagaauauacaauaagccuuagaugacauugguucuuccauuauugguugauauaauuuuauuuuaagacaggguuuuacucuguauuccaggcaggucuuuaacucucccuuccugucuuugucuuagaagugcuagugucacagauggcagauuacagguauuugucacuacaccugcucccccuugaucacaaggcuuuagaagaaaacugcaugaauaucuaagccgacuggauacuguucaggguucuuuauacuuaaaaaggugccauauucaagcauuuacaauaucaaguagcauagauugguaguguaaaagaaaacagccaugucuucacaaacuuauauugauacacuaaacugaauuucuggugucauguuugaaugccucagaguaaauauacauguuuauuuucagaauagcugaugaaaagaacguacugcaguaucuaacacagagaaaaggaaaaggggacaugaugaugauaaagaauuuucauuaauuguauucaacuguauuuucauuuuacagauuuggccuuucagugacuucggauuucugcgugacagcccaaauggccagagauuuucugaugauuaauaaguauuucuugauuacugucuccuauucaagugaauuuauuacuacaguugaaaccaugaacuuaauaaacuauuugcuauucaguuuuauuuauguuuuaaauauaagaguaaauaucacacucugcaauauauauuaaguaaaaguauuuagauaaaaauugacccaaaacaaauuuucuuucuaaauuguaugauauaaaaauauauuggggaagaaauccagaugacuaucucauauuugaauuuugguaguucuaauacaaagaaagcaaucuguuuucaaguauacuucauaugucagcucuucauagcagucuaagucuaagacugagcauuccaaguugacaaaugacugagcucugcugacaacaccguaaguuagaccuaaaagaaacauuugagcagcagucucaguaaggguucccuguguucauaaaaugaauucuggucuacauuguagacagaauguuacauacaaaaggaagucacauaagacccaaugccuacaguccacuauagucuguaaucacucauuagaaaagccccuucgagccgggugugguggcgcacgccuuuaaucccagcacucgggaggcagaggcaggcggauuucugaguucgaggccagccuggucuacaaagugaguucgaggacagccagggcuauacagagaaacccugucucgaaaaaaaaaaaacaaaaacaaaaacaaaaacaaaaaaaaaagaagaagaaaagccccaaacagaggccaucuauuaaaaaggaaaguugauauuuuagggguuuguuuguuuuguugaauuucaguuaauagguuuucuuuuccuaaauuacaccugaacuuaagauagcuccugccaagccuuagacauacaaggccagggcaagagucacguuuucuaacacaugguccucugugagcuuugaaagaaauucguagaaauccauauccagccuuguuuagggcagaacugggcucacacuuuuuucacaaaauuucuaaucuuauugaaugccucaguuauugaaacagguauacaacaggcauauaauguagcaacuaaaaccaucaucuuuuagaugaacaacuucauaauuaagaacaagaugguucagccaguaccagaacuuaccauaauucucaggacccaaauuugacccuugggacccacccuggggaagaagugaagaaucaacuccucccagauucucagaauguccucugcccuucacacacacacacacacacacacacacacacacacacacagagagagagagagagagagagagagagagagagagagagagagagagagacuaaaggaaaaggaagacccuuaggaacuauaaagaauacucuuaccugauuuuugaaaaagauauuuauacuucaaaaaggaaaucauuaguuuguaccaaagagaaaacaaaaguuguuagcuaaaagugcaaaaauauuauucaaguccuucuuguaauauccuauaauuuacauuuuagauacauauaaaaaacugaauuaauuuguuaaucuuaagugguuuugcuugaagaccaucuugaauaacaagaaagcaucuguguccuuguuguaaaggaccgagggcagaagacgcagcucagcucugauggaggagcuccacaaucagcgagcacgcgucacaggagaugaggguggcuucuugugcuucauccuuggagacaguguauuucccaccacaucgacagcucagaaagaaagauucaucaccugcagagaacacagaaauaaugccucagaugcucagagucaccuacucugguaaaaccuuucaaaauccagggcauguuccggagaaacugg

SEQ ID NO: 962 - RNA, 11926 nt, Mus musculus
auuauuauuucuaaaagucuuuauuaguguacuuaagaucucucucucucucacauacauacuuaaaaauuaaacaguaagccugcauuguuuauuucuaaaauacagucuuuauuaguuuacucaagaucagauauacuuuugucuauaaacucuacgguauguuuggucuccgaauacauacaaagaacacacagcaacuguugagacucuuccccuuggaaaacguuauucucuuuacaaaaagaacagauacguuugaaggaauaauuaauauagccauuuuuauacaaagccuuuuccccacuagaaauauacucccauuguaaguaaaaauaaauggcccaaacuuuaaauuuagcagccugguaacacaugcauguugcccagcgugaaaaggcuguggugcgaagccugcagagguccagggccagccugggcuacagugcaaggcccugcagcaaggaaacagaaugauagaaaacaaauaaaaguuuucucucaagaguccaagcaaugugcagcccuaacucacacaaaggaacaaaaagagacaauaaaaaaaugacuaaaaccaaaggauucuaaggauucagauaaaacuagaguuuagcccugcaaaacauuuccuuaaauuagaaaaaguaaacaauucuaccuuuuaauuuaaaaauauaguuaaaaacuguuuugauaccaauuagcugacauucagaucuagugauuugcucauuagguuucugacacuugggccaaagaaaaacccuaaaugaaagcacauuuaauuucaaguugaaaaugacauuuuaucaaagaaaagcaagcaaguguagaauaaccuacuaaacaaaaaugcuauuuuacuggaaaauuccaacuggcuuucaugcuuccaagcacucuaagcugcuaagacucggaacagcagcagcuuggaggcuccgggagccugccgaaggcuuuaguaagaagugcuggggcugcuuccauucugacuucucagcggccuucaucaguacccagaagcccuguuucuaucccacaugccccagcgucuccaacuuuccaucacucucuugagggacauuuuuagaagucuaucuaucacaucuauccaguuuuaacagucagaaauacugcugugaagguuugaauaagggucccauaggcucaucauacacuugaaugcuuguuuaccagcgggugguacuaucugauaagaguuagaagggguggccuugcuagaaaaguaugucauugguggugagcacugagguuucaaaagccaugccaggcucucuugccuguggguaaggacauaaagaucucagauacugacacaucuuucugcaggccaccguucuccccaccaugaugguuaaugggcuaagccuuugaaacuguaagcaagcccucaaugcuucuuuuuauaagcauugccuugguuaugguaucucuucacagcaauggaacagugacugagacaaauaugcagccauuuaugaacuauacacucauguuuuaaauguuaaaaaaaaggaaugaauuuuucuuuaggaacaaauuuucaccaagaaugcauagauuaagaacuaaaaagcugaugguauaaugaacauuuguguucaucucuaguuagaagaacuguauuuuagcacuuaaguaucuuaucuaaaauauucaccuauuguguugcauggagaucaauuuucugugucacaggcccugcuuccagcuaagggccgggucuauuugcacagcacugugaggccaugcaccaaaaaaaaaaaaaaaaaaaaaagcuaauaagggaaaagagaauuguuguaugaccuuuagauaccuaucaaaacauuaaaaacuuguagcuacaaauggacaagaaaauuaaaguuuauguauugagaauuggaguuuuauuguuuugccuaaaaguagucugaagagcauuuguuucguuaguaacauuuaacagguaccuuucugaccacuccaauguugugaaguuaucuauuuacaauacagucuuuaauguuaaguuuuuaccauaacuuugucuaggaccgucuucuugcucaucccagcugcuucccucagcaauguggguuaaguuuccaucaucagguuccucugaugcaucugucuccagaacagcaaugguaaccaacacucccaugaccagcggcgaugucuacaauuccauucaggacugauccaaacuucacuuccagaaauaucacuguucaauucuuuuccucguuuucgucuuuguuggucaauauuugggugaucauuuuuguaaaauaucauaugggugacagggagauaacagaccauaugcuuuucuguaagugaauuaaauaacagguguacagagagcaaccacugagagaacggaaaagaaacucacgaugggcacagaccaugaagcacagcugcuaagcacauccuuucuucuguacugggaaguuagaacuccaugcagcucacaguauacugaggucaauucagagcugcaugaggcugcuaggagacagggaggacucaacuacaccaucaucucugaaauuuguucauaugggaacccccaaaauugcaaaauaccuauacuuguuagacuggcccagacaggcuuagagccgacucuggagaaacaacccaucuaaauuuacaucaaauaaagaauuguaaagcaccccaaaugcaaccaaauucauacuaaagugcuucggacuuauuuaucaacaguuaggcuauacuugcaucuaaaagcgacagaauuggagagagagagaaagagagagagagggagggagggagggaggagaaggaggagagggaggagagggagagggagaguguuuuagagaccccauaguuugaugcuaucaauuacccagcauguuuauuauggauuaucucuccuccuucaaucucuaucugcucauacagccacuuucggucgcagcggcacucagccccacauuugguagagccacaaguggggcaagcguagaagcaucccaagcaguccucguccaggcagucgcagagguccaugccacugaaaaucagcaggcccuggcugucauacaccuuacucuuugcuggaauaauuugucuguaaaauaaaacagugagcugcacuucauacagauuauauuugaauauuuaguugaaaauaagacaaauggagguaaaauaagaaaauggagguaaaauaagaaaauggagguaaaauaagaaaauggagguaaaauauuucuauguagagacgaagucuacuaaauuggcuuaauguguacucuucaggagaguucuagacggagugaccuaagugaugaaaaugaaaaugacgcugacguacccagaggcuaaggugcucagugcacaaguguggaaacugagggguuccugggcccaaggccagaggcaaaaacagacuucaguuuuccucugaucuacacucacaacauacguacccacccacauacauacacauuaagaugugcacacaaauacuacuuauaacuaaaaagaauucaauaaggaaaugcccccaacuggcuuuacauaaaccaucacaggaaugagaagcuggcagugacuuguuuuauugguuacuaaaugacacugcggugaacagaggacacauccuccucuagaggcaucgcacucuaaaaucaacguuucuucuuucuucuuuuuaaaaaaaaaggauuuauuuuauuuuauuuuauuuauuuauuuauuuauuuauuuauuauaugcacaguguucugccugcaugucagaagagggcaucagaucccacagauguggcaucacaacagaugguugugagccaccaugugguugcugggaauugaacucaggaccucuggaagagcagucagugcucucaaccucugagccaucucuccagcccuauuucuuuucuuaaugacgucugguaaaucuggucugaaaauauuuuaaaucacucaauggaaaacuucacaguugcaauaaagguaaaaaugucgauuccaguaagaaaacagcccaaucuguuauaauaaauuugucacuauccuuuagacauacucaauguuaggauaucuauuuuaaaugauuuagcugcugcuccuucuguugacuguacuagaacugugugucuacuucagaccugugcaaaaauugaaagcacucuugaguugucauaaaugcaauggccuuucugucagcugcacacagaaagcagacacaucaagaagagaacaucaauaucaaauuuugcaaauaguaaacaucuuagagacuggugaguucuaagauguuucuucaauuauuuuaacucuuauucucauuaccucauucacuucaugcuaccuucucagaaagaaguuucuagaccuccaacggccgcuuuacuucccuaggaguaacagccauggcuuucagguuuaacuaaucagaguacaauuuaaaaugauuggucagaaaacugaaaauuaagaaaaaacccacaaggauaauguggacgugcagcaggaauguaacaaauagcggagagaacggagcuggcugcccaccugucagaagcagcgcuuguggcuuuggugagcuuucuuuucucccucuuaccgccuucuggagcaaauucaguuugcuucccuggguuuguaaacuguagugaccucagagcuuuagcaguccuucccugaauaaaguaagaaaacuauaaauuaaaaucuuggggucaaacaauaggacuuuacuuagcacuagcccagggucaccccccuccccccgagucuggaaugcaguuuggaauacacacagaaaggaaggugggaaaagccacucuucuagucuauauucaaacuuuuguauuauuuuugcuacuuuagucucuuagacagcaggugcaggagccuggcacacugaggacagcaaugguugccaccucaggagagaaggcagcagaaagugucacauaauccaacagcacagaacugagguguccuucagaccuucuaacuugaaguacaguggcuucacguucugguguacugugucugugucuauacauacacauguauauacauauauauauauauacacgcacacacacugcauguauauacacauacauacagugucuguguguguguguguauauauauauaucuauauaucuauauaucuauauaggcucugguaaaucaaaagucuugugcuaagauuuuaaaucuguuauuuuggagagguaaaauaaguggucuuucaaaauguuuucauacacccaaagccaagauuaugugguaaagaagucagucauguaagaacaauggagagaugaggugaagacauccaagucuagaaucaucgaguaucuaugacgaacuucacauaaugcuggguccuggagauaugccugagaggaacacaauacacacaacuuaacauuuuaauuugguuuaguaaugcaacaaaaagcagaaaacugagaaacuacgccagcagcaagaaagauagaaugcuuaaagagagaaacucgaagaagugcuccuuguggguaacgcaaucuucacagaccucagcuuuccugauagaaaugacuguguacaggccugagacccaggaaaaggcaugaaauaguucacacuuguaaaaacuaugugcucuuugagcacagggagcccuacauuuaaccuuaacuauauucagaacuuagagacagaaacauuaaaagucucaaauauuuggugugcacccuccucccccugccguuuccccauggugacuucgcuggccucgguccuuggggccaggggacucgcccaccugagagcagcuucccaguaaguccgcccuggaggccagguuuacucugguuauguaaaauaaccccagggucucaaaccagacaucuucaaaggagaaaaccugaaauuacauugccugacuacugggcaccaugccucggaccuggccccaguccagggaggcugacagaggaccacugucaagagagccaggcuugucuugacuacaugcugaguucccggccagucugccucggaguaggcccccaccucaaaaccaaaaccaaaaucaacaauuacccacuucuaugauucuuuuccuuaaagcugugcuuuaguccuagacaaagacacacauccucccugguguguagucuccaguaggccaauauucaccuaguuacuucaguaacagaaaaggaucuaaguucccuaaguuggucuuugccaguguucuaaagaccauuccuaaacucuccuucccaagguuuaagaacagauuucaaggcagcauugaaaucuuggacacaugauguucuuuuguucuaagcccuuguuuacugcucauucuggaccuugaguguauggaaacauuuuaaaacaucacuauuucaccucaacauuaaaugguauaugcuaaugaacgugacaggaauaugauaaauaugauuucuuauauuuauuccauauaucuaaagucccacacuguagaaagcacaauggccucuauacauacaucugagucggguuuccgucucuggcggucaucugaaucaacguccacacuuccauugaugaucuggguacauuuggggcaaagcuuccaaccagguacaagcugucuuccaaacuuggcgcucagaaaaguggcaucaucuaagucaaugacgugcagguucuuuuuggcuagcuucuuguguauguuaaaugggucacaacacgacuucugcaaaucuucaaaucugucaauauaaauuuuuacgugauggagacaaauuguauuauucccagaaagugucauuccaguucuaagcugaaguaaaagcaugucauuugaugacaauucuuucaaugucuugaaaccugugugccgaguauagaagguuuuauggcagucgugugugguacgaagcuggacuccaacugaacacggauccaucguccuugauucuaucaauuucccccucuuuuauuuugucuagaaaucucuuugauaggucaaccuaaagaaaagauuaaaagacagauuuguacugaaaauucugauuuggaaaacuguaaaaaguuaguaaaaugcagcuucuuuagaaaacaaaagcaaaauacagcaaacauggaguaguaggaaauaccaaaagaaugaauguauuuaaucaugaaaugggagaaaaagucuugucagcucagaucuacaccagaauccuugagaucacaacuacaacauuaagaucacauuacaugggagcgaaguagaauaaacaagaaguauucacaugagaaauauuagagauucaacagaaaaacugcuuagaauauguaggggauuuaacaacgaugcuggaaacuaacacacuguaugcuuuacauaauauacaaauguuaaaaaaauacaaaagaccuuuauggaauucuacaaauucaguacuauuucacucaaaacacaaauggaaagcccccucugccauccugcuugaguguggaagcugacugcagauagaguacaaguccaaaaauggugagaguaaagaagggcugauuuacuagaaagcuaaguaaagacacuaugguacugcuguagugcagacaaacagacugggguuugguguaugacgagguccuguguuacugugguaaauagauggcauuacacaccaaagugaaaaggauuacuggcuaacaugaaaaaagaaaaauuucuucuggaucaacaaacacaacacagaugaacaaucacacauaaaaagccuaagcaaaccuuuaugagguugccauaccacaaccaucuucuaccuccagacauagggaaucaucccacugucaucuuggccugguaaccauagcaacuaacugauacauugagauuagaauggcaaaggaacuguaaucacuucacaggaagugaacuggcaggauaacugcaggaaggacucaaggauguaaccucuaggaggcugccauucaugagggcauuacccauauuccuguaaauaaucccaaaguucaauaccauaagccaaacaaacucccuagcucaccagugguuacacuggugggaucguuauuuagcuuuguggcugguggccuaguugugguaaacagauguuuguuuaaccucugguaaacagggaaaguuugugcaaggaacuguggggccugcugugugaguacuaugagggccugcaaaauccguuaacaagcagaggauacacuguaguccuugagacuccaguguauguaggcugagacugccagaaaugcaugacugcagcugcauggcccugaaggcagcugcauggccccugcuauguauuauauaagacucaacucggugggcaaucuggaucaaagagagaaagaagaaagaaaaaaagagauggaggugcugguugccauuucuuauagggaccccaaaacuuggaacccaaggaaagaaucuaauaggguagugaaggagaaaacaagguggaaaugauccucaguacaggagaaagaaaauucacaauucagcgugcacguggccugcagcaggaaacugagacuacucugcccugaacucccuguaucagacacaaaguccuggguucaagucccagcaccguagaaacaaaugauggaauacuccuacugucucagcaucugggaggcuggcugauuagaaacucaaggucgggccgggcgugggggcguggcgcacgccuuuaaucccagcacucgggaggcagaggcaggcggauuucugaguucgaggccaggcuggucuacagagugaguuccaggacagccaggacagccagggcuauaaagagauacccugucucgaaaaaucaaaaaaaaaaaaaaaaaaaaaaaagaaaaaaagaaaaaaaaaagaaacucaaggucuuccucagcucccucccuggaggccagccugggcuagaaacugucucaaaagagggggaaaggucaucuuagaacucaggaaguuuauguuuagaaauccaaguccuuaaaguacuauaauuuuugaugggucaauuguagaaaauuaaacuguccaucuaaucacugcauuugaaacgaaccaaccaaccgaaaaagcaaaucguguauaguugcuuuacauacacgaaugucuguguccuacauggcugcagggcuagaaaguggagcaucagaugccauggaaccggaguuccaguuguuagcugcuauguaggugcuggguucaacccaggucuuugggaaaagcagccagcgcuuguaacugcuggcccaucucuucagucccagucacugcauuuuuuuuguuuuuuuuguuuuuuaaaguaaggaucucuuuggagucaugguuaaaggagaauuuucaacaguuguugccagauacagaauuauuagcuaaaucugcauauuugugcuuuuaucaguuauguccuacauauugcuaaaagguuaaucccaucugucugaaauucauaucuaagugcacagucagguaucuuucuuuuuuuuuuuuuuuuuuuuuuuuaaagauuuauuuauuuauuauauguaaguacacuguagcugucuucagacacuccagaagagggaaucagaucucguuacggaugguugugagccaccaugugguugcugggauuugaacuccugaccuucggaagagcagucgggugcucuuacccacugagccaucucaccagccccgguaucuuucuuuuuaucugcuaaauuuggcaccuccauuuucagagccuuuuaggaagcaaagccuucuuugguucuagcucuucuuauuugaguuaaaauagauuuccugaagaacaacuuacaggaacugcucaguuuaaauuuccuacgggagggauggaguuucuuuccuagacaagacuguuggcaacagacaggauggcucagucaguacauugcuugccauugccacacaaguguagggacccaggcauugaaccugcaaaagcaaacaagccaagugcucuggugcccaaauguaaucccaguguugguaaaacggaggcaggagggucccuggggcuuguuggccaguuagacguucuuaaugacaaauauuaacaccaaaagcacuauacuuuaaugccugaauggaucagugggucugcaggcccuucauagauguguggcauugucuaugcaucuauuuuguuuuccaaacagcaaaaaauaacucugacaaggauuuaacuaaaugaccuacuccagguuguucuucuucuucuucuucuucuucuucuucuuuuuuuuuuuuccugagacaggguuucucuuguauagcccuggcuguccuggaacucacuuuguagaccaggcuggccuugaacuccaccugccacugccucccgagugcugggauuacgccaccaugccgggcuacaaaauauuucuuaauccaauuuuaaguuacauugucucuaggcccaccaaguuuggccaaucacaggucaagucagcaaaaccuccucagaguaugguggcucgggggucacauauucuccagccaccaugggauccagucaucuguauaccccacuuguucguaucaauucuucaagcaucacuaauuccuccuucaccucggagguuuccaucaaccuauguaaaagaguaaacuuccagucuuucugcuuuacagcaacaccauacucugcuacuuguuagugcauuauaugcaaagcuccaaaggcaaggcacuaccggauucccucaacagccaaggcuucucuaauuagcaaauucugacacuuuacucuuuagaaauuuuuugaauaaacacaaggucagaaauuccuagagucccaaauggcagacucuccuugaaaucgaugugaucggaucccacuucucugcaaugauccccaccacaaccccgcgugggauucacucauuaaugccccuacucucugccaaugccucaacucaucagacauaaucaacagcacuaggguagaaaaaaauuuaaaacaaaacgaaacaaaugaaacccucaacccaccaaagugcguaacuaaauaucacacgguuagaacugcgaagauugugaauuuuaaagacggucuggagagaugguuccagaagacccaaguuaauucccagcacccacgccgguggcucagacuauccuguaacuccaguuucaagguaauccgacgcccuguucugaucugucggggcuccagccacgcacugcuggcacauacauacuggcaagacauccauccauacaaaauaaaguaauaaaacaaaauguuuuuaaaguuagacuugggaggcagaggcaggcggaucucugugaguucuagguuagccucguccacauagagaauuccaagucagccaagacuacacagagaaacugucucaaaaaacaaaacaaaacaacaaaacuuaaaagccccaggccugguuacucguuucuguaaucugagcuacucaggaggggcuugaugaguuggaggguaguuuaggacauuuggcacgagugaguccucacaaagaagcugaggaugaagcucagcaguggcgaggcccugguucaaauaaaacccugcaaucugaugcaguggcggaccuacugugugcaggguagagccgggugccaggcugcuacaagccccuuccgccguacaagccuccccucccaacacuccucccgguucaccgcggccucccacauucaagugccaucgguagaguccacucacagcccuacggcccgacccggcccgguccaccugagcugccacgggucuccgcugggcuccggaagcaccgucucugcacaggccaagcucggcuuuccacaccaccgccggccccgcgcagaaaccgagaggacggcgagggcggcuagagagaccgcuuguaccauggagaggaaccag

SEQ ID NO: 963 - RNA, 453 nt, Mus musculus
aguuucuagagcuuuggggcccgauugcuggggccugcugggaacaggacuucuaacagcaaguaugucuggaaggcuguggugcaaggccauuuuugcuggcuacaagcgaggucuccggaaccaaagagagcacacggcucuucuuaaaauugaaggcguuuaugcccgagaugaaacggaguucuacuuaggcaagagaugugcuuauguguauaaagcaaaaaacaauacagugacuccuggagguaaaccaaacaaaaccagagugaucuggggaaagguaacucgggcccacggaaacagcgguaugguucgugccaaauuccgaagcaaccuuccugcaaaggccauuggacacagaauccgugugaugcuguacccaucccggauuuaaacuaauggagaguaaauaaauaaaaguagauuugaaaaaaaaaaaaaaagaauagu

SEQ ID NO: 964 - RNA, 2760 nt, Mus musculus
ugacagccauccaucugccucugccugggaguagagaugcgugccaccauaccuugcuugagggauuuuuaaaauacaguacugacugaccugauguauuuuguggcaaguaguguuauaaguagugaaauuuaagaaauuuaaucuaaauguuccauauuuccuuuaaaaaaaaagacauuuuaguagaaaagggaaaaugaaaagcaauagcagcuagguaauguaaaccaagauuacacacucacagaaaaggcaaaucaaggagcagagucccucaacacaguuacucagcacagugaagacacgaaggacacaccguguaacaaacagggccgcaguuguaaacugucguuucccuucuaggacaucaacauugcacucuaguguugggaagcagcagaguuuacaagaguggguaggaaacagcuguacaggcuaggaguaauuuacacauuaaaaaauuaauucuuuucuauuuauaauuucaaacuuucauaaaguauacuaagaauuucacaaauuucuuuucagugaacugaacucuuuuuugcaaugauaggccauuaaauauugcauucacacaaaauggacauuuuuaaucaccuagaauagugaaaauauuuuaauuugcagugucuuuuuuugugacuggauauauuaauguuccucugaguaguauugauaauugguucagaagagaaacucaaugaaauaagaauaguauuuauucauggugaucaauuaaauuauuugccuaauuuaaggaaacuaaauacuaugcauaacugaauuuauuugcaauucucaguuugauuugagguaacagaagagagucuaagucuaccuguggaauauguuguuuuauuuucaauguuuaggguuacauuuaaacauaguugguuugggaaaaugacauauaauuuuaaguuaaccugcaugcuguaaauguguuuaaauaaaggaaaaucuuuuuugaaauguaaaaaaaaagaaaagaaaagaaagcaggcugagcaagccaggggaagcaaaccaguaagaaacaucccuccauggccucugcaucagcuccugcuuccuaaccugcuugaguuccaguccugacuuccuuggugauaaacagcaguguggaaguguaagcuaaauaaacccuuccccccauccccugcuucuuggucaugauguuugugcaggaauagaaacccugacuaagagucuuccuaacugguauccguccucauucaugaugucuuaaugcugcuuacgccagcuuaguuguagauuucccagcacaccucaccaaaucacuauauaugaugagugacuacugcucugucacauuuaagcuuucauuaugcagcaaaugugugucacaugacuugagcaaucaacuguucagauuuacggggauuuguauacaacuuuauacuuagauauuuugccagguuuagaauacccucucucaugcaauaauucacuaacucaccagugaaauggauaauguuguagaagcucagggcagggaucuaggaagaagauuugaaagucuguaguauguuggauuuauaauaaugauuggauuugaauuugaguaguucaucucaaauucuacuagacugcccucaaagauggaaaugagguuccuaagaugcugccuggcauuguccucuggccuacaaacacacacacacacacacacacacacacacacacacacacacacaaaaguacacaugcaagcacacaugugugcguaugucugcaugcauacauacaaugcaaauacaaaagaaaaauuacuggauaaugacuuaaaauaaaccaugccaauguacacuaaaacuaguagguauaaaugaggugagggagaagaagccuauuuucaaagcaucaauucacaaaguuuuucauuaauagagauaacaagccagacguaucuacugggauauaauuaaguagguagaauuaauauaaucauaauuaggaaaauuagacaucauguauaaucugacagaauauacugagaaaaaugcaauguauugagcagaaauguauagcucagacuuaaucauaaagaaaaaaacagaugaucacaaaaugaaggauaugccgaaauauuagccaaucuucaaacaugcuaaaaugaugagaaguaggaaaaaauacaugagugcaagaggacacugccuguauucugaauagaggugucccaaaagcuuauuaaaggauaggagcagagagccauucaaagaaguacuugucauacaaaguacagacaaaaaccaaucuuaaacugaaaacagcaugcuagguccagaagcaacuuaguaauaccuggaugcuagagaaauaaaaaugcaggcagagagaagagcuguggccaaauuaugaugggccauuuugucuugucuucuucacugugcugugauuguggaguuugcauuggggcagacacugacuugacauaucccucagagucuccugagaagcagauaugaaguaucaaauguagagaaguuuuaagagaaaugccuucauguaagaacauagaaaagaugaaauuaaagagauuaauaaucuugggguguaagcugggcucuuaaugaaggaacugugccaggaaggaugaaugaaagaaauagcaaagucauuugugaguccuugaccuagauucaacaaaguaguccagugccaagaaauaggucugguauaguauuuguaccauacugggucaucuggagggggugggcuguggua

SEQ ID NO: 965 - RNA, 2598 nt, Mus musculus
uagguuggauuuaacaggcuggcuguucuguucuuugguugcuguuggcuacccuguauccuaugacagugugauggcugugggguccuugguggaaagcacuucagcaucccagcccucgguggcuauugggagaaccugguagaagguauuugugguucugaggcuaauucacacaaaggaaaggcugagauuagaaggaaagacugagagggacagagggaaaaaacuauggaagcccugggcugaaacaggauguggaaaccucagggaaucuguuguaauuuaaauuguguuaacuaacuaugaauuccaagaguaaacuugugucaauguauuguuauggguggaaugaacaaggaguuuugaauggcaguccuuuauauuuauucaucuuuauuucuucucuaggcuauaaaagaaauaccaacaaaacaaauucaaacaugcuuagaaaauuuagaagaaacacuucaaaagaaaauguacaauaagaagaaucaauguccuugugugguauuuaugccuuuagaaauguauuucaagucugggaaagaaggccaucuuuugcucaaauauuuucagcaagcaaaaugaaacuucuuuuguauuuaaaauaaauaucaaauuacaacaggguauuuuucccauuucucaaauauuugguaugcuugaaaaucucuaagucaccaugaugccaauuuacucauacuuuacuacaacuugauucgaacauuguagaaaacauaguaaauuaaauugcccuuauuauuuucaaaaauaaggagacuuuagaagucauaguuauggccaagauguauuuggucuucugcugugugucaauauguugguuuaaucauacaugucauuuuacuuucuaaaacauugguguaaaaauguagauacauauguccauugcauuguaaauauuguuuaaauaccuuccauaaauaaugugcuaauauuuuauuacuugguauauuaaagauguagauuuuaaacaguuugguuuuccuguuuuauugcaaucccuugcauaugcuaaauguuauuuuauauaagcaugaguuuuguaaauuuguuuuuccuccuagaacaagauaauauguaccuagaccaaauuuguaaacaauccauaaguuucuuaauaaguagaaguggugagaaagcauuuuaaucauuucuguuaccgucuggauuccacagagcuacagcuuacuuaaccuuguucacucgcgugcuuuggccugccuguguggucuggagugcagauuucacagcaaaccagucauacaacagcuuaugagacuucuuaaggcuuuuaguuagccagguuuuuuuuuuuguuguuguuguuuuuuuuucuuuaaaaucuaauugagaaagcaugagacggaauaaucuucacaguuccuaggaguagaguaagaaucaauuauagagaaggcccaauaauuuuucaccauucuuugugauuacuuuucaacuguguugccuguuuuaagaaucaccuucaaaucauccuuucaaauuauuuuagguaauuauaucuuucuagagaaaucuuuuuaccacaugaaggaccagaagauuaguaagugggaacacaagaugucucaguguauaagggcauacauaagcugaucccuggaacaccaauaguaggagagaacucauggcaacuugucauccacccccacauguaaaccccagcaugcaugcaucuacauacacaaaacaguagaagucacucugcaugccucuugucuaccucaugccagaagcuguguggcauuuucuuacaaauguaaguuuuaucagagauuuucucuuggcaaaaaugaguuugcagcaaaaccauguugaggaaauaaugauuaugagaauauagagcuguuugaauaugugaauaaauauaaaauauuugcauugagauagaacgaaaaugcuauugagucugucuguaguccuagaaguuacucuuauuaauaguucaguuacagagcagaucauuuauucuuugguguuagucauuuauuuguugcucugacaaaagcaacuugaaggaaagguucaauuugacuuauacuugguaaagggggaccauccuucauggccagaaaaacuuggugaugggaaccugacggcggcucacacugcaucugcugguaccugcauaacuuuuuccuguuuauucaauuugggaccucagugcccaguuucagggauggucuuccuugcauacugaaucuucugaaaaugcccuuauaaacauaaccugagguguuaauucuggugauucuaaaucuaggcaaguugauaaugaagauuaguuuccuuuucuuauuuaaucucauuucagcauuggacuaggaaugucaaaauaugccuccuuuuuuuaguuuaggguuuuuuuuguugguuuuuuuuuguuguuguuguuguuguuguuguuuugggguuuuuuugguuuuuuggguuuuuuuuuuuuuuuuuugauucaggguuucacuguguaauaguccuggcuuuucuagaacuaacuuuguagaccaggcugaccuggaacucagagagaucaggcaugcaccaccacca

SEQ ID NO: 966 - RNA, 10988 nt, Mus musculus
ggcuucuuuugcuuaacaaugauuuccaguuccuguaaaugcugcgguuuccgcuaggacugaauaaaauaccauuuucucuauccccucagcuguugaaugguuucugguuuuguuuguuuguuuguuuguuuguuuucauuuguugguuuuuguuuuuguuucugcuauugugaagcccuaggcaugaagugcaaauauuccugugguaugcugacuuccuccuucaggaacgucuuccagagauugcuaaggacacauggugaguaguucuauuuucauuucuuaaauucaguucauucuuauuggcguguguguauguucacggcuugggggugagcauggguaggccauaguacaagucuguggagccaauucucuacguccaucuucacguggguucuagagaucugguucaggucuccaaccuugcauagcaugcggcuuugccgguuuagccgucuugccagccucugccuucaggauuuuuugagacacccacacacuaacgcccaucacggcugcaccgguuuacagucccacgcucauuauauaaggguuucucuuucucuaccuucugaucaguguuuauuguugucugaggauagcuauagugacugggguaagaugccuggguaaacaugguaaacacuugcgugucuauugggcauuugcauuuuucuccugaggaggucugucugguuucaucggcucaucuguugguuggaugguuuguucuuucagcguuucauuuucacaacucuuucuguggucuagauguuauuuuguagugacauuucugcaauuugguauaagaccgaaccgugcuuuuguuuuaaucccaggucguggggauacggggcugcuucggaaugucugaagcagaugauuacgaucugccucgugcucuagcagagacauguuuuugccagaugcagacaguuucugcaguugugcuacgcaugggauucugggaacuuuucagaggguguauaaaugcuagaccaccaauaggugaaguugguguucuguuugggagguggggggguggggagugguugcaguuuguuaguagucauaguagucaugcuuaaagaagaaacaaaaggagagaacuuccuuugguggaucuucucucccuauacccuucuuucucuccuaucuagugaaaggaggugaauggggugggugugaguguggauaaagggugggaaagaagaacccauaaaguagugaccaccagcuaacucuguaggacgugugguugucauagcuuuuuccccuauagcuagucucuucacucugggaauuguuuuaauuuuuauuguacagaaccuuuucuauuucacauaacucaauuuguuuaacccugggauuauuuccugugcuucuguuuuaccuaaguuuccuccagugauuucagauguuucuuuauugucugauccauugcauaggaugacauugaguagggaguuugauucuuccaaaggaguagguaaacuuucccuaauaccauuuguugaggagccucucuuuuucauauuauguuuagaccuuugucaguagcuggggcuggcgaagugguuccugaguucaaaucccagaaaccacauggugacucacaaccauccauaaugagauccgaugcccucuucuggugugccugaagacagcaaugguguacuuauuuauaauaauaaauaaaucuuugggacagagugaacaggggcugagugaacaggggcugauggagcaggacugaccggagcagagcaagcagagguccuaaaauucaauucccaacaaccacaugaaggcucuacaaccauccguacagcuacaguacacucauauacauaaauaaauuuaaaaaaaaaucaaguagcuguugcuguuugaguuuaggucugaaucccugugcuuuaauccauugaucuacaugguuuuguacaguugccacgcagguuuuguaacuauagcucugcaauauaguuugaguuugugcugccucgaguguuucuuuuccugucuaguauuguuuuggcuacucagggacuuuugugaguccauaugaaauuuugaacuguaaccuccauggaucugacuuuuuaauuauuauuauuaauuauuauuucuauuacuaagaauguaauuguacccagcacuuaggaggcagaggcaggcagauuucugauuucgaggccagucuggucuacagaguuccaggacagccagggcuauacagagaaacccugucaagaaaaaacaaaacaaaacaaaacaaaacaaaacaaaacaaaacaaaauaaaacaaaacaaaacaagaauguaauuguaauuuuuuuaaaggaaaggauugcaucaauuuuugguuguuuuuuuuguuuguuuguuugguugguuuuuuuaagacagaguuucucuguguagcccuggcuguccuggaacucacuuuguagaccaggcuggccucaaacucagaaauccaccugccucugcuucccaagugcugggauuaaaggcgugugccacuuccgcccggcugcaucgauuuucuacaucacuuccaguaacuagucauuuuuccaguauggauucugccaucuaugaucaugggaggucucauuuuaaaaugaauuuuucauuccuuucaucaauaucuuauaguuuccacaggagauaucguacaacugugagcuguauuccuagguauuuuguuuuucuuaaagcuacugugaaugaggauuuuuaauuuuuuaaugauuucuuuauuggcaaacucauuauuguuauuuaugaaagcuauuggucaaauauaaaauaacuauuuuuuuaaaggcuauugauuucuguguauuuacuguguccuuuuccuuugcugaaaguauuugucagauuuaagaauuauuuugugaagcuguuaggguuuuguaacauauuauuuacauguuauaaauauuuugugcaaauaaaaauaauuuacuccuuucuuuaaaacauguuuuauucccuuuuauuuauuuauuuucucucguguuacugcuaugguuaguaucucaagcccuguauuauauaccagcaucgaaaaugaaaaccuuugccucauuuaugaucuuaaaagaaaguagguaacauuuuuguuuaccucuacuugguacaauguuggcuagaggugugcuguauagacccuuuauuaauauaugcccaaggggaggcuccaaggccugacacuauuacugaugcuaugguguacuuacagagaggagccuagcauggcuguucguugagaggcccaacaagcagcugacugagacagaagcagauacuuacacccaaccaauggacagaagcuggggucucugugguugaauuaaggaaaggcuggaagaagagggugaccccauaggaagaccagcagucucaaauaacucagaccccugagaucucucagauacugaaccaccaaccaggcagcauacaccagcugauaugaacggccucccccugcccccaucucccaacacauacacagcagaggacugccuggucugaccucagugagagaagaugcaccuaacccuugagcgacuuggggcuucagggaauggggaggucuggcaggguguggggguacguguguggguguggagaugucuucuuggagacaggggaggaagaauggguugaggaacuguuggagggcagaaugggagggugauaaagacuggacuguaaaaaaaaaagauuaaagaugaaaacaaaaagaaaauaaauaaaaauaauuuugaaaauuaaaaaaaauaaugagcuaugucccuuguauuccuaguucccuuaggaauuuuaucauagucaaauguuuaauuuuguuaaaagucuuuucugcauguauugagagaauaaugugaucucugucuuuaaguguuccacaugucaucuuggaaauguugaacuaaacuugcaacccugagaugaaaccaucuuagucauggugucugaucaggugagucugggcugaggagaucugagccuggcaagugaggguggggcugccucucccugugcacuucacugccuaagcugagugucccgcugccuacacuuuuccacucaucauuaucugggccccuugcuguccacaacugccucccagggcugucacccugggggugugguagaugaaguucaaguucccggucuuauguuucuuuccuguuugcuggugucugugggagcucagcuggaguuauuuaguaauuaaauaauuguuuaguaacuaaauaagaacuucuuucucaagauagugccagcccuugcccucauauggaaugguaguguggguccauuugaggaaugaaccagugucucauaaugcacuguauuugaaguuuauggggcuuugaacuuaucauaaaguuaggauuuucagauuuaccagggccaguggacuuaccauuagcaaucuucccuucuacccuaaccucuagaaucuacagcuacagcugucuucaccguggcuuuucagugagcugcccauauuuuuucucucuuuguaaccaucagucccuuaauguccucaccugguuggacaccuccaggugacaugccuuuuuuacucuuuccaagaccuacagugacaccaaauuccaaaccauucagauggauaucagaaacaucuuccuacuuacaccuguaucccuaaaccuuuguaaaucugaucuuucccccaccuuucccuucaguucuaacccaugagaagaaugagccuccagggaacaguugaauuguacaggaaacacauggaggucccaagucuacaguauauaagcuaguggugagaaacauaaaccaaaaguuaugugcguaagaaccuaaagaacaaaaguggggggagaaaucaggacaggaaagcagggcaauucuccccuggccaugaugaggcccuuuaagacuaaaaugccagcucuguuucaucaucgaauuugaggauuauuuccuuuucuucuucuucuucucccuccuccuccccagccuuuuccuccucuucuuuauuuuucuuuuucuccuuuuaaagaguacuuucuuuaauuaaaaaaaaauuaauuguguggguggguggaagucagcuuguaagauucaggucucuccuuccccuguggcagacagaacucugcuccccaaacucacuagcaaggaccauuaccugcugcuccaucuugauagucuaaauuggauacauuuuagaaugcugaagaaguuugcagugcuguacaaagaccuuagcacgagacaauuauuuuacagaaguacguguaaaccacauccauaagaaaaagcagccuuuggggugaggaugugcugauggcaaagcggagaaacgcccuuugaagcuuuuacugucgacaugaacagguaugggaggaaucuggaaaaggcggaacuuuuacccaagcagaacauuucaguaggaauuagagggaagacugcauagucuaugaauugccauucuuucccuaacuuggauacuaauuuuuuuuuucaaaaacauucauaagaguugggguguguggcucagagguagaguauaugccagaugcaucugagucucguuucuuaacccugugacaaggaccacgaugaugaugaugaugaggaggaggaggaugacaaugauggcgagaaccauucucucucucucucucacacacacacuguagcugucuucagauagacacaccagaagagggcaucacaugggaucccauuacagacaguuuugagccacgaggugguugcugggauuugaacucaggaccucuggaagagcucuaaaccgcugagcuaucucuccagcccaucuuuaacuuuugaaauaaaacaucuggauauggggcuggagagauggcucagcgguuaagagcacugacuguucuuccggaucaucuguaaugaggucugacaccuucuucuggugugucugaagggagcaauggugauguacucauaugcauaagauaaauaaauaaaucuuuaaaaaaauccaucuggauacaaugcuuucaguuuaaaauuuuccuuaauagauuuguuuuauguauauguguauuuugcaugcuugguucccuugguggucagaagaaugcaggggauccagaagagggcaucggaucccauuacagauaguuguagccaccaugagggugcugggaacugaacauggguccuuccuuugcaaguacaguaagaguguuuaaaugcugcgccaacucuccagcccagggugacgucuuugaaaagcacauuaccaacccuaaauaguacucugaucucuuugaaaaaugguaaagugaaaaaacaaaaaaaucaaaaaaccaaaacaaaccaaaagaaaccaaccaaccaaaaacccuuccccacagacaaaaaccaaacaaacaaaaacaaaagcaaacaaaacacuaggaggauuuagucaaugcaauagaauauuagaaugguucaggauagauuucuugcgagccauggcucagcaugugauccccaguuccucagaguuuuaagccuuuuaugcuuuguuguuuguuuguaaaaaaguacgccuguguuccuuuuuuuaauuauuauuauuuuucauuuuuuuuaucggcuucucugaaucuguccauuccugcuguuuggccaaacacgauacaauuuaucuuuccugcugccuuucccaucccaggucaugcuuaauauuaaaccauauaaaagucacuuugaagaacaacagagaaaguuaaaauucuuaugaaacugaagacaggggaugcugaacugguagggaaacauuacaacagcugucuuaguucgcuccuuugaguuuaaaauaauguguuauuauuuaccgaauaauuuuagaauccuuuaaaguuuuuauuauguauagauguguguguguguauacauacaugagcaugccaugcuauguauggagugaaagauugaggacagcugaccagacucuuuguauaccuugugagucucugggaucaaacuucaaucaagguauuggcaaggaggccccuuuaccuucugagcccccucucuggcucgaccuucuuuuagaaggguccgcuaagugucuacuccuaaggauccacucuauucaggacagaagaguuuugauugauauaguucuguccacacagaagucaccuggggagauuuuaaacauagacuucacagagaacuuuauuguuuucauucgaguaggucagagauggacccuggauugucaguguuuaaaaauuccugauccuguuguaagcucuuccccaaaucauggccuccugcuagagaauggugcaagcaggggucuuuuuaggcacaaaccccaauacaagguuacauauaugaaauauugauuaaaggaaacauuaaugggcagggaguggacugaggcaggccaagucugggugucgagguagugguaggucugucucaggcaagaaagagauggaauggaaaagccugagaaacugagggggaagaguccugggguacaaugcaggccuauaaaagcuaagcaaggacauccuucaucacaggagccccaacccacccagcaacaggucugccuuucguguauugguccugggaucgguccauaaggcaacgcugaccugccgauggggugggaauaguccacccgaugucgcuauuagaaggauucccacggagucgaugggguggggauaguccacccgaugucccuauuaggauucccacagagccgaugggguggggaauaguccacccaaugucccuauuagaaggauucccacggagucgauggggugggaauaguccacccgaugucccuauuaggauucccacagagucaagagcugcauuuucuggacagccuuggaauuuaaggcgugaagcgaaaucccucuauucacucaaauugcaugcaaucuaauuuuauuuauggaauuuaggaacuugaaguguaaggaaccuaauaaagguuaaccuaguuuaaucccuucccuaagucuugggggccuaacagcaucuccguguuuacucuagaguuaacgaaggcacacaugcacagguaggagagcccacuuuugaguagcaaugacuaggauguucugucucauguugucucaacccuuucucccuaacguuuucaagaugcucagaaacaauaaaugagacauagaaggugagagagaggucauagcuuaaaguugcucauuucaggcaccagcagaacacucuggugguagggcacuuggguuugaaccacuaagcugaaggcugagacagaagcaucucuucuuaguccacaaauucaagacuggggcaccacagagagaccuucaccuaaagaucaaacacaauccuuucaccacagugagaaaccauccccagagguuaacuacauaacucaaagcagcauaccucauuaccaggacagccaguuaauauccaggucaacugcucuuuauccucuauaacugauuuaauuuuuaacucugauuuuuauaggaaauaaaagauguuagacaaauuuagugucaugaaagcaaauuaauccuagccacccagauggccuuuggcuuauuuacaagaaguugcugugagccucuaaauuauucuuuccaucuucauggaacuuggauaaagauacucaaagccaaagauaauguuuuugcaauuagcauuguucaguuacaaaacuguuacuauagacaaccccacuaaggcuauagauauucaccuccauugcaauuuccuauagguuugcugacuuuuagguuauuauuaggaagaguucuuugucuacauuugaaaaaccuuucgucuuuaaaaaauauaauuuucaauuuaagcacauuucuaaggacaaacuucauuaauaagaacuaaauuguagacuagaaacaauggcgcuuuggugccaccuugugguaacaucagagaccaccaucccuaaacugugacuacgucggagaacgagcuccccauuuauagaaggcgguguuuggugccaccuugugguaaaauuagagaccgccaucccuaaauuguaacuaaguuggugaguaaaucccuauugacaaaguuggugaaaauucaaauguaguacacauuacacugauuuaauuugauuuggaaaaaauuuuuccugaauacuuucuucuacaaugcuuuuguaagggcuaccaacacugguaggaaguacagcugcagacguuacaaacguuaauauuuaacuugagagaagacuaccagccaugauuuggaucgaauuaaucuuuuuuuuuuuuuaaagauuuguuuauuauaaauaaguacacuguagcugucgucagauaccccagaagagggcgucagaucucuuuacagaugguugugagccaccaugugguugcugggauuugaacucaggaccuucggaagagcagucagugcucuuaacugcugagccaucucuccagcucccaaauuaaucuuucuguaccucaguuuccuuacuuauuucaucuaugggcaucaugaauuuuaaagugaugaaaugaagcaggugguauagcauguaugaaucucucggcauacaugcucacuaaaaaaacaggucaaaauuuuacacacacacacacacacacacacacacauauaauugcaagggucugaggagcccuaauguucgaaugauaggacuucuuuuauaaaaguaacacaccucccaguaaaugucuauacuuucaauugcauacaaaauuacacauauggguggguacaacucccaggcuaucauaaaaucucaauuucacaaacaagaaccaaccaacuagaaaaacaaaauguguuacugccuccuuaucuucaucagauucaaaggaaacuucuguauuaugaaauaaucauuguauuuuaaaguuccauaucuaucuaugucuauaacaaaggcuugacacuauauuuuacuagggacucagcucagugcuagaauauuugaauaguaugugcaaaguucaacuaacucugcagaaagugucuauuugucucuagauguucuauauuuuauuaaaacaaaaccauuucuguguuccuucaccuagccacuaauuugaauccuaccuucguggugaccucaguguuccuucugcugggagcacucccucgagugaggaucugacuggcaagucgggaagaacagucccuuaucuccacagaagccuggcugauuuugaaggccaccucucuuucaagcuuaaaguauauauaggccggccuaugcuuuaagagaauugugaagaccagccauugaugguggcccgugcaguaauccguagcgaugaaccaaaggucagccuaggcuauaaaaugaggccuuacuucagaacaaaaaaaccuagcccaaaauguggaguguguaguagcaguaggggacuguaccccuggauuauucagaccccccaaggcuuugcucucagcauaagggagacuucagcaauauaauucuggcugaaccaaugcuuuucaacgggcaguuggaucucaggggaccugcauaaucaacaaccucuggccaaagacaaacucaucaucccaacuagagaaaggguugcugaagauguagagccuucuuucagacuaaagacaaugccaacuaauuguuuaacugauuaggccaugcugauaauagacuaaaacauggaaagcuaugcucuguggaauggaugagccuggacagccacucaugagaacaagcuguuacauugcuccaagugacuaugguuaucucugccacagaaaacaggaaccaggaagccccuagcucucaaaugucagggcucucauccucuuacaagaucucuacuggaaucuuuauugcacauggaagaagccacacugaauucugguucagugauggauucugguagugaugccagagugugaauucuuuuuaauaaaaguguucugca

SEQ ID NO: 967 - RNA, 2000 nt, Mus musculus
ccuccucuucuuuauuuuucuuuuucuccuuuuaaagaguacuuucuuuaauuaaaaaaaaauuaauuguguggguggguggaagucagcuuguaagauucaggucucuccuuccccuguggcagacagaacucugcuccccaaacucacuagcaaggaccauuaccugcugcuccaucuugauagucuaaauuggauacauuuuagaaugcugaagaaguuugcagugcuguacaaagaccuuagcacgagacaauuauuuuacagaaguacguguaaaccacauccauaagaaaaagcagccuuuggggugaggaugugcugauggcaaagcggagaaacgcccuuugaagcuuuuacugucgacaugaacagguaugggaggaaucuggaaaaggcggaacuuuuacccaagcagaacauuucaguaggaauuagagggaagacugcauagucuaugaauugccauucuuucccuaacuuggauacuaauuuuuuuuuucaaaaacauucauaagaguugggguguguggcucagagguagaguauaugccagaugcaucugagucucguuucuuaacccugugacaaggaccacgaugaugaugaugaugaggaggaggaggaugacaaugauggcgagaaccauucucucucucucucucacacacacacuguagcugucuucagauagacacaccagaagagggcaucacaugggaucccauuacagacaguuuugagccacgaggugguugcugggauuugaacucaggaccucuggaagagcucuaaaccgcugagcuaucucuccagcccaucuuuaacuuuugaaauaaaacaucuggauauggggcuggagagauggcucagcgguuaagagcacugacuguucuuccggaucaucuguaaugaggucugacaccuucuucuggugugucugaagggagcaauggugauguacucauaugcauaagauaaauaaauaaaucuuuaaaaaaauccaucuggauacaaugcuuucaguuuaaaauuuuccuuaauagauuuguuuuauguauauguguauuuugcaugcuugguucccuugguggucagaagaaugcaggggauccagaagagggcaucggaucccauuacagauaguuguagccaccaugagggugcugggaacugaacauggguccuuccuuugcaaguacaguaagaguguuuaaaugcugcgccaacucuccagcccagggugacgucuuugaaaagcacauuaccaacccuaaauaguacucugaucucuuugaaaaaugguaaagugaaaaaacaaaaaaaucaaaaaaccaaaacaaaccaaaagaaaccaaccaaccaaaaacccuuccccacagacaaaaaccaaacaaacaaaaacaaaagcaaacaaaacacuaggaggauuuagucaaugcaauagaauauuagaaugguucaggauagauuucuugcgagccauggcucagcaugugauccccaguuccucagaguuuuaagccuuuuaugcuuuguuguuuguuuguaaaaaaguacgccuguguuccuuuuuuuaauuauuauuauuuuucauuuuuuuuaucggcuucucugaaucuguccauuccugcuguuuggccaaacacgauacaauuuaucuuuccugcugccuuucccaucccaggucaugcuuaauauuaaaccauauaaaagucacuuugaagaacaacagagaaaguuaaaauucuuaugaaacugaagacaggggaugcugaacugguagggaaacauuacaacagcugucuuaguucgcuccuuugaguuuaaaauaauguguuauuauuuaccgaauaauuuuagaauccuuuaaaguuuuuauuauguauagauguguguguguguauacauacaugagcaugccaugcuauguauggagugaaagauugaggacagcugaccagacucuuuguauaccuugugagucucugggaucaaac

SEQ ID NO: 968 - RNA, 2322 nt, Mus musculus
gaauuuaacugccacucugaguugauaccaagaguauguuuacaauuuuuuaaagagcaacaaagccauuucaguaauuugcuggugccuuaccaggucggcuagagcguuuauccaggucauuccugggaagauucacuccuccaauaaaugcuacuguggcuuuaaagguucaccuuuuucagaaaauucugcaguuaggcaguaccuuaucaacaggauuauuuauguuuaagucucugucuggaaaccuggauacuaaguccuaacuauuucuuucuguugccacaaccaaguauaauuguauaaucacuuuucaauacaaagacagccugguguuagcaggaugagaaacuguauaagccaggaaaucccaguguugcuuauaaucucuugcugaugguuaucacaugcauuccugucucacagucuuggaccucucugugaaaaugagggaagagaaaaaacugauaaaaaccuagaaugacuuucuguuuucuuuaagaauugguaucugacaacuuuaaaguucaaagacuucuggguuuuagagagauuucuguacuuucuguuuuuggggguuuguuuuguuuuguuuuguuuuguuuugaaauccugcucuaacuucagccauuacuguaacuuuaacuccaggaaacugcugggcucccagcccacugaauuuucuuucuuggggcagauuagcaaggggcucuuuguggcuaucuaaugggcauucuguucugauagcaacaacuuagaagagagauuuuaggaaaccaaguagcugccuuaccacuccacuaaccauauacauuuguucuuugggcuuucuagaacugacucaugcagagcgacuaguauuuucagcagagcuguuuaggagaucugcuuuaaugaauagauaagaaaguguucaaacacagauaggagucacaaccucccggaacccauugcugggaagagacauuaaccauaaucaaauagauuaaguacucaguguaacugaauuacacuuguaggucaucugacuagcuauaauucauugcacauucaaacugagcaucuuggaagacauaaaggaugaaaugguaugaggcacccuguggguuggagaugcacagacuaauaaauuacagagcaaacccaagugcuuaaaaagcacagugaagucaacagcgggguagcgauaaagcugagagccauggaggcagcagaagcucccuggaauguaccuggucaggaaaggcaccuuucaaaccauaagauuucaucuggagccuaaugaauuaaauagcaagggccagcagacacaguguugagcaggagguguuuuagacaaaugucaaggacaauagaaacaaacuugguaaggucgcauaguuccagaaggauagagcaaugagaacauggggacaaauggaguggaaggguccagggagccacaccugugacucucagcagggucgggauuacacagccccauaacacaggaaaggaacuuggauuguauuuugauuagaguaaaauucuuucccaguuucucaguggcaaaacaguuuaaaaguuuaaauugcuuauuuuuaaucauugaugauaauuuguauguauauuuaauaaugcccaaaggcacuccuaaguaagccaacacuacuccacuagaaucaaaucuccucuaucaaguguaucauuaaauaugacaaagaccauacuaagcuaccuauuccuuuuaaaugugaauuuaguacuagugauauauauuccuaugaauucugucauaugccaucaaacacgugaaucuuaacuagaaaacaaugaaauuaucuucuacgcaaagggguaaugcaguagaagaagcagagacauggacucugcuaaaugcuuuuuguaaggcgcauacaaauaagagugcaaacagaagacuauagaaaaacagagccuggaauacaaaguuaaauaaaguaaaaaggguuuauggacucagauuugcagacuguuguaaaaagaacucgaguuuaaucuucuaacucaauucaugugaauguuagcgacacaccuauaaacguaaagacuuaugcugagaucaacgcuuucagaaaaaucuuuaaauguugcuuuguauaacuugguaguggaccauuugaugaguauuugaaaagcucugaguucaguccccaauacaaccaccaaaagaggagaauggggcuguccucguggcugcacaauuagcagccauccuaacagaucaagaaguaacgcacuuuccaacaugaucuacugccaaagcuccauagaguaucuacacauuccuuuuaagugcua

SEQ ID NO: 969 - RNA, 1037 nt, Mus musculus
uuuagaacugcagcuccuucuggauuccccagagggcgucuucacucuucuucaggcgggcuucuuccucgggagucagugucaccuucacaacguccgagauucuauuuugucccaggauacaaugggacacugaggaagacaucaucauugauuccauagagacccuuaaucaugguggaaaugggauguacccgccuaagguucuucauuaugcucucggccaagucugccacagagaggccaaugguccaggauguguaaccuuucagcuuaaucaccucauacacacugucaacgaccugcuuaugaacauccuuccacuguuccuuaucugcaucaaugcccaauucuggguucagagacuuuagagagaugccggcaauguucacaccacuccacacaggcacacuagagucgccauguucucccaggacccagccgugacagcucagcaggugaacccucagccuuucucccaucaaguaacagaaccgagcugaauccagacugcaaccacuuccaauaagucagcuuuugggaaagccaccgauuuuccgagccacaaaggucaagauauccacuggauuugagacaaccaguagcuugcaguguggacuguacuucacauuguucggaaugaugaacuugaagauguucacguuucucuguaccagauuaagucagcucucucccucuugcugauggcccccgcugugaugaccagcuuggaguuuucaacuacacaauagucuuugcuggagauaauuuuugguauuuuaaggaagaggcugccaugcuggagauccaucaucucucccuuugguuuccaugacgucaacaagggcaagcucaucugccaaguccuucguuaagauacugauggcacaagccaugccaacaguaccaacccucaacaacuguaaucuuguucuggaggaccuguucuuccuuaagaagauucacaaucagcugguccuugaggguugccaccaucuuggacuuugaaucuuuugagaccgcuagugcacgauggg

SEQ ID NO: 970 - RNA, 2269 nt, Mus musculus
gaaaacgcugcauucccacccaguccagggguugaaacagugucagaacagcuucccuuagcuacuagcuccgucucccuggagccagagggaacuccgaaggugaccgcaaagccagcgccuggagcagcagguccccagucggugggucgggcuauccugcuaaaacagcaaagguccagccucucaguagagagaggaucagggacgcugaggagcguggugcacaccgcugcugcguagagccacaugaagccuguggaggaaccaggaucagagagcggcaagcgagcugcgccugaggagggcgccuucucccgaagccgcugacacccgggggaaccuuuuuccuuguuccuggacuaaaacgcuucucccgaauauccagaaugguguucccgaaguugaucuggauggguuucuuuugccaccugugucgaggcuacuuugauggcccccuguacccagaaaugucuaaugggacuuugcaucauuacuucgugccugauggagacuaugaggagaaugaugaccccgagaaaugccagcugcucuucagggugagugaucgcaggcgcugcucccagggggaagggggccaagccaguagcuugcugagccucacucuucgagaggaguucacaguacugggccgccagguggaggaugcuggacgcguccuggagggcaucagcaagagcaucuccuacgaccuggauggggaagagagcuauggcaaguaccugaggcgggagucccaccagaucggggaugccuacuccaacucugacaagucccucacugagcuggaaagcaaguucaagcagggccaagagcaggauagccggcaggaaagcagacucaaugaggacuuccuggggaugcugguccacaccagguccuugcugaaggagacacuggacaucucuguggggcucagagacaaauacgagcugcuggcacauaccaucaggagccaugggacccgcuuaggucgacugaaaagcgacuaucuggaggguggggcacagaagacaggcuaauauuuccauuguaacugcuucauuuuauccaaauuugcacuuucagaacacgucugaagucaucuuucgaaaagaaagaaaaauuuuaauaaguugaguuauucugauuuuaguuugguuuugugcauuauuuauguuauuauuaaggauuuuucacuugcaaaaaaaagcaauuuuaaacuaaccccuggguuauuuccuaaaggguuuuauugcucuaacagaaucucuucuuucgacuccaucuaaaggaugcauuuguguggaaagacugauuaaacuuccacauccuggcgggggacgaggugcguggcuccuuugcaucagcaggcuucucuuuggucucugaaggcugagaugccugauuuucagaugaggucccagguguguggcaugccugccagacaaggaaguucauugauucuccuuucgcucuuauuuauuuaccauguucuuaguuguuucuguuuuguuguaagaguguuauugagaauuugcaugcaaaucaccaccaguaagauguucaaaguuccauuguggguuuguguaaguugaagaugcaacauuuaagauagcaaaacuuuagggugguugcccacucaugaugugucuuucacuucaccaucaaagaaacagauugcuuaacacucaagugucuaugauuuaaguugucagcauguuuuuuucuucuuggacucagauagcauugcuuccuuuuguuuauugaaaacuuauauuuccagagggagggucuaacuauagaaaucccuuauguacauuuuauuacucagccaauaaauguuuucauauaauacuggcuuuuuuucuaguuuacagucauaacucucauauuucagagagggacuagugcaaaggagaggggagauaggauugaagccaguuuaucagaguauaugauaaggaugagauuuuaaaaagaaaaacagagggagaaggugcuguauuuuugaguaucuuacccugucugcucacauacaccauccuaguaagggguagugggaucuagccuguacaagaauuauacauuugauuuccacucuucugauggaaaaaucuuaaauuucucucauuuuucauagacuccauuggaaaugugugacaaagguccauaucuccuaugcacucauucuguguuagugaugccuaacaauuugaaagcuauuucuaugcucuuaaaauaaaugaauuaaaaugugaaaaugcau

SEQ ID NO: 971 - RNA, 4938 nt, Mus musculus
acuuguaaucuuuuaagaauaguaguaguucucuucauaguaucuggcggaucaacaauggagggugagguaucagauuccagaaagaucaucaugaaguuauauguguuucugguuaacacuggaaccacgcugacauuugacacugagcuaacugugcaaacuguggcugaucuuaagcaugucauucaaagcaaauacaagauugcuauucagcaccagguucuaguggucaauggagaagaaugcauagcugcagaucaaagaguguguacuuacagcucugggacggacacaaauucaauuuuucuuuuuaacaaagaaaugaucuuaugugaccgugcaccugcuauuccuaaaacuaccuuuucaacagaaaaugacauggaaauaaaaguugaagagucuuaugauggcugcaguuuuccacacuguugcuucaaggacacagcuugcaguggaaauauaugauguuuccaagaagcucugcucuuucugugaagggcuuguccaugaugaacaucuucagcaccaaggcugggcugcaaucauggccaaucuggaggacugcucaaauucauaccaaaaacuucuuuucaaguuugaaaguauuuauucugauuaucuucaauccauagaagacaucagguuaaaacuuacucauuuaggaacugcuguuucaguaauggccaagauuccacuauuggagugccuaaccagacauaguuacagggaauguuugggaagaccggauucuuugaaugaacacgaaggcucagagaaagcggagacgaaaagaucuacugaacuggugcucucuccugauaugccuagaacaacgaacacauccuuauuaaccucacuucacaagucaauggagcauguagcuccagaucccaccgauacugaacguggcaaagaacucaaggaaucuugucaaaguacuguccggcaagaagaagcuucaguagaugcuaaagacagugaucugccuuuuuuuuuuuuuuuaauguuucuggauuaaauuagacagacuggauaaaugcucaagauagaccuaaugauguggaaucucuggucaggaagugcuuugauucuaugagcaggcuugacccaaagauuauucaaccauuuauguuagaaugccaucaaacuauugcuaaacuugaugaucagaauaugaaagccauuaaagggcuugaagaucggcuauaugccuuggagcagaugacugcuagcuguagccggcugguaaaugaacagaaagagcuugcucagggauuuuuagcuaaucagaugagagcugaaaacuugaaggaugcauccguguuaccugauuugugucugagucaugaaaaucaacuaaugauuauguuacaaaaccacagaaaacuguuggauauuaaacagaaguguaccacugccaaacaagagcuagcaaacaaucuucaugucagacugaaguugguguuguuuugugaugcuucaugaggaucaagaugcagaaaaccugcaggcacugcuccaccuugugauagagcuuuaagaaagagaauuguugaggcucuuaguacaguuccucagauguauugccuagcuguuguugagguuguaaggagaaaaauguucguuaaacacuacagagagugggcuggugcuuuagucaaagauggaaaacaauuauaugaagcugaaaagucaaaaagggaauacuuugggaaauuauucaggaaguccuuuuuaagaaaucaucuguuuaaaggacuggacuccuggccuuccucauuuuguacucagaagccucgaaaauuugacugugaacuucgagauauaucauuaaaagauuuacaguuucuucaaucauuuuguccuucagaagugcagccauuccucaggguccccuuacuuugugacuuugaaccucuacaccagcauguacuugcccuacauaauuugguaaaagcagcacaaaguuuggaugaaaugucacagacuauuacacaucuccugaaugaacaaaagguauccacaagucgggcauccccgcagucagcugcuucuccaagaauagaaaguacaacagguauuacagcuacugccucaccaaaaacuccuccacuaacuguucuggauaccuaauguccagcagugugucccuuagaagaauuaucuccagauauuaucgaugcucauacauuugauuuugaaaccauuucucauccaaacacagaacaaacuguucaccaagcuucuauagacuuggauucauuagcagaaauccccgagucugacuuuauggcugcugugaaugaguuugugauagaagagaauuuaucgucuucaaacccuauaagugauccacaaaguccagaaaugaugguggagucacuuuacucuucagucaucaaugcaauagauaguagguguaugcaagauacaaguacacguggaaacaagugcuuuggggaucgggcuacucuacagguccagcuggagaaaugcagagcugcugcgcaagacucucaaagcaguauacaaaccaucaaggaugaucugugccauuucagaacauuuguacaaaaagaacagugugacuuagcaaauuguuuaaaaugcacagcuguagaaauaagaaauauuguugaaaaaguaaaauguucucuagaaauagcacuaaaggaaaagcaucagcaagaacuccaaucuuuaaaaauugaguaugaauguaaacuugaugcucuagcaaaagacagugaagaaaauguaaauaaaauuuuaaaauugaaagaagauuuaguaucccuuguagaggcuucgcaaaauaaagacaaugaauucacuucagcuaaacaugaaaaggaugcuauugucugugugcagcaagaaaaggaucagaaguuguuagagauggaaaauauaaggcauacucaaaauugugaaauuaaagaacugaagcagucaugagagaugguguuagaagaccugaaaaagcugcaugaugaaaaaauagagucauugagagcugaauuucagugcuuagaacaaaaucaccugaaggaauuagagaacacacugcacaucaggcacacccaggaguuugacaaaccacaaugugucuuuggagaaauuuaaaaaaaaaagaaaaucagcaaagaauugaccaggugcuagaaucucaugccucaacuauucaggaaaaagagcaacagcugcaggaguugaaacucaaaguuucugacuugucaaacaugagauauaaguuagagguugaacuugcacuaaaggaagcagauacagaugagauaaagaucuuguuggaggagagcagaacacagcagaaggaaaugcugaagucuuuacuugaacaagagaccgaaaauuuaagaacagaaauaaguaaacuaaaccaaaaaaaaucaugauacuaaugagagguaccagguggguuugucaguuaagagcuuuaaugacaacugaaaaagaucagugcauuucgaguuaaucaguagacaugaagaagaaucuaauauacucaaggcugaauuagacaauguuacaucuuugcaucacugaguguuugaaauagaaaaaacaaaaaaaaaacaaaaaacugaaagaacaaauaguugaauugcagacuaaauugaacucagaauugagugcucuugaaaaacaaaaagaagaaaaaauaacccaacaagaagagaaguaugaagcacuuaugcagaaccuugagaaagucaaggagagauuggucaugaaccacgagcaagacaaagaacaguuaauucaggagcuuaauuuugaaaaaaacaaagcgguucaaacugcacuagaugaauuuaaauuggagagagaacuuguugagaaagaguuauuagaaaaaguuaaacaucuugagaaacaaauagccaaaaguccugccuuugagucagccagagaagauucuucaagcuuagcugcggaacuucaagaggaacuucaagaagaaaaagcuaaguuucuggaacaacuugaagaacaagagaaaagaaagaaugaaaaaaugcaaaaugucagaaccucuuugauugcugaguaucagaccaacuuuaacacagucuuaacgagagaaaaugaggaaagaaaacauaauaaaugaucuuuagugauaagcuaaaaaguacaaugcagcagcaagagcgggauaaagauuugauagaguugcucucugaggaucgagcuccuuugcuugaagagaggaagcagcuugaagaggaagugagcaaacuccgcacuagcaguuuucuuuccucagcaccuguggcugcagccccagagcuuuauagugcgugugcaccugagcucccaggugagccagagagaucagucauggagaaggcagaugaaggaagaacggauucagcaauggagacaagcaugaugucuguccaagaaagcauguuaucugaagagaagcagaggaucaugcuccuagaacggacauugcaguugaaagaagaagaaaacagcgguuaaaucaaagacucaugucucagaguuuguccucagucuguucaaggcauucugaaaaaauagccauuagagauuuucaggugagagauuugguucucaucaucccagaugagcggcaugacaacuauguauuguuuacuguuaguccuacuuuguauuuucugaauucagagucucuuccugcccuggaucucaaaccagcuucaggugcaucuagaagacccuggguccuugggaaaguaauggaaaaggaguacugucaagccaaaaaggcacaaaacagauuuaaaguuccuuuggggacaaaguuuuacagaaugaaagcugugucauggaauaaggaaguauagccacagaagaaaucucuacaucucauaccauuuuugauuuguccuccagugcugauaaacuacccuaaaaaca

SEQ ID NO: 972 - RNA, 1066 nt, Mus musculus
cugauucuggccugaacaacauguuaacuggagaugucaaauagucaggaaaaauacagguuucuguagucauaaacucuaaugacagaucuguucagaaaauucugauguaacaucucugcuugcucagcuuuuuuauggcuuccuucauaucuuuguuccuuaaaguauagaugacaggauuaagagcaggggugacagcaaagucaacaaugaacagguauuugucagucgaugauguggggaaaggccacacauagagaaacaugcauggaguaaaaaacagaacaaccacagugaugugagcugacagagugacaagcgccuuugacaaguccccugaagaccuuugccagacugugaccaaaaugaagacauaggagaggagaagcaagaagaagguccccaaggucaugaagccacuguuggcagcaacaacaaacucaaaugugucucuauccgugcaugccaguuguaugauucgagggaagucgcaguaaaagcuguccacuuuguuaggaccacaaaaaggcagguucacaacaaaagagaacugugacauggcauggaccacuccagugacccagccagcaauuacaaaugaaaugcauauucuagggcucaugaugcucauguagugcagaggcuuacagauggccguguaccugucaaacgccauggcuaugagcagcaccaucuccacuccucccauaauguggauggagcagaucugagucaugcaacuguggaaagauauuacuuugugcucuuucagaagaucugagaucaucuugggcacugugguagaggaaaguccaacaucaaugagggacagauuggccaaaagaaaauacauaggagacuguaaacgggagucauuaauuaccaaaaagacaaugaaaagguuucccacgaugaugcuuacauagagcaaagagaagguggacaugagaaaaauuguauuuuuccaagaacuggagagucccaacaacacaaauucaaaagcuacaguuucauuuauuugauccauugacuggaacagaggagacaauuucaauggaccugu

SEQ ID NO: 973 - RNA, 1460 nt, Mus musculus
uauacuuaaauugaauuuaauuaaauacaaaugcugcagaucccaagagauagccaccaccacucaggacuucauuucucuggccuuugugcuuggaccaauuuaggcccaggacaaaggcaguguguaaaggaacuccaaccccacccaagccguccucugggagaggcuagaauucagucuggcucucccacuuagagacugccguguguccugcacuuugaggacaaaggugggggggggggcgcuccucuucuuuaguucacuugggcaacucuggugcugacgcaguggaaguugagcaucguagccaccaacucuggaagaucaaagucaugcuuccagccccaguccuuccgagcauugcugucaucuagaaucaugggccagcucuccgcuauggcuugucggaggggauccacgcaguaggugaucuggaagucaggagcaugcuugcggagcgccugggccagcucuucaggggugaagcucauggugccgauguuguagguucucauggacaggcgcucggcaggggcuuccaugaccuccaggguggcccugagacagucacugauguacaucauugggagccuggugccggccucgagguugcauucgaaugugccguucuuugcugcagcguggaaaaucuggacagcguagucaguuguuccuccuccagacugggaaucugcagaaaugauuccaggauaucgcaggcaccggaaaucuaaccuguaccgguaauaauaguauucucccaugagcuccguguggaccuuggauaccccauagaugguccuaggccuuugaauacagagaucgggugcaggguucuggggagagguagguucaaaggcuucaaucgugcugggcacaaacaaucucacguuguauucagcugcaacaucuagaacguuaugcaguccaguuauauucacaucuuuggcuaaggacacauuugccuuucccauggcacucagcagggcacuguagugaaacagccagcugauacggugguucaccacgaucucacggaggcucuuguaauccaagauguuggcauaaacaaaugggccgcuguggaagacaugagcagggggcuuccuuaugucugauaggaucacauuguccuucccaaaucguuuccucaggagguuagcaaguccuacucccagcuggccaagacccccugugaucaagacccgaggaggcucagcuucugagaucgagguggaguagaaguuggcaucggcugggauccggugcugggaggugccuagaaacugcaagggcaagacaagcuuccggcagcuagaggcuuugcucugugcagucccauugaccaccuguuuuguuuuagcaucccaaggaauagcaucuguucuucugauacccugcagacauagaagacuggaugcugagaacgccacgcgggagccggagcagcacguccu

SEQ ID NO: 974 - RNA, 940 nt, Mus musculus
uucaagagauuugucuauagcccauuagaugucugaauacucuccucauugccaucuucauuucuugauuccucaauguguagaucacaggguucaaaaagggaguaacaacugcaucaaauagggccagaaacuuauccagguguguagaggaagaaggccauguauagaaaaauauggcaggaccaaagaauaagacuacuacagucacgugagcugaaaguguagacagcgcuuuguaggaaccacuugaagaguguuucagaacaguaaauaugaugacaacauaggaaaugaucaguaugaagaagaaagccacagacaugaauccacuacugauugagaccauuaauuccagucuauauguguccaugcaagcaaguuugaugaauugaggaaggucacaguagaagcuguccaauagcugaccacagagagguaaauuuacuaugaaaaccaguuguaucacagagugcauaagaccaacuacccaggcaguaauuaaaaagaagaugcacaucugggggcucaucauggucagguaaugaagaggcuuacauauggccacauaucuaucaaaggccauggcaaugaguagcaccaucuccacacccccaauugcauggaugaagaagauuugaauaauacaaccucuaaaggagaugacuuuguucuuuuugaauaagucauaaaucaucuugggugaaguggcagaagaaauaccuauaucaaugaaggagagguuagacagaagaaaguacauaggagaauguagcugagggucagaagccacagugaaaauuaugagacaguuucccaucaugcuugccacauacaacacugaggauaacagaaagagcagcaguuggauauuccaggaguuugugagucccaggaacacaaacucugaugucacagaaugauucacccucuucauugg

SEQ ID NO: 975 - RNA, 7646 nt, Mus musculus
gagcggcgggaccaggggcgcccagccuccuuccgcagcugccggccucggcaaccugcccugacacagggcuccaccccgucugcgcucgcaggguggccacagcauccggaaagugaccagggcgcuccccuacgcgcccaccucucugccccgcuuccagccggagacccugggaaaggggcagccagguccucggggcgccacgcuccgaauggcgcgaggggccgcggagaacgcggcugaacggggacgccggagagccgcaagccccgccccgcggccggcgcccugacaacgcgagcggcccgggcggcgccgccgcucuccgccccucggccggcaccaggcggggcugggaccagagcgccgccgcugccagugccgcacgagccgcgcugcucugcagagccggaccgggagcggggcccgggccgggagcggggggucgcggcccucgcucgaccuucucccaccaugagccagggaaguccuggggccugggccccccuggaucccaccucuggguccucugcguccccaaacccguucgugcaugaguuacaccucuccggccuccagaggguuaagguaaggugugggcaggggacguguggaagacugguuggaauggagagacccagugaugagaugggcaagggggugccagaggagguggaugagaagcuuguggggagggaguuagggggcgcgcacgugggggcggcuggggguggguaggcgaggagccuuggugaggacuccagcuuaggcgauagacgagcucacaagugaggaagaaaugagugggagagggagcacugaaggagacccaaggauaggagagauggagggcacuggggaaugcggauuacauccuacggagguugacgggcuaggauggagcugaaggcuacggaaagcccagggugggggcaggggcgugcucagcgaucggggcuucgacuuaaacgguuuggacccagagacugcguccuugugcccuuccaacaccuccucuuuccgccaccaccacccccccccccccgugucacugcagcaccuacuggugggggcagggaggcugggagguggguuagcuacaggaaguagagggacgcaccacccuaggguagccaggaggugguguggggaggaaguguccaagguuucuguugugaucaccucccgugaggucggcccccgggggcuagguuuauuuaccugcucaauccuaaggaagccucuggagucacccuggcacuuggcaacccuuaccuugcggaauagggcugaguguuaccgaaggauugcuguucugcaguacuaggcuagggauugauugacccgagguuugaaaaguggaucucuguguuuccagccaucugcuccuugggcccaaaguguugaaagcccugcacaggguuuguuugacauaggagcuauuuauggaaugggaugggauguugggaagaacugucucuaaccuacaucaaacacagugcuggacaccuucccugcauuuucucauuaaauccucuuuucuuuuuuucuuuuggggguggggagguauugcccuguguagcccuggcuguccuagaacuuguucuguagagaagacuggccuggaacucacagagauccaccagacucuaccuccugagugcugggauuaaaugcuugggccacccacucccaguccauuaaauccuaacauccauuccaaguaucagaugcguuaugacaguaaccuuuguagggggagggggucaccugagaguaagaaaacaaggcaccuaaugguauugaucccuuguccucccggccucacuagcauuuucaucccauguggacccccugugccucuccccuaucaccuacaagguguuaacuaguugccccugggucaguccuuauaggagucgguagcugugaaaugagccuuucccgggccuaagggacauuuucuccugcccuucugcaguucugccuccuggggguacugcuggccccaauccgaguacuucuagcuuuuauuguccucuuucuccucuggcccuucgcguggcuccaaguagcaggucucacugaagagcagcuucaggaaccaauuacaggauggaggaaguaagugggacccaacuccaaagaccauuucucaccgguuucgaugcucugcuucauccccaacacacacacacacacacacacacacacacacacacacacacacacacaccagcaucuggagcuugucacaugagcuaacagccaagcccagaugugguccuuaggaccugacuucuaagugacauguccaaaguacuucagcucgacgaccagcguguuuugagggggaaagagggguguccugcuuucccaggagccugguugggggacaggguugauuaagagucacaacucccucucccgcugacucccagccuuaccucggcaggacuguaugccacaacgggguucuuggucugagccgccugcuauuuuuccugcuuggcuuccuucggauccguguucggggucaaagggccucucgccucgaagccccuguccugguugcugccccccacucaacuuucuuugacccaauuguccugcuacccugugaccugcccaagguugugucucgagcugagaaucuuucugugccugucauuggaggugagagaguucaagagcgcauaggggaggaauggcaaccccaaaaaucagacauggaaacacuggcucccaguguagagaggacagucaggaggggcaccugucuguuggcagauaaaaguaaggcaacaucauuccauuugucaccugaucucaagacucagggcuggggccagagacaaggugcuaaaaagacagccuccauacauagauuguagcaauaaauggaugguugaaauaucuugcacuguugaggaaacugaagcugccagaugucagugccucagggucagaaccaagugacuccuccucuuaaccuucccaacccagcacuccuucgauuuaaucaagccauccuagucucccggcaugaccccgccucucggcgcagagugguugaggaggucagaaggcgggcuacuucaggaggcaaguggccucagguggguaaaagauaucuugaagcucugccucacgugcccaacgguugcucuuuccuccccacuucacucugugcuuuggguuuuuuguuuuuguuuucuuuuuuucacccagguacuauuuuuuccugaaggcaccuguuccaacaagaaggcucugcugaaguucaaaccaggugaguaaaaugacagugggaggugagguguguguggggggaguaccucacaaaguagagggaaggguaccggguaacagugacagggagccucccaccucucugacaaggugagucagagaggaaauucuugguagagcaaagccacauggcauuugggauuugucccagccccucaugccagguagcuaccuccguguacuaacuucugccuuggggguggggguggaaaugggauuuaggagccuucaucgcaggggugcccgugcagcccguccucauccgauaccccaacagucuggugagucuggguagaaggaaaugguggguucaggggauuaggaagcccuccugaguggacauaaguggaaacugcuggugggguguuaaagauacgcaucuggggugaagcaugaggugagguuggggucugcugaaggagacuggcugguuuccaggaagagaacuaaccucugccccuucugcuuuucccacaggacaccaccagcugggcauggaggggccccggcgugugagugcuagggucacagggguuaggguggggagucggguccaccagagcauuucugauccagucucuaaucaaagaggugaaugaccuacaguguaggacugagagaacuccagcggagauugcccucugaccuccccacauuacuuggcaguguuucuaggccucccaccuaagucacuccugcuauaauuacaguuccuuauuuacuguccaguauuucuuguuuguggguuugggggaggggagggaguucguggcugguucugaacucaguggucccugcuagagaacccauaccacuagggaugccucuucccauugccucagcgcccaggcuucuccuuggaguguuuccugcagcuuuugucccgcccauuaccuuucuggcccuucucacagccuccuggcuaacuggagcuaggguucccauuccccccccccccccccccccccgcaucaccgggagaacgucccacugccuugcucaagaggagcagcuagcucaucguuaaacagcggcaaacacccaucucuccucucuuagacucaaaguucucuggcucaccgccucucagcccugcagcaucguggauguagagguacaaaccccuuagugggauuggggaaaauagaguagugaccacgcaugcuuucagguccugaugagagccgugucuguauuucaguuccucccugucuaucagcccagccuggaggagaguaaggaccccacccuuuaugccaacaacguccagagagucauggcacagugaguauuacagguugcuuccugcuguucaacgaaguacuuccuggagcuguucugcugagcugaggaaccacgaggaggugcgggagguuuugaggcaaagauaagggauaauggggaagggcugggagacagccgagaucaaggagagaaaaagacaaaggaaacugaccgugccagucuaaccguguaaggaaaccucaggaaggucuccugccgccuucucuugaucuccauccuucuuuguccugaagggcccugggcauuccagccacugaaugugaguuuguagggagcuugccugugauuguggugggccagcugaagguagcguuggagccgcagcucugggagcuggcaaaggugcuacagaaggcuggguaaguuacccuugaaggcggggauauaagaagcagugcacccgggaggggaaaucagggaggaagaagggcugugcuacccuccguccuuaguacagggccucaggggacagacagcagcugagccugcaccggagccuagagcuggggguaagacugugcauggcguauccaaaaagaaacugagucaacucugcugucaacgauuccgucguaggcuguccccuggcuuuguggacaugggggcagagccaggccggagucgaaugaucagccaagaggccuuugcccaacaguuacagcucucggauccucagacaguggcuggugccuucagcuacuuccagcagguaauggacuagaacccagggcaaaauggacggcuugcccucagagccaaggagcucaagauccagggaugauguccgagugauuauuuauggcaaacuauauuuccggaaauggaacccaaguauacugucaauucacaauucuaguuuuugucuguguguauuaagaauacacucaaguuuuuauacuaggcaggugcucuuuauaccacucacaagggcccuuucugugcuaaugggucuuaguguucccucaacacuaagggaacagaagcaaggaaucguaaguuuaaggccagccuaggugauguaguuacaccuuucuaaaagguuuuuuuuuuuuuugguuuugaaacaggguuucucuguguagcccuggcuguccuggaacucacucuguagaccaggcuggccucgaacucagaaaucccccagccucugccuccugaaugcugggaucaaaggcgugcgccaccaccgccuugcuaaaaguuuuaaaguaauuaaaaauuuuaaguuuugagcuguuuggauuucuuaaauugaggaagaccgucagccaacauaucccccacagacauaacaucuauccuguuuagauuuuuaguauuuaaaaaagaaaaaaaaaaaguuaggucaguggcccccaagucuguucgaccaguucuaccacauaggcugagucagaggaaaaccaguuugucgggguuggaaaccgggauugcucccuuggguauaucagagugggugguaacuuuggaauuccugggggauccccugacauuccuagaucucugugggaggacuuggucacuuggcauagcuuggcauagcuuauggcaguaagugauaguggaaggcagcacaggaguccuggggaguuugccggucauucugagcacagugaucaugagcaucaucuuuaagccugcugaacagaagccagagggcaggaggaagaugcccagcccccacauuguucugguuuuucacccuccaggaugccaaggguuugguugacuuccgaaauguggcccuagcgcuagcggcccuggacgggggcaggagccuggaggagcugacucgccuggccuuugagguaccuuugagggacugugggacagcugcugagaugcuugaccccacagcuucaucccaagagggcagaauauuguacuguucccaguuagcucuucaauaacgcaagcucagggcccuccccagugcuacacugccuaaaacugccucuguccagaaucucccaccaaggccuaccugggaacaagaaggcagaagcuagcuagcuguuuuacacuuguccugaaagaucagguacuagagauucaagaaggcuuuacguacagcacucuuagaaacagagcagugcaucaggccggcuuccugggcaaugugaggcacugucugaaggagaaaacuugaugcccccccccacucuuccccaucucucccccccucaagcucuuugcugaagagcaggcagaaggaucugaccggcugcuguacaaagacggcuucagcaccauccugcaccuguugcuggguucaccccgccccgcugccacgacuuugcaugccgagcugugccagccuggaugcagccagggccucucccucugugagucacugccuucuuugcccugugcaggugcuggggguggggguggggguggggugaggggguuauggucagcaccaggauauggucugagcacugagcuggguugagaaagagggcuaguggccagugucagggaucagaaccucugagaggaggcaagcuauauuugagaaggcaaacagacuagcagggcuggguucugagaaaagagaagcgagggguguccuccucacucucaagugguauaacuuucccgugucccacuccuccuguccaggucaguuccagaacuucucccuccacgacccucuguacggcaagcuuuucagcgccuaccuacgccccccacacaagccucgaagcaccucccagauaccaaaugccucaucccccagcagccccacugcccuggccaacgggacugugcaggcccccaagcagaagggagacugagcgccucagcuucccacuuuccucagcucaaacccagcccugcucucaggacggcgucagaggccuacccuaugccucaaccccaccucugcuccuguuugauuuuuuuuuuuuuugguuaucuuuuuuuuuuuucauuuuuuuguuugguggggucuuuuuguaaaagacuauuuuauauauaaauauaaauauauaucuaauaaaaaaaaaccugaagcuugg

SEQ ID NO: 976 - RNA, 7646 nt, Mus musculus
ccaagcuucagguuuuuuuuuauuagauauauauuuauauuuauauauaaaauagucuuuuacaaaaagaccccaccaaacaaaaaaaugaaaaaaaaaaaagauaaccaaaaaaaaaaaaaaucaaacaggagcagaggugggguugaggcauaggguaggccucugacgccguccugagagcagggcuggguuugagcugaggaaagugggaagcugaggcgcucagucucccuucugcuugggggccugcacagucccguuggccagggcaguggggcugcugggggaugaggcauuugguaucugggaggugcuucgaggcuuguguggggggcguagguaggcgcugaaaagcuugccguacagagggucguggagggagaaguucuggaacugaccuggacaggaggagugggacacgggaaaguuauaccacuugagagugaggaggacaccccucgcuucucuuuucucagaacccagcccugcuagucuguuugccuucucaaauauagcuugccuccucucagagguucugaucccugacacuggccacuagcccucuuucucaacccagcucagugcucagaccauauccuggugcugaccauaacccccucaccccacccccacccccacccccagcaccugcacagggcaaagaaggcagugacucacagagggagaggcccuggcugcauccaggcuggcacagcucggcaugcaaagucguggcagcggggcggggugaacccagcaacaggugcaggauggugcugaagccgucuuuguacagcagccggucagauccuucugccugcucuucagcaaagagcuugagggggggagagauggggaagagugggggggggcaucaaguuuucuccuucagacagugccucacauugcccaggaagccggccugaugcacugcucuguuucuaagagugcuguacguaaagccuucuugaaucucuaguaccugaucuuucaggacaaguguaaaacagcuagcuagcuucugccuucuuguucccagguaggccuuggugggagauucuggacagaggcaguuuuaggcaguguagcacuggggagggcccugagcuugcguuauugaagagcuaacugggaacaguacaauauucugcccucuugggaugaagcuguggggucaagcaucucagcagcugucccacagucccucaaagguaccucaaaggccaggcgagucagcuccuccaggcuccugcccccguccagggccgcuagcgcuagggccacauuucggaagucaaccaaacccuuggcauccuggagggugaaaaaccagaacaaugugggggcugggcaucuuccuccugcccucuggcuucuguucagcaggcuuaaagaugaugcucaugaucacugugcucagaaugaccggcaaacuccccaggacuccugugcugccuuccacuaucacuuacugccauaagcuaugccaagcuaugccaagugaccaaguccucccacagagaucuaggaaugucaggggaucccccaggaauuccaaaguuaccacccacucugauauacccaagggagcaaucccgguuuccaaccccgacaaacugguuuuccucugacucagccuaugugguagaacuggucgaacagacuugggggccacugaccuaacuuuuuuuuuuucuuuuuuaaauacuaaaaaucuaaacaggauagauguuaugucugugggggauauguuggcugacggucuuccucaauuuaagaaauccaaacagcucaaaacuuaaaauuuuuaauuacuuuaaaacuuuuagcaaggcggugguggcgcacgccuuugaucccagcauucaggaggcagaggcugggggauuucugaguucgaggccagccuggucuacagagugaguuccaggacagccagggcuacacagagaaacccuguuucaaaaccaaaaaaaaaaaaaaccuuuuagaaagguguaacuacaucaccuaggcuggccuuaaacuuacgauuccuugcuucuguucccuuaguguugagggaacacuaagacccauuagcacagaaagggcccuugugagugguauaaagagcaccugccuaguauaaaaacuugaguguauucuuaauacacacagacaaaaacuagaauugugaauugacaguauacuuggguuccauuuccggaaauauaguuugccauaaauaaucacucggacaucaucccuggaucuugagcuccuuggcucugagggcaagccguccauuuugcccuggguucuaguccauuaccugcuggaaguagcugaaggcaccagccacugucugaggauccgagagcuguaacuguugggcaaaggccucuuggcugaucauucgacuccggccuggcucugcccccauguccacaaagccaggggacagccuacgacggaaucguugacagcagaguugacucaguuucuuuuuggauacgccaugcacagucuuacccccagcucuaggcuccggugcaggcucagcugcugucuguccccugaggcccuguacuaaggacggaggguagcacagcccuucuuccucccugauuuccccucccgggugcacugcuucuuauauccccgccuucaaggguaacuuacccagccuucuguagcaccuuugccagcucccagagcugcggcuccaacgcuaccuucagcuggcccaccacaaucacaggcaagcucccuacaaacucacauucaguggcuggaaugcccagggcccuucaggacaaagaaggauggagaucaagagaaggcggcaggagaccuuccugagguuuccuuacacgguuagacuggcacggucaguuuccuuugucuuuuucucuccuugaucucggcugucucccagcccuuccccauuaucccuuaucuuugccucaaaaccucccgcaccuccucgugguuccucagcucagcagaacagcuccaggaaguacuucguugaacagcaggaagcaaccuguaauacucacugugccaugacucucuggacguuguuggcauaaagggugggguccuuacucuccuccaggcugggcugauagacagggaggaacugaaauacagacacggcucucaucaggaccugaaagcaugcguggucacuacucuauuuuccccaaucccacuaagggguuuguaccucuacauccacgaugcugcagggcugagaggcggugagccagagaacuuugagucuaagagaggagagauggguguuugccgcuguuuaacgaugagcuagcugcuccucuugagcaaggcagugggacguucucccggugaugcggggggggggggggggggggggaaugggaacccuagcuccaguuagccaggaggcugugagaagggccagaaagguaaugggcgggacaaaagcugcaggaaacacuccaaggagaagccugggcgcugaggcaaugggaagaggcaucccuagugguauggguucucuagcagggaccacugaguucagaaccagccacgaacucccuccccucccccaaacccacaaacaagaaauacuggacaguaaauaaggaacuguaauuauagcaggagugacuuaggugggaggccuagaaacacugccaaguaauguggggaggucagagggcaaucuccgcuggaguucucucaguccuacacuguaggucauucaccucuuugauuagagacuggaucagaaaugcucugguggacccgacuccccacccuaaccccugugacccuagcacucacacgccggggccccuccaugcccagcuggugguguccugugggaaaagcagaaggggcagagguuaguucucuuccuggaaaccagccagucuccuucagcagaccccaaccucaccucaugcuucaccccagaugcguaucuuuaacaccccaccagcaguuuccacuuauguccacucaggagggcuuccuaauccccugaacccaccauuuccuucuacccagacucaccagacuguugggguaucggaugaggacgggcugcacgggcaccccugcgaugaaggcuccuaaaucccauuuccacccccacccccaaggcagaaguuaguacacggagguagcuaccuggcaugaggggcugggacaaaucccaaaugccauguggcuuugcucuaccaagaauuuccucucugacucaccuugucagagaggugggaggcucccugucacuguuacccgguacccuucccucuacuuugugagguacuccccccacacacaccucaccucccacugucauuuuacucaccugguuugaacuucagcagagccuucuuguuggaacaggugccuucaggaaaaaauaguaccugggugaaaaaaagaaaacaaaaacaaaaaacccaaagcacagagugaaguggggaggaaagagcaaccguugggcacgugaggcagagcuucaagauaucuuuuacccaccugaggccacuugccuccugaaguagcccgccuucugaccuccucaaccacucugcgccgagaggcggggucaugccgggagacuaggauggcuugauuaaaucgaaggagugcuggguugggaagguuaagaggaggagucacuugguucugacccugaggcacugacaucuggcagcuucaguuuccucaacagugcaagauauuucaaccauccauuuauugcuacaaucuauguauggaggcugucuuuuuagcaccuugucucuggccccagcccugagucuugagaucaggugacaaauggaaugauguugccuuacuuuuaucugccaacagacaggugccccuccugacuguccucucuacacugggagccaguguuuccaugucugauuuuugggguugccauuccuccccuaugcgcucuugaacucucucaccuccaaugacaggcacagaaagauucucagcucgagacacaaccuugggcaggucacaggguagcaggacaauugggucaaagaaaguugaguggggggcagcaaccaggacaggggcuucgaggcgagaggcccuuugaccccgaacacggauccgaaggaagccaagcaggaaaaauagcaggcggcucagaccaagaaccccguuguggcauacaguccugccgagguaaggcugggagucagcgggagagggaguugugacucuuaaucaacccugucccccaaccaggcuccugggaaagcaggacaccccucuuucccccucaaaacacgcuggucgucgagcugaaguacuuuggacaugucacuuagaagucagguccuaaggaccacaucugggcuuggcuguuagcucaugugacaagcuccagaugcugguguguguguguguguguguguguguguguguguguguguguguguguguuggggaugaagcagagcaucgaaaccggugagaaauggucuuuggaguugggucccacuuacuuccuccauccuguaauugguuccugaagcugcucuucagugagaccugcuacuuggagccacgcgaagggccagaggagaaagaggacaauaaaagcuagaaguacucggauuggggccagcaguacccccaggaggcagaacugcagaagggcaggagaaaaugucccuuaggcccgggaaaggcucauuucacagcuaccgacuccuauaaggacugacccaggggcaacuaguuaacaccuuguaggugauaggggagaggcacaggggguccacaugggaugaaaaugcuagugaggccgggaggacaagggaucaauaccauuaggugccuuguuuucuuacucucaggugacccccucccccuacaaagguuacugucauaacgcaucugauacuuggaauggauguuaggauuuaauggacugggaguggguggcccaagcauuuaaucccagcacucaggagguagagucugguggaucucugugaguuccaggccagucuucucuacagaacaaguucuaggacagccagggcuacacagggcaauaccuccccacccccaaaagaaaaaaagaaaagaggauuuaaugagaaaaugcagggaagguguccagcacuguguuugauguagguuagagacaguucuucccaacaucccaucccauuccauaaauagcuccuaugucaaacaaacccugugcagggcuuucaacacuuugggcccaaggagcagauggcuggaaacacagagauccacuuuucaaaccucgggucaaucaaucccuagccuaguacugcagaacagcaauccuucgguaacacucagcccuauuccgcaagguaaggguugccaagugccagggugacuccagaggcuuccuuaggauugagcagguaaauaaaccuagcccccgggggccgaccucacgggaggugaucacaacagaaaccuuggacacuuccuccccacaccaccuccuggcuacccuaggguggugcgucccucuacuuccuguagcuaacccaccucccagccucccugcccccaccaguaggugcugcagugacacggggggggggggguggugguggcggaaagaggagguguuggaagggcacaaggacgcagucucuggguccaaaccguuuaagucgaagccccgaucgcugagcacgccccugcccccacccugggcuuuccguagccuucagcuccauccuagcccgucaaccuccguaggauguaauccgcauuccccagugcccuccaucucuccuauccuugggucuccuucagugcucccucucccacucauuucuuccucacuugugagcucgucuaucgccuaagcuggaguccucaccaaggcuccucgccuacccacccccagccgcccccacgugcgcgcccccuaacucccuccccacaagcuucucauccaccuccucuggcacccccuugcccaucucaucacugggucucuccauuccaaccagucuuccacacguccccugcccacaccuuaccuuaacccucuggaggccggagagguguaacucaugcacgaacggguuuggggacgcagaggacccagaggugggauccaggggggcccaggccccaggacuucccuggcucauggugggagaaggucgagcgagggccgcgaccccccgcucccggcccgggccccgcucccgguccggcucugcagagcagcgcggcucgugcggcacuggcagcggcggcgcucuggucccagccccgccuggugccggccgaggggcggagagcggcggcgccgcccgggccgcucgcguugucagggcgccggccgcggggcggggcuugcggcucuccggcguccccguucagccgcguucuccgcggccccucgcgccauucggagcguggcgccccgaggaccuggcugccccuuucccagggucuccggcuggaagcggggcagagaggugggcgcguaggggagcgcccuggucacuuuccggaugcuguggccacccugcgagcgcagacgggguggagcccugugucagggcagguugccgaggccggcagcugcggaaggaggcugggcgccccuggucccgccgcuc

SEQ ID NO: 977 - RNA, 1346 nt, Mus musculus
cguccaaucuggaagguuguuggcgcacgcgauugaagcggcgcacucggaguaaacgcggcuggcgguaguacgugugucuuuuugcugagggcaguuauguuucuccaauauuaccucaacgagcagggcgaucgcguuuauacgcugaagguaaggggaggaggaaacagcuauauaucaaaaggacgagaaauuuagaugggaggaacaguuggaaccggccugcgcagcccacugaguggagccaugucggagccaaaacgugguagauaggcaguggcuucuuuuucugaccacgcgaucuccuggccucaggucacccauuuucuuguuucuuucuaucacaccacucauauugagauauuuuuuauuuuuccuugagcagaaauuugacccuaugggacaacagacuugcuccgcccauccugcucgguucuccccagaugacaaauauucaagacaccgaaucaccaucaagaaacgcuucaaggugcucaugacccagcaaccgcguccuguccucugagggcucguuaaucuuuuacgcugcucaugccucggccuauuaucagcaaccaaacgcgucaaucuguaagccuugaagccuucccaugcuguuuggaauccuaucucacucaccacgugaaugagucuauacugaugggccucgccuguaaaaggaacaauauuuuucuuucuuuuuuucaugccagguuauuaaagauauagugaacugaaaguucauuuuguguguuguuggaggaagagaugggggaaggguaguaccguugguaguacaaggccacuugagaacauucguaagcccucauuguagcaauagaacugugugccaucgacgauaggguguuggggggaaaaaggcugugaaagacuccuacaaaggucagcauucccuggaaaacuacugucuaauugugggcccuuuaaaaaauauucugaauuccucaaagaguaaaaaaaaauguauguguguuuuaguauuuuaccgacaugugucuaugccuauaugugccaguaaccaucaagaccagaagagggagucagaucccuggugacuagagacugauagcuagucuuucugugacugcaggggauagacacagguccucugggaagcaccccucucuccaguccuaccacuacauuuugaguucugagauaacaaguaugcccaacccuggaaguuuucuuuuucucucuuuagacagagucucuauguagagcuggcugcccuggaccucaggucuaacugccucugccuuugaacacuaucuuaaaggugugcgccagccuguggauguuucuuuaccaagccagugaaa

SEQ ID NO: 978 - RNA, 149469 nt, Mus musculus
uccaugucuguauaaguucucuuuaauggaaauuuaagccuggcuugcaguuucaaaaggauaugaacaagaaaggggaaaguagcccauaaugaugaacaagauacaggugucuuagaaaagacaacugaauuuuuacagaggucacaucuaagguaacuagauaccguaaugggagguuugggugccauagaguuaagguuuccagagagcuuuuagagaugacccuugcgguucgcgggucaguguucacugagugccucuaagcagcauacugaguacguggagcacaggugaggaaaaagcagcucgccacacgcguucagacccuagggcggacuacaguucccgucgugcuccacgugagagucgccgguccgcgcaggcguggugcccucugucucccgcgcugcaugcuccgggcggggcugcuguugcccggccgcaggacggcgccgcccucuagcuccccagacuucuccggacgguuaaccucgaaugaggaacgagaggggcggaaaggggagggcugcggcggcgcgggcacagcccgccgcgcccggggcggggggcggcgaggucacguaacggccucgggcgucugccggggagggggccuccugcgcgccgcggcuccggaacgguuagcggcuaguaaacaacagcugcgcgcgcacccgcaucagcuggcgcgggcucccgcaccugcgaccuccuccguagccgggaccagccugccuggccgucuucucccuccgccgagacccaaggaaagccggcgagaggcuaacgggccccgggaggaaagcgcguccugucacacgcagugcaaacacggcgagcggucgugggcuugagggacucgccacgaccugccacgacccugcagugggagcugcccugauccgcuagccgccgccuccagcuccuuugccaggacgagaccucugggaggcaggaauccacucugcuucggcauccucucguggcucuccucuuucuccuuccuguaguguggggguauuuucccguuaugcaugcgcaucucucccaccagacccaaguggauuaucgaccucaaaaacaucggguggcucagcacacaccuccucccagccagaccugugggguauucaccugauacacaacagguggcuggugcacaccuuugcgcaaucugauccacgcucuuauacgccugauaagggugggccugcaugcuccguccucagcuagaaccgugggacacucggcagauaaaggacuaacuaccucauccggacccuggggguugagcagagggaggcgucaccagcugcugugagaucauggcacggagcccucagcccuggaccaggggagauagcuaggauucugaaagaaccaaguuauacaggauuagcaucguuuuguucuuauuuuguuuucucgaaaauuauuuuucaguuacugguggggcacuuuauaaaacagcuggcuugaauucuauacacggauucuuaauugggccuuugugggcuguaaaucaggguaauugaggguuuuugguuuuuuuuccccuucuauuuuugcaaucagaaguagcuaguguaggaggaagaguuuuugugagcuuuuccuuuuuucuuugucaaaaaggaaaggggggggaaaaugcauccaccagaagccaccaccaagauguccucaguucgguucauggugacaccaacuaagauugaugacauuccagguuugucagacaccagcccggaccucagcucucggucuaguucucgaguaagauuuagcucccgagaaagugugccagaaacaagccguagugagccuaugagcgaacugucuggggcuacuacuucucuggcaacuguugcccuagauccuuccagugaccggacuucuaauccccaggauguuacggaggguaaguagagacucagagagccggguguuucaacccuuggguuguccauguuggcuaacuacccuaauuuuauaaucauaaauuaaggcccacguuucugugaugcuuacgagugugggaauaauagcgacaguuaguaggucacugcaguagucuuuuuggcgugggaaaguagcuggcaagagggcaaggaaaugucuauuuugguuuccuuauuucugucuuauuucuaauuaaaaugacuauuuuuaaaaaauuaaaucuuuuacaacacacaaaaaaaguucuaaacuaaaauuuuaaugggcuggauaugcgcuuucuagagagcuuuggggcuuugacuccuaagucagcguuuaaggcagguuguuacaucuugugucuuacuggauucuuuugcagauucaguugggugucauaaaauuauuuuuugaaauuuauguuuuuauagaguauuuaaaguaacugaauucacucaaggaagugguacucucuugaaagaauggaacuuucgagagggacuucucgugcaugauucccacauaauuucccugcugagcuuuagauaacuauuuuguauauuguauauugaguuuuguagucagaaccuauagaagccacuucuguucguauuaaccacuuuccagacuugaccuugagcugacgagccugacuugaauuagaaguuuuccuuugauuuagugggaagaggugaugcaaggaggaaaguuacuuuuuccagacucaguuaaaaaacuugagaacugccacuuaguuuuaugccucauucggaccagcauaagucuuuuuuuuuauuauuuaaguuuuucccuuaagaaucuuaaagacuuuuaaaaauucuauucuacacaaguuugaaaacauggcuuuagacagugacuuguuaaagcaaggcuaucuuaccauuuccggucucaggaaauaguguuccuccugaccuuaaguguuccggaagccagaauaguuuuaguuccucaaauuugcuuguuuuuaaugucuugagaaagauagacuugguaaagcuuauaguuccaaaauuaacuaaucuuuagcgagucauguuucuuuuauggcaguaguaugaguuaauuccuagucugacugcuuucuguugcuuaauaaaccuuacacuggauuauauacacuauguuaaaguaugagauaaaagaucauaacuuccuuuucuaccauauuuauuuaucuauauauauauauauauauauauuuugugacaggaucucaaguagcucaggcugaccuugaguuuucuauauggucaaggaugagcuugacccuggcucuaccucccaaguguugggauugaaggccuuuuucaaccacacccaguuuugugggaugcuguggauggaacucaaggcaggcacucugucaacugagcuacaucccaagccagcaccaaauuacuuccaaauuaugaucuuaaucuuuaauucaucacauuacauuugaauuguuaaaaaaugcccauuaaacaaauacagaaguggaugcucacagccauccauuggacgaagcacaggguccccaaugaaggagcuagagaaaguacccaaggagcugaagggguuugcagccccauacguggaacaacaaaaugaacuaaccaguacccccagagaacccugggacuaaacgaccaaucaaagaaaacacauguugggacucauggcucuagcugcauauguagcagaggauggccuagucgguccuuaaugggaggagaggcccuugguccugugaagguucuaugcuccaguauaggagaaugccugggccagaaagcaggaguggguggguuagggagcaggggguggggguggggaauaggcgauuuucagaggggaaacuaggaaaggggauaacauuugaaauguaaauaaaauauaaaaaaugccaauuaaaaacuacaaucuacauaaguccuuucaaggaguacugauaacuuuuuauucaguccuauauuccagucaacuugaucaggucuuauauuuuuauaucccuacucaagacuauaacuauaauaucuauagcacuuuguuguuauuuacauaucuuucccaaccagauuauaaaguucuugaggacaggggcacaguuuuugcaccuaauauaauuuaugauaucacaucuauuuugugcucaguagugagucaaagaacuuacagacauauccaacagaaauucaacagaauuuuaaaagauauggugaagagccagagaugauggcacacuccauuaaucccagcacuugugaggcagagggcagagacaggcggaucucuggaggccagccuuauggauggauggauagauagauggauagauagauagauagauagauagauaaagggagaugaaagaugaaaggcaacugcugaagcagagaagcagauguauguaucuauauguauaucuauauaugaugaaacgagagaauuguuuuaaauguuucuguccuagugcaauuuuuuaaagauuaugauuuauuuauauuaauauuaaaaaaggaaaaccucuccagcugguucaacuaugaaaccagugcugaccacagcucaaagggaagaugacuaaugcuacauacauagaaaacacuuucauauaauuugaaaggugauccaauaugcacuaagugcuuagggcacauuagccuuuuaagaaaauguuagaggauguuauauaucuacauuuggaaucacuacaguuccuguggaaguuacucuacccaguugcuuucccaguucuauauuguauaaguaggucucauccaaucccaagcccuuuuuuuguuuguuugguuuuugcuuuuuguuuuucgagacaggguuucucuguguagcccuggcuguccuggaacucacucuguagaccaggcuggccuugaacucagaaaucugccugcuucugccucccaagugcuaggauuaaaggcguaggccaccacuacccggcuacacuuuccuuuuuaaaacaggacucacugaaccuggaguucaucuguucaggaggccagcuggguagccagcaagccccaaggaucacucucucucucccuccacaguguugauuagauaggcacacagugcuaugccaacuuuuuacaugugcacuggagaauucaagcuccaguccucauuguccauguuuggcaagcacuuuaggacugcucugucucccugccuuuccaaaaggguguggguuaaggcuuuaauuguuuccuccuccuccucuuccuuuuuguacuccauauuaacaugaaaaucuauagcauucugccuccucuuuuguuuauggaauacccucuuagguaccuuggucccuaaagcuaguagaauucuaagaucagaucauagaagugggauguguggacuauaauugacgaauugacaguauguaucauuuuaaaaccugauaauaugcuaauaguaucuguaucacaaaagcagucagccagauucagaauaugagaaauuguauuuaaugaguagauucuccaaaacaugaauggcacaguguagaagaaugauuuauagauuaaaaagagccauggcaaucaaaugcagcauguagguuuggcgccuacaguggacagaacaacuauaaaaagacacuugugagauaaugagaacuggguaguuaguguacaucuguagucccaguauucaacguagcaagauagagggaucaguuauaccuacuaaccuagacagcauaaugagacacugccucaaaaacaaaugagagucacaguaauugagggaauuugaaauacauggcuuuaaaaaacauuaaagaaauucuaauuuucuuagaucuacuuaagauauuguuguuaugagaagcccucagguaaagauaaccuguuggaguauuuacaggugagaugaaauggucuggauuucacacacacacacacacacacacacacacacacauauacacacacauacacacacacauacacacacacacucacacacacauacacacacacacacacacacacacacacacaggaaagaaaaaaagaaaagcuuggaaaacaguacuguugcuaaaaaguaugugaagagccacuuacuauuuucacagcuuuuauucuauaaagaaaaacauuugaaagguugaguuguguacucaagagucagagacaagaucacagguucaagaccugccuagacaucauaggcccuugucagaaaaaacagugccagggcuuacagcuuuaugguagagaguucgcugcacacucaugggccuuuggcuugacccagggcuuucucccacucccccaagaaauguugguauuuucagagcuggcuuuggagggaguaucuucuguucuagaggcaguccugggauucccuggauauggauaagcaccauugauuaccacaguaauuaugucaccuucugagcucccaucucaguguucucuuccauuccucaccaagucuuuccucagugagcccacaugcuuuuccucucauuggcaugcugauggcuucgagguuucauaauuuuuucuuuuuucuugaaaauagguucuuuucuuauucacuauauccuauuaucaccuuuacuaauggagaagcauaaggggaggaggauaguccuggaggucuggaaccuuacaaaagucaugucuuuguuuuaauaauaaggggagugcuauuucagguagccuguaaugaccuaucaggacauuacaauguugcuauuuaaggcauauuacccuauauccuuuuggaucauggaugguuuccauuuugcuccugguaauuaaaacauuucuggacuaccaagaacuuugcacaaauucuaacaagguuccaccuuuaugcccugagucauaauggcuucguuggagaagagcaagcuggcauucaguucucacuacgcuugcucuuuuggccugaugcauuuaugcacaguauacaccugacaaacuuguuaacugagaauaaaucaacuccuaugcacuuuaguuuugggcauuaguuuuugaauagaauguaucucuucacaguauaugaaauuuuuaaauguucacuguuggaauuauaaucacuguuaaauguuaaacaaaauauuguuuuaauuggguuuuauaaguuuuauaaaaucuuauugguuugguuuggauuuuuguuuguuuguuuuuagagacaggauuuuuuucuguguagaucugacugcccuugaagacacuccauagaucaggauggccucaaacucagagacucgccugccucugccucucaagugcuguuauuaaugguguuugccaccaccaccugacuagagcccuuaauuacaaaugaaggcaaaaccacauaacauauaacauaugaaggcacguacaugggacauuuugccuggacaauaauaguucaaugguugguuaguaagaaauauuuucuuaugggggccgggcagacaaaaagaaacaaaaacaaaaaagaaagaaaaaaauauuuuuuuaauucuaagguauaccuuuguccuauuuuaacauuuuuuuuuugcagaacauuuuauuccugcugaucuugagugucuguguauauauguguguguguguguguguguguguguguaugacugaccacacacaagaaccugugaguguaguuaagagacugaacccaggguuuguugccuucuaauuacauggccugccauguucugccacugagaagucuccagccauauauuuaaguuguguuauuguauguacuaaagguuguucugggcaucucuuauagcuucaguucaucucaaauucauuaacauccaacuuccacuacccaagugcauauuuuuucuugaagugggaugagugugugugugugugugugugugugugugugugugugugugcaugugcuuucacaagcaugugaccuugcacaugcgagcaugcuuguguauguggaggccagaaucuuggguaucaccucugcagccacccgugcugccuuugagauagggucucucacugauccuuggugcucacugauuaggauaggcuggccaggcccccuauuugcuagcagguucuuuacucacugagcuauuacuccaauuuuuaagcuccaagucaguagugaaacuuaauucacaagguuucauaaucaagucagaauaaauaaauuaaucucauggacugguaagaugguucaguggauaaagacaccugccaccaaaccugaugacauuacuucagucucagaacccacaugauggaaggagaaaaccuauuccuaaaaaguuauuuauuaucugucuuccaaccagcauaugcacaugaauuagugugagcgcccacuuguauacacacacacacacacacacacacacacacacacacacaccagauauguaauaaaucucaacuguucaaaauuucagauguugaaauuuuuuuuccauagaguaacuggcaagauggaaguuuucaacugugcaguguuuagggcuggagagcuggcucagcaagcuguucuugcagaugaccucaaugcgagugugagucucggcacucgcgucaggcaucucaaaguagccuguaucuccagccucagaggaccgaugacuccuccauucacgugcacagacaguccuacccacuuguaaacacacacaauucaaaguagauuuuuuaaaaugugugguuuuuuaacauuaaaaagcucaaaacuaggggaaaaaagcaauauuaagucauuaaguggcagguauuuggguuucuuuuuugucuuguuuugucuuucauauuuaguuuugucuuuuaguauuuuauuuugugggugugagugugcaccaugaggcacaugcaggggcugaagacaaguuuagggaggugcugcucuuucagcauggagguccuagagacugaacccaggucgcugggcuucgggacaaaugccuuuggccuuugucacuucacugaccccuuaugcucccaauuuuaguccuuuguauuuaaagaucucuuuguagucaggagcuagcugcauuccagcuucuagguuccucaccuaguaaucaguggccgccuucgguuugcuguuuauugcugcauuugauaauccuugguguguuucuagugaccuugagaaguccaugugcaaaagccaauugauaacauuuaucuguuugcuuucauaaucauuucguacauuaaagauuuuagcuaaauggcacuugaguuucuuccaucuuaccaguuagguuugccuucacuuugaugaaaagcucuucauuuugcauauugcuggguaaagaaaaaaagaaaacucuauuaaguauaaacuugugcauacaccuguacuuuuucaccuaaggagugaaccguugucuguacaagaaguuacaacacagauuaaauuuuuaaaaaauguuuguuuguuuguuuauuaugugagugcacugcugcugucuucagacaccccagaagagggcaucagaucccauuacagauggcugugagccaccauguggugcugggaauugaauucagcaccucugcaugagcagucagugcucuuaacugcugagccaucucuccagcccaaacucuuuuuuuccccuaagauuuauuuuauguaugugagcgcucuaucuaucugcaugugcaccugcaugccagaagagaaaccaaauauaauuagaguuuguuuugcuuugagauuauuugcauuuauuaccuuaaacauaaauaaugcuuauuuucauuauugaaaauaaaaauggcuaguuacauccuaagaugcaaacaaaaggcucgugacugauucaccacccaccccuugguuagcagugugaucuauuccacuuacgggacuaagcacagguaggagcuaggauccauguucuucuguauagauaagguuagcucuuuccuuucuugaaaaaaaaaguuuugguauuuuucaccguggauuuuuguuuguuuuuuguuguuguuguuguuuuccugugcuaagauaaacuuuuucuugucuaagaaaaaaucugaggcaucagauaaguagauuggucaaauccaugguaaccauugacaaguagugauugagcccaggguacugugugacuccagugguaguauuuuugucuuacgaaaguugacccugccaaaauguuuauuaaauuuaaauauauaauaauauaacagaugcaugaaagaaauaccccaggacauuauuuugccugacauucagaggaaaacuacaaacagaaggcaauacaauuauuauuuuuguuuuguuuuuuuuuucgagacaggguuucucuauguagcccuggcuguccuggaacucacuuuguagaccaggcuagccucaaacucauaaaucugccugccucugccucccgaguacugggauuaaaggcgugcgccaccacgcccagcuggcuucuuuauuuauuuuucaauuuuucuuuuuugaggcagucuugcugcuguuuagcccaguuggccuugaguguggauccucccuauucaaccuucugauuuccuggguacgaggcauucacccccaccaugccggaaccaaagcagugguucauaaaaucauuuuuucuuugaaguagaaauuaaauuaacaggguugguccugaacuggggaagcuacucagugauagacuauuaacauagcauaugcaaggcccuagggucaacagcuggcacuaucgaccaacuauugcuugcuuaaucgauuauuuuguuaacaaggacauuuucuuugggacuguguuuucauuguuuuuuccuuauguuuuaagacuauauuuauaguuuugauaguguguugcauagugucauguuuguauucuguagacuuuuaucaauagaaauauauuuuagggcuagagagauggcucagcagcuaagagcagugacugcuuuucuggagguccugaguucaaaucccagcaaccacaugguggcucacaaccaucuguaacaagaccugauucccucuucuggugucugaagacagcugcaguguaccuacauauaauaaauaaaauaaaucuuuaaaaaaaaagaaaugcauuuuaaccugccaauaauuuaauaauagaaaaauuaaauguguagaugggauauuaaacugcagugaggaacugaguugucuguauucuuagcuaccaguguugccucuuugguuggugauucuuggaugucauuuaccccuaggcucagugacauuagaccaaggggaaaacagcccuguacaggaaguuacaacacagacuaaacuuuuuuauuuucauaagauuuaauuuauuuuauguaugugugugcaccuauaugccagaagauggcauuagauccuauuacagaugguugugagcuaccaugugguugcugggaauugaacucaggaccuuuggaagagcagcuaguguuuuuguuuguuuguuuguuuguuuguuauuguuguuguuuuuugagacaggguuucucuauauagcccuggcuguccuggaacucacucuguagaccaggcuggccucgaacucagaaaucugccugccucugccuccugaguacugggauuaaaggcguacaccaccaugccuggagauuaaacucuuaagagucaacuuuaagagccaaacaauuuccagaggcauuugguaauaccucauuuaguguuuggacacugcugcuaaaaaugacagauugcccugaaguuagcuagcuagccaucacauccuauuacaucccuccagugagcucccagcuuugggcuccugaagaaguaaccggucugagcagaguggugggaugucaugcucuccugguucuuuguuggcuuguguauuguacucaggauguauaguucauuggauaacaggacugcacacucaugcagggcuggggacgggcggugccuugcauugacucauucccauuucugguaccuguuaggcacucuaguaguagagaguaaaugcaugauucuuugagaguuuggaggccucaaccagaggacucuugccuuuuguucucuacaacaguaugagcccaccaggaaggaaugucuuucaucuuuuaucuuuaaggccuuuggccuuaaaauuuauuaaauauuaaccacuucaacuauuucauagaaaucuguuuucauaguuuuaaauaguauguucuugcuauccuuguuacccggucuucacaaaaguuauucacucaccguuucuguacuuguaugcuacgugagauaaaacuuagaauuuuaagucauuuaaauuaaaaauuguuuuagauaguuaauuuuauguguaugaguguuucgccuacauguauguaugagcacuacaagcauaccuggagccuucagaggucagaaguagcacuggguccccugggacuggaguuacagaugguugugugccaccauauggaugcuggaguugaauucaauucugcaagaauaagugcucuuaaccauugagccaucuucccagcccauuaauuugauauuuuaaacuauuauucagucucucaguagcagauaaaagggguugcugaauaugauaaauagggaagguguaggcacaucuuuuauuggagaaugagaauauacuuagcagacuccagcaauagcaguaacucuaaauuuaaguaaugaacgacucauuaucuucuguaagauguuuacagaauucuauagaacagucauucagaauaugcagauagugcugggucauauugccuaucagaggaaguaagguaagaaauugaaauuuuagaagcuugcaugguagcuuaauagaacaaucuuuuaucugcugaauuucaugauuuaaaaaauugggauuuaugccaggcaguggugguguguuccuuuaaugccagcacuugggaggcagaggcaggcggauuucucaguuugaggccagccuggucuauagagugaguuccaggacagccagggcuacacagagaaacccugucucgaaccccccccccccaaaaaaaaaaucugcuuggcaugguuguauacuccugagaagauagagacaggaugaucagggcuuuaaggacagucuccauuccauaauguauuugaggcugggcugggcuacaugagaccaugugucauuaaauagaaaaaaaaacuucaccaaaaauaguuggcaaaacacuauucuaaaacagcagugaaucaucuuucauacuugugccugacaucccaagugacaccacacucaaugcggggauugaguaguuucucuaccguugguucuaaguagucuggaauagguuuuucuuuccugcaacuguuuuuuaccuacgaaucauugcgcuaggguugggaaaugacucuguguauaagcgugcuugcucccaaucccagaauugggagauggcagggcucacuggccaaucugcuuuuucagauucagugaacuucaaguuccgugaaagaccuugacuccagagaauaaggcagaaagacauaaaagagaacacuugauuuuauuuucuaacuuacacauacacauaugaacauaccccaccacacacacacacacacacacacacacaagaucucuguucuaacauguaacauagguuucuuuauaagauauguuaaaauuugggaguuuuauacuuuauaaauucuucaguucagauauuuuaaauaaaugauagagggaggaacuugugagggcccaugcguagcugaggaguuauugguagcuaacacugcuggagaagugggucaggagucauuuuucuucaguggcguaaccacugguagguagucugugccccgacucaauaacccauaccaugcucaugcaagcaacaccaauuaacuugaguaggucacuuaaaaacuacauaaaccuagaaggaguacuuauuggaaagaaagaauucaguggaagugaggagcaaaagaggguaaggaaggaauauuaucaaaauauguucuauacauuuauaaaagugucuguguaaaugaaaguguaauuuuuaauuuauuugagugcuggcuaauaguucccaugauuuaguaaagauaucugcuuaaagccagaugugguugugcaggcccuuaaucucagcaccagggaggcaggaacagacagaucuuugugagucuaggccagccuggauuuuauagugagcuccagauuggcugggacuaacaguaagacucuguuucaaaaaacagaaucagaaagccuaccauaacuauugugaagauaauccuauguuggaccugcuuccgguauuugcuacugccuuuccuauuuguuaaaaugccauuggaaggaaagugaauacuguagcuggauagccacccauugggcuugauuugaagguuccaccuccaguauuuauuuagcucuuaacagcagagaaaguacuuugaaugcugucuaaaaucugcaggaauuuaggagagguucaugugauuugaaucuguuucaaggccagaauucauugcuccucacugaggauucccagugagcacaauacuuucauaaagcuuuaucuugugugguguguggucauauguguauaaguuaaugagagaauucugggaacagguagguguaugcagaugaagacugcacagugugggcucaugauaucuagucuguuguaucuguguucugaucuuaaaauguuuuuauuuuuacuguguauguauugcuauuuuaccuguauguaugccugugugccauguauguaucugaugcccagggaggucagaagaaagcaguggauucccuuggaugggaauuauaggugguuguuagagggguuuuuuguuggugguggugguguuaggagucaaaaaugcagguccucuagaaggccagcugagccaucucuccugccucuguguccaguuuauaaaaauaauaugccugcaucuuugaucaaauuuaauuuuauauguuauuuucaaaaaggguucuauuucaauuuaaauauacuacaaaauguguaacauuaaauuaaaauuguuucaagaugggcaugguuccucuuauuucuguacuaagggggcugaggcaggaggaucauaauauccagaccagguuaggcuacuauuaagacccagucucaaaaaacaaaaaugaaaacugaaccuuucagcaaucaaaucauaugccucuaggcugguugugguggcgcacaccuuuaaucccagcacuugggaggcagaggcaagaggaucucugugaguuugaggccagccuggucuagaguaaguucagagcagucagagcuacauagugggacccugucucaaacaaacaaacaaacaaagaucauauggcucuaggauauucauauauaauuuaacugucaguuucugaaagccaagauaaaaauacauaugauuugaccaaaauuugaguauuuuuugccauuggagagaauaauuagaaauucuuacaauuugauaauuuuugugaaaauaauuuucuacugacuuguucuuguuccagucuuuucacuauguuuaacucaucuuuauuuuuauuuuuuuuaaauaaacugcuugaaucagacaaaacacugguuaucaugaauuguaaguucagccuaaaaauacauaauugcaugggguggagcaguaaguuauaauuuuaaaauaauuacuguaacuagucuucuuuugaaggaugacucuucugacaauuuaaagauaguuacaaauaaacauuuuacugaaacuauuagcaaagaaaguuuugucuauuuugguccuaauguaaacaacacuguagaagggagacauuaaaaauguuccuuugcauaaaggucccuggccuggccuuaguaucuuauuaauuuuaaaugccacacauuuuuaaaacgugacaguguaaauauuucacaccugcacaucaacucucaacauccagggcucuaaacugaagcacaagcaaagcauuuauggagcucuagaaccugugugugaaaaggagcgugcgugaccccacagugacucugccgaguccucuuccauuguauguccuuagguuucauuaggaaaauggucaaauggacagacaacuugaaggacguccacagugagcacauaauuuuuauuccauaggugacuauaccuuucugcuucacuaaucuauuuuuaaagcauuuuaaaguuauaggaaucaaaugcuucacccccaguaacacugauauguguuucauuuguguugucuauaaugcauaaucucuaauuuuaaucauaaugguguuaaauuuacccgauuauuccucuucauuguugaguaacggucugcugucuaaaucuacugaaguguuuauccuauugauuuauagauauugggcuguuuacuauuugggccauugugaagaaagcugcuauaugcaugcuuuuuuuuuguuuuuuguuuguuuguuucuuguuuuuuuuuuguuuuguuuuuuuguuuuuuugguuuuuuuuuuuguuuuuuguuuuuuuuuuuugguaacuacaucuuuuaguucucuugguuaaaaaugccaagaggguuugcugggucacaugguaaaaguauauuuuagauuuauaaaaagcuagaacuuucgcccaagggaaaguccuugaugaccccugacggggaguauguuuucaaaugcuucuuagccuuuuguuuauuguccuuugucagcuguuuguuuuaaucauaagucuugucuuuuuauuccugaguuuaagaaaucuuuguguaguuuauauccaagguucugcauuucaagguaaauugagauaccaguucacuuucccacaaacuugaauguguauuauuauuuaaagcuuagaauuuguucaaggcuuuuucuucugaaguaaacuucuuauacagugaaaugcaaagggacauuccaaguaaauugacugaaauugacaaaugcauacacuuucuagcaagaucucuagugucauguuuucaggaaguuuugcuguguuggagcccagcuaaucuccacuccaccuucucagaggcaaccauuguacuaauuagaaaggccguuagcacgaauauaacaacaguagguuauauucuaacauuuucacgcccauguguuguguacuuugauccuguucuccucauugccuccuuuccuuccccucacugguacccugacuuuucaucagucgcucccucuaaagucuaaacuccacguacaagcuacaguacaguauaguaguugucauucugagcacagccuauuugcuuaacgugaugauuucagguuguacuuuuuuuuuaaaaaaaaaaaaaaaacaaacccauguuuucuuuauccauuuaucuguuuuaacaacaccuagacagauuucaucuggcuuuccaugccauagacuguuuuaaacguuaaagcacugcaaacacauucauguuguguuuaucugguggucauuuuuaacaucucgaaugguaaauacacuuuggcucuauaguuuuuuucuuacgaaugaauauguaugguauuuccacuuuagagacgucaggaauauaagcauuuuguggagcacaguuugauuguuaggagagaaugcucgagagugaaguuguugauugcuagggcaaguccagacucuucuauaguuauccaccuuaacagccgcagccacaguguuugaggguccuuucuuucauucuacuuuguugccacauuuggucuuuuuaauuuuagcugucucagugggacuguguuaguauauuauugugacagugcauuguguuuucuguguaugaugucucaccuuuauguaauuauuuucuguccacaucauucauaucuuaauguuacuucaccuucaguguucuauggccugcacaucuaucuacaguuaauccccagagagaauuguaaaauugcugaccgcugugguacaaaacacugagcugguaaauaaauuacuccugucauagaguuuauuaacagggcuuugucacacuccuucuuguucaguuugauggacuuuagagaagaggagagugagaugauaacauuuagauuuagucuuuuuuuuuuuuuuuuuuuugcuuuguuuuuuguuuuugcaucagaucucauuacagaugguugugagccaccaugugguugcugagaauugaacucaggaagagcagccagugcucuuaaccacugagccaucucuccagucccaugaagggacuuuuaaaagucuuaagauccaaacccuauugcuaaagcaguuaaauagaaauaucugagauagacccaaagcaucaauauuuuaaaagcuccccaggugaaugaaugacugcaaaccaugacuaucaggaacauaugaaguagaaguuaaguacuugugaacuuucuuuuaaauuuagugagucuuuguugccuaccaaaaggcuuuagguauuuuaaaguuugccuuaccauucaccgugacuuuagucaucuuuuguaucuaaauguuugugcagugaguuaaugagacugauguagaguuucuagugcaaugcagagcacagcguaggacugacuacuguagagguggugugcuuugaaugaaugaugaucgcauucauucucuagucagcacauuuuacugagucuugucuggcagaagacauuucuaaugacaaagucuugcuaugguaccaacauggaaaguaacauaaagcuugauuuacucucccugcccguuuaaucagcugagcacuugauaaagcuauucaauguuauuguggaguaaaguauguuacuauguuaugggacuacaggcaccuuaaggauaccuuuuucuuuaaaacaguuauguugaagcuuccuuuacauaccaauuuaaaacuuuaaauacaguuuucucuuuuaaacuugugcuuuugauaaaauuaguucucuucuugaauguccuugcaagcaucugggcauccaaaacuggguuguuuauaaaauaugaugugucauuaaauauuggcuaaguagauguuucaccugaaggaggagagaagccuuucacugacucuugcaagguuuucccauaugcuuugaacuuaagcaacaauggaaaccguccuuuuguuuucugaguugacauagugccagucuucauuaaagaggguaguuugugaaauaaaguguucccugaucuuucucgugugaaguaaaaggacagaugaugaguaagguugagaugauggaacccagagaaguggcaauaaauuaaaggaaacaagugggagacacaggguggacagcucuugaugagcucacgggcuuuagcuuucugccgccuggagaaacugcccagacaguuggaguucuacagguuaauaacaauaagcugggguggagugcuuaagccuuuuaagagaaugauaaacagggcggaaggcgugucuucaagcgucccacucccuuggggcuauggucacgugggcucaguacuucccgauucccagccacugucucccuaggcugugcucugaguguggagggagagaggcagggacgcacgggaaggaaauuuaaacgcugaaagcaagggucugucuguaagaacaaugccgcacuucacugugaccaagguagaagacccagaggagggggcagcuggcccccucucuccugagcccagcucagcagaaguaaaagcccggauucaggauccccaagaaccagguaaguccugcgcuuguagcgucgggggacccacagacuaguuuuugugaaggaagcgguaacuuggccaucagucuucaaacuguugcuuacagaugcugauggagaaaaggcguguuuuucaguuguuucacuccccguauaucugauaacgugccuuuuuuuuuuuuuuuuuccacgaagcgguuuguuuuuuccucuacaaagaguuuucuguguccauuaccaacaggugaaauugaaucgguagcaauguaugaaaggaguuuucaagcacaaagaaagacaguaaaagucauuuaugcagauuuuagaauucaguuuucgcucagauggcuuaaauucuaucuagaaaaagcuucgaaccaaacagauauuggccuuuuaaucuuagcuguuuauauaauauauccaaagggagcaugguucaguaguuuuguucuguggacuuuuuacuugugaaccugcgguuauucagaacccugccucaauuuacccgguacacaguaaaucaguaacaaauguucuaauaacuuaaaaaguacauugguugggcauuguggugaucagcauagcaucggguuuaauaaaaguauuuaaugaaugugcucaucucuuuguggccucugaauguugacaguuagacuuuccuggggaauugugguuugggauuuuuaaacaugcaauuaaaguauuaauacugugguauuaaguauaguuacacuuugacucuaauuuuuuuaaauuuguaaaucguuagcaacaucuguaugugggaaaaguuaagggaaaugcacaauuccucuguagcucuuucuugugacaggcagcugugguuagcaaccuugaacuugagauggagagaaguguuggaauaggagacguuccauuuauucacccucauucuuggagugagagacuuugucaggagacaguaaagaagguagauuaaaauguaaaacauguaaauguuuugcccacuauguaauuuuugcuuugcugaauagcagcgaacugugaguuagucuaugcucucuuacuugaaccugcuuuucuauggcuuuagguagaagagccagcagagucagucuuaggccuggguguaugugaaguuacccuuucucauuugcugaugguuucaauuccuuuuguguuuaggcugucuugaauaaugucacaaaauguaaauaauauaucucaucucucauuuuuuuuuugugcuguuuuccucugccuuuaauuacuucaucuuuaccagucucauuguuuugagaaauuugguuuuuuuaguaagagggguuagagaagaguaauaaaauuauucagucuauuaacagccaccuagaaagccauaaaaguuuugauggaacccagcuuuauuaauaacacaacauuauuaggcuuaaaauauuuucuuccauaaaacugcuuugaaaaaggaagaagcaacagauauaagcuaacucugggcuggagagauggcucagcaguuaagagcagugacugcuuuucuggagguccugaguucaaaucccagcaaccgcaugguggcucacaaccaucuauaacaagaccugauucccucuuuuggugucugaagacagcuacaguguaccuauauauaauaaauaaaauaaaucuuaaaaaagaagaaagaaagaagcuaacucgaauuuaauaagggucuuuuauuugguguuuuccauaacauuucagagagugugcaguugaauauacuaauauuugacaagugaacaacuacugggaauguauuaucucaguugucuuuaccauaaaguuaaguaagaagaaaagagauuuuuuuucuuguuauugaagguuuauuucucuccuuccuggacacauuugcuagaaauguagugaauuuuagccacuugcucuucuaaguuaaaagaacaaaagaaagcaaggaaggaaaggaaggaagaaacucggugaaaccuacuguuuuguacaauggauauguacuuguaaagauacuaccuaguuuguuauuuuguuuuauuacuucaaacccugaccacuuguguaacaccccauccuuccuuuuuccuuugcaucaguguaacaagaaaaauauauaguacaaauauauauacuuaauauacuuauuugaacuaaaaaauaacuuucgauaaguagaaauaugaaaauaggacuaauccaaacucacuuuuacauaaaauaauuuuaaauguauuaucauuagugugaauauauuguacaugcuauuagguuacauaaggacauuuucauaaguuguacguaaguaaaauaaguauagugguuauugccgcauaagguacuacaaagucugcaauagacccugcuggagucucagaaggaaagcagaaccucagcguucugaaacaugucccuuuuuccccugcacuguuuucuuggcagcaagccuguagaaguagcaaugccacaccugugucacccuuuguccccucaccagacugagaguaagcagccugagccagagacuuugucagaucguuuguaucucaggcuccuaagcugcuuagcaaauaguucagugacuaggcaugcucucagccuuucaauucaccagacuuuaggccaacugugggacuucuccuaauguuccaaagguguaaacuuuaccaaaggcagcaaaauggcuuuagagucagggaucuggcuaugaaucccagaccuacuaauuacaccuaauugguaauagugacaauuuguaauaauuaguacuugggugacuuucugcaaguuguuuagcuucucucuucauuaauaaagccaaugccuacuuuacagggugacuacaaggacuguauggaauagauaauucauagauacauguaugacaucacacuuacaaauaugaauaccuauuucuuacauuaugauuagugguucauugaaaaaaaggaaaagguuuggauaacugauguuggaagaauacugaaaugccuggaggacauuguagguaucugaguaggggauccaaauaauuuuuaaggggggacacagagaaaaaucaccaagaauggaaauaguuugaaaauaucaggaaagaguccagcucuuaugagacacaaaaguugggacaaucccaggugugugguaaagaagaggugagggaggagagguggagucuggucagcgaagcucauccauuucaucuccuccuccuguguguggguuugcuaccccuuccaggccaguacuugccacgggccacccaccuaaccugcccuggaggcggugccuaguuaccagugcuccccauugcaucauuuugcuaaguccuugugugcuuggcccacugaguuugauaggauuauuaaacauauauauacacacauacauacauacauauauauauacauauauauauauauauguauauauauauauauauauauauauuuuuuuuagguauagugguagaagccuguaaucccaggcucagguggggggauaaugaguuugaagccagacugggcuauacagugaggcucuuucucaaagaaaaauguaaauuauuuuauaggacuguuacagaccuuaucucuuuauugcacuuucuuaaucagauauauauacuacagucauuucuugauuuaaauauaauucauaaaaauauuuuaauuaaauaacugcucuaaaucuccuugcucuucaaaucagcuuauggauuagguaacuauggacugccaugugugccucacuagacacagauagcagaucuguuguuagcaaacagccgcuccaugggaaccugguagaagagcauacugugagaguucuaugaauuaaagauuagaucuuaguaacucauaagauguaacuauuagcuaccuauuaguuguacuuguuacccgugaaauauucuuuaaaugguggcuuugacaguguugucucauugacuaaaacuaaaauagguugaacuagacaauuacaaauucucuauauagauuauuuuuuggagugaagauuuccagugagaugugcuggcauacacuuguauccccagccuguguaacagccagaccucugucuccgcacauuccuuuaauccagcacuuaggaacagagacagagcagagggaucucugaguucaaggcuagcuugacuuagguagcaaauucgagaccagccuagagaccccaucucaaaagaaauuuuuuuaaaacuuuuucuucuuuuauguaucuguuuacaugggauuuuuacggacugugaaaacagaaacagaucugcaucuuauaaaaucugaguuaaaaguuuuggaacuggcaggugagcuguguuuuucugccuccuacacugcacuccaguauuccagaauuguaagaaggcuucacaugucccgcaaguaucuucucaauaauuuugucaugauuuuuauuguaccuaaaaauaagaauacagauuuuggaguuagggagguagcucagugguuggaaugcuuacucugaaaguaugaggacuggaguucacaugccugcugggcaugucagccugccugccuuuccagccuuggaaagaaaagagcuccagaguaugcuggcuagcaagccuaaccgccuuggugaguucuggguuuugccuaagcaaccuugguaucuuagaacuuaacaugcauguccacacacaugcaaagcacaaacaugcauauauaccacacauacguagaacaggaaaaagaacaaggacuauaaaucugaauguguuugccuacagucuuugcaucuuaaaacacuguggacuugacaugugacacucccggacuuaaacauuugccgguucuauuucuacacugcuuaaccacugauuuguuaggauagcucacucccaggauuucuugcuugguaucccaacccuuauguacugucugcuacuuuggccccacaagagacauaccagauugaagauugaaugcuauaaagauaaaagcucuauaaaaauacacuuguaaguaggugugguagcgcaugccugcagucugaguacuuggaaggcugagguaaaagcauauagugagacccugucucaaaaauuaaaagcccccaauguccucauuugauuuuaaauauugcuuauuacuuuuauauucuauacucaauauuuaguugguaguaaggaauauauuauguauaauuuagcauaugauacuuuuuuuuaaaaagauuuauuuauuuuuauacaaguauacuguagcugucugucuucagacacauuagaagagaguaucagaugguugagagccaccaugugguugcugagaauugaacucauggccucuggaaccgcugagccaccucucuaucaccaugauacaacuuucuaaaacuuaugcaguauauccaaguucaccaugaaauugaagauuugaaagaguuucagauuucaguccaaauuuggacaugcagagaaagguuaucaggugguaaccucuaaagaaacuaguaucuuuugguuuuggcauauugaaagaggaagauauuuuacauacaaaauguuaucagcauuauaguaauaauagcaguugccauugcuaggcagugcuaggugaguagcugaggcaggguuaacccaggcaucuaacaguguugacuucuugcccacagcaaccacuggaccaugguggaucagaaaagugaggugccaggaaaucuggguuacaucaguguacagacucagguggagaaucugugcauagcacagccuuuccuccccggcacugcaguccuguacuuuuuaaacaugcuuuaaaauuuuuauuuaauauaaauuaaaauagaauuacaucauuuccccuuucccuuuucuccaaaccuuuccgugucccuuuucuccauucuuacauauguguguguguuuuauauauagauauacauacacuuguaaugauaauaaacacuuuaaaaaacucuuauacuacuaggcaucuguauucucuuaauuacuaauccugaggcuuucuuucuuuuguaaauaugaauuccucagaauuugaugaaaauuuauuccuugucaaacuuugugugugcuguauugcucuuuuauuugguauggacuauuuccaaguauacuguauuuuucuaaagugugccaaaaauugagacagcugaagaagcaggaagcuuggcuuaaucagacugucccagaguaucucucuaccugucauauauauaggaaggcgcauccuuaccugugagauggauacuucaagacuaaggguuagugcuaggauguagacaauguaaaauaauuaacuuuuagaauuacuuuaaaauguuagaagcuggguauguuggcuggugcugcaauaucuagcagggggaucauuagaacaaguucagggccagccugagcuacagagugacaccuguuuaaaaaaagaaaaaaaaaaaaagcaagagaaaccuacauguagugccgaaauuauacuagguguuuuuuacuuaaguaaaauaacaauaaaaaaaucccauuuaaaggaaaauuuucauauagguguaacauauacaugguagaaauugcauauggcacauaaacacauagauaaaauuauuuuaauccaguaagcccuguauauaagguggguuggguucccuuauuuacuuccuguguucuucuuacugcagcggaacaucuuguggaaaaagauccuaauauuaguguuagaaaugucagcucuggagcaagagccuaagaagccaucauugucuuucucccaacuccuugcuuauacuccggauagcuuuuuaucugaacuucuguuuucauuuucugcauaccauaaaaaauuacacacaaccacauugaacuccuccauuuacuccaggucugguccgucuccauuuccugugggcuggcaugacugauugucccuggcuuugauuacuccguuuaucaauaucugucaguacucagacauaccaacucuaugucucaacuugcaguugcuugugguuuaaccuaugcacuucauuugauugauugacaugcagaggacuaguuucaaacuugugguccuucugcuuaggccuccagguacugggacuauaggaacgcaccacuguauuugaccuuauuucuucaguuauauuaugaauugcagaaagaugagugauagucuuaauauuuuuagaaaaguaguuucuauugcaggaaauuucaaacugcaaaaacagugacuuuccugccaguaucucuucucucuugcuguuuuuguuuuguuuuguuuuguuuuagaucuuuguauuuagaaauaucaaccuuuuaaaacaaaauguuggaacuauuuuccucaaucauuauuuuuuuuaauguuucauugagguauagguaacauaaaauucacuacauaaauguaccauuuaaugaguuugcacacaugcauauacuuguaaaacaguuaccauaaucaagauaaugaacauuuucaguucccacaaaaauuuccugugcucuuuauaauguacuuuagcuaauucccagguuugcaaacaacagcuagguuuuuucugucacuauucucuuauuugcauuuaugagaguuuuaugugaauagaaugauagaguauuauugucuucuuuuauacagcauaauuauauugauauuuauccauucuauuuuuauuuuauuuuauuguuugguuuuucgagacaggguuucucuguauagcccugacuguccuggaacucacuuuguagaccagacuggccucugucucccaagugcugguauuaaaggcaugugccaccacgcccggcauauuuauccauucuugucaguauccuuugcuucuaauucuccuuaacauaucuuuauuucuugaaauuuuuuuugaacuuagcauucaagggaguaguugaaaacaagacaguuuauaaauauguagacuucacagagacauuuauguguacuuuagaaggauauauugguaccagucaguagacccaauaacuuaaaaggcugaggcagaaggaucauugaacccaggaguuagaagccaacuugggcaacauaaucaaaacaaagaaacaaacaaacauacauacauacauacuacacuguuuugugauuacugucccuauccuguuauuccucucccaucucugacacccuuucucaucuaucccagucccuuucccagguccuugaauuuugauuugauuuugugucucacuaaauuuagcaagagccaucugugcgagcauuaccuuggaacuauuccuuagagccugguggaaucaccaauggauacacaacugaaggcaaugacuccccuuuucccugugucuaucauuaacaaauaguuuaucaguggggggugugguccccuaagcccuuccuccauccauaccuguuaacagacccauccuuuugcagacacgguguaggcauccauagcuauuuugagguugugguaucuaucuguuucccagaagauggcauguuguagucccuuuucucugucuuccagcucuuaaauucuacuccuacuucugugaagcucucagagccucgcagggaaugguauaaaagucuugguuagugcugaacagucauccacuacuuauucucagggacuuugaugcuuugucagucuaacucguaaacaauuugcaguuccucucucgggcucacgaucucuacucuuugggguucuugacaggcuguauaauaccagacagaauucccuccugugucacaggccaccauaucagucagagagcacuugguuaaccccucacaguaaugucacucuuguacaagugagcauaucuugcuuuacagguuggccuuguaguucacaguuuacagguggugagacugccuuaggguuuccacugcugugaagggacaccaugaccaaggcaacucuuauaaagaacggcguuuaauugggguuggcuaacagguucugagguucaguucaaugaucaucagacagaagaagcauggcaagaggagcugagaguucuacaucuuguuccaaaggcaaacagaagacuagcuuccaggcagccaggagaagggucucaaagcccaccccaaagugacacacuuccuccaacaaggucacagcuccuaacacugccacugucugggccaagcauauuaaaaucacugcagagacuguugguguucuuucucugaauggccugcauagugccuucugggauuauggaagcuagccagcagagagaaaggucccaggucaguuccaccuggauuucuccauucaugcaaccaagguguauuaucuucagcaauagugucuuuuuguauaguucugcugggcagccaaaaggaauggcaggagcugaucuuguuugggaguacucuuggggcuccuauaauugacaacucaguagggacacuaggguuuuuauuugaucauuuacaguuccuaggaaaaauauguucuaaaaucugguuaaaagauaaguuucuuaaauauauuuguccaaauuuuaguguguguaggauuagucuauaaacugaaccacuuuuacugaauguuauauuucugagcauguucuagaaagaugacaguuuucuagguuuuaaaaguuguuggaggguuggagagauggcucagcaguuacgagcacugacugucuuccagagauccugaguuuaauucccagcaacgacaugguggcuuaaaaccaucuguaaugggaauccgaugccaucuucugaugugucugaagacagcgacaguguauacacauaaaugaaauaaauaaaucuuccuuuuuuaaaguuguugguuuuguagcccaagcuggccuugaacuugagaucauucuaccccagccuacugaguauggauauuauagcuauaugccaucccaccucaaagguggguauuugcauauuccacugucuguccaauccuaauuccagcuuguuccucuuucucuuuagcagaaguacccuggaucuagugaacuguugggaaugagcaagacaauggacucucaaggcucuuucaggaaaacauggcuuaggauugauuuguuccucaaaugcugcaugagagccuuuagugccgcaagauaauauugagaauggaagaucuaaaaagaacaugacuuguagagaucccugagaucuuuguaggggauaggaagagcuagggcccugagaucuuccuaucucuaagcagagaagagaggcuucuucccggccccaacagaggccugugagacagaagcagacacugaguucucuccguuccuccuccuccuuccucccucccacacccauuaaaauuuaagucucuguaaaagaaaugaguugguucgugguucuggaagcuggaaaguccaagauaaaaguaucaguuuaaagggagggcaauagaagaaacaaguggaccaaacaccuugugauaacaagccugcucucacauuaauaccaauccauccaggcaggcagugcccucauagcuuaacaccugggcugaggcccauccucccagucaugguggacccaggguuaaguuucucucacuugccuuucuuccaaucucauugaaaccauaaauguuugaauugcaucuuauuuuguaguaaagaagcuaauaauguucauaauguacaaaaaauggaauaaaucucuaaggcauuaugccagaugaaacaugagggcagccucaaaagucaugcauaaugagauuacaauuccauucacuuauucagugugugcgugugugauguauauaguaugcacucaugaguaugugaauguugcaauguacaugcacauggaggccaguggauaucagguguccaucucuacuuucuucuauuaagagaaggucucuuaggugggcgugguggcgcacgccuuuaaucccagcacucgggaggcagaggcaagcacguuucugaguuugaggccagccuggucuacaaagugaguuucaggacagccagggcuacacagagaaacccugucuugaaaaaccaaaaaaaaaaaaaaaaaaaaggccucuuacugaacauagaacuaugguuggagccagcaaucuuuagcaacccucccagucuuuguuuucuauagcacauggguuaguuacaggacuacauggccaccaugaucuuuuuacaugaguguuggggauuugaagucacauccucauaauugagcagcaaucacucuuacccccacuaagucaucucucuagccuccauuuccacuuuuuaaacauggaaauucaaaguauguuuacuaagcaaacuguguugauacauacauaguaaaaaauuuuaacuuuacauauguaauuguuucugguuuaaucucuguauuugaaacuuuagaaacguauuaagcaauuaagcuauauuagauuuauauuuguguguggguaguacagaguaaaacuugugggaguaugugcagguauguauugaggucagaguacaacuugcaaacauaaucuuuuacccuaugggucccuggaaugaagcucaggccguuaggcuugaugacagcacuuuacccacuaagcgaucucacugucccagcaauuaugguaugaacaaaggcaugcaccacucugcuuuuaugauuauuuuuagagacugcugcagcaucuuuauuuagcugguccaaucagcuguuaauucuaaauggguuuuuucucgcuggcugccugguuucccuagauaguuugcuuuuucucucuuucacuucauaagagcuuauuaaauucauuuucuggaggaugacaagugcuggcaaucucaagaaaacaaggguggguacagggauuuuugucuuaauugucugucuguggcauggaaucaauaaagacuuaaaauaucaagaauguucucaguauugucuguaaugccugugacucccguuagaguuuaaauguuaaguauuccccacaggaucugguugcugauuucuagucuguggcauuguuuuaggagguuauggagccuguggauagaaauuaugguugauagaguugggucacugggaaugagccucugaagguuauagaccgggccuacuucuagcuugagcucugcuuccuaguccaccaugauguaaggugucccagcugcucauggccaccaccgugaacugaccaugccuucucugccaugaugaacugaaaauguaagacaaaaauuaaccuuuguuuucaguauuuggucacagugaugcaaaggucaccacugcagaaaauuggugcuagacagugcgguugucacuuuaauaaaccuguucacuaguuuauagguuuuugaacugguaggcaggaagaauauggaaaaauauggagcugugggcuagagaaaccuuugaaugcuguaagaguuuaauggggcgauugugauugggaggcgaggaacaaaauggggagagaaauguagccaauaaaaaugauauucaugaggucucagacgggaacaaggacucugggaaagagggguagaggccauugauguauucuagcaaagaaucaggcuaugucuugucauguauguucugaagauuuaagugaggcugaauuuaaaagucauguacuaacugacacugagucuggggcauggugguuacuggcugcuuguaguaaaauuacaaagggaauuaaaaauaaaaaguagagcaagaagaugugaaaagcuauacuuugggaaggaaggaagugaacacauuuacagucaugaagggauaggugcagacaagcuauauguucaagauauuaguauaguuauaggaaagggaccaaugggggcaagacccuauccaucagaggcuucaaggugucagaaugcagacauauuugaaagacguggggaaagugucugaacagaccacauuacaacagagguucccuuuuuaccaggaccaccuaaggacauguuuuugcagguuuagcugugcagguucucccaggcaacuguagcugugcugaaggggacuaacuguaacgcaauaggcagccaaaccuugugucauccauuuguucggguuuuguaggcaugggcuuguagaugcaaaguccuuagaggacugcaguauuauggggacuuuguaacuagaacuaaauguauuuuguuuuauagagucccuacaggaaggcccugaauggugaacaaaugaaguaaguugccguagaaacuauaggauguuggauaugccagggucuuggaacauaugccaagaaaaacugcguguauagaguggaacuagcacaagaaaacccauggguggccagugagggcuaaagaggcagugccacccaaaugauguuaccaugugauaugaaugcuggacauggaguuacaaguuguuugccugcugaauuuuuauuugaucuaaucuuugucaguuuccuguuucuucccuuuguaauggaaauguuugaagucauugguuggaaucauguuacuuucuauuuuauuuuuauagcagaucauagcuccaaguugucuugaaucucagacaagaccauaguuuuguguguuuauuuuaugauauuagaaauugaaccuagucuuguguacaaggcucacacucuaccaagcgauccuuguccucagacucucacgagagacucuggacuuuugaacgguuuugggacuguuaguauuauggggacuuuggaacuagaacuaaauguauuuuauuuuuaugagauggccguaagacacauuaugauuugaaugugagaugagacacacaggccaguauguuaauacuuggucccaagcuggugcugcuguuuuggaagacuguggaaccuugguuugggaugcagugauaguacagguggauaguacaguggaaggcaagccuuuaaggacucuauauagcccagcuccacuucuggcauaaggucucuguuuucuggucccaagaguuguaaggugcccuagccacuuccucaaugaucaccauaccuuuccuaccaggaugagcuaaagcugaaacuguaccaaagcaaaccuucacauugcuugucagguauuuggucacacaaguucaaaaguagcuaauauaaugccccacuucauccccuccccccaucuuuuuguuguugaguuuuguuuuguuuuguuuuuguuuuuuggaggcaggguuucuccguguaacccaacuguccuaaaaaucacuauguagaaggcugaacucagccuucugagugcuggggcuaaaggcaugcacuaccacaccuggcugccucuucuacccguuuuaaaacauauuugacuuuuauuuuauguguauugguguuuugccugcuuguaugccuuugugaaugcguuggauccuggaguuacagagaguugugagcugccauguggguacuaggaauuggaccccgguucucuggaagagagagcagucuuaaacccugggccaccucuccagcucccuuuuccccuucuuaguaaccauguaguuacuaagugcaugcuuauucuucuaaagccaccaccuuuaaaaaauaaaauaaaaagguaagaccaaaaaaguuucacuguguagcccauacuguccucaaauuuguaauccgcuaaccucaucuucucaaguaacuaagauuucagacaugccacuuguccugguugguucugucaacuugacacaaaccuaaacauaucuguggcagguguggaggacucuuaauugagaaaaggccucuuuaagauugaccacuaggcaaaccugaagggaauuuucuuagugauugauguuugagggcccagcccuuuguugguagugccaccccuggacaguugguccugguguguuuaagaaagcaaauggaacaagcuaugaagagcaagccaguaugcagugccccuccauggccucugcaucaguucugacuuccagguccugacuuucuaggaugauggucuauaaacugugcaaugaaauaaacccuuuccucccuaugugacuuuugguugugguguucugucacagcaacagaaagccuaagacaccuccauucccagcugcauguugaguuaguaguaacugugugccagguaucuaugccauuaggcaaacugaggugggacuaucaauuguguccaaaaauucaauaccagcuugggcaacacaguagacccuaauaucagaauaauaacuccuaauguuguccuggagaauuccuuagagaugcuggguuuguuauuguuuguuguuguuguuguuguaugcuugguuuuggcagguaccaccaccuccuuguaaagaugcuauuguuagcguggaugaguuacauuggcccagacuggaugugaugaaccugccuuauuagucuaauaaaucuaauguucaccuaauuuucauauuggcugcuaaaauucugcuuucauuuuugaguuucacauagaauuuuucaguuguuuuccuaucccuuuuuguuucuaagguuuucauaauaugaucuaaaccccucaaacugcccagacauguguccugcuuguuuuuucucugguuuugggacccuuauuguuuuuaaggguuuaaaaaauccuaucuacagcugacacugugcagguuucauaugaugguaguaagaaaauuccccucgaaucaaucauuuagggacucuauuuguagucauuucagcuuuaugaaucauccucacuuuuuauuuauuguuuuuucuuagguugagccacagcuuucaugacuacuuuuaacaaaagauuugucacaaagugaaauaucagcuugugugcugugaauacuguauaaauuaaaaauagauacaguacaagucauaaucuugcuaaauacuguugccaguuguaggcucuaagaaaagauuaguaaguucuaaagagauauuuaaagauauucuaacacauugaaauuauauuugauaaagcaacucuuaguuuauugaucgaguaaugucaggauggcagugagaagguggaggagucacauccuaaagccuaaaaccacagguagagaugaucugaauagccaauaauaacuuaauaaacacuuuaaauguuucuuuguacuuaaauuaauaaauauuuaugaaucuuccuuauagaagcaauaggaaguauuaacacagguacacuagcuuaauggcuacacagaagcauuuucuucugugcaguuguucuuggcauuuuccuaacuucucucuuccuuuaucuuuaucuggcuuugaauuggauuccaugaccuugugagcugccucuucgucccauguucugccaugcucucuggauaggggaugaaguccucuucucugaguacacagugugucugaagugcuaacaguaggcaucacauggucaucuguggguaucauccaguucuuccugcauauuagguagcuucuuauaugaucuguaauauuacuucaucaaagcuuuacaugauaacauuugcccuugguuauuucaucucuaaauaauaauuauuauauauucauucuaacauauuaaucauauauaaauaauauauugaugauaauucauucuuauaccuacacuuuauaguaauuauuauuauuuuauaaucuggcuguuuuaagauauuuuucuuaguuauuugagaauuucauacauauucacccaccguccuccagcuauucacagauccaccuccucuucccuuucuuguaucauuuuucuuccucaucaaagccaauuugugcugccccaauauucuuggauguguguccuucaacuagaauauggucaaccaaucaagggcuacacuauuagagaaacugacuaucucucaacagcuaaugauuuccaguuuccacucugcuaagaguggaacuuugugcccagcuccuuguuccaugauggaauuuagucuaguuugggcuuguacagaucauguacauccuguccaaccacugaguucauaagucccacugcauggauuguggccaaaagacauuuguuuucuuauggucaucuacagccucagguucuuacauucuuuccaacucuggaauuauuccugagauuuuggagaagaggguacaguauauauguuccauuuagggcugaacauaauaaaaucacuuauucucggcaucuccgacaguugugggucucucucugcuagucaccuucuacuacaaauagcagcuucucagaugaggguugaaaaaugcauuguucaacaaguauaaucauaagucauuagaaauugguuuaauacaguguccauuuagcagaauaauaguaauagcuucuacaaccuauggucugucuagccacggauucuugauccaguaauggugucagauguagguuucaucuuggggaguccaggcagaaggugguugguuacuccaugauguucugugccacuguuguaccacugggcauuucuugccaggccagucauuacuguagcuggaaggauuccuuucugggaaugauuggugauuacuuuucuccucugguagcaagcaucauaaaacuagccuguagggaugaagcuuccaagccaggaccagcuuguuaucuuuauuuucuaugacucauacuugcugucuuuggcaauuguguccuauccccagacccuggaggauaaccaggagcacaggcaauagccuguacgacuugaaggucuaugggaccugaauaaccagcaacuccaaaagaagcagccuauucccgagccugggcugcuuccuuguuauggagcaggaguacugcugccccaucuaugguuaacucuuuuuagguaaguauauagaucuagucuaggaagcuucuauaguaguagguuucaguauaacucuuuugaaaaaucuuugguauuauuucucccucccaguuuccuucucugccccuccuucccccagcuuaucccuuuuuguucaugaugcccuuauaucccuuuauauacaaguguagucucucuccucgcucuugaaagccuugcucccuguuaguaauuuccaaaugaaacacauauaugugaagacucaaagcuaauauccacaaaugagagaugugacauuugucucucuguccccgggguaccgcacucaaaaugauuacuuccagccccaucuaauuaccugugaauuucauauuuucauuuuuguuaauagcugaauaauauuuuaccguguaaguauaccaaauuuuguuaucauuuccuugcuguugugaauagggcaguacugaaugugagugagcaucucuucaguaggcuggagaguccugugggggugugcccaagagugugcaugaggagccaccauacugauuuccaugguuguuuggcuaguuuucacucccucagcaguaagcuccuuuacccacauccacgccagcguuugucaucaguuuuacuuucuuaauaaaaaaguuuuccagacacuuacauuucagcuuuggagaacucccugcuuaguaccacuccccauuuuuaauuguguuguuuguuuuaauuuuuaggauuuuaaaaauauauucuagauucuaacccucugucguauguauagcugggaaagauuuuuuacccauucuguaggcuuucucuucacucagaugaugguguccuuugauguacaacuuuuuagcuucaugaaguuccauuuauuaauuguuggucuuaauggcuacaauauugagaucuuguucagaaaauccuuuccugcacccaccaguucaaacaauuuccuacuuuuuuuuugucugucagaucuaggguaucagguuauaugugauccauuuggaauugaguuuuguguguuucauucucuauguagcagaccagugugagcaacaccgucugcugaagaugcuucuuuucuccaguguguauuauuggcuucuuauagaugaauagguagcuguaggaguguggguuuauaugugcauccuuaauuugaucccaaugacuauuguuacgccaguaccaugcugguuuuauuacuauaggucuguaauacagcuugaaaucugggauuguuguuauuuuggcuauucuuggucuuuuuuauucccauauggaauuuaagaaugauuuuucaacuucuguaaagaacuguauuggaguuuugauggggauugcauugagucuauagauugcuuuugguaaaauggcuuuuuaaucucaaucaauucaugaguaugguugggguguguauuagucaggguucucuagagucacagaacuuauggauagucucuauauaguaaaggaauuuauuggugacuuacaaucugcaguccaauucccaacaaugguucaggaguagcugugaauggaaguccaaggaucuagcaguuacucagucccacacggcaagcaagccaaaaagagacucucuucuuccaauguccuuauauggucuccagcaaaagguguagcccagauuaaagguguguuccaccacaccuuuaaucccagaugaccuugaacucggagaucucuuugucuuaauuuucuggaauccauagccacuaugccucaagaucuccauaccaagauccagaucagaaaauucuaucucccagccuccagauaaggguuaccugugagccuucuaauucuggauuguaguucauuccaaauauagucaaguugacaaccaggauuagccacuacaggguguguguccaucuucugguaucuucuucaguuucugcuuucaguacccuuacuauuuguacaaaucuguuauuuucuuggucauauuuauuccaagguauuuugaaacacuauuugaauaguauuguuuguuugguuucuuuccuguuauguuuugccaucaaacuaguuuuggaaguuuagaugcuucauguauuggccagagcauugagccuaacuuagcuuuggcuucuuuauacauuuccuacugauaucacagaauuaucaugagaaccaaagaaaauauuugaaaacuaaguguaggguauuguggguuguguggucccaguaucugcucugccauagggcacagcugcaggagaggugguacuugggaaguugaccacacuuaccccacaacagguggguauugggcuguagagcagcgcagggacauuggggguccccaggccuuugaugaggcugggggcuucugguucucaggcucuuggucacccaggcaccacuaggagcuacggaagagcugagaacugagugggaacccacaggcuggaucuaggcgggggauugggggggugguggaugagggaggggaggagaagccccggcgguccugcugggguaguccuagguuugauggcagcugcaggcuuggacaacugggcuugguagagaagguggcugggaauacagagaggucuucuacaggagauuagauggcggcuuuaugggcaaaggccuucuccuuggcuccccacagcagauccccaugaaaagagacaguccaugguucuaagacauuuauugucaugguggaaaguaguuguuuaaaaccauaccucacuucugagggugggccuggguuaaauaccuuuugcagagagaagugucugggaaggaaagcuuauuggcuaagcucuccagccuuuagguaccucauuaaaaugaagaucugucuugagccuacaugaccacaagucacaucuacaaguggagggguuugggacauugcccuuacacaacugauagccacaaaucuauggggaguggggguggggguggggugauuuggcuagugauggagccuggugcccaggaaucaggugaagugcaugcugucccuucaggauuucuggggcuuuaagccuuagcucaaccagggaccaugcccgccuuucacggccccacaggguguuauuaaauauaaauaaauuacuaccacuguucucaguuucuuauauuugguuuaaaagcuucuuauauuaggaauugucuuuuguaugggaugugucuaugugagacagggucuuaauauauaacccugauuggccuagaacuugcuauguagacaggcuguccuccaacuccuuccugucucugccuuccagcauugugauuaaagccacaugauaccaugcccagcuuuuuucuucucugugcauauucauaaauauacuccacccccccccacuucuuucccccacccugccucagugaaaugcugucuugagagcucagucaaucuucuuuuuuuuuuuuuuugccguuuuaguccuuucuguucuucauuauugcaccucauuucucuuucuuuuccuuuucuuuauuagauauuuucuuuauuuacauuucaaauguuauccccuuuccuaguuucccuucugaaaaauccccuauccucuucccccucccacugcucaccaaccuacccacuccugcuuccuggcccuggcauuccccuauacuggggcauagaaccuucacaggaccaagggcuucucuucccauugaugaccgacuaggccauccucugcuacauaggcagcuagagccaugauucccaccauguguuuucuuugguuggugguuuagucccagggagcucuguggggggcagguuaguucauauuauuguuccucauauagagcugcaaaccccuucggcuccuuggguacuuucucuagcuccuucauuggggacccugugcucaguccaauggauggcugggggcaucuacuuuuguauuuguuaggcacuggcagagccucucaggagacagcuauaucaggcuccugucagcaagcucuuguuggcguccacaauagugucuaguuuuagugguuguuuaugagguguauauccccagguggggcagucucuggauggucauuccuucagugucuacuucacacuuugucucuguaacuccuuccaugggaauuuuguucccccuucuaagaaggacugaaguauccacaguuagucuuccuucuugaguuucauguguuuugcgaauuguaucuugggcauugcugucuugagagcucaaucaaucuucuuaucccagccugccaaguugcuaaacuugaagccauguaccacggaugcccaauacauucaauucucuuaaaaauaguuguuuaaugaguaucuucuaucuaucugauccucacaauuuuauguuuuauuacauaaauagaaaauuuuauuuucauugccuaaauagaaaauuaaagcuaaaaauuauuuagucauuaucccagauuaaaugaauagugcaaggugaaguuagaaucuuaccugcauuuuuaccucccaguccuguguucuuguuuccauugccccuuguaugugcccuuguauguaugauggugggcucuccauacgucaccauucuaggaauucccuuugucucuccugaaaugauaacagcaguagccacagcaugggauggaaaugcuguagaaauaauacagauaaacuguuugggugucugucauauacauauucuaacaacugcuguggauaaccauugcuguuauuuucauacaaaaauuuguuauauuugacucuaaaacugucaugacauauauauuuauaucauaaauggacugauuaaacauuauauaaaacugauauauaucugaagagauaguagagcauuucucugaaagcuaacaugaauuacuuaagcaagucagcccaacaauaaaguucugugacagaguggauuagcacaaaaguuuuaaaaagauacaaauauugucucacuucugucauuaaccaagguuggaaaugauaggcauaugccugccuaguagguaugagucagagaagaagacaugaguuguauagcuucuaucaaaugacuaaucgaucaguagauauuuauagguuuauacucuuaaauuguucauguacaagcaugugcuguaauaguagagaucagagcacagccaucuucauauggguuccaggaauggaacucaggucuucaaguuuaccaggaaguaugacaacccacuggaucaacacaccagccuuguaaauaauuguaugcaaucuauagcuuuuaauuuuaauaucuguccugauaacagugguuagaagucuuguauuuuaacagucuccguuuuuaguuucuauccuugaaaccauauggcauaagucuccaagcgaaccaaggucuuacacuagcaguuuuuaaaguuugcucccucagcuuuuuuuccagaaauacaggaauagcauuaguaauguuuguagcuguauuagauggcuuuauauuugagcugcaugaugugucauccucucugaagcgugucgugagcccauacugucuuaugacuugggagagagggauggaugcugaaaagcuauugaacaaaggaaauauuaaaaagaacaaaacugaguauuuauguuaguccuguaaaugcuguaaaugaaaaccacagggggcuggugagauggcucaguggguaagagcacccgacugcucuuccgaagguccgaaguucaaaucccggcaaccacaugguagcucacaaccacccauaaugagaucugaugcccucuucuggugcaucugaagacagcuacagugugcuuacauauaauaaauaaauaaauaaauaaauaaauaaauaaauaaauaaauaaaucuuuaaaaaaaaaaaagaaaagaaaaccacagucugucaaaacuauaaggugaucguuccauucaggagguugaggcaggagguugucagacauccugagcuucacagugucucaguccccaguagcaccagaauacagccccaaagcaaaaucgucaucacuuacucugcucugcauugugacauaguguaacacaaaucugcauucugacaguuauuuguuuuugucuuugggauauacauucuuauuauguguagcccgggcuucuucaaccuugagauucuccgccuucacauuuaggauuauaggaauauaaucuaccaagccuagcucaugguuuuuaaaauguacaguucaguuguauuaaguaucuucucauuguucuaccaaagagcuucagaacgcuuacauugugugacucaucguacaaaucuccacuuuuuuucccucccagcucuuaguaaccauccuuccugguucugaguuugacuacuuuggaguuucagacaaguagagucauaugguacuuggcucuguuccugugugacugaguuauuccauuagcauguucucaaagauucaucuguccuguaguuuguggccaaauuaccuuccuuuuaaacuguacauauauacuacauuuaguuuacccauucagcaauggacauuugaaugacuucucauuaaaugaauucuuaauauauuuacuagcugcugggaaaccucacagcuaaccagagauccaggccacugaucugucaucacaaagacucuccuacauagcugucuugggaaacgacuaaaagcugaccucuugagcuagguuacuuguccugucccagucuucuguggcgcucguacccagcucugacugcugcuugucaucuuggcuacuuuccaaccuuacucaggaugccguuuucuuuuccgggaucaucuuagcuuucuaacugugcuuccuguaccuccuccucaucgugcagucuguucuugauagcagcugcagugauccuguggagauagcaagccuuccagugacuuccuauuguacucagaguaacucagaaguccagacugugcccuagaaggccucgugugacccaugcuuucuucacugccugcauucgucucuuagaccauguuccauugcucccuguuuaugcugcugauagccugguuuacucguucacugaacaggacagcucggaccuugguucugaguauuuccucuuucugcacaguucuuuucuuuuccuuccuuccuuucuuucuauuuuuuccagaauauggugucaaauccccuggaacuagagugauaggcaacugugagccuauugggguacuacugucugaaccaagguucuuuucaagagcuguaagcccucucaacagggacauccaucgagccccuuauuucuguucuuacucccuuuacaauccaaccaucagcaugccuuuuaaacaguuaaccaggcguguuguguggcuguguaaaaccucccaguagaccuuguucaacguaaaagugacaaucauugucuugucuucaggaccuugaguauaacugcuaucuaccuguuuccugacccuuuuaaccacugugcuacucauuacacuucagcacaucacaaguucccaagaguaccaagcugacucccauuugauacugccuuuccucauccaucccccugcuccaagcagucauuuucaagauugucaugcuuaccuucuuuuuauagagaccuuuauuuuuuuaagguuuuauuuuuauuauuuuaauuauguuucuuauucuacgucccuuggccaguuagucacccuauguuagucuacugcagaaagaagcgucuccgaugaaagcugagaaauacauugaucuauggguauaaucauaagucauuaggaauggguuuaacacuuuguccauuuggcagaauaauaguaguagcuucuaugaccuauugucugacuagccacauggucuugguucaauaauggugucaacuguagguuucauuuuggggagcagccuuagagucagccagaaagugguugguuccucccaugauguccaggucacuacuguaucagugggugcuuccugucagacccaucauuauuguaacuggcaggauucauuucuggguaugauugaugguuucuuuugucucuucugguagcaugcauaguguuuuuuagcacugugaaaacuagagggaugaagcuuccaccaucuugauuuccccguauccuaugacucaaauacugcuucacucaucaaguucugaaggguuagccaaaagcagugacaguagccuauaauguuuguuggggaagucuccaggacuuuacuggcugcagucccaaaaaaaguaacucauuccugagacuuaagcuuauauuugucccaguuacaggguaacuccauuuuaacucuguuaauauauguauccacagguaucuuagaagcuuauacagcaguagcuucccgugugaccuuuccaauguugcuaucccuucccugcucccucuccuacccucuucuuuccuguccuucucucgcucucucucccucccuguuccacaauuucuuucugccuuucuguaccaggucuuuucuuaaugauugccuccucagaaagguuugcucaguuaacucaguuaacuccuuagcuaacauuuacaaacucaaauuaugguuuuuauuuuucagggcugaugauugaaguaaaguuauuuuaauuguuaauuuucuuuuucuuaucucugaguaucuucaugaggacaggaacuuuaucuuuucaaagguaggcaaguggcaaaugcuaaagcaaaguucuuacaggaagugagaaauuccagugacauaaaugacaagaaaacaaaauaucuuuguugcugauaggggaaaggguuuacuggucuggagagaugaaaagcuaagagagaaaaggauggcguggaagaaaaccuugaagugagcagagguuguuugagcuguuuaaggaaagaagcuguccgcauaucauaaaaguacccgguaaagcaucagccucugauguagaagcaagaaggacagaagagcuagagaagaugacugcagacaggggucacgcaaaacagaugcacgguguacacagcgcagcacagcgcagcacagcccucgacaggaggaaggucccaacaggggcuucuuuaacuagaaaggaaacuuaucucuggcaucagaggucaguguugcccuuuugggagcuaauguaucuagggacgggacuaaguugaaacuggugcuuaauugccauuccaaaaguccucuggcccuuaaaaguuaagcuaaguauauccugcuuauuuauauucuguaacugaagcuuaaaccugaauggcaauguauuuguuuugacuuagucuacugaguauuuucagccacuguugaccuacuccuaaagggggaagaacagauuccauucaaacuaccaauuuguuguuguuguuguuuuugagacaggguuucucuguguaacccuggcuguccuggaacucacucugccucccaaaugcugggauuaaaaacaugcgccacccugucccagcucaaacuaccaauuauguuccugaucaccuaagaagucugaugaagaugggcaagauuaaaauaguuuucauggccuguuuaacaugauaccuguccuguggaucaaagaauaaauuaggcuuucauguauccuuaagacaugcauuucuuagcauggaaccuguuacauaaaguaauuccucugagacuacugaacaaaguaauuagaaacuguucugguagggacucaacuuugagaacauuuauggccuaugggggaaucagugcaucaucacuaacaggagcuggaaguaguuggauccugaccucauguuugagguuugaagcuuaagugagaaaauagccagauauggaaguggcagagagcaaggauucgaagcagagucagagaccaugucuauuugacaaaacuuaaauaaggaauugcuuucuuguuuuguuuuguuuuucgagacaggguuucucuguauaggccuggcuguccuggaacucacucuguagaccaggcuggccucagacucagaaauccgccugccucugccucccgagugcugggauuaaaggugugcaccaccacgcccggcuaaggaauugcuuuccuauggaugagcaaagagugguuucuuaaaccuacucauggagaagacgguuugagcauugcuggaaugauuccuauuucagaauauccuccaguguugguggagcagugguaagauaucuguuauaguagcgcuuucagaguggcuaagcucuagaagcagcuuacauaucuguuagcaaaugaggauaaggaaagugugguguuauauaauacacaauggacuuuuauguagucauaggaaagaacugaauuauguuauuugcaggaaaauggauguaagcagacaucaugcuaagcagauuaagacagaaagucuaggcucucuccuauaugugggacuuugacuuuuuuuuuuuaaagacaugaacguaaaaaguggaauacuagggaagagauaaagggccauagcaggguaaaggaugaacuuuggucauaugggaaaaugaauagaagacacguaugugaugcauuaacaaaacacaugguuuuguacauugaauaaacacugcugaaaggaaugaaaaggagagcccuggcaguguuggaaaggauucacuaauuugaacauucuacaaaguaaguggcuacuaagugagaccauguuuccccaagaccaaacaaaggaaaugcugucaaacagcaucucaugccccagaggcauuuuugugcaaagaauuaacccucacagauuucauauuuaaaaguugccaucccaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaaaaaaaguugccauccccauccacgaaaccuuaaguauguacucugcuaaauggcagccaucaacacugaggcaggaccuuccaccagugacgagacuguagcucaugaaaggcucagaugaucuugagcauucucuagcaauagaguauuuugaaauugaggucucuauauugcuuaaacaauauaaugugacugcacacuucauagaaacuacagcauauuauaaauacagguugugugagcaccagggaaccaaaaacuacaaauuauaugacuuagcacuguggucuggaaccaacuucaugauauuucuguucucaguugugaauguuauuagguaaagaauuucucaacagaacaauaaaaauaauuauuuuaugggcaauaguaaaauaucuauaauaagccccacccacaaacauuuuucucucugcuccugaaggugugugacagaugaauccguuuuuagauuucuaaauuuuuucauauaauauauuuugauccuauucucuccucucccccacguucucccagaucuucucuagcucccuacccauccaugucauuucuaccucacuccucccaucccuuccucucucaaaaacaaacagaaaagaaaaaccaucaaaaaauaaaaagugcaaaaccaaaagagcucacaaaacaaagcaaaacgaaacaugggaucugauucgugcugagccuaaggccugcccaggaguucagcugaugacuccauuggaaaaagcucggauuuccuucuccuggcaugugucaguuacaaauagcuucuugguuggggggcacuuugugcacacuucaccuucacagcacugaaauuuuguuuggcugaauuugugcaggccuugugcuuuuauucagaugaaaagaugcauuuuuuuagaagcuaaagaaacccuuguuaauguguuggcucaauuucucuuuuccaaaaucaaaucaaggaagaaaauucugaaaaauacaacuaaaauauuaaucauuuaaaacuuaauuguggaaauaaggucauaauaacauuaugucugucuugcugaacauuguauacugacagggauacuguaauacauauaagaaaccagaguuuguuaagagcuccuuuuuauuccuucugucuuggagcucuuuuuuauuauugcuuacugaaguaguggaggucaaacccacucuaccacuugcuauguccuaccccuggggucuuuccuuuaaagugguauguuuaauuacauaugacauauauaugaagcauggugaauauuauuuucacuuuguguaaaauauuaguaacauuuaaaauaaaauauuuaccacugccccccccaaaaaaagagaaagaaccaaaacacugcuacuuuuguauagcuucuugcugacagaaaauuuaaaacuucaauuagaaauuaguaaaacucauucuucacacacccgugguuuaaauuuauuuucauuccuucagauacuugcauggaagccagaugcaguucacagcaucucaagagacuuaguuuuuuaggaaaguagagcuuagggccguuuccauauuuagcccuuaaugcuuuucaagaccuuaaaauaagcuagugguugauguuaaguggugguugucggucccuccugcauuaggcauuuggcuuguugucgccacuuucagauuauugaugaaacaguuuuuuuuaucaaagcugcuuagucacuagaucuucaggucauaggauucugguaguaauccgugccuuugaguugcugcagaaaauguaacucaugucacagguccugaaagguuagacuucugcuuuaugaacuacugcagccuggucgcaucugcauaaugauuuuuuauuuacuguuuauugugguaauauauauaggacacaaaguuucuugcuuuagucaguuuucacguguauauuucuuggcaguuauuaccugcccuuacuccuaaauuuccugaauuucauaucauccaaacuuuagcaauaauacccauccuuccuucagccagucccguuagcacucaucuuucugucuauaacuucgcaugugaccaauauucugcauaaauguaauucgauaauagguguucuuugucugccuuuuucuauuagcauacuguguuuggguuucaucuguguuuuacagagcguggucagaauuccauucuuuuuauggggauaaugcugcagccuauaggacaccacacuucauugacuccuccaucugccggaggacagcugggacggcuuuugccuuuuacuuuuaugaauaaugccacuggaaacuugguuacauguaucuaucugaguccccacuuucaagcgguuugggggauagaugugaaauuuuugggucauauaacucaguaauucaguauuuaauguauagaagaacaugaucauuguuuuacaguaguuuuguucuuuuuuuuuuuuuuuuacucuuuuguuaauguucauuuauuuauuuauuuauuuauuuauuuuacguuuuugcuugucaccuuguuugacuuuuguugcuugaguuuuaaauaaauguuuguuuuggucauucauuuuuuuccuauccuuuucaauuguuuguuuuucagacccgagucagaacuccaucacaggggagcacagccagcuguuagguauaguauugcucugggaaguaucucuguaaagucucccucuuugucccugaagacauuaccuacuucccuccauugcuauuuugauucuuucacuuugcucuucacuccucaagcuucucacuguuuauuuacaauuugguaagauauaugaagcuacuuuuguaauuaauuauuaaaaucaguagucaguacaauuuuuaauuauauuuuaaaagguaacuuuacauaaucuguagcuaaaaaaaaaaaaucuuaccuucuuguuccaggauaguauugaaaagaagacauuaucuuccacacauuugcugugguagguuugcccacaaacacaucauauguacguaaaaauuauuuaaaaguuagauuaaagugggcaagagauaguuaauccaguaauggcacuuggccugaaagccuggugacccaaguuugguccccaggacccuugcacaugggaaggagagaaccaacuccacaaaguguucccuaaccuccacacuggcacgguggcacgguggcgugguggcacaugcacacacacccuguuaggaacauguacaauaacaauuaagaucacaauaucauggucuauacagauauucuucucguuuauuauguugguguuuaaucacauuuuaauugcuggaagcuguugaguuucugugagaugcucaccagguaaagcacuucccugauagccugaguuuggguccucggauccacauaguagaaggagagagccgacucucucggguuucucugaccuucacagcacagugcagugugugugcaugcacccaccaucacacagaaaaauaagauacaauaauaauguaauuacugaaagccuuccuagacaacaugccuuuaauaacccauaaaauugauaguccaguuucuuaccuaugaaacaaguuauggagaugaauugauuuccucuagguauuauuuauuguagggaaauuguaauuugacaugaauuuuauaagcucucaaaacuuguagauuucaaaacauauccuuacaacuuggacuccuuucuagaaacacugcaaugaggaacccaagcaacacaaaagaucaguauuaaaaaagcaaauucuuuaaagggucucuuguccccaacaccuccccucuacuuccccaaguacuuaauuuugacuacuuauuaggaguucuagaaaaaguuauuuauaaauguucauguccuguauuauguuucccuuaaugccaauggcauugggucauuggaauggccuuuugucguuuauguuuccucgugguaucuccucucaguacguagggaucucuccauccuuuauguagagugcagugggacuugguugucacugcagcuuuacucagccauuuccccucuucaugagcauuuagguuuuuucuagaacacugauuuaaaaaaaauuauguugagggaccuggguucaauuccaagcauauggcagcuuacaaccauuuauaacugcacuuccagggaauccaaugucuucuucuggccuauauaagcaccgugugcauguggcacaugaacaaacaugcaaacaaaauacucauacccauacaauauuuucaaaagaaauuauguugccaugaguaucuuauacuugaaucugugcagucacagcugucaguacauuuguaugcaaauuuucucaguggauuuauacauuuucaacaagauaaaucaccauaaacucccaccaaucuggguaugaggaacguuugccacucuguuaucaaaaacugauguucuuuuuaaaguuuuaauauuuacuuauuuaauguagggaaugacaugcauggcauugcauguguguggaggucagaggacaccuuucaggcauugguucucuccuaccauauguguugugcacauugaacucaaauugucaggcuuggcagcaacugacuuuaccugcugagccagcuauccaguccaaacugauacuauuaaucuauauuuuuuauauuuacuaacagaaugucauuucuaguuuguauuauacuucuuuaguuaugagugagaauaagaaauguaugguauguuaauaauuaauguuguauguagugugcaugucuagguuuguacacuggcaugugcuaucagaaaguccacaggaggggaggaacuugauaugacuuguuugcuuacagaaaaagcuccagaguauugaagaaacugggcaugcguacucguucucuuucugucuaucugucucaugguagcacauuccuguaaucccaacaugugggaaacucaagacaacaaggccagccugggcuacauuagacucugucucaaucuuucuuuucuccccuaaauuaugaaauugccaagauaagcucaaaagucugagacuacuuuguuaucugaccaggaauauuugugcaguggaggcagggcaaggguaagaauuuauacaguucacaaauuaccaaacagcauugaacuagacaaagacuguauuuuguaauauuuuuuauaauugccccuccuuucaggacuggggauguaauucagugauacaguauuaauuggcaaaaacacccugggcucaaccccagcaccuccaaaguuaaacccccaacaccacuaacgggccccccgggucuuucuaagaggcuccuauguguaggcucaccugcaggaaacacuggcucaacugucuugcuugcugaauucacuuuauaauaacaucuuucagacuuugccugccaaaugggauugaaaacagcaucuucaggcugcuaagugcugcuccugccaacaggccgcaguuauuuuacuguuguauuuacuguucccacugacucaucagcucucgugcaaaacucagggucaggcugaggugacggaugggaggugaacuuucuucugggauaauguauccaagucuguacuuaacaguuugcgaacuguucccaaccuguguauguguauaauuuucuauuuaaaaaauuuuggaaagcaagcaggcaaacaucagugagucguggcagauuuucuuaaaaaugagaggaugaaaacauccagguuugcacaaucuucuuucauaguauaggaagccaaauaaauacuucaauaaauuugagucuuucauaggcuugauaccaauacguaauagugguaagaugaggaaagcauugcccagccuaaacacaguaucuguaauccgaaucacacaguguuuuuauuuuaauuuaaauauaaaauuuuaucacuauuuugagaaugucaugcacgcaugcaguguauuuugauuauauucacccugcuccucucguggacuccuccucccagauccgaccucuuucccuacuugcuccaaaguuucugucugauuuuuggguugguuuugguuuugguuugguuuuguuuauuuuacagcccacugaguuuaguuuaugaugcucacauacucauggauauugagccauccaguggaguguggguguauuagucaggguucucuagagucacagaacuuauggauagucucuagauaauaaaggaauuuauugaugacuuacagucggcagcucaauucccaacaaucguucagucacagcugugaauggaaguccaaggaucuagcaguuacucagucucacgcagcaagcaggcgaaggagcaggagcaagagcuagacucccuucuuccaauguccuuauauugucuccagcagaagguguagcccagauuaaagguguguuccaccacaccuuuaaucccagaugaaaggcguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacacauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuucuccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguaggaggacuccccucucuggagccaaaacuucuaggccagcagaaccuagaguuauggggacaggaagcaaaaauuuuccuagagggucacuaggagugauaguaaguggaacuauuccuuuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccaguguauuccaugaucgugggcccacugucgaacuucucuggcugugaaaugaguuccuuggucagaagcaauacuguguggaauaccaugacgauagaugaggcauucugucaauccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcaguagccaggucagcuuuggugaguggaagcccguguugcugagcccaagcauaaccuccaucucgaccaccaugaccacuuuguucaugugcccauugagcaaugacagggauggcuggggagagaggcugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucagugaauaaucguacaucuggccacuucuucuuacaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcgcgucccacuuuaugacuugcagggucugauaguacccagcucaugauggguaguucaggucgcauaguaacuugguguccuauugucaaacguucaguuuccacuaaggcccaauagcaggccaagagcuguuuuucaaagggagaauaguugucugcagaugaugguagagcuuugcuccaaaaucccaaaggucuuuucugugauucaccuacaggggccugccagaggcuccaaacagcaucucuaucagccacagauaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauaggcccacuaaacguugugcuucuuucuugguuguaggaggggccaggugcaauaacuuaucuuucaccuuagaaggaauaucucugcaugcuccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucaguggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguagggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauagucucuagauaauaaaggaauuuauugaugacuuacagucggcagcucaauucccaacaaucguucagucacagcugugaauggaaguccaaggaucuagcaguuacucagucucacgcagcaagcaggcgaaggagcaggagcaagagcuagacucccuucuuccaauguccuuauauugucuccagcagaagguguagcccagauuaaagguguguuccaccacaccuuuaaucccagaugaaaggcguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagugggcgaccuaccagaggccauaaacuuagagaaaagggacucucccuuccccagaagcauuaccugucaauagcuguccagcaagggguugggacuucaccucucccuuccaugcuggaauguuagccagguuagucuuguggaggucuuuuuacauguagcaguuuguaaaauuaccuucacaggcugugguuuggcucaauguuaagaguguuuaucuaccaugugcaaggcccuggguucaaucuccaaugccucaaaaauaaacaaauaccauacuugcuaaaaauacaugacagacuuuauauauuucaaaaaugaauuuauguuccugucaugguucacaucucuccucccaguacaugguucacaucucucaaucaucccaguauuuagaaagaugaggccugagaaacaugaacuuuaggguagccugagcuacauagacccuaucucaaaaauguauguauaaaguuaugugcuucuuguauuaguauuuaagaaguauguaaucauuuuauauaaguagagggagcauuuaauaggaaauuuuaaacuaaguguccguaacuggagugcucuugugugcccacucauugauugcucggugagggagaauaauauacuguuuuauauuuaacuguaccaguugacagccaaguaguagauuuaaaagaauuucuuuccuuugaaaugugugaccuaugaagacuaacagaaugaaaauaucacauuuuaccccucauaggauaauggacccaggcauuaaucaucaaugcuuguuaauaucucaaaaagaaagacaaccugacaaagccaaggaucacagcgcaguucugcagcaguuuuucuguuccccaaaaauaacaaauaugaugugcuuaagccaauucauaggaacucuacaguaaacagaacacagcaucuugucgauggcauuaucaaaacccaaugccucugaaacccuaggacacaugacacgauuucuugaggaggaagaaagcagacuauagcugaaagaaagagagcagucagucguaauguguuuugccugacugcaaacucagcauagaccagaggaucacuugugggguuucucuauauugcucaguguugccuugcuuacccagaaugcaugagugccgagguucuguccucaucacuaaagaaagaaaccagcaaacaagccagccugugaacccucauucacaucccuuucagaaaaaaaaagauacaagagaaaaaacccuaauuuuagcuuuuucuuucucacuaguuaauaccuauucaccauauaucgcagaauauuuaauauacuucuacuuacaacauacuucucagaaaaucucauauuuuuccaacuuuccaauuuucauucacuugaaaacaguaauuuuucagcauuugagacaauguuuccuguuguaguggaugugguucaaacagauauaugucagaggaaauuaaguacucuuuauguuccaucucugucuagaugagaacagcaaagaccaucugacagggccaggaggcuaaagaacuaguuuacaguuuaucuugguuccaaacaauaaagauauuagguauagacuuuuucugauuacagagaagagagaauguagcuuagugaaggugugcucaaagcccuggauucaguucguagcacacacagacagaaaggaacaacaaaagcaaguuauaggacauaaaugugucacaaaaaacagaauuaaauuuucagaagacacagguucugucaguuuucuuucucacugugccgugagacacagcagcuuccucaugguguacaugcuauuugggucguaaaugagaggggagagacauggcucugauggugagaugcugacgucaggucguugacggggccaguggggucuuagagaaugaucuuaugguucaguaugauccuuucuucuuaacgaucugugugacugugugugggggugggagggguggcuguaugaguuuauauguaccucacaucugugccugcugccauagaggucaggagagggcauccgguccccuggaacuggaguuagaauugugugagcuguuugaugagauuacugcgaacugaacucagauccuccccaagagcaguaggugcuguuaacugccaaggcaucucuacagccccagaguucuuauauaacuuuuaaggguccuagaauauacgcuugguucugaguucaugacgaaaaaaaauuauuuuuuacuuggaauaucuagaaauuccccugugucuagcauuccuguguagugacccgacuacagaagccuaugguuaucaguguguggccaaagugucuuggauaaaggugcuugcugccaaccgugauaacuggaguuuaacacagggccucccaugguagauggagagaccuacacaaguuguccuuugagcuccauauccauggcaagugucacauguguccacauguacacaacacuaaguaaauuagugcacuuuuaaaaaucacuuuaagccgggugugguggugcacaccuuuaaucccagcaccugggagguagaggcagguggaucucugaguucgaggccagccuggucuacaaagugaguuccaggacagccagggcuauacagagaaacccugucuugaaaaaccaauaaauaaauaaauaaauaaauuaauuaauuaauuaauuaaauuuuaaaaaaucacuuucuccagggcuauacagagaaacccugucuugaaaaaccaauaaauaaauaaauaaauaaauaaauaaauaaauaauaaaauuaaauuuaaaaaaaucacuuucuuggaccaggauuguaguacacaccuuuaaucccagaggcagagaaucaacaacaacaaauuugaggccagcuugguuuacauugugaguucuaggacagagugaaaaccugugaguucuaggcuacauagugaaacccuaucucaaaaaaaguuauuguaauaaagucacagauagaaucaucauguagcuauauuaauguuccuguguagacaucuguccaguuccaaaugcuaucuauacaucucagugaugauaugcauccaugcagguagagucguuuuucugauuccaagguucacuuaauggcucaugcuuuuacucucaauuacauuuucaucacuuaucaccacaaaaguguauguguguucauuuguauuguuaucuugacuuugucuuccaucucugaaauccuucuucugcuuguucuugucuguccauaauggcaucuguuguuuuuauuugcuugaccaucucauuuacuucaaguguuucuguucauuuuggugugugugugguuuuuuuuuuuuuuuuuuuuuuuuuuuuuuuuuuuuguuuuuugagacaggguuucucuguaucucuguauagaccuggcuguccuggaacucacuuuguagaccaggcuggccucaaacucagaaauccgccugccucugccucccgagugcugggauuaaaggcaugugucaccacgcccagcuuccuuuaucuuuugaacuuuuaccuccaauuuacuguugcauucacuuuugagacugucuuguugaagucuaugauagauuuccuuaauguguccaucuguuugaaucuucugggugaucauuauuaagucucuuaaaaaguaagacucugaauucuuuguuagacauccaacuaucuaugugguuuuggguuccuucuuuagggaguugguuuguugggaugggucauagaacacagcugugucauaguguuuguguuucugugauguuguuauaugcaucucuuagagcaugugugacugucaguuuugacuuccccaucuuuggaguguauucugugguguuucugugguucuucccaaaggauugucugcaugaaauucagcuguguggacuagaggaauuuaguguugucaaguguagucgucaagguaauccggucauagcuccguggcaacaagacuaaggguggaucagcacaugaagaaccaacacagccaggugggcucagagccuccuucauugccugaauucugugaauccacuggagccaugauagauccacugagucaggauacuaucugggggcuguggcuaaagcucuaggcacuuaaguaaccccugggagaccacaauaguguaaacuccagguccuccagugaccacugggaccucaggauucaaaauccacacccacacuaaucuuaacaccccccccccuuuuuuuuuuauuuuggagacaggguauuucugugcaguccuggcuguccuggagcucacucuauagaccaggcuggucucgaacucagaaauccgccuaccucuaccucccaagugcuggaacuaaaggcaugcgccaccacugcccggccuuaaagaccucuuaagccaaagcuccaguuucucaggggacccugggcacugaagcccaggauacucacugaccucugauuccacuggagcuagagauucuugcagacucucagauuccaguggagccagugaccuaguccccuggugcuuccugguccugcagaaacccaagaguaauaaaugcaacauuuuccaguuaaguauauauuuaaauuucccuguuuuuaauuuuuuauauuauguuauguuuuuggauguuuugccuacauauguaccuauauacagcaaguguaucugguccaugggccagaaaaggguguuagauccccugucacuauagguauaggugauugugaguugcugugugugugcugggaauugaacccagguccucuggaagagcaguugugucauucucuguucuagaaaugucuuuucacguuuauuugagccaagguucuaacaaagcucauaucuuagauuucagucacaucaaaagcuuuaauccguaaaaguuuacucucuucagcuugugauuuccugaagaaauuagauuaucuuguuucugacuguggugauuacaucuuugagcaugcuuaccauguauuuuuguauuuccuuuauauuuucugcauuccuggagaggcuuaguagauugaauuuccauucuuuugcuaagaaugaacaguaucuugcccuccgugauguuaguauuggucagcaggcucaugacugccuuccuuuacucauugccagguuauacuucagcucuuuaucauugguuuucauagccauugagaugacugcuuagaucuguuauuuuuacaaagguuugcaaacuggcagagguuuucuguguacuguuccaugugucauaaauuagcuacaauguguuucuaaaaaaguuaacuaauaacuagucuuuagcaguauaauuauccucagguguaauucucacaaaacauacagcauaguuacuugauucuucuaugauuuuucaguuguauauauuguuuccuuaaaacugggcaaaauugacuucuuaaaaaugauuauuuugaaugucucgugugucucaugcacuccuguuaagugcuccucccacagccacugggagcuucuucaugucagccucuuguccucucagaugaccaacucaucucuagaguuugcuguccuuuugccaggcuccucuaauagauuuaaaguaauauacagugcuuuuaauuuucuuuaauuuuuauauuaguaucuuuuuucaguaauagaaaucuuaguuuuaaagagcauacauuuuucucuucucuccugucagacugcaauuauguaacuuaugaacaauuuaaaaaguuaaagauuaagaaguauucauauaacacaagcucugcugucucaggaucuuggauucuucuuuguuugcuuacagguaguucauuagauuccaguuaggugcugucgacauaaaaguaauauggaaggguucauagaaaaauauacuagaugcugaucaugaagagacacauauauaaucuacuacuuuggggacugagaaaggauagucaagaguuugagaccagucugggccucauggugagacucuuucaaaaacuacugcugacuuccagcugcuugguguacagauaacaaaagacaacagagugccuagccccaaauugaacuuugauacguuaucucaaggcugggaguuuugauggaggggguggcagggcaggaagauuguaagagcugaaggccauggacguuuaaaggaaacuguuuuccagacagaagugcaucugaacucagugacuguuacagugugcacagaugugcacaagcuccagccagccagaguccagcagugggaauguggugggauguguacuuccagcaccagugcaccaaggagcuauuagcauuuaaugauugcugugaagaagagauucagguugucauuuacugguggugaccuuaauaaugugacugugcaccagagcauaccuuaaucuccaaacuaacuaagcaacacaaacuggaccucaugggaaagaaaguuaaaaaaaaaaaaaaaaaaaaaaggaagcaugcugaaagcuggguuggaaaaaaaaaaaaggaaaaaaggaagcaugcugaaagcuggguuggaaagcaaugagaggguuggaauauauucaaaauacauccuaugaaauuaucaaagaauuuuuuaaaaagcaucaaagaugaagucaccuauuauaagugacaaagcgucaggaaggaggccagcaacacuguucugcaagcacuuggcacgcaacccugacagccugcauuccauaccuuacacagguggaaguagagaaucagcucuaccagcuugugcuccgacuugugcacuauucuacacacacacacacacacacacacacacacacacacacacaccacaugcacauacauacacaugccuuggaaacagcuuuuucucccauuaucagcauuaacaauuuguaaaguagcccaugucaagagcaguauaacacaccaagaaagaaauacuuguggguuaguucaaggguagggcccccagcggucucuguauuaagaaaagaacuuuguguugauuccuuugguuuccugauuugcuuuugccugaccaucacauucuucaagcucugcuaacugaggucuaccacucaagcugaacuugaaucugaagugguuucugcuaacacagaggcaacaucguuguuggugcugcugucuuaguacccaugaaaaacuaauguuuuccuuucuuuucagaugacggccauaaaaaagcccgaaaugcuuaucucaauaauuccaacuaugaagaaggagacgaauauuuugauaaaaauuuggcacucuuugagguaauauuuuaauuauauauguaugugucugugugggaguagaagagggcaucauauuucccuggagauggaguuaggagaguugugagccucccaaugugggugcugguaacugaacucaggacucuggaagaguagcacggacucuuucccacugacugagcugucucuccaaccugcacaaugcaauucaucagcuacuaggaaauaugaaaucaucacauuuccagagaaauguuuggaagcaucaaucaucauguuaagcaaaauaagccaaacuaagacugaugcugaguagugcauguuuucucccuauguauauguaaguauaugugugucagagagggaggagacuggggguggggggagagagagggugagcacaggcugugaguaggaaggaagagauguuaaggggcagagaggugaagaccaaauaauagaaugcaugauguaaccugaaagcaggaguggggacuaauuagggaaagaagggggaaccuagucucuuuagagggucagaaggaauggggaaggcagaggaggaggggagcaagggagagcacaagcauaacacauguguaggaaccccuacugagugucaggacucuguauccuaccuuaacucguugcccuaauuaagcguggucuuuucuccaucucugcgcugggguuggaccgcaggccuugagcaugcuggcagccacucucacugaccuguccccucagcuccacacagucuuucaaaugugaggaaaaaaaaugucucacagaagacuuuucuuaaaauauuuaucuguuaaagauuuuaucauuuacuuuucuguuuccugguaaaguauuuuguugcugaauuucaguauccuucauaaauuauuucuggcuuuauaggaagaaauggacaccagaccaaaggugucuucucuccucaaccgcauggccaacuauacaaaucugacacaaggagcaaaggaacaugaagaggcagagaacaucacugaagggaaaaagaagccuaccaaggugaugccucacaacacccaggauaaaaaaagauggccugaauauaagaugaugaagacauacccagggcauccauccaugugaagaaacaauguauuagauguuuuauguacccagacaaugcugagcauuggcaucauggcccaggcagaaugcacaguguccuggcuucaugugggaagccagucccuaugcucuuuaaacuguuaaaguauauaacauuuuuagugucaauuaaugcuugaccaaaacuuaagcagaguuaaaaacagugagacugacaagagucugcuggaaggaguugcuucucuggcaggcugggcagaggaggcccucugacuugguagauuugagcagaaaccauucaggguuagccaugugacugacagcacugcaggaagagacaguagcacaucagugaaguggaucuaccuggcugcucagucggccuggugcaagggguuugggguugguuuuuuuguuuuuuuggucuuuugagacuauaccucaaauauaagacagguuggccauggauuuacaauccuucugccucaguucccagugcuagaaucauaggcauguaccaugauaaugauagccagcaauuguuagacuuuuuuuguaauacuacuauuuuucuuacaauaaaauuaugccaauacacacaggccagcucuuugcaaggggucagauggccuucaaguuuuuauuuuccccauguguuucauuuaccaacuauuaugaagaauuugaaccuaaauucucaacaguuuccacaaguuaucgcuguuuuuaaaugaaaagaauuuuagcaauagaaaaaaauuuuugaagaauagaaauuuuuagauuuucaaauguuccauuguuuagguauaguaaaaauauguaggauguuauccaaauuauaaauguauauagauaauagaaguauagugaugaaguuaacuaagagaucuuagaagguaaugguuaaacuuccugaugacucuacuuggauauuaauaugguaagucugggcugcagauggcucagcaguuaagagcacugacuguucuuccgaagguccugaguucaaauccuagcaaccacaugguggcucacaaccauccauaacaagaucuggcgcccucuuccagagugucugaagacagcuauaguguacuuacauauaauaaauaaaucuuaaaaaaaaaauaauaugguaagucaaagcaucuuuuauggcuauggcuaacuauauaauuucccuuugccuugcauuuuuauuuucagagcccccaaauggguacuuucaugggugucuaccucccaugucuacagaacaucuuuggagugauccucuuccugcgucuuaccuggguagugggaacagcuggaauccuucaggccuuugcaauuguccucaucugcugcugcuguguaagucgugcauuggcuccuagagcuuucauuuugagcugccaagaguauaugcacuugaccuccuggagaacaagcacagaaaauaugugagaaggcucaugaccccaacaggaaagagaauuuugaucuuaaaaucgaaaagauuuucacuaagcacccauuagacauaacuuacauuauauaguauaugguuuccuagauuuuuggaaauacaaaacaaaaugcaggucuuaaaauaauuuaaaauauggauaauuugagcaugaaaacacugauguuguaacagaaaauauuagaaaaugaauacacgcugggcguguuggcacacgccuuuaaucccagcacuugggaggcagaggcaggcggauuucugaguuugaggccagccuggucuacaaagugaguuccaggacagccagggcuauacagagaaacccugucuuaaaaaaccaaaaaaaagaaaaaaaaaagaaaaugaauacacuauuccaaaauguccugaaaauaaaguugguagggccugaauuggguuugguuacuuugaacucuuuuuaucccuuucuuguaaaucacuuaguuuuccccaggacuuauuaucucucacacucaacccauucugauucuccuucauuuaaacugcucacucuucuguucugugucccaucccugcacuuucuacuguugcaguugucuuagugaccauuauauccucccuccccccugcacgaacuaugcagguuaagcagacauaaccuguaucauuaaggauuuagggacacagccuuccccacuugcaguuucucaagcuugaaacucuaggucauauuugacuccuuugccauucaccagggccaaucuguucucuuugagcuguuucauaugcacccuuuccuccuuguucccacuaccacacuguugguuuugccucucauuugcacuaaagucgccuacuagcuagucacugugucuacagcaacucucucuuucaagcccuuucugaacuguguuacuagauaauguuuuaauuuuuuuccccaauguuucuugcuguauuauuauuauaauuauuauuugguuuuucaagacaggguuucucuguguagcucuggcuguccuggaacuuacuuuguagaccaggcuggccucgaacucaaaauccgccugccucugccucccgauugcugggaugaaaggcgugcgccaccaccgccuggcuucuuacuguauucuugaccuuguagcuagucuguagguagguucacccuaccuugcaauguuagcucccuagcuguuccuuucgaauaugcuauacagcaacccguccuaaaaguagguagaguaaaauguuugcuaagugcucugacauucacacaugggaaagaaauacagaaaugucagcuccacucaguaguaaaauccuucucuucuacagacaauguuaacugccaucuccaugagcgccaucgccacuaacggaguggugccaggucagugcccagccuugaaauucacagugucagugaguaaucacugugguuacgguuuuccagagaacaugaauguguuuguucuguuguucauaggguacugugacagacacuuccuacaagccagagagacaaaugcuguuuagcuuaagguuuugaaaucucauuauuuuuagacuauuuuuagugcuugaauuucagccauacucuuugcuuauaaaauguuuuauuagacuaucuuauuucuuuaggaaggauuccauuuuuuucccuaguagugacaaaauguagaguauuggacacaccaucuuccccagcaaaucuacuuuguuacguucaauuucccaaagucugaaacaucuuuuugugcacauuuuaagauuauuucuuaugacuuguuuacaguucuucuugugaugcuguucgaauucuguuuugucuuguagcugggggcucauacuucaugauuuccagagcccugggcccagaguuuggcggggcuguaggccucugcuuuuaucuuggcaccacauuugcagcagccauguauauucuuggugccauugaaaucuuucugguaagugauggauuaacuguugacuacaauguagaagcucuguggguuuauuuuguccuuagauaucaagguuccugagaucaggcgaguuguggcagccaaugaggugaugacugccugggaccgucugcuuaccaugacucggaagcagaaagguugagguguccuucaccugccuguccuguccccucuggcugauuguccccaacuuuaucaccucagccagggaagucauagcuaaguacaaaagacuuguacauaugucaauggaaaaaaguaacauaaaguuuuucuacauuguauguguguuuguauguguguagaggccagcaaucaaccuauuuccucaccugcuguuccucaggagccauccuguuuguugagauggggucuuucccugggaccuggggcucaacacguuuggcugcagagcuguucagcuccaagguuccuccugcccucaccuccccagugcuaagaugaaaagugcacaccaccaugcacagcuccccuggggaucaaacucaggugcucauucuugugcaacaaauauuucacuggcugaguuguaucccauaccccucuuuuugauaacuuuauaccaaugaaagaguuuuuaauuucucuacucaucuuuucuauagccuuuugaauaaaauuauucauuuuucuuguucccauuuggaaaggcaguauucagaauagcaaauagaaaacaaaaauaaucuacaacauaacauuuuuauagacauucuagagccaaauaaaaauguguuuaauuugcagucaggaauggcacauaaccuuaauccagcacuugggagauggaggcagguggaucucuuugaguuccaggccaacuagggcuagguaaucagacccugucuaaaaguaaaugauuauaaagaagaaaggagggcuggagacaggcccagugcuuaagagcacuggcugcucuugcagaggaccaggguucaauuucuaguacccacauagcaucucacaacugucuguaacuccagguaaaaaggauacaaccccuucacaaaacauacaugcagguaaaacaacaguacacguauaaauaauaaaaauaagaucacuuuuuaaaagaaggauacaaauuaauguuuuggucuuuguuuguuuguuuguuuagcuguccuucacaaaagaaacaaacuauuauagccccucuccuugauuguuuugaaauggccgcacaucuccucuacuucucuuucuucuucugacagguauacauugucccccgagcugccaucuuucggagugacgaugcacucaaggagucagcagcuaugcugaacaacaugcgcgucuaugguacagccuucuugguccucauggucuuggugguauucaucggcguacgcuaugugaauaaguuugccucacucuuccuggccuguguaauugugucgaucuuggcuaucuaugcuggugccaucaagucuuccuuugcuccaccacacuucccguacguaccuaucuuugacauagucagugaugguaucugguaaugugaacauuuccaccagaaugucauggggugauuuccuauugguccaguuucccagaaggaagcuucuugacauacugucuuguuuacccucuucaucacuucugaaauguagaccuagcagccauagccaucauuaagguaccucucuuuaagugugcucccccaacccccuaauaaugaauguguuuaugugaacuauccaugaagggcuuugcagucauagucauuaccaacaaccaauguucaauugcuuuuaaaauaaaaaucgauucaaaagaauuuuagaguaguggucuggagagaggacucuguaguuaauagcugaucuucagaggaccuggguucaauuccuaacacccacccacaugauggcucaccacugucuguaacuccaguucuaggggaucuggugcccucuucaggccucuacaggcuucaggcauacaacugacacacacagacauacagguaggcaaaaacacccguauauccauaaacuaaaucuuuguuuuuaggaguuacccaaauuguuuauuuuuuuucuugguacuguaaguguuaagacuuaccagcuauaaaaggaaaugacugucuuaucacauguauguccccuggacguuccaugccauacauaauaugcaguaaugaagugauggauuuguucagugucuucacucacagacucaccuauugucucauggauuugugacacacaggccaguugacacugaguuauuuguaaucuuguuacagaaguugccuuugaagucacaugaaucagcaggggaucaaauuuauugauauuacgcugauuuaaauuagcuuacagggaaaacaaaacaaaaacuuuauuuuucaugaugaaaaggcagguccacugaagaugaaugacuuuccccaagucagcuaaugguagggcaagaacgugggacucugauuuccugauugcuguuugguauuucuucugugugaugucaguaauaaaucccaccguaaguuuucauuuugcuugcuuagggccauaaaauaagaucuuuuuuagaguuauaaagguuuuagaugcaacaguuuagcuguaucucaacuugggaaauuccauuuugcuucagguuccccuuugggcuucuccaauuuuguuugguuggaaaagaaaucccagugcaagcuauuuuguuuuuuaaaauuccagaauaauauguuuuaaaaaaucaaaccuuugagaaaccaugaaacaaaacuaggcuuguuaaggguuguugaggccaagugauagaucgguggcucauuguguauguaugaagccacucugaagaaucugagccauggguuuugagcucagcaguauuuuacuacggcucuuuuucuccauucuuguuuauguuucuagguaguggaaaaaagcaaagcuacagucaauauuuguauuauccuuaaauuuccuuuuuaccacugggucuagguuuaaggucaaagccaguuuucucuugggccauagagggauaugcuuuuaagucuagucaggcugcccuacaacaguagccagaagacuuagaagagccagcagucccaggagguuaugacaauagacaucuucacguuuccuuuccuaccuucuuucuuuccuuuccuccaacaccccuccccccacaccuccugucuagaaagaaaacaagcaaaugaaaauaugggcauuuggacauuuuuuuuaaaaaaauaagagcagaaguucccuggaauguuauuguuguugcuggcacaugguaaugguguggggguggggcggugacugcccauguguaugccuguguggaaacgaccugggugcuagagaucugagcucaggaucucaugcuuccagaacaagagcuccaaccucacuggaccaccucccuagccccuccaggauucuuuugagccugaaaauggaugaauagccaaauauuuuuuggaagauaauugagcauaguuucuuuguauaguucuuauguuugaaucauauuaccuacaucugucauuuguaugaccuugaucuugggcagaauacugaaucacuguuaaugccuccagcaacauaagacaaauauuaaaauauugugagaucugugaggguuacccuggcagaagauacaugucaccucaguuuaagguguucaucccuauuaccauugcgguaaaaccccugugaggugacguuuuuauccuuuacugaccagcauuaaaaggucuuaaagacuuaguuuucucuguucuuucuucccuucuugaucuuucuccucuucucuguuugcuuugauuuagggucuguaugcugggcaaccguacccugucaucaagacaccuugacauuugcucuaagaccaaggagguugacaacaugacaguaccaucaaaguuauggggauucuucugcaacucgagucaguucuuuaaugccaccugugaugaguacuuuguucacaauaacgucaucucaauccaaggcauuccaggguuggcuagugguaucauuacugguaaguuagagaguuuaacuagacccgguuuguuuuguguuguuucuucuuuaaggacaguggugggaaauaggcguucccaucuuagauuuuucacccucccccuauuuuuuacuuuguauuauaguauuuaauuacucauaacaaugaguuuauuauauuuuauacaugcaugcacauuauguuauuuugaucacauugacucauacucauuaaucucucauuaguuugcauacacacuaaauuuaauuauaacugauuauauguucauggaugguauguuuauaccagcgugggcaccuuacaguggcuucaagacugaggaaaaggacucucccucccacacuggguggguaucaagccucaggaguggguggggucuugugagcgcccccuuccuccucaugugacauauugauagagcccaucuugugcagguaaucagagaugcuuugaguucaaacaugcaagagccagaaaggcaguuugacagauacagcauguccauuuagcaaauauaggcaguggcuuccccacuaaagccaaugaccuagaccuuaauuagugaugguuaugauugcaguuguaaggauugaacccagggaauaaugucugacaagcaucacauacucuaccauugagcuacaccccagcccacugucuaagacuguccuauugaacauggcauggaucccuguguauuuacagaugacuuuaaacucagaauccuuaggccucagacuucugaguacuggcaggauuauaggcauguaccaccaugcccugcauauaucuguuuuucucuugaaauuauauuaaugagcuuccuugcaaagugcagcuguuaaaauuuccccuuuuuugagaacagagauggacaaaugacuuuguagcauaggauaagauaaaauauuuugugaauauuuuuauuuugcaauauuccucaagcuaacuugaaacuccugggcuuaagcaguccuucugccucauguuccugacaagcuaggacugcagggauuugccuuuguaucuaauuuaauguacuccugaaaaauugccagugguuuuccuucagugauagcuaaaauagaacuguuuuaaugucaccaaacacaccuauguuuuccuagacagcuaaauuucugaaauucuuuuguugagugauguccaccuuaaaugucuuguccacagauuucuuccaaguucauacuaagagguuaaaacuguuuugauacuaauuaaaaaaaaaaagcuuuacauuugagaacuaauuuaaaaauguuuuguccacaaauuucuugcaaguucauauuaagagguuaaaacuuuuugauacuauuuuuuuuuaaaaagcuuacauuugagaaauaauuuaaaaauaggcuuuaugggacaugugauuuuagucugcuuaacuuuuacuaaguuguguuagaaaagucaauuacauuuauuauacuaaaauauuuuguaaaauuauuuuaaaacaaauuagaaauaucacauuucauccuauaauacuuacauguguucauguuaaagaaacaaugguucuuuaaaaacauuaaagggcugagguagagagagggcuacgguacaguacuugccuagcaaguaaauggcuccugggucagucuccaguacaguaauuauaacaguaacaauaggcgucucugguugaauauuguuuggguaagaaaucauauaguuguauuacuuccauauugcauuuauccuucuauucucuuucuucuuauccaccccaccccucaacccuuugcagaaaaucuuuggaguaauuauuuaccaaagggugagauaauugaaaagccaucagccaagucaucugaugucuuaggcaacuuaaaccaugaauauguucuugcugauaucaccaccuccuucacucugcugguggggaucuucuuucccucggucacagguaaguggauagggcuguuacuuguuuuaguuggccaucagccacaaugagugagcuuucucaguguucuguuuaccccuagucuucaggaucaguaugaacaucagagugcccagaaagcuaagaaguuaacuugguguuugcccucuagguaucauggcugggucaaacagaucuggagaucugaaagaugcccagaagucuauucccauugggaccauccuugccauccugaccacauccuuuguguguauccuuuuugugaacuugguuugaguuaugguaugggaucaugcaauagaacuaggaugaucaguacuuucaucuaauaguaaugccaucucuuaguaccacuuaaguugccagauaguuggccugcuucauaagcauuguuaaagcauuuuauagaaguaaugaaucuagcaacucauuuacugauaguguaguuauuacauaaaaccaaaagacaacaauaauuuccuugacugucagcauaacagauuuaagcaauguuguccuuuuuggugcauguauugaaggagucguucucagagacaaguauguguaacaaccauaugucuucuucuaugacauuuugucacuagugucaacacauaucaagaaaccagguuauaacuaauaaaauagaaaauguauacauugaucuaaaauguguguguauauauacacacacauauguagauacuauauauacauacauauacauauauguauauauauauguauguauauaugagcuuguauagcacauacaacaccccuagauuugauuuuagcaaaaaaacguuugaaaaggggauuaaaauauaugugcauaauuuagccuaugauaaugugauuuuuuuuuuuuuuuugcaauguuucucaagcuaaccucaaauuucugggauuaaagacuccuacugccucaagcaguaaauauaguacauaauaaggaccaaugauauuuuguaaaauacaacaaaguagcuccuuccuccauaaaaccacauaaaguugucagaauacuaauaaauacuucuuuguacaccaagaauugcuagaaaguuguacaaagguagaucacguuaaagaaacuauuucauagcuccagcaucugcucuacaagagagaggcaucuauuuauuaacacuugggcauucugagugaauuggaaacuaacuuucuucaugaaggcuacuuaguauuuauuacuucuuuucucucucauauguuuugugagauauuuguggaucucucccugaaagcugcuaauucuuacauuuuccacuucagucccuuucacuaggaauguaaguaucuuucuacccuagguguuuccccucauuuucauccaugauccaaaucauuuuuaagcccugggacucuuaucuacuucucacuguucaguggucccaucaguauguacaaggugcauaccuaaauauaauguaagcaauaucacagcaagccaauagccagcaucaaacuaaauggggagaaacuugaagcaaucccacuaaaaucagagacaagacaagggugcccacucucucccuaucuauucaauauaguacucgaaguucuagcaagagcaauuagacaacaaaaggaggucaacgggauacaaacuggaaaggaggaagauaucacuauuugcagaugauaugauaauauacauaagugacccaaaaaaauccacgagagaacuccuguaggagcaaauaaacaaccucagcaaaguggcuggacacaaaauuaacuugaacaaaucaaaauguuuaaauauauuaauuuuugcaauucuuaggaaucugccucaaggaaaaauaucuuauguuucauugaauauguguucauaaugauauuaauuacaguauuucaaauuauagaauacuuguaggagggggcugcaguugggauguaaagugaauaaauuaaugaagaauaucaauaguagaauaauggaugauauaaaacuguuuuaaguagauagaaacaugcaaaguaugcauaaugcuaacaagugaagauuauggaccucuugaggcuggagaaacggcucagugcuuaagagcacuugcugcuuuuucagaggacccagguugaguugccagcaccucccugguagcucccugcaguuuugggcauucugcauccucuuguagccuccaggcaucugguacacaaggaaagaguaaugaaugcucuuaagcgacugugggccaguuuccaccccaaggcagauuaauugccauuacagagaagucuguaaaugaagcuuggcuuguuuuuuaacuguacuguuuguuuuguguccuuaauauguauuauuaauuuuccccuccacaguggugauagggccucagaaauaugcuaaguaaaugauguauuauauaucccuagcccagaaacuuauuuuugagacagggucuugcuguguauccugagcuggccuugaacuugcuguauagacuauacuggccuugaacuaaaaaauguagccuuccuauccccaaacucagccuccugaaagcugagguggcaggcaugugccauaaugccugcuauuaugaaaaaccucuaccuuuacauuuuucaguauucauguuugacucaguucgagacuuaaaacuuaugagcgcugggcaugguggcgcacgccuuuaaucccagcacucaggaggcagaggcaggcagauuucugaguucaaggccagccuggucuacaaagugaguuccaggacagccagagcuauacagggaaacccugucucaaaaaaaccaaaaacaagaaagaccaaacaaacaaacuuacaagcaagaaaacguaacugggugaaugucuuccuaacuuuuaaucuagaguuguuuucaaaucaaauuucucuauucuuucuuucuuucccagauuuggggaugcuguaaaagggaauuugguuguaggcaccuuauccuggccauccccgugggugaucguuauuggcuccuucuuuucaacauguggggcugggcugcagagccucacaggugcgccucggcugcugcaggcuaucgccaaggauaacaucauaccuuuccuuagggugagugauggguugcugugcccgcugccuuuuuuccccucgagauuuuaugaaaaauauuaccuuuuucagcuuuagaauugggagaucauaaauguagggacauguagaguuuuaguacaaggcccucaaaauccuuuguauacauuuauguaugauugcucugaaguuacuuuucagauaucugaaaugggaacauugugucagaggccccaugccugauguuuuuucucaugugcacagguuuuuggucacagcaaagcuaauggggaaccuaccugggcuuuacuucuaacugcugccauagcagagcugggaauucucaucgccucccuggaucucguggccccaauucuuuccauguaagagccacuuuauucucaacuaugguuguuuaaugauaaauaacaugauuucuaucagucaucuaaaaauagugaugauggcagagguaaccaaacauaggcuucacuuuacuuaaaagaauguuccugagauggggcugaagaugugacucgguggcuaauagcaugugugggucuuccagaggagcuacguucaguucuuagcacccaggucaggaggcucacagccacauauaaguccagcucauagagaacugacaccugaccucugugagcacucacgugaacacacaauucaaauaaaucuuuaaaagacuauuccugacaacuuuuauauaccccuaacuuuuauaaaugacugugauuuuauagagggagggguccuacauacaaguaacuuguauaacuuuaaaaguuacucgaaucccuaccuucuuuuccuucuguuuuuccccuucuuuuuuuuuuuuuuuccauaaagcuugcauuugaacccagggccucauaugcacuaggcaugcucucuacugcugagcuacauucucuagccccugccuguauuuuaugagucauuagcaguugauuucacuuuuggcaucuacucauuuaccugugcauuacugaugauuuauugucuaucugacauugggaauaugaagaugucucaagacacugauaauaggugagaaauccaugaguucccauauaguacaaugaaugaagagugguaaagguaacugcugggugccacgaaagcacagcacauagaaaggaaguuucuguagccaguggcaugugucuugaagauaacuaguuauuuguuacgcagagaaggaggcugugucuuacucuguaguuccaggggauucagugcccuuuucuggccucugcagucacccuuacauauaaaaguaaaucaaucuucacucgguauggugguacauaccuuuucaguucagcccaggaggcagaggcagacagaucugugaguuugaagccagcuugguauauauauaucuagacaguucuaggacagccaaaguuacauaaaugagacugucucaaaagaaaaaaaguauguguguggggggagggacuagaagaggauaguauuaaacuagaaguuggaaaaaaaaagaagugcaagccugaacuaaggugagggcacuaaacaagaaaauaaagaaguuuuggaaguuugaagucggcagaacuguaguucuugguagguaaauguaggggaagaaugaauaaggaaguagaaauagggauuaaguccugaucaucugggaaaagaaugguugugcugggcccaagagauggcucagugaguaagagcacuuucugcucuuccagagguccugcguucaauucccagcagccacauggcugcuuacaauuuucuguaauuccaguccaaggggauccaacacccucuuccaccuccacaggcucuuagcgcacacauggcacagagacauacaugcaggaaaacacauacacauuuuuuuuguguuugagacaggguuucucuguauagcccugacuguccuggaacucauucuguagaccaggcuggccucaaacucagagauguaccuacuccugccucccaagugcugggauuaaagacauguucuaccacuaccuagccaaaaaaaaaaagguuucaucagccaagagagaacauuggaagauaaacagauuugggagagaaggcuucuaaaguucuuuaaaugguuggugcuguauaaauaggguuuaguagugcacaggccuccaguugaauuauuauaucauuuuauaauaauuccacuuacuguuuuuauuccuccagguuuuuucucauguguuaccucuuugugaacuuggcuugugccuugcaaacauugcugcgaacccccaacuggaggccucgauuccgcuauuaucacugguaaguuuucaucuuccuccucaucuuucuagaaaucuaggagagucuggguccugaauacauuuuuuuuaauuggccagccacaccauacuauugugauguucaauuguugcuggcauuccuucuuuccuacucuuuccuaacuguuauguaucacuuuauaauaacauaacaguggcagaaacugaguacuucuaaggcucacguccaccuuccccuugcacagcugccuuucuguucucucuuagcugagcacuggcuugcaucaucucaucaguuuucauccucacacuguuaucagaacuucacucaguaacuaagggcgagcugugaaguuagguaacugaagaccuaguucaccuucacuacuuccuuguccaggaaucugcuugaaagcauauagacuccugaaaucuuauuuuacuaauucauaacagggaggaauagcgcuaacaugcacauuaauacagugcucuuacauaguaaagcucucagugaaaagcugugguacugugguacaguuuugccaguccugaaggagccaucuguguuucuuuuuggaggaggggaggauagauuguucuagguuuuggcugguuggauuuuggauuuugguguuuuuauuuguuugguuuuuggguuuuguuuugagacagggucucuguguugcccuggcuguccuggaacucacuuuguacaucaggcuggccuugagcucagagauccaccugccucugccccucaagugcugggauuaauuaaaggcauguaccaccacuguccagcugucaugugucucaucguuuuccugugagcauaugaucguguagauuuuuauguuuguauauguguaccuuacuccuucucuggcuucacuuacuaauacuggccaaugaugggucauuuauguggcaaaaauauauaccuacaacugguuuuaacaccucucauccuuccucuagcuuuaacauuagcuaaaaguuuguggugagcauuuuuaguguuauauuuuagccuccaaaguaacaguucuucuauuuacaagugaacauucgucauagaacuagaaaggcaauacugcaaacaaaggagcuucaguaauacuuuaucuaucugcuguuacuauucaucacuagcuuuucaucacuagauucuacaguuaaggguauuaaauacucauaaaaauguuaggaauacuuacaagaaaaauauuuaauaccacauuuaagauuccugaugguauucaaucucugcuuuuccacauaaguacuaauuguccuugaggcaaacagcacuguagcauccucuucauaguucaugauugccuagaaacaggaaggccuaggcuuuaccccacaugggcuggcgugaaggcucaguaauaguuggccugccuacaugaacaaggcauugaguuugagccacagcacuaggaagaaaaacaguaagaguccuugcuacagcaaacauaugaggaauuuuuuaauaacaauuuucauuuagauuuaacacaaguugugucuguaauuaacuggaaauuaguauguaauaacaacacuuauauaucaguauauuauaauguauauuagcauguauuauauuuauauuaauaugauauauaaacgcaucauugauuauauaauguauaauauaauuuuaauauaguaauauaauuuguuauauuaaucauauuuuauauaauugugccuuguauguuauauuaaugaaauauaaacauauaauauauaacauacauugauaucuauuauaucuuauauuaauuuauuuauauauacauauuaaaaacaauccccaccauagucuaggaagcaccccucaaacuggugucaguccuugcuucuucagauacuucuugguuuauaauuaugauuuucauuuucuagggcccucucuuucaugggaaugaguaucugucuagcucugauguucauuucuucuugguauuaugccauuguagcuaugguaauagcuggcaugaucuacaaguacauugaauaucaaggguaaguuugaauuuuaccccaucacugcugaauggggcaaucaagaauggcuaguuuggggcuggagagauggcucagcaguuggagcacugacugcucuuccagagguccugaguucaauuuccagcaaccacuugguggcuugaaauuauguguaaugggauccgaugcccucuccugguaugucugaggacagugacaguguacucacacacauaaaauaaauaaaaucuuuaagaaaaaaaaaaaaaaaaaagaauggcugguuuggccaugcauguugucacaguagacaggaggcugaagcaggaaaguugcaaguacaaggcugggcuccauaucaagauucucccacaccaaaaaggaaaaaaagaaaugcugggcuggagauaugauagcccagugugguuaguagcacuugcugucccuccacaggaccauaguuuggcucccagaacuuacccagcagcucucaauccacauguaaccccaaccccaggggaucuggcaccuguuuugaucucuagagacacaugaacauccaugagcauauccacacauauacauaaauaacgcucuaaaaguauaacccaaauauaaacagcuuagcugucucaagcaggggaucaucugaaauacaauuaacccugaaauaaccaaaaccuccagcagccuccaaaacugggaaugaauuaucuucugacucagauugcuuuggcuuuacuuccauuauuuugaaaaucacaauuacaaguaauuucugaaucugaauugcuguuccaaauaguuacuuuugaauagauccacacaggguuaagugaguaacccuggcagccuguauugugaaccccucuguagggcaguccaucucacaguguguuccucacgcuagugggggacaacagauaaaccacaagccugaguuuuaaucuucuaccuuguacauacuuuacugcuagauuuagagaauccuggguuuuauuuuuugaacuuguacucacuauaauguaaacugacuaucccucuuuuuucuuuuucucccaagggcugagaaagaauggggggaugguauccgugggcugucgcucagugcagcccgcuucgcuuugcuccgucuagaggaaggaccuccucacacuaaaaacuggagguaaagcagucacaaagcagagcuuagucgugugugcccauaguuaacacacagcuguacucugcugaucaccagauaaagaaaugauguggcucaaggaacuguugaacuauccccuaaccuuacugccuuucuuacucuuauaucuauuguuguuacucugugaauauuggucaguuuuagcuaauacugagaacauucaaaguacccaagaacccucaucuuaccauuccacugauuccauucuucugucaaaguugaaugcuuuguggcccuccugagguaaaggauggagaugccaucaguuucccacacccaccccuucucacucacaucuucccaggccucagcugcucguccuacugaagcuggaugaagauuuacacgucaagcacccucgccuccucaccuuugccucccagcucaaggcaggaaagggacucacgauugugggcucugucaucguggggaacuucuuggagaacuauggugacgcgcucgcggcagagcaggugaggagcacugucucugucugugcuucucaagcaugugugcccugcaggcuuccaaggccagcacugcugugaggaagagggcagucauucucucccagaugguaaaccuuuuauguuaucauagaagaggagcuggaaaauccuuuuauuccuacuaacuucaaaaaugcuuuucugagcggggcauguagugccugccuuuaaucccagcacuuggaagauaaguggaucucugugaguucaaggccaaccuggucuacagagugaguuccaggauagccaaggcuacacagagaaacccugacucacacaaaagcuuuucuguauguacccuugacaacagauuuccuaggaaaucauagaggauaauaaagcauuugaauaguauaauagauguaaaaaaaaucagaaacauuaacccaggugacaaaaauuaauuuuuuaaaaaaucauaugguuacaaaugaagagccuuacccuagauaaccacugacuuaauuugugucuuuggaaaaaucauauccauuuugugcaucauuauuaccuuuucaacaaaggaguaagguaaaaagaaauggguauaugauauuagcucuaaguuagcuugacuaaaugcagcacuaauaauuuaaaugcagguguccuuaccauucaaacaucacaauaaauagaagaagagaggaggcgggggaggaaaccuuaucugaggagauucugaaguaaaacuuccaggaucaucagauuaaguuucuugaaaaaauaagucaggacaugccugggaugacaagaguaugguguuuccacuagugaacucacccugccagucaagccaugucugguguucacuuuuuggacaucccugugcucagugcuucaccugaaagggaagcacgcagaauagaggaaaagggagaggagcuacauguggacagccagcuacagauagaaauacagaugacacuucacugaacacauuuaacuucuugaaguuuucuguugagauaaucuuauguagaaucuggggagagauggaaauacagaagccagagggaacgauaagguuaaaagugcaggauaaagcaguugaaguuuuguguuuuuuuuccucagaccauuaagcaccuaauggaggcagaaaagguaaaaggauucugccaauuggugguggcugccaagcugaaagagggcauuucacaccucauccaguccuguggccucggaggcaugaaacacaacacaguggugaugggcuggcccaauggcuggcgucagagugaagaugcucgcgcuuggaagacuuucauugguacagagucuuguauuaaccugagggcccagaagggggacuagauuaaaucucugucacccuaacucuguccuaaaguagagaccaugccaugaaacauacuguuagacagccaccuaaaacuaguaaccugaugaaagaaaggggacuagauuaaaucucugucacccuaacucuguccuaaaguagaggccaugaaacauacuguuagacagccaccuaaaacuaguaaccugauguuagcccgccuucuucaucuuuacauuuauguccacaaaguauuuagcuaugucacgucucaaacugucauauuccauucugaugaccccacaggaacuagaaagauucuuucgucagucucugacaaauucaugcauuaaauauguaguauaaaguauccacaguuaccuaaaucacgguuccccauucaauuaguaguuccccagacuucagacagugaucucugcuccuuaaguguacuguauuaugucaauaggacgcauuauucaaagaaaugucaauggauguuaccuuccuuuccugaaauggugggaagcaaagcccagagauuguuugcagaucccaauuugcucuucucuccacaggcacaguacgagugacaacugcugcccaucuagcccugcugguggcuaaaaaugucuccuucuuucccagcaauguggagcaguuuucugagggcaacauugaugugugguggauugugcaugaugggggcaugcucaugcuauuaccguuccugcugaaacagcacaagguauucugggucaccacuuuaccucuugcuguaauggugggacuuaaucugaagagacagggcuuguucuuggcugucccauaaucccagcuccagccuuaugagaaguagaguggguuuaagguuuuauuuuuuaauuuuacuuguuguuauauuuuauaccaguccuccuuaagugaauuccugcaagcuuacuaaaauuccuguauaauaguguuuagaaaaaacaaaaaacagagaaaccaaauacaaggguacaucaguuucaggugcaguccucacugcucuggaacucgcucuguacaccaggcugcccuugaacucagagauccaccagccuuuaccuccugaguucuaggauuagagauaugugccaccauacccagcucucuauuaaauuuguaaugguaucauugcuaugcuguuugaauaaaccacucaguguacccugagugcggauauguuuuucccuccccauaugaagccagcagcuguucugcagugggcagcaguuugguguccucuaaaucaauacugacauaauuaucuguagguagcacuccauccauuuuaaacugauagucuuacacugucuuccugcaagcccugauuauucuaccccugcucugacuuaggagaccaauuucacaauaccauaugagcaaauuuuuucuugguaaugaaauuaagaacuuaaaaccaggaauaaucgggcaguaguggugcacgccuuuaaucccagcacucgggagacaucggauuucugaguucggggccagccugcucuacagagugagauuucugaguucgaggccagccugcucuacagagugaguuccaggacagccaggacaacaaagagaaacccugucucaaaaaaccaagaaaaaaaaaaaucagaaugugaaaugugccaguaaucccaccucucaggccaggccaggguuuaguguuaacuuagaaaauauuuuauguguugcuuagucagucuuaucaggaagcaaggaacaaauacuugauacuacagcaaggucauucuagauauaaauucucuuuuuaagaaaucacuuuuucagggcuggagagauggcucagcagguaagaacgcugauugcucuuccaaagguccugaguucaaaucccagcaaccacaugguggcucacaaccauucuuaauaagaucugacgcccucuucuggugugucugaagacagcuacaguguacuuagauaaaauaauaaauaaaucuuuaaaaaaaaaaucacuuuuucccuucacgcaucuaacuuuccauguacacguggcguugugucagguuuggcggaaaugcagcauacggaucuucacaguagcccaacuagaagacaacaguauccagaugaagaaggaucuggccaccuuucuguaccaccugcgcauugaggcagaaguggaagugguggagauggugagaaguagaguuugaaacagaagagacuaacacgccuucagcccuagcuugcuuucuaguuaguucaggacauuacucagcuguaaaugugugcuuuaaucaccuaggccaaccaaagcccuaaauaacugaccuaaguaaguagaccguguaaauguuugcaauugauuucuuugcuuucuuuuuaaaacuuuacauuuuuauuacagaguaaguguguaugcguaugggucggagggugauauacaggauucaguuuuccuucuaucauguaaaucucuggaccugaauuugaggcaucagauguggcaacaagugccuuuacccauaggaucaucuuccuacuccugggcugcuuuuuguuugcuuuauuauuuacuacacaucucuuacauaggucccaaauucuuagcuacuuaguucauuaauauuuaauucaugcuaaaaagucacacuaguuuugugugcuuuguuuuaaggaagugauuagaucauagaaaacacuaaaacccucuauuuaaucucaugccccaaaccauguguccuuagaaccaaagacugagcaaaguaggagggagagguugcuaugguggcaggucuucugaauuaggucagguguaaaaauaaaaaugggggaggagggcuagugagacggcucaguaggaagagcauuagcuacucuucaagaggacccguguucaauucccagcacucacaugacagcucacaauuguuuguaacuccaguuugaggggaucugacacucucacauagauacauacaggcaaaacaccaaugcacacaaaauaaaaauaacaaauuuuuaaaaacaacaaugugugguuaacucuuccuucugccuacuuugugugcugucugucuguggcagcacgacagugacauaucugccuauacauaugagcgcacccugaugauggagcagaggucccagaugcuucggcauaugcggcuguccaaaacagagcgagacagggagguaagaccuugcugaguucaccugacccuguucucugaggcugaggccugucagugauauaaagacagauacuuccuccuccuguuucuuaguuacuccaguagaaccuaccgucuucagaacauuuaagcaugagaaaaagaauaguaaaaauaacuguguuugacuuucuccaggcacagcuggugaaagaucgaaacucaaugcuacgcuugaccagcauuggcucugaugaggacgaagagacagaaacguaccaggagaaggugcacaugacuuggaccaaggauaaauacauggcaucccgggggcaaaaggucaagucaauggaaggauuccaggaccuacuuaauaugcguccguaagugugugcacucucaagcuuauccuaugauacaguauccuagacagugguacauaugugacugccugaacacagucacaaagcacgaguguuuucaucuuaccuaaaucagcuauuauugucuacuaaugaagauuagcucccaguuuuaaacauuguauacaaaacaagcuaaccaucuuuuucuccuccacauaguuuauuucaauauuauuugucuauuauuauaaaauaggcaaauggaaugagaaaacuaggccaaugagauaauagcuuguuaggcaaaggugcuuguugccaagccuuaguacugaguucggucaccaggacucaccucuuuguaaauugguggaaggaaacccaacucccaaagagcugccuuccuacacacacacacaaccuuuaaagaaugagaaaacuagagauguuaaccuaacaaagaaacgaucacacuauccauagucaagugaaaagacucugagccucaaaauaaugaguaugugagcuggucuucuuucugccuuaacugugugauuucuuccccacucagggaccaguccaacgugagacggaugcauacagcagugaagcucaaugaaguuauagucaacaagucucaugaagcaaagcugguuuuguugaauaugccaggaccaccccggaacccugaaggugaugaaaacuguauccuuuccgagagugaagcagccaauggggggaauucuucucaagacagcuggauagugguuaaagucagucaguuccccauuuccuucucuaaggaggagcuuaaugucauagcugaggccacuuccuaagugagauuaaccgaucgggaagcuggggcagcggauuaucaugaucucagugaaacccaagaauaccaagguggugaaucugcagagacuuguaguuuucagugauaaaccuggagacagaacacacaucguucuccuuuucaggauccucgcucugcaaagcugcuuuuggauggaguuagguaagaagcacuugaaacuuguuaauggaacugagaaaaagaccaaggauucugcuucaucccaggguugcuuuuaugggaaaccucccagcccugcagugacaggacuggcucauucuuagcaacaccauugaggaaaacagggguuguuuuauuaaugaagaaacugguaugaaaaucugacucaugcagcuucacuuagaaauuuuguagguucucucuagagaucuuuuaagcugguuuuuaaaaaaaacuuuuucuuacuuggcauuuugucaaaaggauaacauauuacuugugaauucuuuuucauuuuugauuugugugugcauacaaauuuauagaggcauaugaaugcacacauacuauagccuguauguggaggucagaggcaaaucuuugagucagucaacucacgucacuaggcuuuuguacagcaaguguuucuaccugccucaccuuaucccccaggccuguuuuuuuuuuuuuucaggugugucgcuugcacguaugcaggucugaaguguuuguugaauuuucuagagcugaguuagagaugaucaugagccaccacauacgugcugggcacucagaccuggguccucugugagagcaucaacugcucuuaacuacugagacauaucuccagcaguuaaaacuguuuauaugaggcauggugacucacacccuuaauccuagcauuggggaggcagaggcaggcaaaucacugacuucagggccaguuuagucuacauaaugaguuucaggccagcuagugugacacaauagugugggagugggugugcacgagugcucucaggacucauuccagggaacugaacucagguugacaggguuauacaacagauggcuuucagcaguggggccaccucacuguuaacucaguuuuaaaucacauuuagaaaauaaauacaggcuggggcugucacucagugcuagaauguuugccuaacaugcauaagauuccugguucagauccaaguacuuggagcacgggaacaaaugagaaugucuuguauuaaauacacaaaggcucuagauuccacgauuauuucauaaguuuaaaacugaauccaauuccaggcuuggugguacaagccuauaaucucaggaaaauuuacacaugucugucuggaugccauagcuagucaagaucagccugggcaguucagugaggcccugucucaggauugaaaacaauuaaaaccagagccggugaagcagccgcacagaguaguguguuugccucgcaagugcaaggcccuagacugaaugcacagcacggccgagugaaugagugcguggauauauagaugauguugagucaaguucaggcuuuuccuauucagagcaggucuaugaucaaauaaacuuagauuacugaugccagguuauaaagugcacuacugaucauccuauuuccuugacaacuucugaagacauggaauuucuagaagugcucacugagggauuagaacgaguccuucuuguccggggugguggcagugaggucaucaccauuuacucauaaucagcugugggagauucugcgugguccgacuucccuaagacucaucguccauggagaugauagcucuuuccuaccacucccacucuauucuugcagagcugagccccaucuaugcucuuggcugcaacaugaucugccaucccagcagaaacaaauaaucccucaacagaagaauggucaaguccuaaaagcuauuucuauggcaggagaaggcaagucaaaauuaacaagcuaagccaaagggaaccuuuuggcacacagaagguaaugaguuaguaaaacauaugcuagaaauguaacuggcaacagaaagcaauguucauaucuaacauucaggacgaguuucagaagacacgggucagugagcaccagaaaguuaacaggcaguuaagcuucaccuuaguaaaaaaugaguucccauuauagagacagccugcagcagccaggauggaaacaggauacugauauauaaaaccugagacauagcugcagccacuacuucuuccucaugguuuauugucuguacuguaccacuguacauuuuaacugucuuuguuuuaaaacccauucugugguuauaaugcagacaguaguguuacuauagaaauguuuuuuugaaaggcuagaaauguuuuuucagguuuucaaaugcugaacuaaggggauuccaaagagugcguauuaaaauauauagaaacacagugguuagcuaugcaacauaaagcacacaagcuauuaucuuaacaaauguggguuguuauguaguuaaccagaagggucucuucuacucuuaguaggcauuggucuuaaaaaccaaacaaaccaaaccuguaaggaagagacgccagggcugugugaugccaccuccaaggccccaggguucagagguucagcaguggaacugggggugugaaagccauacccuuuccacugugccaaaaucgucugccuacacuggcagacagguuugcaguggccugacacaagcaccuuuucuuucacaagaaauccaucuguggccucuucaccaaagccauagugcagauuugaggcacucgaccuccaugcccagagcuuuucccgucucaauauuauuauuauucauucugacuucggaaacuuggcucugaaacaaaugguucacuaagcuaaugaucugcuguauugguuuugcuuucaaaaagcucuaacugugccaaggaaauacuuguguaagaucagauuuuuuuuuuuuuuuuaauuuacugaucacaaacacuuggcuuaccagcauaggcagccuuuguggcugagcaguauucccagggugugaaaccuccauacccuuuccaagauaguuacugaagaaacugucuucuugcuuagauucacggcugcuuuuacauuuccuuucacugacaguaaauugugccacucuccauacccuguaggacaaugaacacccagaauucaacccaagacagaagaaaacccucaaauauggcuuaagaagcugagucauaugguuuguucuuccuccucccaggcccacuugaguagcaaaggauccagcauguuuuccuuugcuuccugcagaggguagaaacuacucguaguucucuuuccaacacuccauugcauacuugaguauaauccccuaggcuccaaggcauuggagcgcccauucuguaaaagccagccugcccaggaacugccuaacacauccaccccugaccaaagugacacauacuuuuuccauaucaaacaaacaugggaagagaauaagguuucuuuaagaaaggcuguuugugguuagagcuacauaagaaucuguuaaaggguagaguauagucuucauuccccaagauaaaaaucacuguuacauggacaaaugguuauuaggccagauuuguacucaucucugucuagaacauuucaugucuauguguugcuuauguugucugucugcaaagugucuuagcucuuuuaaucacugcaaauaaagcaauacugaaaacuugagagagaaaaugcaccuuaggggaaggggccaaauguuucuagagggaagaggaagaccuucuccugccuucuuauaagacccagcuugugucuuacccaugaguuuauuagcagggcaggcuguaacauucguucucccccaacugguccucagccuuccguagcuaccuuaaaagcuggaguuugaauugcagggccugguugacaggugccagcuuccucguggcagagcaaaagcugcugcuuuucauauucuguugccuccuuuucuuguggccccaaggaucccaccaauccucauucccccuaaauguuaaaagaaaauuccuuauuguggauauuaaguuacacuguaagcauauuuacaugcucuuuuuccccccugguuuuucuuuucaucauguauaauuugaauccagugauagucucacaucuuccaaaaaagucugcuuaugugauauagaagagaaauauuaaaguagacugaaggggaacuugugaaacauuaagcauuguucucaaccguuuaauuuauugaaaggagaagcugcuacugagcagcugcuauucuuuuguuuacauagagucugguuuuguuuguuuugcucugugcugggaacauaaauaaaguuuucuacauuauuuucagucauaaguugugcuguaguuucuuuucugcuguaacaugcugcacacuggccucaccacaggaggcucuucuccacaugcaugacuguuuuaagggaggauauuuaggagucaacagcuuaaaaugcagaugagguccauaugcauggugcuuucugggggucacagaaguaagccuccuccacugaacuccauucucuaaaaaaagaaacaguaaagaggucaauggcaaacaacuucuuaguuacuuuaucacaagcucugcuguacaugaccuuguaacugccaaaugccuguaaacuuccaaaccuguguuguuacuuaagaaaugaacacgugggcuagugagagugcucagaggguaagggcacuugcugccaagccugaugaccugaauucaguucccaaaacccauauauucagucggaaguugugcuaucguuuguuuguuuggguuuuuuuugccagcuaacuugcagcaccaaguucucugaccuccaaaacacacacacacacgggcaugcaauaaaaaauguaaaagcuuuaaauaaagcagcccucaauaccaacauccaaugagcucacuagcuguucacugcagacucuguuugccugaaauuuaacuuuaaccauaccucagggggcucaauaaaggcuagccagucugaugcauguguaggcaacagucccauggacuggcacuuguaaacugccaaugccaaacccaucagguucccaaugagauagaccaagccuugaagaaacuucugacuugaacucuccagcaucuugaaagcuguugggauuaacagacauugucaacaccauuuuccucccaauaugaaaccuagaauuuaaacauacagccccaaaauaagauuauaaaugguacgacgacuaccacuaccaaaauacccucuagcuaaaaauaugccaaagaauuggccuucauuccuuagcacccagggaaggaguauuauuuucugaauacuuacuggcugaaauggccauaagugcuugaaugggucgccaggccaucauacacaccaucauaguagggaagauggaaaugguguugccugccauguacaugaugaagagguucaugggaaucugcuugaggggacccaaggcgaugucccagcagcgcuaaaauaaacacacgguuuagaccucuaaucacuccccuucagucucucguguacuguacaacugaucuuaagucaugugaacagaagcuucaguucucugcuagacugaacuggcuuuucagcuccucuuuagguugcuacaaguugcucuacuacucuaccccugugcuuuuucccuauauaaacuuucuggggccuuuuguuuuucaggaucauuccucuguguagaucuggcuguccuggaacucccucuuuaaaccaggcuggcuucaaacucagaaaucugccugccucugccucccaaguacugaaauuaaaggugcgugcuaccacugcccagcaaguuuugagaaauuuaaaaucuuuuuguuacuugagacaaggucuugguauguccagguugaccucuaaauugagaccuuuuuuaacaucccccaaaacuaauaggauuguagauaugcaccaccacaccuggcuaaaauuccaugaucuuaagaacaugugagaagacucagcaucuacuucaugaaagucagggaaaggggcuggcgagauggcucagcggguaggagcacugacugcucuuccaaagguccugaguucaaaucccagaaagcacaugguggcucacaaccacccauauugagaucugacgcccucuucuggugugucugaaggcagcaacauuguauaauaaguaaaucuuggagaaaaaaaaaaagaaagaaauuuaagcagggugugguggugcacgccuuuaaucccagcacuagggaggcagaggcaggcagauuucugaguucgaggccagccugggcuacagagugaguuccaggacagccagggcuauacagagaaacccugucuugaaaaaucaaaaacaaaaacaaaaaagucaggaaaagaacaaacuaaaggauuuugagaagaaaacaaaaaugagagcucaucaaaaauaaaauuuucuuuuugcaagauuauaaauucaauucugguaagccuggaggggagaaggacaacucuuccauguccagagagaaggcacgcagcuuuacagacccuccaggcgucacacucaccaguuuagaaacuuguggacuauuugaaaguuucggaaauggauacauuccuagagacaugacuuaacaaauugcauaaggaaaaacaguugcauggcaauuagcaaagcugacccuauaauuaagcccagaucacuuucuuggcaaauucuaacuauuuaaagcuaaaaauacaagucuuacacaaacuccuuuggcagaaaacaaaacuaaaaauucuacaaaucuuguuaauacccaaacccuaaaagacuauuaugagauauguauguaugcauguguauuuuuguauauauacaaaauaaaaaguuauaauacuuaugaaucuaaaugaaaaauccuaacaaggcacuggagaagugacuuaguguuuaaaaguacucguugcuuauucaaggggaccaauguuugguuccuagcacccacaugguggcucacaaugauccacaacucuagagcugggggauccaauaccuucuucuaaccugagagcucuaggcauaauauauaugugcagacaaaacacugauaugcguaaaauaaaccuaaaagaaaauaaguuuaauccuaacaaaguaugaaauauauaaaucuauguaaaaauaaccauaacuauuuugauuauucacauuaaaacucaaccauauuuguaaauaacuuucuguagaauacagcaguuauacaaguauuuuaugauaugcuuuuaaaaaucauaucauuuaauaauuuguaaucauaauuugauauaccaagauaaaacauuacaggauaauacuuauccaagaaugacuaaugacugugugugucauuuucauacuguaacaacugaauguauguauuccauggaaucaaaauuauucggcaaaacuaaggcugcaagggaagcauaaacgcaagaagauaccaagcacccucugcacacugggacucgugcugugacaguccuguaaaacagcuacuaaggcagaugcuaaauaacauaagccaugugauauguucauaacauauaaaucaaacaguguggcacauggaaaggcuugacucuguaauauuagagagaccccaaaggagggacuuagcaaguuaugaaggaauccugaggaagagcauucuaagacuagagaacaaacacaaaaagcagggaagggggauuugucugguauccuuacagagcagcaagggaaucauuaugaaagaguaaacaaauguaaaaauaguagacagggcacaguagcuacaaggagucugacugguacaagcagaguuaugucuaauacuaaaaagacguuugguguguacgcggaaugaacauggaauuuuagacugauuuugaguagggauggucuggcauguuuuaaagggaucauuuuugauggcuguguuuggagacugcaaagaggacaagguaggacauaacaagacccauuagaacuccauacagagaaggauacugagaauuugagaaggggagacuugaauauaggaucucagggguuuauuugcagguauacacaaagcgcaccucuuuagaccuagaaaacgugguaaugcuggaaacaucuuuaguucacacaauuaugcaaagccauagugguaccuaauguguagagaucaggaguacuaaacaucuuaaaguaaguacccagcauaauucuccccaacaacaacaaaaauguacuuagccccaaagagaaaacagagaaaacagugcugagguugagaaagcaugauuuuaaauagagggauggagggauaggugguagaugguuagucuacggcuggugauguaacaguugaaggcagugagaaaugauagcaggauugggauguuuucaggguaaaagugacacaguauccuaacacaccgaaauuaugucagggaacauauacguaagauacuguaccauggaucuuaagcaaugugucuuaaugaccggcugcuuuaccuccacuccagagaguaaggcgaaacagggcuggccuacacgcuacgguaacgucuaauaccucuguaccuucuccaccaggauccggucggucucuugcacgcugguaucaggcacuugcuuguccaaguaaccgacuggauagagggagucucccuguccacugccccggucacuucggccccuaaagaaccaaaccaaaucaagagacuaaaacugcggguuuccagcccuaucaaucacaggaaaaagaaccucagauguagcuacccaaauuagacccucucgugcguucgucaguucucucugccuauugggaaaacuaaaagauccuggggaaaaauaccuuccacagcacagaagcuccuuggguaacaucuaugugcuacccacucgugucggagacuuagacgaggcccagguccgcuggaucucgggccguucuaggguaaggaucagauaccgagcuucacucgagagacucaccugcugccuccucccggcccacucagcucaauggcccauuugaaccgccggccucgguuggccacuaggccccccugggucgucaugacagcggccgcuggcuaaaaguacccacacccuccggccgcuugcguucugcagguaagaacuagcugcaacugcaagcucuccgacuuccucgcguucgccgcagugcacuuccggcgcauaauugaacgucacacgaucaccggaaacuuccugucgggaauacagaagaaagaaugcgugaauuuagaaaauccgcagacauccagaagagcagcuuucugaaaccucccugcgaguacaccucucacuugugcucugucucucaggugugcgccaucgugcuggagugaaguccgaaaagacaagaacugaagccaagaagagcacgaaauugaaauguuguuuuaauccugggguuauccggaauugggugaccuugagcgaauuauucaaccucugaguacuccguguccacauaucgcaggagcuauguauuugucuuguuguuguucuuguuuaaaugguuuucccccauuuaacucgcaaacuaacccaccgagguagacucugggaauggaaagauaagcugaguucaggauuuaucuggucuccuuuuaaguccuuucauuacuuacugugccaccucgucuaaauuaaauucauugcuccaccugccucaugcaaaacgauggauaaucgccuaauuuugaccuguugugggauuaaauaggaccuauaaccuagaccuaacuuuuuuuuaucauuaagcguuaucauuccuagaaaggaguuuaauauucaauggcucaucuguauuguaauuuagucuauuacuggaaaaauguuuccucccucucaccccuuuuauaauucaguguuagugugaaaaucacuugggacaucuguuccuauuguacuaggaguggaauugcuacaucuaagaguauguacauuuuuaaagaauuacuauuuuaaaugccuacuuuuaaauuaucaguucaaauacaguaguuuuguuuauuucuucuauuuaccuuuauuacuguuauucccaaauuguuuguuauggcuguaguuuugaggaaaggacuacugugacaguaugguugaggaucuggcugaagaauaccuccuuagccaacuuaaguuuuaagagauaaucucuuagagaugacggugaucugcacacauugaagauucccaccuccacaucauuuuccaguuuuguaguucuaugugcagagaagagaaggcuguguaugacauacaguguagcagaguggcggagggugugagauuuuaccagcuauucagaacacugcaaccuaagacauuagucuagaauuuuccauuuaaaguuuguagaacacaagugaagcuaggagagcuacgugcagauaaucuaagccacgaaaagcaaaacugaugauugaaaaguuguaauuaaauaaguugucauuaaaugugccacgguagaaauaaguuagaauuauacauauguaaaacaaaauauaaaauagguuaucuaucacaaauguuaauauguguuaaguaauaguuuucagguaacgucuaauuuuuagggcacucgugugcuaauaaauuuuuaaugagcauauuuuaaaaacaaacuuguuugauaaaaucgcauuuuucuacuuaaaguauuuccucguuauaugaaacuuuaaacuauaaaucucaguuacucuguccucaaggagucagccaggaaguguauuccuucaccccgagaaucuuaaaugucauuugcuaaguuguaucucaggaagacgaagccauuggaacgagaugcucacaucugcgguauuuucaguacuguuaguauaaugugauaagcuauuuacaaagaugacaacaggcagauauggcugcacuggcaugucaaaccacaaaguggcugccagcauacauguguuuuucaugacugggugccacaagaccaccccucuucacauacuccaaggagcugagcacugaggugaccagcucuucagugccugcacgugggauauguucugcuaacugggcugccgaccaagugccagcccaguguggggauacacagggggccuccacccaaucagaggagaaggggacggggacagggacagugagugggauguaaaaugaauaaauaacaaaaguugagcacugcccccagccccagccucagcaugccuggcuuucucagccagugaugccuuccaagcccugcacauugaguccuucuccagcuuccuccaaaguuuucagaagugaugaaaccacgggauucuggacgcagugccaaugagcaagcugugcaaucaagggccccacgcccauccccuggaggcccaucccccgguuagaaagauuuaacugucaaaugguuacuagagaauugcuuuuaguuuucuuuccuuaucugaaguuagguuuuuguuuucuuuuuaaaucuauuuauuuuauacaaggucccacuauguaccccuggcuggcuuuaaauucagagauuagccugccucuaucuccuaaaauuaaagauaugugguaugaucagggccuuuuuuguuuuuuguuuuuguuuuucugucuuacaacuccuucaguauccaauagaauguaggagacuacuuuaugcaugugggaaugcuucaggagaaaaaugaagggcaucuccacaaacuucacuugcucauuuuccuugucacuuuuuuuuguuugauuguuuauuuguuuguauuuuauuuuauguuuuaaacaggguuucacauaguucagacagccucaaagucaucauguagccaauugauagccuugaacucuugaucuuccagccucugccuucaaguguugggauuauaguccugcaccacuguggcaagaucugcuuauucuuuugaaaagauuaucagacuaucauuaaaguagagauuugugaguauguguuugugugugugugugucugugugugucuguguuuuuaaaaaugggguuuugagugugcuuuguaaggaaagggaccgaugugugugugugugggggggguguuaaaauaauuuuuaggaauuuuaaaacuauauauguguguguguguguguauauauauauauauauauacauagauagauagauagauagauagauauguguguguguguucuugugugucuauguggguauaugugcauauauguacaggugucugaggaggccaggugucagauugggagcuuguguuacaagugguugguagcugccagacaagggugcugggaauugaacacauauauaagaccaguacaggcucuugaaccucugagccauguuuuuuguguuguuguuguugguuuuuuuuuuuuuuccauaagccuaggaaauguggauucuaaaccugaauggcucaauuagggacccucuugaucuucauuuguaaaacuuagaugauuucuaagggcgcccucuagaucuaggauguauuacacuugcugucaacaaauaauaauuugugcugguugugguggagucugccugcaaucccagcacucgggaaguggaagccagaggauauugaguuccaagcuagccugggcuacauugaaagacacuuucaaaaacaaacaaacaaagaaacaaaaccauuuugcuuacuguccuuuccauccuuauacacuccuaguaaagaaaaaacucaaagaaauaauaagaucucaucuccacccccuccccacuccagacuaccugggucucuggauuaugcuggaaggucuuuuagcauuaauuauagcaauuuucagccuagaagcacaauggcugcuugggaggcacauauggggaguacuaaaacaugcuaaugcaagacuucguuuuucggggcucuuugcaaggauggcuaugggugaauuuguaccagaacagcagcuacagucaccucaguuccaccuuuauccucucaauguuucccuuggauaagacacacucagcagcuuccaauucaaagcaucaaaaagcugugccaaggaagacaaauaaugcucuaugagcaacuggaagcauuuucuguauugcuguauggacauacacagcaacacaaauugaaagaguggaaccugcacacuauuggcagggccauucuauagggcaagaucaguaaucaugccagcuggucuccuaaucaaugaguuguuucaaaaccaacacgcaggugaagccaaguaaaagcaucauguauucacaaaagcaugacacacugaagaaaguaauguacuuuugaaaccuuaaaaaaaaauuaguagugccuggacacugcuuccagcgauugggguugacucccucugggugggcccugggaaucagucuuucuugugguucuuuugauacugcuauacaggaagaccuaaaaagcacggaacaaaaguaucucauuaaccuaaaauaacaaaguuuggguuuuuacaaaugaauuugagaaaaaaauuaucaguuuuugaaagccucuuugugugccucuaacugcacuagcagugauuuggaaaacucaucagaaauacuaaaacugcgaaauaaacauuaaauuucccuuacuuuguauuuuugagcaaacauuuuaaugauagaaaauaggcaacucucaauuugguagcucaugaguuacuuuguuuguccuuuauauggcacaccugcacauuuuuugacccaucuuucagguugaggaucaaacucaggcagggauuccugcauacuaaauggcuaccuugucccugagcuacaaccuccucucuuuuguauuuguuucuguauuucauucuuugccuccuacuaggagucagaaaaguuauuucacaccaaucuucuccaaccuuuggauuaacaccugaacaaggaaagucuuuauucagucagauuugcaagaaugggaagaauggauaacucuaaaggaauccuacagauaugaugugagguuuuuuuguuuuugucuuagcaucugacagcaucuuuauaacacuucuguuugguuauccuuucuuguccaaucaguuauuccagugugcucuaauagacccugaaccuuuuguuaugucaauaaaauuuugcacauuucuuguuguuuugacaaucucucaaagaccaucucuuaugaagcauacccccacccccaucccgugucaguaacggggucuuaaaaggaaauguucacccucuauuuugucugucugcuuucacaucacaugaguggggugaugguagggaaguccauuccuugcuaauuacuguugggugaacccuaauucuaauuuuuuuccuuuuccaguucaugacugcagugucaugaaauacuccagccaggauaacaugacuaaguuaguggugugguguucugaaaugauguugauucagucaggccacucuucuuggcaguuaccuuuccuucauuucaagaguguugugcaauucacuuguaacaaguccccauuauucuucccuccagcacuugcuuaggaagcugggaggguugccauucccacagaacgcauuaaaggauaagaaugacaaccguagcaugagucauaaugauacaacacugagggccugacaggccucuccacguuagguuacucugaauccaucaacucauucugaagagcaacuuaugccucuucagagugggcuaaacggucucuaaaucugaaugaccaauucaauuccuuuaggaaaaaaauuucauuugucuuaguuuuuaaaacaacaaucaguucaaccuuagauuuuuaaaggacuaugauggacuaaagaucuaugucucucacagcuaucuuauguugaaauccuaaucccuggugugauguauuuuggagauagggcuuugcaaagcauuuaguuuggaugaagucauaaagguggagcccucaugauagcauuaguaacccuguaagaaaagaagagacagaaaauagcucucuucccacuacccaccauuugagaaucuggugagaaagcagcccucugcagacaugaagagaaccauaaucccugggcagaaccagcuuacacauugaccuuaaacuucccugcuucccgaacagugaggauauugguuucugauaucuaagccacucauacuuuacugugucagcccaaacaaugaauacaaagggaagcagaauucaguaacauuuauuacuucaaaagauaaaaucaucccuuaaaacacauauauggggagcuggagagagugcucaguggauaaagucgcuugccaccaagccugacaacaugaguuugaucucugggauccacauggguggaaaaagagaacugaccuauauacacaaauauuuuaaaaaccacacauuuaugaauggaguguuugauuuacucauuauaucaacacaaacauacuaaacucuauuaauuuacucuuauuuaaucuguuuuggguguccucuaugucuguuaugucuagcucauugcuuuccaagguugcaaaguauaugcaguauagaugcaugcuaacuuagccaaucuccaaaagauggacauuuagauuauucccaucuuucacuauuacaaaaacaaacaaacaaacaaacaaacaaacaaacguugcugugagcauccuuggguaccugucacuauaguucuguaagagaaucaugcacuuaggaguugaacuauugauagauucaaauaucuccuauaaaauguacugcuucccaacugugaagauguaagaggguugcauaugcaucagacacaaguugucuucucaacagacuucccaagcucucuaucauuucccucuucuauccacgagaaacaaacaaacuugcuauuacuagcaccaacccaggugucaguauuguguuugaaacaaucaugagugcaguaaaacaagagcugccuuaucucaugcugccgcuacuuccucccacagccugcacaggaagauggggauugacuucgccaaagccaacuggcuggaauuuuccagaggugcuggaagcagagcaguggauguugcuuauggcauaaacgaucuguugcugugggcaggucucuuaaaacaguguccucuuagcgacagucugagugaauaaacauaacauacaaggcaauugaugcccuaguucccuaaaccuccaaaccaaaucuucauaacuaagguucuugccaacaguccuccuugcccaucccuuggccauccugcaaccuggugacagaucaguuggcagaagaaggaagaaaucgucacugccuugcuuaggagucucagccucugcugcauccucuaauaucuccaaccaccaacucuugauaaacccaggugcuuacaacauucuggguaccuacuuaaguuuucagucuucgugccugucucucuucaaagcugucuucacuagacucaaaucgggcaaacagugauccuuaaacuuacggugaauuuccuguucucugucuggaauagcaggccugucagaaccguguccagcucgguaggcccuagcucaaagccuccuucacacucuuaauuccacuaagaagugcacauaggucuuugcauagaguucuuuauucuguggggugucuauggauaugggcuucuuuauacauugccaccaaguguuccuacacauagcagggaaugaggcaggaagacuaacucagcuguuuauucacucacaagggaaagaugaaggaaggauaggauuccuugcagacugcccacuguaaagaccuggccaccuuuuugugcauguguauucuuguugggacauggguuauucuuacuuauguucaugugacugcagguaccugucucuguguggcugugcuugcaugugugugcaugugaaggccaggggacaaccccagugguccugccacagguacuacauuuuguuuguucugagagagguuccuacuauccagagccuugaccgcucuggagcucugacugccucugcuucuaaagucuugggauuaaagucaugugcugccacaccuggucauuuuucaggggagugcaugcaggggggggggguguuaguaaugaagucugcaggcuguggguuucuguuuagagaugguucucuagauagugaccaaggggagaagaaaaauauguaacccaggauagccucaaacuacugauuaccgauccucuuaccuuuguaucaauuauccuaccaacacaugcaccacaacugacacuguguuguuuguuuuuuaaugugguaugugcaguguguguguguguguguguguguguguguguguuuacaugugcaaaaacuggguaaggggagaucagaagaaaacucacaggaguugguucucuccuuccacccuuacaugaguuccaucaguucuggaucucauauuuauuugauacaggguggcaguccuggaauguguuuuguagaccuggcuagcuuggaacucagagaucugccugccucugucuauauuccuuccccacccgcagugcuggguuuaaaggccagcgccacuagcuccacagcccuccuccccauuuugaguaguuuaccugcuggccagggaggccugguauucacccaccugucuccaccuccucauuacugggauuaaaggcaugugccaucacugcuagcuuuuaaaauacggauugauucugaggauuguauuugggucccugugcaaagcaaguacuacagacaaacggaacuauuuccccaggcccaugccacacgucuuuaaggaaagaaaagaaaagaaaagaaaagaggaaagggggaaggggaaaggaaaggaaagaaaagaaaaaggaaaagaaacuuuauugaguaucaagaaaaaaauucaauuuauugauaggaaagguauugguguucucaauaucaaaaugguacaauuuguauuucaaaaguugcaauaucaagacaucuuucuuuauucuauauguuaaaauacaagaaccaggauguaaaagcacaggguuuuucuacaccuuccuuuguucugacauaacuacacaaagaccuguugcauuuauuaaaagcugcaggcacuaagcugggcaggauucugagccagccuggccagucaccucccagccacgugguguuaccugccaucuugguccccccccccccuccuucuucucaauggagacgcccuagcgacucuccaccuuggacccucucccggggauuggaagucuugccuuaacucuccuccucaacuuuaggcugaucagaucuuuacugaccaaucagaaaaugauuggggaacaaaguucuacaaaauaaggauucaggaaauccuucaucauaaugacaauaucaaaauccggacugcaccccagaccuccggguacagaaaucggcauuggaauacacagcgcacaaaaacaucccucaacaccgggacaccuuggcagcucauuaccgguauaaaccuuaaaaucugggucuggauuugagaguuuauauuuuaauaaguuccauaaaugagcacacugaagaucucuucuuacuuuuaggcaucuggacgccuuacuuucaauaagauuuuucuguuaguaaaccagauuucgagucucaggucucugccauuugcuaccacaccgcccagccucuccugagguaaggaacauguuuuuucucucuuuauucucuucugccgagggcccaggaauaaucuuuauugcauagugggccgucaagaaauucauguuuaggaugaugaagaaauaccuugagugaaagugacuucaugugcguuacgcuucuauuuuaaagcaccaccaccuacuugguagaagucauguuuaggaaguauucucucuggccugguuccucucacuggcucacccagauggagcuugcagguguggcuacacauagaggcaugugccugcuugugcuugguaucaucugagcagcucucaaagacauugcucacacaaaguagucuagaaauauuuucccauucccauaacuggcugcuucaauguuuucauuguuacuuuuuuuuuuuuuuuuuuuuuugauuaaagcuagggcccuguuguugcagaggacaaauauaugacauuauacuuaacuaauggccucuuagcucugaauauccacaucguuuagaauauagcuuucaugaccucacucagugugguguauugcaaauaccacucuuucugacuuuccaagccaccuccuguugucuauaacaccuggagacaagucugcuaggugcauaggaaauccuuaaacauguugaugaacuuaacuuaagcagccauuuccuuaagaccuaagaguucuuucaggagcauauaaaaaagugagccacgggauguaugaggaagacuugcaucaaaugcccuacuugcuuggcugcuguacuggggacaacaaccacagaagacaaacuuagucuuaucuuugcuacccuugaccaguggcuuaaccugagcaggcucuggucaagggaauugcccucaguaacuaaaaauaugucaggggcagaaccaauucuaaucuuuuguuguuguuuguuuguuuguuuuucgagacuaguuuucucuguguagcccuggcuguccuggaacucacucuguagaccaggcuggccucgaacucagaaauccgccugccucugccucccaagugcugggauuaaagucgugcaccacccugcccggcccaauccuaaucuuauagucuuguucccaaccgaagaagacugagcuugcuuucugaggagaggaccuauauuauacacauuugucugaagacuguugcagcagucugugaguuuuuggguagggagggugcugggaguugcaaauuuuucgguuuuuuuuuuuuuuuuaaauaauaaaguugauaaaaauuguuaaaagagauucuggaagugugacacguaacagaaaacaagacagucagaaauuauguaguguuuaccaggagccacauacucuccaaauuacuuuguauguauuaacccauuugcuauccccagcaauacugaggcagaugcauuuuccucauuuccauuuuacagaugaggaauucaaaagcacaccguuuugugacucguccaaaguggcacaguuccagaguccacgcuuuuaaccacuauacccuggugguuuaaaugaaaaugaauauucaucuucuccugaacgauuuuaacagcagauugccccacguguagauugucccuuacccgcagguccacuguucuuguggcaaagcgucggacgcaccuguggacacgagggggcgccgccgccccgcacccuggucccccuccggcaggcauccgagggggcggagucugagcuggguggggcccggcuggccgcccacgggguagcuaucccggcgggccgcgcgcggcgguguuugaauggcugugaguggggcccggcuggggauccgagggacgcuccgagcugccgggagcgguucaucagcacaguggcugagcuugggcgcugcgguaccaugaggcgccgguaagugacggccggacccgguuggggccuucgcugcugcucgcgcggcgggcuucuugagcagcuggccgggcccaccugcaggccccgcggcagcggccuuuccggggcugggcggcggggucggggcgggacgcaggcggguggggcccccggucucccgcggagcccccgggcgagcgguugucuggagguuggagcugcaggccucggggguccuggcaggagaggcauggaucaaaccuacugucauuuauuuaucuucggguggagucgacaucugcacccuacggggaaagacggggcgcgugagaagauugcucugcgaggacagguuuuccccagagcagccuaggcccggcugaggcauuuccuuauuuuucugaggaauuuuugagucccagacagaucggcuuuuguuucuaaggacagaaacuugacauagccgcauaagaaucauugacugcaacuuuuaaaaccucguugugcuuucugaaaaguuauuccguaauuguaccuaggugcuuaacugagcuuaggcauggagauaacaaagaguugauuuguuuuguacuggcuucuaaagucccuugaaaacagcuauaucaauuucuuggcagaucuggagaaaaaaguaacuggaagagauaauucuauaauuauugccgauuucguacuuaacgagcucgcugagacaccaguccaccuaauaucugaaacuuuauacaaaaucauucaggauuuuuccucucucauauauuuuugguugugagccuagccuuuaacggcugagccaucucuccagcccucuucucucuuucaaaucagcuucuucaagucagaaguuuaugcauggaggcuuuuugcuuggauaguagcuggacuuguaauaagccauaacgaguaauaacuuacuuauuuuguuuucugugugcuaagaguuguuuuaagagugcugcuuuggaauagguaguauuaucaucauuuugacacgggaaaaaggcacggggaagucaucuuagguaggguuacauaguuauuugcuccacaaagccacagggccgccuccucugccuugaucuuacuaauguccaaaguguuguuucauuugcuugagcuucggagauauuuaugugcguacgccucuguguacacuacacaugaaugaauccacacaccaaccacauucccugcucguauugaccacgauuaauuuuuguguuugagggaaaaaaauguuucuaagauaaauagaaauaagguuuaugguuucacuuuucagagaccagagaacagcuggaaacaugauucuuuaaaacuggguacacuauuuuguauuuggaaugaguauacuucauaacaccuugcagagaaacaccucaagaguaagcuaccuucaguagucagcacuuauucauauggaaaccuugaaacuucauucagcaauuacugagguuucuauugccucaguguccagcacaguacuggauccagugagcuauauucaagaaaugugccaggcaacagguauuagggaaguuaguuuggugugagauuaguuacaaaauaauauacucuuccuuggggcagugauguaugaugaucuggacuggguaaaucugcuauacagcuaagaaaugaagggcuuguguaagacauuuauagaaagggaggcaggguauuuuacugaagaaacuguucaaagacuaggaauccagaccaaaaauuacuuuuaaugggaacaguaaguuaucuuuuuaaaaguucauguugguuaacaucauaugaaauaagacugggaaauguuguaaaugacacaugucauagaggucugauacacccagaguucucaggcacacaaagauuugggaauuuguaaaauuuuguugcaguggcucucaacugggucaaguuuucuccuuaggauauuuaggguugucagacauaaggaaagguugauacugucaaucuacuguccauaggcuggaguacuuauaagcauccugcaucagacagacucccauaagaaacaaucacuccaagggucaguguugcugugguugcgaaacccuaauuuuaaguugguugguuauguggcuggcuuccacucacauauguuauagguaaguaggaaugacaaauuuuaggaacacaacuagacuucauaaugacauuaggagugguuuagaguucucccaaaggcuguuccaauccuagaggagagguguguaggagauaggcaggagcuuuaagaaugcuaaaauuaagguaagaaucacuaaauuuuauuuuaucuaaaugugaagauaacaaaaauucauuugaaauagaaaaugaacauaauagaaaauagaaaacagaacauaagcagaaauaagggccagcaggaugguucaagcagccagaagugcuugccuugugagucugaugacuugaguugacucugcaauccacauuaaaagaacaaaagagacccccaagaggugggugaggugucacaaguccauaaucucgucaaacgggaggcuuaggagacgugggagacagagaauuccccagaaacuugagggccaccuuaccugcaguauuauugcagcaugguaaaaacaagagagacucuaacucuagggcuuggagagauggcucagugguuaagagcacugacugcucuuccagagguccugaguucaauucccagcacccacaugguggcucacagccaucuguaaugggauucagugcccucuaauggugugucugaagacagccacagugcacucauauacauaacuuaaauauucuuuugaaaaaaaagaaggacucuucagcaagguagacgugaaagccaauucccuuaaaguuguccuuugaccucuauuugcacucuggcaugugcaugcacacacaauauuuaauaaauaauuuuaaauuauuuuuuuaaaaguuuaaauacaucacuuauaaauaccccaauagaacaacuguuaauguuuugauguauggcuucuuuugaagcuuuuuaaaggcugauaguacuuuucuuuuuauaaaacugggauuaugggcuagagagacagcucagaaguuaagagcaguugcuguucuugcagagaaaccagguugaguuuccaacgcacacaucagauggcuuauaauguacugacuccaguuccaaggccccuguucuggucucugcacauacauguaugugacacacauucaggaaagcccacacacauaaacuaauacaaauaaguacauuaaaaauacauaucuuuucauuguuuaaacaaauacuuuuuuuuuuuuuuuuuuuuuuuuuuuuuuuuuuuuuuuuugauuuuuuugagacaggguuucucuguguaauccuggcuauccuggaacucacucuguaaaccaggcuggccucgaauuuagaaauccgccuguggcugccucccaagugcugggauuaaaggugggcgccaccacuacccggcuaaacaaauacucuuuaggggacaggagagauaguugaucagugaagaguucuuguucuugcagagaaccuggguucaguucccaguacaaaugugguggcucacagccacccauaauuccaagguuaagcaaucagaugccaucuucugaccucugugggugucaggcauacauguagugcacacacauacaugcaggcaagucauucaugcauauacaauaaaccuaaaagaaauuaaaaguuaaaaaauacuuuuacagucacaguauuuggguuuuuuuuguuugguugguuuugguuuuucgagacaggguuucucuguguagcccuggcuguccuggaacucacuuugcagaccaggcuaaccucgagcucagaaauccgccugccucugccucccaagugcuaggauuaaaggugugcgccaacacugcccggcacaguauuugugugugugugugugugaaguaacuggagauacagcagaaugcuuaucuaccaugcacagugaccuaaacuagguacucagcauugcuccccucucccccccaaaaaaaagaaagaaaaaagauuauuuggcaacuggggacuacauaguagggccgugucuaaauaaauaaauaagucaggauuaaaaucuuugacauuucaagguuugauguuucagaagccaauaaaagaacaguagaaacagugaaguaaacuguaugcuuauaacuuucauucuggaaugugaauuguauucacauacacaacauaaugagaauguuuggucuguaacucacuacguaaaugaggcuggucuggaaugcagugauccaccugauugugacucccaacugaugggguuaaaguauuuaccaccacaccuggcuccuccugagauucuaugaaaacccucacuaucaacuaauucuuuccccacacuccuaaaguuaguuguguuucccugcuuuuacuuuuuuuuuucuuucuuuccuuuuuuuuuuuuuuuuuuuuuuuuuuuuugagacaggguuucuuuguguagcccuggaagucacucuguagaccaggcuggccuugaauuuagaaauccgccugccucugccucccaagugcuggguuaaaggcuuguaccaccacugcccggcacuuuuuuuaaaaaaaauauuaaguuuauauuucagauggcaagcuuucugcuucacucucuuuucaaaagauuuuacuuuuuuuaaacuguuggucaugaaucaaagaguaaagggcuaauuuugaguuuuuguuuuuuaauguacagaugacacaguuuuacaaacugauuauaacucccaccgucacuuuucccaggggaaugggaaauuauuuuuaaaauguacaguucauaaagaaugucauaaaauauaccaaucaguauugcuuuuuuaucauucauuuugcuugauugcuguuguguaaguaacagcaaucaaaacuaaucugugauuguaauuguuaguuuuuugguugcugugacaaauaccugagaagcaauuuaagaagagaaaggugugugugugugugugugugugugugugugugugugugugacaaauaccugagaaacaauuuaagaagagaaaggugugucugucugucugucugucugucugucuggauuugagguuuuaacuaaagguuggcuggauucauagcuugggucugauguaagagaacuggcugcucuuccagagguccuaaauucaauucccagcaaccacaugguagcucacaaccaucuauuaugggaccuaauguccucuucuggcaugcagaaguacaugcagauagagcacucauauacauaagguaaauaaacccuuuuuuaaagaagccuuuauuuaaaauaauucauuuaucagccauuugaccauauccaacuuuaagguuaguaagagcccaggcuugguaguaccugagaaucuagcacuugggagguggggacaggaaaaucagcucaagguccucuuuggcuacauagcuacuugggggccaaucugggcuaccugagaccuugccccccgcccccaaacaagcaaaccccaaaaggaugauaaaccaaccuaucauuuaucugagaguuaaacuaacacuguuccaugacacaauuuaauguuuaccauauuuaggaacuuauaauuuaacauuuccaaauaucuuugaauuuucuuaguguucuuucuugacugaucacugucucauuuuugaguguauuguccugugaguaacccacuuuccacugacuugugacuaaaaauacaaggaagauuugucaaauuuagagaauggugcaguccuuuaaagucugguuugguauuaaacccuggggaguuuuuuguucuuaaggauaaacuuugcuacuuugaacugggaugcauaugucugcucuguucuaauacuuuuauaauuaugaaaguaaacuuuacacauugauaaaaauuuagugaaauaaucauugagaaccacagggcaaacccuguucaauagaggcuguaagaagaucuuauacgcaacuaaggaauacugagaguuauggaguauagauaguauguauaacagcuccccucccccaaugagccccuuaauugguuauuugguaccaaguaguuagucuugaaaucaucuacauccaaguaacacuacacagacuaaagcaaauaguuaauauauuuagauguguauauguaaaggugauaaugauaaaagaggccagaauuugaagagggcacagcaugaaaggcuggaggaaggaaaugguauaauuacacuuuaauccaaaguuuaaaaggacaagguuguaaagaacuugcuuuaaaccuauuuucuauuucuuuuucuuuuaaaaaagaaauuuaaaaacauuuauuuugugugucuggguauuuugucugcauauaugucugcaccccccugugugccugguggccacaggggccuuugaaagagggcuuuggaucucuugggacuggaguuacagaugguugugagcuaccguggggaagcugggaauugaauucaaguucucuagaaaggcagcuagugcugcaccgagccaucuuuccagcuccauuuuguauugcacaguuuaacuuaacaguuuccuugguagagcguggugauccauaugcuucagccaucauucaggagguagaagcaggaggucucugaguuccaagccagccuugucuaccaagcaaguucagaaccaccagggcuacaauagagaugucuugucucaaagaaaaacaagaaaaccaacaaaacaaacaaacaacuaaauaaaaaaaaacccaaaaggcaguuuucuugccaagcucuuggauagauuuucaguaauaucaucaugcuauacuugaaugacagaauuccauaaccagaaagguugggaaguuuaaagcuaugaccagcaaugagguaagaaaguucuaguugcugagaagagggguugggggagaaacacuauauaacaccaaaaguucuuagaauggcuucagaguuuuuuuuuuuauacauuuauuuauuuauuuguuuguuuguuuguuuguuuauuuguaagucaggguuucugacuguccuggaacucacguuguaggccaggcuggcuucaaacucagagauguaccugccucugccucugccucccaaaugcugggaucaaaggugugcuccacuucaaucaacuuuuuauaguuauuuuguauucuuucacgugauuuuuuuuaucauggaaaaguaguuuauuuuacuuagucccuacacuacuacugugaaaauagcaaguuaaguaagaucaugcaacuaauaaacgacuguaauagaauuuaaauucagugacucugacuuugggauuuuuuuuuuuuaagacaauuuccugcucccugagccugcuucauugagauuacacuugccugaucuguccuguauuuguauuuccugcucuacuguauugccuuuucuuuuuagcuuaguaauacaagaaaauuauaaccuuacacuauuuuuuuuuugcauuuagugugugugcccauuugugugcaugccaugaugcaccuguaggauucaaaggaaaacuugcaggaguugcuucucuuuccacuuacgaugucauguuuggcagcaagcacuuuuagccagcccccucacuuaaucugggauuagacuaaaauuguauguuuauaugucaguuuuugaagauuaaaggaaugauaauacagaaucauauuuuaaggguguauagcucaguagaagggcacuugccuagcaugggcuauuuauuuagcacacauauuacggguggcgauaguaauuucuaccuuuacuaauaagagccugauguagaaaagucuuuguaggaacagcuaacaguccuugcauauuugccaaguuuauuuuguuguggauuuaguaaauaugacaguuuaaaauggaguugcuguuacaaaacagaacaaggagucacagauggccuauagucccagcuccucuggaggcuggggcaaaaggagugcauauuggauacauuucucaagaggaaguuaaaaaaaaagaaggaagaaagaaaggaaggagagacagagagugauuaaaucauauauauauauauaccuaaagauuuauguauguauguauuuauuuauuuauuuuauguugcugucuucagacacacaccagaagagggcaucagaucccauuauagaugguugugagccaccauugugguugcugggauuugaacucaagaucucugaaagaucagucagugcucuuaaccgcugagccaucucuucagucccuaaauaaauaguuuauauuuuaaaaggccugggaccauagcucaguaguagaacacuuaguugccugguguaugcaaggcccuagguucaguuucuagguugaacaaaugaguacuuuuuuuuuuuuuuuuuuuuuuuuuuuuuugguuuuuccagacaggguuucucuguguaaccuuggcuguccuggaacucacacuguagaccagcuggccuugaacucagaaauccaccugccucugccucugccucccaagugcugggauuaaaggugugcaccaccacaccuggcugaguauugguuucuaugagaauuauuggaauauugcuuuggcuaauuuuaguuaacacaaaccuagucaucuggggagaggggaccucaguugagaaauugucuccaccagaguagccugugggcagugcuagucuuaggcagcuguggaggaaagguagcugaaugugaugugagccggggagggggcaccauucuucugugguuuuugcuucaagcuccugucuugguuucccuuaaugauggacugaaaguggaagaugaacucuuucccaauugcuuuuacucaugguguuuaugacuacaacagaaagcuuaaccaggaaaacuguguuguauagucuauuugaaagcaaauggcuuaaacauuuuauuauuaaacuacguacugauuugaaaauuaaagcaguaaaaaacuaaguccugucuccagauauuuacauuuucagguuuuugugguuaccucugauaaugguuaauauugauuaccaguuugaucuaggauaguuuaggagacaggccucugggcaugccuguugagggauuuucuagauuauguuaauuuagguagaaagacucaucuuaaauguaggugacacuauucuuugagguggggucugguacugagucaaaaguaggagaccugagcaacagaauuccucccuuccuuccuucuuucuaccuuucacugcagucugacuagccccucaagcuuuugccaccaugauuuccacaucauggugaccuauacuucugaacugugagcaacaguaaaccuuccuaagcuuugcuuuuugucacauauuuugucauagcacugagaaaaguaacuacugguguaucauuuacaauauuauauggaugugccuguguggcuaugugcacaugauugcagagggcaggaaugcccaauaucucuggugguggugagccaccuguuguagguucuggaaauugaacucgguccucugggaaaauaguacacuuuuaaaugucccuaagauucaggucuaauugggaucuauuccaaaugcuucggugcuccauaggauauacugcuucugccuucuaguaacuaguaccaaccacagcuuuuuuuaguauaauuuuuguuggcuugucacuccucucagaaauaagacauauguuaccuguucauauuuugacacauaguagggagugaauuaaguguggacuauauguuauguuuucuuuuccacuuuuguuuauuuacuuucauuaguugagaucuggaaaggcuacaguaucuuauagauuuuguguccaguggccuuugcaggaagcccucuguguccgugggccaggaaccagaguuaccuuucccagaucagucugguuuagguugguuugguucaguuugccuccaggagucacuguuauuuuuguuuuaaacacauaagcacauuucuuaccuaaggagaacucagcuucaacuuucaacucuuugagaagagcucugugcucuccuuggugccggagaccucacuuagagccagcaaaaauggccuugcaccacagccuuccagauauauuugccuuuuagaaguuuuguucccagcaggccuuuucaggcgccaaggugacuggguuuuuuguuuguuuguuugguugguuugguuuuuuuuuucgagacaggguuucucuguguagccccagcuguccuggaacucacucuguagaccaggcuggccuugaacucagaagucugccugccucugccucccaaaguggcuguuuuuaucauuuaaaauuaaaccucaaaauaccaguguuuugugauuacacauuuguucacucaacgggguguguaugcacaugugucuguguguaguguauuuauacauuaaguaguagcugugaaauugcauuuuagguaguauauguuaauguaugcagucccugucuaucagcaguuuuauaguguagcgauggcucaguagggaaaggugccaaaucugacagccugaauccagccccugugaccuacacaguaaaagagaaggcaguuuuucacaaguuguccguuugaccucuacacacauaguagcauuugugugcgcauacagacauguaauuuaggaaaaaaaguuaaauguuuuaaaaagcuuugaaguuuauuuagccagaggagacagacuaaaaucagcuagugcucagccauagcuuacauuaaucccucauguauuuguuaucugccaaaggcagaaacugcaauauuaaacugaguguucuaagagaugguauaggaaaccuugcaccaagaccagaaucaagaaaugcuuuggaaaaaaagauucaauccucauaguaagagaggcuuugauaaagcggaaaggaagaaaagaaauauuuccuggagaagaaacauuuuguuucaacacaaaggcaacauugacagagacagaauaugucuauuacaaaaacuugggaaaugauaauuaauguuauguuuucuguauugaaggacauauacaguaagucccuauccuuuuccuuuguaaaacaguuuuaguguccucagaguuuguccauguccugugucucuccccacauucucccccugaucucaugucauuguccccuuagcccccuucuuuuccuuuugauuucuguguaguguucaauaccacucuucugccaaauugccugcuacuuuggaaucagcuuugacucucaaaauauucucuccuuaagccaggcauggugguaugugccuguaguuucaaaaagugggagcuuggagcaggaagaucaagaauuugaggagggggaggugcugcuuugagauugcucaggauggguaaaagcacuugucugcauaagccuccacaaaguuguccucugaauucccauuaguguacaugcauguacauugugugugugugugugugugugugagagagagagagagagacagagacagagagagagagggagggagagacagagagagcacgcaaguacguaacaccaccacgaauaauaauuuuaaaguuaauuuguacugaagagaugccucaguggguaaaagcacuugguaccaagccuaaugaccugaauucaguccucaggacccauaugccagcuguagcuauauaacaaguuccaggucggccuggguuauauaaugagacucuguuucaaaaaaaaaaaaaauuccccuaagaucccauuucucuuuguuucaguuuucuccuauauuaaaacaaagguaccguuuuguagguuuuucauucuuuuggaguuaagucaaggcaaauuauauaaauaaacauuuuuacuuuuauucaugaaaacacuaaaacagcugguucccaaguuacauggauaguuaaagguggaagcuggaaaauucugccugguucuuuugaaccuggucuuuaaacugcaccggucuuuuaaguuuuaagagagucuuuaguuuuuacucaguaagcuguggcccauacuacuacacagugagcaguaagguucccagagaguugagagagcguggaaggagcccagaggugucugcugauugagcuuuguaaacucccacaugccauugcauacacagggcacugagggcauguucagcuuggucuacacagucugauccagcccacacaguugacuacuagaaccaguuggucuggcuuugguaaucuccauucagaacgcauguguguucuggguguuuuaaggaacauuucagaaacugucaggacucaagaauagacugguuuccuaaagggaagacagugggucugagcccaccguuacuucuaucaagcaagugccugauguaugagcaugcuauagugaaaagccauaaauucucuccucuauuuuuuccuaugugcuggggauugagccaaauucuugcagauuuucuaccacuaagcuacacaacagugcuauuucccaauuuccuuaaaggcaguuauuaagauacuauuucuaugacuugucacuuccauauaguagcacaaucauuacuauaguaaaguauguaacaucucucuacccccaaaauuuucuuauuccuuuggagagaacuuuucccugcuuauuacugauauguuuccuuccacaguuuauauuuuugcuauuuagaaugucaugaaaauagccuuuuacauuuuaguuuccuucacuuagcucaauauaguugaaguuuuuucauguuauauaugucuguaguuauucacuguguuucuauaguuuuauaguucauuaguugauaauuuuuauagaaagaaaugaucaaaaaaauagauguaggacaguaaacauuagaacugacugaggccaaacauccauacauccugauugcacgggacagacuuaguuugugccuguuguccuaacaagcuuuuucaugaugccuccucucauucccagcagugucuugguuuggaugguaaauuauuuaguuaauccaaaugugacaggacaagaugugaucauacuucauaggcuuucuggugguguucaauuugcuuuccaaacacuaaaucauacauauuuauguuuuauguaaaugcuaugaauguuaauagcaauaauauauauaaucucacuuugaucgucacaauauuauuuauauuuuacauuugagagaauaaauucagaauagaaggcccuccaaacucaugaacuagaagguuuauuuauauaucaucuauauauguauucacaucuguuaauugggagacauugugguuuauuaguuaagauuagaaacaguaggaagagaaucccuagacuccaaccccaacucuuugcauuuuugcuguugauuuuagggcaaauucaucucaucuauacaaaaaaaguacaaauguauguauuuaugucugugugugcacacagagaggucagugccugacacccagcagaucucuuacgagauuacuuaacauuacuguaguggugcauuuccuucccagcccuccuccugccccauuagaaauaacagggacuccucauguguauuuccucuuuuuuugagggauuaucucuuacagcccaggcuagucuuaaacuugcucuauaguagaagaugaccuuaaacuccugaucuuccuucuccugccucuuaaaaccuagaacuauaaguaugaaccacuguucuuggcuucucacucuuaaaaaaauaagaaauaaaaaguaccccaauaguaugguaccugauaaugaggguguucugugcuuagauaguuuaguguguguguguguauauauauauguguguguguguguauauauauaugugugugugugugugugugugugugugugugugugugcgaguccaaagacacugguagccaagacugggaaucagagcuaaagaacauaauugaaugucucagaaccuuuuagguauacuagauuuccaauaaauacuuuaacaugcaguguaaccagguuuacuugaacaaaguaaggcauccuuaaaauguauguaauuuauacuuggcuuagucaggguaguauugcuuugaugaaacgccaugaucaguaagcaaauuggggaggaaaagguuucuuugacuuacacuuccacauugcuguucaucgccaaaagaagucuggucaggaaccugacacagaggccauagaaggagugcugcuuauggcuugcuuguccuggcuugcucagccugucuuuuuauagaacccagcauuaccaacccaggcauggcuccacccauagugucccccauugauuacuaauugugaaaaugcccuacaguuggaucucauggagccauuuucucaacugaggcuccuuucucugugaggacuuugugucaaguugacauacaaaaccagccaguucaaaacauaacuuuggaaaauucuguauuuguauuuucuccauaaacacuauaguuguuauuacauaggaugauuuauagggaucaggagaagaccuguagugggaaacaaagaacuaauuauuuuuacaguauuuuaaaaaauauuuaucuauuuauuuaauguauaagaguucucugucacugucuucagacacaccagaagagggcaucauauuccauuacagaugguugugagccaccaugugguugcuggaaaaugaacucaagaccuggaagaguagucaguacucuuaacucucuaagccaucucuccagcccauuucuacaguauuuuaggcuugaagugauggggcuuuucugacaguagaaaagggaagucagaauggaauuaggaaauauuuugauggaagauucuagaaucuuaguggcuuggugaaaggaaaggaagaagaauaaaaauaacuccccaguuucuaguuggagagaauuuugguuguuaguaauucaaguaugauaggagguaccauuauugaacugacaauugaagagaucuguuuuagacauguugauuaaaaacuagugguggguguggaaaccaguuugguacagaaaaaguuacaacagagccuagaucuagaaaaguaacugagucugugaaaacaugcccccucaauguucguguagggagaaaagaguuguugaaggaaaagugacucaaagaagggaagugagcaaggagaguccgcagaguugugugggaagcugaggaucauggacuggugaaacagcugacuagugaugaaggaauagccuuaacauuggccugggagcucuccauugaacaucgacugcuaaaagguuucugguagggguuuuauuuauugcaguggggaagguaauuuguuuuucuuuuucauuuuuuuuucuuuuuuucauucuuugauguuauuuguuuuguuuugucuuguuuugccuuuugagacagucuuacuauguaguccagacuggccuugaacucacaauucucagucucuugcuuuagccuccaggguacuguaauuauagacugucacuauuccuggcucccauauaguuguaagcgauagacuuacacaugagaaaacagaauaaggcaaaauuguaaaggguuaaagaccaauuggaagcuaaaaagcacucauuguagaaauuuggcaggaaaggaaaacagaaagaguauaggagcugauaggagaaacuggagcaugcuugaaagcaggcacaggggaaucgguucaaagugagaaaacaaagagaaaaaaaaugaagcaagugggcagaaguaagaaaauuagauuauauuguccuaauuuuggaaaaguuaaaaggacugaucgcauuuaaaaaaaucauacuuuuagaaaauagaaaaaaaguaaguuauugagaagauggaagauggcccauagucccucuagcaauaacuuuaauuaaagcuguguuguguuguuuuacaaugcuugggauugaauuuaggcccucaagcaugcuaggcaagcacucuaccauaagagcugugucuccauccccaacuuaaguuugguaauuucuuuuaacuaauuaaacauacuuuuaaacagacuuguaacauaagcauucacaggguacacgugcuauuuuaaugcauguacacauuuuguguuguugaaucagguugcacauaucuccuugaacacuuacccauuuccuuagggugaaaauauuccgaaucucuucugcuugacuuuugagauacacaguacauaauuguuaccuacggucacucugcuaucccagaacuucguaucucauauuuaccuacaacuuagagccuauugaucagcccaggucuuccuucugcucucagccucuguaaggucagcuucaguagauuccacauaggaaauuacaaguuauuuguccuuuugucucugguuuauuucacuuacaaaaucucuguuuuuauacagguggcauaaguuguaagacuucauccucugugguauuccauugcuuauauuuaccacauuuucuuuauucauucacuaauaaauagauuauuuccauuuccuggcuauugugaauagugcuacaguaaacagagagaaguacaguuuucuauggcaaacugaacuguuucuuuuggauaaguacccacuguuggaacugcagaaucaucugagcauuuuuuauuauuuugaagaauuuuuguacuuuuuuuuuuuuuuuuuuuuuuuugguuuuucgagacaggguuucucuguauaucccuggcuguccuggaacucacucuguagaccaggcuggccucgaacucagaaauccgccugccucugccucccgagugcugggagugcugggauuaaaggcgugagccaccacgcccugcuuguacuuuuuuaauaaugauuaugcaauauacagucccaucauuggugugcaacaaucucuuuuauuuuguaaaauuuuuauuuauuuaguguguguguguguguguguguguguguguguguguguguguaggagguugggguugagugcaugugugucuuagucagaggacaacucuugagggauugguucuuuccuaacuuuacguggauucugaggcuacaucauggagguaggucaucagguuuguguagcaagauccuuacuacuuagcuaucucaccacuccaagggguucccuuuucuauauauccuugcuaguacuuguuuucuguacuuucugauucucgguauuccuaaugaaauauaguaauaauccaguaugguuugauuugcauuucccugaugauuagugauguuagcuagcacuuuaauccuccugcugacuguuggucaguuuagguuguguuagcugccacugcugugacauucagaauacccgagaaagccaccugaaaagagcagaaguuuacuuuggcucacuuucagagguuguagguugugauuacuugacuccagugcuaugguccuguugcaagacaggaaauuuuggucugcagaaccuuguagagcaaagcuguuuauuucacugugaccaagaagaaagaagacaggggagugaccaggggcuaagagauaagaaguaggcugucagugaccuacuuccuccagacuccacaguaggcccuaucuucuucaauacagaagacuuucagggacauucuagguccaaagugcaauaagauucagagcccaaucuuaauugagcugcuugauuuucuuuucuuuuucuuucuuucuuuuuuuuucuuuucuuuucuuuucuuuucuuuucuuuucuuuucuuuucuuuucuuuucuuuucuuuucuuuucuuuucuuuucuuuuuuuugagacaggguuucucuguguaucccuggcuguccuggaacucacuuuguagaccaggcuggccuagaacucagaaauccgccugcaccucugccucccaagugcuggcauuaaaggcgugcgucaccacugcccggcuuugauuuucuuuuuuucuuuuucuuuuuacuauuguauuuuuggaguuccuuauuauucugaauauuaacuccucaucagauuauauaauuugcaaauauuuucuccuauucuuuagguugucucucugaugaaugcuucuuuugugcaaaaccuuuuucauuugaugugaucuuauuugucuuuuguucuuucauuuuggggugaggauuaauagaacuuuuauauuagucaggguucucuaagugaacagcauugguagaaugaauauacaggacucauuugagugacuuacagccugugaucugaguaauccaacuacaaaugucucuaaagggaaaggcaaaggauccugucauugugcuguccacaggacuggauuucucggcagucccaaucuggugcucuagucuuggaggcugacaucuucagucucuuggaaccccuaagaaguaaguucuaauauugaaugucucaagaacaggauagaagaacuugccagugaaagucagggcaagcaggcaaaaagcaaaaguuuccuucuauguccuuuuaugccaccugaaaguauggcuuacauuuagugugagucuucacccauugauccaaucaagaagaucucucaaaaagcauguccaguugcuuggguuuuaauugauuauaaauguagucaacuugauaaccaagauuaagcaucuguuuucuuucuuuuuuuuuuuaaagauuuauuuauuauuuauuauauguaaguacacuguagcugucuucagacacuccagaagagggagucagaucccauuacggaugguugugagccaccaugugguugcugggguuugaacuccggaccuucggaagagcagucgggugcucuuaccugcugagccaucucaccagcccaagcaucuguuuucaauacuguuguaauaggcuuuuguuguuguuauuuuuaacauuguuaagauuuguggauguagcggaucagacucagugcccugugcaugcuuagcaagcccaguaccauugaaguacacccucuaaugcccugugcuuuaaaaagacaauuuuuagaaauuguacuuuucaggacauuuucuggaagugauuugguuuuguuuguuuguuuguuuguuugugagucucuguguacaaauggacucuucugccucugacucugaguacugggauuauauaacaaggugaccaaauggauaaggcauugcauuacugaacuuauuucuuguuuauauauuuuauuauuauagggcagugauuuuuuuuuaagcuccaauuaaauguauuuaagagggaggagggaaggaagaaggaaagauaguagcuaaaaacgguucugauccucauggcucuuaggagauaaccacauguggaaggaauucuuguauaaggagaagugugucuuucucaacagcuuguuuuguuuugguagagaaauugccuaguuggauuacggguuaaguacaacgugaauagucaauguaguauaugaauguagagagaaagcuaacuuggucuugaacuguccaggcauguuucauuccuguguaaugaguuucccuuguugugagaaggcagggaguaucugaacacuuugagcuguuuaaucucuugguuuggcagccauuauaagaguauaugaauagaucccuuuuuaucuuugagguagaagacagcuacuguauaaagagaaaucaucccgugagcuucauuauuaugcuguuguuuuucucaauagagcuacucauugaaagcauugugauauuguaagaaaaugcaugcuaugucugauguuuagaaguuguacacaauguuagaauagcugucccuucucugcuuuuauucucuuaggguccugcuuauguucuucuuugcuuauguucuucuuugcuuauuaagaguuguuuguuuguuuuuuuaaugagucuucaaccauuucagauucuuuucuuuuugugucuuaucaaauagaacuucaaaaacacagagagaacuugaaacuaguuucaguagcauuccuaagugcuucugggggagaaagacaauucuaucuauauuaugggucuagaaaggugcuauuaaaugcaugagacauggguaaaaaacagaguguauagcuuauaaagccuuauugugauauaaaguauacaccaugaaacuuuuaaaugugcaauuuacugauuguaaggacagacuagaacauucuccagucccaguagaucuuuagagcauuuauuucugucacugaaaaacucugugccccuguguaguaacuuccauuccuacuccaacuugagaagcaacaaacaauugguuuucuggcuguauuuuauuuccuauaaguggaauuuugucacaguuguaccguggucucuuacuuacaggacuacugcucauguguauacugaauuaugaguaccuaguuccuuuuugcucuaaguaguguucuacauagaugggucacauuuuauuuguuaacaggguaauaaacauuuaccaguguugaugucucuugacuaugcucaauauuugcauacaaacuuuugugucaauauguuuucuuccccuucaguauauauguaggaguggaauuuaacuuuaagaaacugccagggccuggagcuuucucccugggagagcacuugccuugcauacaugucacucuagauauucauccccaauacugagaauggaagggagaccaugucauguuauuuuauaugaugcuugacaguccuugguucuccaucuuucucagcacuuauuuuugucuucauuguauagcuaucuagugaguguaaaauaguauuucauguaguuuugauuuugguuuucuaguggguaaugucuuucuuuuuuuuuaaaaaaaugcuaccuuugugguuggguuuagcuccuugaacacuuacccauuuccuuagggugaaaauauuccgaaucucuucugcuugacuuuugagauacaccguacauaacuguuaccuacggucacucugcuaucccagaacuucguaucucauauuuaccuacaacuuagagccuauugaucagcccaggucuuccuucugcccucagccucuguaaggucagcuucaguagauuccacauaggaaauuacaaguuauuuguccuuuugucucugguuuauuucacuuacaaaaucucuguuucuauacagguggcauaaguuguaagacuucauccucuguuuuagcuguaugccauuucuuucugauuuuuugacagcuaccccccuuucacuuaauggauacuuaguauuugcuuuauuuauguauuuauuuauuuauuuuugagacaggauuucucuauuaauccugguaugccauuucuuucugauuuuuuugacagcuaccccccccuuucacuuaauggauacucaguauuugcuuuauuuauuuauuuauuuuugagacaggauuucucuauuaauccuggaacuuacuuuguagaccaagcuggccucaaacucagagaucugccugccucugagucuugaguacugugauuaaagauacgugccaccacacccugcccaguuuuuauuuuaagcccauuucauuuuugcaaauccuuuuuuuuucuaagcuuucuaacguguuccaggauauauuggaaaauuccuucccaucucucgcauuagaauuuauuuaucuuguguuauuguuuuucaguauugcuauuagaaaggaauauuuuuuaagauuuauuuauuauauguaaguacacuguagcugucuucagacacuccagaagagggagucagaucucauuacggaugguugugagccaccaugugguugcugggauuugaacuccggaccuucggaagagcagucgggugcucuuacccacugagccaucucaccagccccgaaaggaauuuuuuuaacugaaugauuauuacgcucacauuugacuaaauaggauguuguaaauuuccugaauuugggggggaaaggaguguuuuguuuuguuauuaugaggcagggucucucugaagcuauguaaacuaagcuggucucuaacucacagagaaacuauguaaacuaagcuggucucuaacucacagagaaacuauguaaacuaagcuggucucuaacucacagagaucuccugcuucugcuuuucagugugcugggauuaagaguguaugccaccacaccuggucauacugccgucucuaguuuuucauaguucucugaauuugaaggugauguaccuuccacaucugcuuuccuucauuaugguguguacuggcuaguuucaugucaacuugacacaggcuggaguugucacagagaaaggagcuucaguugaggaaaugccuccauaagauccaacuuuaaggcauuuucucaauuagugaucaagggggaaaggccccuugugggugggaccaucucugggcugguagucuugggguucuuuaagagagcaggcugagcaagccaggggaagcaagccagcaaggaacaucccuccauggccucugcaucaacuccugcuuucugacuugcuugaguucaagucccgacuuccuugguauggaaguguaagcugaauaaacucuuuccucccuaacuugcuuuuuggucaugauguuugugcagggauaaaaacccugacuaagacauggugacucagauggagcccuuuucucuaggaauuuguguucuucaguucuguauaguuuucuuaaaucuucucauugguuucuaauuagucucucuauucuuccuuguacuucccuuuuguuugaauguugguuccucuaaaccugucuucugauucuuuuuaucauuugcuuguauguucuggaagauacccucagauuugucauucaacuucuguggagguuuaguuuuguuuguuuuuuuguuguuguuucauuuuguuuuuaaguuuuuauugugugcggguguuuugccugcauguaugucugugcaugaugcccauuaaagccagaagaggaugucagauuccuuguaacuggaauugccgacuaugugggcuacuguguggaugcugaaaauugaacccgggucaacuaggaggaacugccagugcucuuaagugcugagccauuucuacauucccaucuauuugggguauuuuuuguuguuguuuggauuuuggucuuaauauagcuuguuuaugauuucucacaauaguuuuauugcuuuuuuuuuuuuuuaauuuugagacuaggucucacuuuauaccucugauuggcauuaaaccuaaagagaucuugucuguuucugcucucaaaugcaggauuacagacauaagcuaccacaacucacucugugugugcuugucuguaucuguguguaguuuuguuagcuuuggcagaugagcaccacuguaaacaacauacaggaacuucuuuagccacuuugacgaucauuguaucuguguuguguuguguuuuguuuuauuuuguuuuguuuuuugagacagaguuucucuguauagcccuggcuguccuggaacucacucuguagaccgggcuggccucaaauucagaaauuugccugccucugccucccaagugcugggauuaaaggcaugcaccaccaccgccugacuguaucuguauuuuaaagggauguguaugugugcccacagguuuguguauauguaugauuuacuguagagcuggucaaaguucccaaagaaacaucuugugaacuccccuugaaguauaugggcuugauugcaagccuucauaagucaaguggaagaaagacgauaaagggauuugaaauuuaguguauaaaaacuuggguuuauaauuuuuguagaauaaaauuguaguccuggcacgugaauaagagcacugacugcucuucaggagguccugaguucaauuccuagcaaccacaugguggcucacaaccaucuguaaugggaucagaagcccucuucuggugugucugaagacagugacaguguacucacauacauaaaauaaaugaaaaauaaaaucuuuuuuuuaaagaauuuuguuauauauguuaaauuaaaauacagaauuucaugugugguauauugaaaaaaaccuaccaaguuaauuaccacuuuagcuuugcagcuucuaaauuguugcucuuaucucuucuuuuucuccauaaugguaauauuaugccuuuaaaaaucuucuuuuuucauuuugacaauguguuuaguucauuguacuuuuuugagacagggucucucuguguagugcuggcuauccuagaacuuggccagccuugaacucagaaagccaccuguuucugccuccugagugcuaggauuaaaagcaugcaccaccacugccuggcuagucugcugucuuguauucuaucuuucuuuuuuuaaaauaaggcuuauauuguggaaccccuuugaccuagagucuguguuuuuuuucuugccuuguuucucacucuacagcagaacaaccuccagacuaggcuuuagccgaugagaaguugaaaagccuuuauguccugggauacuauauguugugcuuuuucuguguuucagguuuuagaaauauuuaaaacaaggcuuauauuuguauuucuagaguuuagcaggcaauggcaaaguuggaacauugaguuucaagucaaccuguacuacugucucaggaaaacaauaaucuguauauuacagauuuguuacacacacaaacacacacacaaaguaugucuuuuuuuuuucuuuuuacuguuaagccucauuugcacagcauagagauguuaauauaugugcauauacaugcuaugaaagauuggacucuggcuuuuuaaauuuucuauuuuuauuuuguuuaggcacuuaagagauuauggcauuugauacucaccauguuaaaaaacggaacuucucuaauaguauugaucuuccuagaaagaggaucucuaacuucaccaguaagaacaugaaggagguaaguaugggaguuuaagccaucagaucuguuuaauuucauagguuagauagaauuaaugaagcauaccuauuauuauauuccuaagguuauaagaaaauuuuggcaaauauacuguuucuauaaacugugauauaaauguugacaaggaacucagagaugcauuuuguucauucaaagggugauuaacaaugaaaauuuuuuuaaaccacauuaaacucgaacugacuuauuauaagcacccuuuaaguucaguauaugacugguauuguuuaaaaaaagaaaaauaauauguuacuuugccaaacauaccaaaauacaauuuugugccuagugguugaaaacaugguauuaacacaaagaaaacauuggcccuaucauuaccuauugaguuuuaaacugcauuguuaacaucaaucauaaaguuugcauaacuguauuaaaaaacugaauaugauucacuguuuacuuuggcuuucagguuaagagaucuccaaaacaguuggcugcuuacauaaguagguaagagcuucuuuaacauuuguaggaagaauugaaaguagacgugaagacauaaaacaaguaaaugcucuuuuuuacuauaauuacaguuaacuuguuauccagcuguuccucugugcugggcucuguacuaaugcaucagcauuaucuauuccuuauauagaugccauuauuccuaaacagugacaagaauacuaauagucagaggaaauaugugauuugcucaggaucaaauagccagacagcugucaaaauggccuguacucuaagagcagcuuucuaaaccauggguauccacgguaugaccuggggucccuggaggccaacagggaggguuugaaguccuugcucaucuuguccauuuuuacucuuuuacaaguguacaguaugagcuguucagaaauagcauaauauuaaauaacaacagacagacagaaauaagaauacagcugucgucuguuaaacugagaaguagaaauugguacaaaugugaaacagcuauuucuguagucuuucuguucagaaaaaaaugugcuccuuuugguaaaauauucuaugacaguauguuucuuagcuucccagaaccaugacuuuuuauaaggaggaaacauucugggggccauugugguagugcaugccucgauuccuagcacuuggcaagcugaggccgcagaauugugaaugcagguucagccugagccacagggugagacccaguuucaggaaaaacauuucuuuugguucaugguuucagaacuuuagucucugacuuguugccuuugggucugugauuguggugaaagaaaacugcuucccuaugaugguaaggaagcacaaaggaaaaauaauaauaacccccagagugucuggaaacuuguacucuauaagauuuuguuuguuguauucuuucauacacaaaauuaaauguguuccagcauaaaauaaauuuaaaauuuuuuacuuacuagaaaauguguuaguuguuuagaaaaaagcuuagaugucugaaaaguguuucuguuuccauggccuuuaauauuuuauuuuaaaacagaagcuauuauguccuuuuguuuucaucuuguauaacuuaccauauuuuuuauugccuucccgguaauuuauaacuuuuauuuuccucuucaaauuaagaguuuuaaaaucauuuucuucuaauuuuaguggauuauaauugcaaaauguagcugauuaaauuuucauuuaaaaccuuuuuucuuuuuuaaaaaauuuuuaaauuuuuuuuuuuuuuuacagaacaguugcacaggcagugaaaagcccagaaaaacugcgcaaggugcucuaccacagaaaguuaguucgucguuccuucccaaauccuuguuacaaaacuaagcaguccccaaaaagugggggcugugacauggcaaauaaagaaaaugaacuggcuugugcaggccaucuaccugaaaauuuacgccacgacagucggacauuugucauuaauaccagugauucugggucuucacagacagaaagcccaucaucaaaauauagugguuucuuuucugaaguaagucaguuuuagcuuaauuuauuccuauuguacuacuagguugcuuuguuuugguuuugauuuccuuuuuguuuuuucccuuguguuauucuauuagcugauagccacucuuaaaauaauauguauuugaauuguguucacugccuaagacaguuguacagaugaacccccugucucuaacagcgucugaaauagaaugaaauaccugauaggcuguuguaaaauauccaaagugacaaguuggcaaagagaaauuuagaagaagaggguaaagagacauuuuaccuuaaaaaguagaucauuguaaccuguuaucucgucaguuuugcugguucuuagagcugccagugguuacuugauucagcaaaccggcuucuacaucuuuuaacuguaaaauuaacccuaaggaaaguaacuauacaaauguaugcauuuacacacauuacaauguuuacagaaacagcuuaaauaggaaaaaaaaaacagaaauaaucuaaauagugauaaagacuaaaaauauguuacuauuuuuuguuaaaugaaauccauauguauuuuagcauugaaaaugcccauggauucauguuuauguauagggaaaaaaguuuuuuuaaaauaagauuuuaaacuuuuugguguguaacuauauguaccuauuugcuauugucuaaagcaugauuuggaaagacgcauuccaguuuaguggcuguaauugcuucuggagaaugacguacuucagauacuuuugccuuaggguagucacuuuuugucucaaauaguuuugagcuaaaguuuucauaacaggaaugcauuaccuuauuuagaaauacacuuagauggcacauucaucuugcuuguagcaggaccacacuccaggcugugcuuccucucucgugcuauucauuugguaaucaguagccuaugugcuuacauugucucugugcccacagcccuaaaacucagcuagaaauaucuuacuauauaaacuacugggauuuuugaaaaaacaauagcaaggagggaagaaagaaaaaguacuaaauuuauccacaucacucauucacuguauucaacuguaaauuacuguauuccuuuuugagggccaguauaaggcauucccuuugcauaauucaaggcugugucuaccagaacauuuucauuuaaaaaaaaaaaaaaaguugugucauguuucagugugguuuuuaacaaauuagaugauugccuuucagguuucucaggaccaugagacaauggcccagguucuauucagcaggaauuugagauugaauguagcuuugacuuucuggagaaagagaaguauaagugaacuuguagcuuauuuagugaggugagugugauguuuuuguuucuguuuaacauuaguaaucuuuaaugagauaugaaaagagacuuuuaagaaaguuuuuauugguuuuauucaaauuuaaacauuguauuuagcauccauagacacacuauaguuuaaauuauauucaucaccaauuuaaguguaguaaggauacagaaaacuuuuaucagauuaaacaaagcuguuacuuuuucugguuaggauucuuuucuuaucuguaaaacuuaagugugggaaacuuaccauucuaaaaacaauccccuuugggaguuuuaagaaucagucucccuccucguugcaucuaagucucugaacacugccuuacuggugccuacuccacgccucgcugagugccuccuuuaaaaagauacggcucauccuuucccaugucuuuuucuauuccuccacagcacuuagcaucagcauccugcucuauauagucuguguucaucucucuuugauccauugcugccuccaacacccacucaggcacucgaaagcaaucccugucucuuuuuucccuuuauauccucaguacucgacucaugauaaauacugaaguuguucaauaucaaaugccucgaaaggaggauggagacuguaauaugaauauaacuaaggacacuguaagcaaugguaucugucuuauacucacaggauagaagaccuuggaguugugguagauugccuuccuguucuaaccaauagguaaaaacaguaauuuuuuuuuccggaaaaaaauaaguuuuaaagaaaaauuuaaucaguucauauuuuauaacuuagaauuucuuuuaguuuacaggaagaaaagcaguauaucucacuuggcugcuguguagacuuacuuccucugguaaagucuuuacuucaaagcagauuugaagaguaagugcuaaauuaaaucucaacuuuuuucucucaacauucuugauuuuuguguuuugugaguucauaauaggagacuggacuccuauacauuugggagauacacgaugccuggguuuuuuuguuuuuuuuguuuuguuuuuuuaauuaaaacaucaaagcuacacuuuauuuacugugacagugggguaagagaacaaccucuagaauuaaguucuccuuccagcgugugaauuuccgaguuacucaguugucagcuuuggggucagauucauuuacccacugagccauuuucuccaacccuauuucuguucccacgagguuuauaguaugauuaggacaggaauauaaaacuaaagaaaaaucacaaaaggauuaagaacagcuauguaauuucuaugguuuugugaaguauauuuuucuuaaggagcaugacugguguauaucuguggggacuuuugggggguagcguuauuguuauaggcuuauaugaaaacacuuaauuuugucacaauauuuuacuucagauauguaauuguugguuuaaacuggcuucaagcaguaauaaaaaggugguggucagaacucucaucuacgucagaaauuauaagugauggguaaguauaacuuuaaagauaauuuaugcugaaauuucuauggaaaaguaucuuaauuagacaaaguagugaguuuauucuguggucaucauuguauaauuuuauuuucuucauuuucagagaaauauuaaacugagguacuuuuuauuuaugaaaaaaacaugcagagucccaaaacuccuuauaucucugcugcuagaaccugaccuuuuauuuuagguuuguuuugguuuguuuugugaugcucucacugugugucuucagccccagcguucucggugcugguguaagacagcauagcuaucucagcccuucccucccgagguaacagcucagcagugguguaaccuucacauggaaugugcuagaaagauagaagaaaggagcugcccuugguguacuaaggaauggaaauauccugacaggucucugaaaaugguuacagucagcaugccuuagcuugaaaauaugugaggagucucucaaaugauuugaacccaagccaggcaugguggaacaggccucugaacccagcacuaggaaggccaaggcaagaagaacacaagcuugaggccagccuaggcugcacagcaaaacucuguauugccagaugguguugaaaacaacagucucucuccucacuaacucccucuuagauuccauaaucuuuguaaacucaguggaauuuucuacuucauacccaagaaaguuguccacuugcuacaaaugccuacuugcugucucaucuacuuugacagccaaauauccaugaauuuuuguauggcauagcauauacuauuuuaagaaguuucuugacuuuguuauaugauuuucuacugauauaaauaaauuaaaagcaagucuguaucuuacuauuuacuuucuucucuuucuuucuuuuuuuccccucagaaauauuaagauuuuaaagcaacaguugaguggacuaugggaacaggaaagccaucuuacuuugguuccaggauauacugguaauauagcuaagguaaucuauauuuguaauuuaagaauuuuacauuuugaccaguauugauaugcuuaucucuuacaggaaaaaggcacauugcuaguugggauuuuaauauuuaaacuccuagaggacauugauaguuauaauugcagaaagaauugguggugagaaguauuuccaccugcugcuuggcauuugcugucaugaguaguuauuuaccaggaaauaaaacauuguaugguuuaagaaaguguuuaugucacuggcucaugaaauuuucuuggguaccuguguaaaaagaaacaaaugcgauugagcauuaaauauaucacuauaugugauuguacacacauuucccagcccccuaccccauccccuuuucucccucccucccuuaccucuuugucuuuguuucugcucgaacaguuuuacuauguagcccuggcuggccugggacuugcuauguaggcuaggcggccucaaacucacagaaauuggccugccuuugccucccaagugcugggauuauauauaucaccaugccuggcaagaauucuuuuuugacucacuacuuuuacucugauuacucugacauagugaguuuuuuuuuuaauguuuuggguuauagucacacuuuuuucaaauucaucuaacauccuucugaaucucucauucagacuaaagucuuauaaacaguucuauuuuucugagguuguuuguugcuugugauuuuaaaguauacauaacacugugaagacuuuaguagagcugaaaagcauuuuuugccuaaaauuuugauuuuuuuuuuuuaauguuagguuauugggacaggucuguauagucagggcuauccucgugucacugugaagccccuccuggugcugaaaucaccaucuucuuuccucagcucccaagugccgggagcagaggaguaugcugccaugccugguuaacuuaaauucucuuuuuauuaaaaaagaaaagccuucugauaaacauagccuuaagauacuauggugaucaugaaaauugucaaguaauuaaaguuucaauguaaagucuauaguaaaaucuugauaucagcccuaaaauauguuacuuuauguuauguuuucagggagcaauggacgguauauaaagugaauaaggaaaaagaaacauuaaaagcuguacauuuucauuuaaaauuuaaaaauaaaugauuucuuugacccauucauguguauagugcauucuggucauacugaccuuauccuuccacuacuuccagucacccguccucucccaagucccugcuccaccuuuaucauaccuuugugguuuuuguuucuugagacaugguuuuucuguauagucuugacugugcaggagcucgcucuguggaccagacuggcuuugaacucacagagaucugccugacucugccucccaagugcugggauuaaagucaggugccaccacuuccuggcuugcuuuuauauuuucuugccuugcuuuuguuucucuuuaugagcuguccacuguggcacugaaaauaguggcuuccucuccuacagcagcccuugacugcuuuauuacaccaucugauuuuuagccuggagaaaaacaaauggguggggaguggaucuggagaggggaucucaaggucuccuccuuacagaggaccuggcuucacuuuuuaguacacacauugcauuucagagccgucuguaacuucaguuccaagagauucaguguccccuucuggcugcuucuggccguaugcauuccugugaugcacagacauacaagcagacaagcauuuauacacauaaacucagaauaaauuauuuuuaaaaauaacuugaaauugucaaacugugccuugggcuuugguuucuauagcacuuacagaaucucugcauuuuaacugcaaagcagaguuguugaaacacaggaaccaaaacauucacuuaguguuugcucaacguuauugaacauauagcaugugccaggaccugugauaaacaaaugcauauaaaauuuuugaauaagacuucuuccuucuuuuuaaagguuucaaagggaaguaaggcaaauuaagaaacaagcagaaaagaaggcagguugagugcguuuguauuugcuugauuaacugaugggauguuuuuucuccuuuaaggauguagaugcuuauuuauuacagcugcauugaaagauuucaucuuauaaagauuugaguauucagacagcgcuggauucuaugauuuccaaaaggaggucucuccugagaaccgagagcuguggaagaaauaaaaccaauuuuuuucuuuuaaaaagccacauaauaaaaccacuaaugaaauccuaacaaucuacuucacauugaaguggaaauaucaagaaggagcggcaucaacuucaaugaggugaaagugcacuaugaagacuguuugccuuugcugcauucagaauucaaaugacuguuugauagcguuguuuaagaacuacugggucuucacucggcccugcauaagaauaugauugauaguaugcaaaaauaagacaggacuuauuaccaggaacuauaaagaccaaucauuaaauuuuuuauuguguuuuaugaagaaacacuuaagugugugcagcuaauuucuucuguuggaaagacuuggaaaguuuaaaacaucauaguaaguaauauuaaaaauuuuuguccacacugauacuguguacaaaugccuuaauuauugauaagccaauauguuauaauaccaauaucuuuuuuaaaaaaauuaaaagcaaccaugcucuggcaugauaaaaucauggaauuaaaucagggguuuacauucauguagaauguuguugaaauauauucgacaccauuuuuuuaaacuugagaaauuuuuagcaucucugauucuuuuugucagaaacuucauguuauguuuguauguauguguuauucuuauauaaagaaaaaaggugaauauguauuuguaugaauguuuaacuggaaauguccauggaguuggcuaauuuauauucacuuuuuauuguauauagaguucuaauauuuuucauuucuguaacauuuaaacuuccuuugaguaaauuuacuaaauauuucuauuuuuugcuuuuuuaauucuaauuuuauaugaaaucugauuaauuccuugacacuaaauguguucugaaaaguuccacacaauguuucagaauuguuuacaguuaaugcugacauuguacuuuaaguuccaacacagugcaucacuaccuccucuaaugguuaguaggaaauuccagcaaaccauaugcaagcguuuuuguguuuuguuuuguuuuuuuuuuaauauggccauuugaaguaucaguguacucaauucuaggaagucauaacaguuugaaucguaccugucuuaguuggaauugcaguuagcuaccacuccugcuggcccauucaucaucuuucuuuaguaaggcuugcaagcuuccagaaaagauaaauugacuuccucuucauauuccaauguacauuuuaaaacuuaaagcagugacuacugagacccccagccccccugcccuccaguguuauuuuuuaacugaauucuguuuuguauagcuauuauuccagauaucuauguacaccacagaaugaauauccguuguaguaauugauuauuauauccucagauuagagucacauccaaaugacuacaguuuugugauuucgaggugagguauguaagaagucauucuucagaacgugggggugucaugaaccuccauuccccugaagccuucagcugggaacuacagccuuucuuucuucuuagccugcaguuuucacugucuuauugaaccauuugggcagguugaugugguuugguuggagugugaugcuagugagacuaaggguuugagucugauccuuuuaaauucauuaacuucucacgugcacaaagaaauucuguaguuccugauugcauauuucuuucaguauccacuuaauaaauucaguuugugaucucaaagaauguggugugcauaguuuacuucucaaagagaaauagaaugauugauuuguauaacaguauagauuuccaguuugaagagaaaauauucaaaauaagaccuaacauacuuuauaauuuuuuuuuguuuguuuuuguuuuaagacaggguuucucuguauagcucuggcuguccuggaacucacuuuguagaccaggcuagccucaaacucagaaauccgccugccucugccucccgagugcugggauuaaaggcgugcgccaccacgcccagcuauacuuuauaauuuuuuaguugcacaauaucaaauacuauggaucagauuauugacuaaacaguaucuuuuuaaaaaaaaaucaaaguucaaguaaauaucaauaaaaauugaguauagua

SEQ ID NO: 979 - RNA, 4018 nt, Mus musculus
acagcaaacauaugaggaauuuuuuaauaacaauuuucauuuagauuuaacacaaguugugucuguaauuaacuggaaauuaguauguaauaacaacacuuauauaucaguauauuauaauguauauuagcauguauuauauuuauauuaauaugauauauaaacgcaucauugauuauauaauguauaauauaauuuuaauauaguaauauaauuuguuauauuaaucauauuuuauauaauugugccuuguauguuauauuaaugaaauauaaacauauaauauauaacauacauugauaucuauuauaucuuauauuaauuuauuuauauauacauauuaaaaacaauccccaccauagucuaggaagcaccccucaaacuggugucaguccuugcuucuucagauacuucuugguuuauaauuaugauuuucauuuucuagggcccucucuuucaugggaaugaguaucugucuagcucugauguucauuucuucuugguauuaugccauuguagcuaugguaauagcuggcaugaucuacaaguacauugaauaucaaggguaaguuugaauuuuaccccaucacugcugaauggggcaaucaagaauggcuaguuuggggcuggagagauggcucagcaguuggagcacugacugcucuuccagagguccugaguucaauuuccagcaaccacuugguggcuugaaauuauguguaaugggauccgaugcccucuccugguaugucugaggacagugacaguguacucacacacauaaaauaaauaaaaucuuuaagaaaaaaaaaaaaaaaaaagaauggcugguuuggccaugcauguugucacaguagacaggaggcugaagcaggaaaguugcaaguacaaggcugggcuccauaucaagauucucccacaccaaaaaggaaaaaaagaaaugcugggcuggagauaugauagcccagugugguuaguagcacuugcugucccuccacaggaccauaguuuggcucccagaacuuacccagcagcucucaauccacauguaaccccaaccccaggggaucuggcaccuguuuugaucucuagagacacaugaacauccaugagcauauccacacauauacauaaauaacgcucuaaaaguauaacccaaauauaaacagcuuagcugucucaagcaggggaucaucugaaauacaauuaacccugaaauaaccaaaaccuccagcagccuccaaaacugggaaugaauuaucuucugacucagauugcuuuggcuuuacuuccauuauuuugaaaaucacaauuacaaguaauuucugaaucugaauugcuguuccaaauaguuacuuuugaauagauccacacaggguuaagugaguaacccuggcagccuguauugugaaccccucuguagggcaguccaucucacaguguguuccucacgcuagugggggacaacagauaaaccacaagccugaguuuuaaucuucuaccuuguacauacuuuacugcuagauuuagagaauccuggguuuuauuuuuugaacuuguacucacuauaauguaaacugacuaucccucuuuuuucuuuuucucccaagggcugagaaagaauggggggaugguauccgugggcugucgcucagugcagcccgcuucgcuuugcuccgucuagaggaaggaccuccucacacuaaaaacuggagguaaagcagucacaaagcagagcuuagucgugugugcccauaguuaacacacagcuguacucugcugaucaccagauaaagaaaugauguggcucaaggaacuguugaacuauccccuaaccuuacugccuuucuuacucuuauaucuauuguuguuacucugugaauauuggucaguuuuagcuaauacugagaacauucaaaguacccaagaacccucaucuuaccauuccacugauuccauucuucugucaaaguugaaugcuuuguggcccuccugagguaaaggauggagaugccaucaguuucccacacccaccccuucucacucacaucuucccaggccucagcugcucguccuacugaagcuggaugaagauuuacacgucaagcacccucgccuccucaccuuugccucccagcucaaggcaggaaagggacucacgauugugggcucugucaucguggggaacuucuuggagaacuauggugacgcgcucgcggcagagcaggugaggagcacugucucugucugugcuucucaagcaugugugcccugcaggcuuccaaggccagcacugcugugaggaagagggcagucauucucucccagaugguaaaccuuuuauguuaucauagaagaggagcuggaaaauccuuuuauuccuacuaacuucaaaaaugcuuuucugagcggggcauguagugccugccuuuaaucccagcacuuggaagauaaguggaucucugugaguucaaggccaaccuggucuacagagugaguuccaggauagccaaggcuacacagagaaacccugacucacacaaaagcuuuucuguauguacccuugacaacagauuuccuaggaaaucauagaggauaauaaagcauuugaauaguauaauagauguaaaaaaaaucagaaacauuaacccaggugacaaaaauuaauuuuuuaaaaaaucauaugguuacaaaugaagagccuuacccuagauaaccacugacuuaauuugugucuuuggaaaaaucauauccauuuugugcaucauuauuaccuuuucaacaaaggaguaagguaaaaagaaauggguauaugauauuagcucuaaguuagcuugacuaaaugcagcacuaauaauuuaaaugcagguguccuuaccauucaaacaucacaauaaauagaagaagagaggaggcgggggaggaaaccuuaucugaggagauucugaaguaaaacuuccaggaucaucagauuaaguuucuugaaaaaauaagucaggacaugccugggaugacaagaguaugguguuuccacuagugaacucacccugccagucaagccaugucugguguucacuuuuuggacaucccugugcucagugcuucaccugaaagggaagcacgcagaauagaggaaaagggagaggagcuacauguggacagccagcuacagauagaaauacagaugacacuucacugaacacauuuaacuucuugaaguuuucuguugagauaaucuuauguagaaucuggggagagauggaaauacagaagccagagggaacgauaagguuaaaagugcaggauaaagcaguugaaguuuuguguuuuuuuuccucagaccauuaagcaccuaauggaggcagaaaagguaaaaggauucugccaauuggugguggcugccaagcugaaagagggcauuucacaccucauccaguccuguggccucggaggcaugaaacacaacacaguggugaugggcuggcccaauggcuggcgucagagugaagaugcucgcgcuuggaagacuuucauugguacagagucuuguauuaaccugagggcccagaagggggacuagauuaaaucucugucacccuaacucuguccuaaaguagagaccaugccaugaaacauacuguuagacagccaccuaaaacuaguaaccugaugaaagaaaggggacuagauuaaaucucugucacccuaacucuguccuaaaguagaggccaugaaacauacuguuagacagccaccuaaaacuaguaaccugauguuagcccgccuucuucaucuuuacauuuauguccacaaaguauuuagcuaugucacgucucaaacugucauauuccauucugaugaccccacaggaacuagaaagauucuuucgucagucucugacaaauucaugcauuaaauauguaguauaaaguauccacaguuaccuaaaucacgguuccccauucaauuaguaguuccccagacuucagacagugaucucugcuccuuaaguguacug

SEQ ID NO: 980 - RNA, 4009 nt, Mus musculus
uccuccacauaguuuauuucaauauuauuugucuauuauuauaaaauaggcaaauggaaugagaaaacuaggccaaugagauaauagcuuguuaggcaaaggugcuuguugccaagccuuaguacugaguucggucaccaggacucaccucuuuguaaauugguggaaggaaacccaacucccaaagagcugccuuccuacacacacacacaaccuuuaaagaaugagaaaacuagagauguuaaccuaacaaagaaacgaucacacuauccauagucaagugaaaagacucugagccucaaaauaaugaguaugugagcuggucuucuuucugccuuaacugugugauuucuuccccacucagggaccaguccaacgugagacggaugcauacagcagugaagcucaaugaaguuauagucaacaagucucaugaagcaaagcugguuuuguugaauaugccaggaccaccccggaacccugaaggugaugaaaacuguauccuuuccgagagugaagcagccaauggggggaauucuucucaagacagcuggauagugguuaaagucagucaguuccccauuuccuucucuaaggaggagcuuaaugucauagcugaggccacuuccuaagugagauuaaccgaucgggaagcuggggcagcggauuaucaugaucucagugaaacccaagaauaccaagguggugaaucugcagagacuuguaguuuucagugauaaaccuggagacagaacacacaucguucuccuuuucaggauccucgcucugcaaagcugcuuuuggauggaguuagguaagaagcacuugaaacuuguuaauggaacugagaaaaagaccaaggauucugcuucaucccaggguugcuuuuaugggaaaccucccagcccugcagugacaggacuggcucauucuuagcaacaccauugaggaaaacagggguuguuuuauuaaugaagaaacugguaugaaaaucugacucaugcagcuucacuuagaaauuuuguagguucucucuagagaucuuuuaagcugguuuuuaaaaaaaacuuuuucuuacuuggcauuuugucaaaaggauaacauauuacuugugaauucuuuuucauuuuugauuugugugugcauacaaauuuauagaggcauaugaaugcacacauacuauagccuguauguggaggucagaggcaaaucuuugagucagucaacucacgucacuaggcuuuuguacagcaaguguuucuaccugccucaccuuaucccccaggccuguuuuuuuuuuuuuucaggugugucgcuugcacguaugcaggucugaaguguuuguugaauuuucuagagcugaguuagagaugaucaugagccaccacauacgugcugggcacucagaccuggguccucugugagagcaucaacugcucuuaacuacugagacauaucuccagcaguuaaaacuguuuauaugaggcauggugacucacacccuuaauccuagcauuggggaggcagaggcaggcaaaucacugacuucagggccaguuuagucuacauaaugaguuucaggccagcuagugugacacaauagugugggagugggugugcacgagugcucucaggacucauuccagggaacugaacucagguugacaggguuauacaacagauggcuuucagcaguggggccaccucacuguuaacucaguuuuaaaucacauuuagaaaauaaauacaggcuggggcugucacucagugcuagaauguuugccuaacaugcauaagauuccugguucagauccaaguacuuggagcacgggaacaaaugagaaugucuuguauuaaauacacaaaggcucuagauuccacgauuauuucauaaguuuaaaacugaauccaauuccaggcuuggugguacaagccuauaaucucaggaaaauuuacacaugucugucuggaugccauagcuagucaagaucagccugggcaguucagugaggcccugucucaggauugaaaacaauuaaaaccagagccggugaagcagccgcacagaguaguguguuugccucgcaagugcaaggcccuagacugaaugcacagcacggccgagugaaugagugcguggauauauagaugauguugagucaaguucaggcuuuuccuauucagagcaggucuaugaucaaauaaacuuagauuacugaugccagguuauaaagugcacuacugaucauccuauuuccuugacaacuucugaagacauggaauuucuagaagugcucacugagggauuagaacgaguccuucuuguccggggugguggcagugaggucaucaccauuuacucauaaucagcugugggagauucugcgugguccgacuucccuaagacucaucguccauggagaugauagcucuuuccuaccacucccacucuauucuugcagagcugagccccaucuaugcucuuggcugcaacaugaucugccaucccagcagaaacaaauaaucccucaacagaagaauggucaaguccuaaaagcuauuucuauggcaggagaaggcaagucaaaauuaacaagcuaagccaaagggaaccuuuuggcacacagaagguaaugaguuaguaaaacauaugcuagaaauguaacuggcaacagaaagcaauguucauaucuaacauucaggacgaguuucagaagacacgggucagugagcaccagaaaguuaacaggcaguuaagcuucaccuuaguaaaaaaugaguucccauuauagagacagccugcagcagccaggauggaaacaggauacugauauauaaaaccugagacauagcugcagccacuacuucuuccucaugguuuauugucuguacuguaccacuguacauuuuaacugucuuuguuuuaaaacccauucugugguuauaaugcagacaguaguguuacuauagaaauguuuuuuugaaaggcuagaaauguuuuuucagguuuucaaaugcugaacuaaggggauuccaaagagugcguauuaaaauauauagaaacacagugguuagcuaugcaacauaaagcacacaagcuauuaucuuaacaaauguggguuguuauguaguuaaccagaagggucucuucuacucuuaguaggcauuggucuuaaaaaccaaacaaaccaaaccuguaaggaagagacgccagggcugugugaugccaccuccaaggccccaggguucagagguucagcaguggaacugggggugugaaagccauacccuuuccacugugccaaaaucgucugccuacacuggcagacagguuugcaguggccugacacaagcaccuuuucuuucacaagaaauccaucuguggccucuucaccaaagccauagugcagauuugaggcacucgaccuccaugcccagagcuuuucccgucucaauauuauuauuauucauucugacuucggaaacuuggcucugaaacaaaugguucacuaagcuaaugaucugcuguauugguuuugcuuucaaaaagcucuaacugugccaaggaaauacuuguguaagaucagauuuuuuuuuuuuuuuuaauuuacugaucacaaacacuuggcuuaccagcauaggcagccuuuguggcugagcaguauucccagggugugaaaccuccauacccuuuccaagauaguuacugaagaaacugucuucuugcuuagauucacggcugcuuuuacauuuccuuucacugacaguaaauugugccacucuccauacccuguaggacaaugaacacccagaauucaacccaagacagaagaaaacccucaaauauggcuuaagaagcugagucauaugguuuguucuuccuccucccaggcccacuugaguagcaaaggauccagcauguuuuccuuugcuuccugcagaggguagaaacuacucguaguucucuuuccaacacuccauugcauacuugaguauaauccccuaggcu

SEQ ID NO: 981 - RNA, 4009 nt, Mus musculus
agccuaggggauuauacucaaguaugcaauggaguguuggaaagagaacuacgaguaguuucuacccucugcaggaagcaaaggaaaacaugcuggauccuuugcuacucaagugggccugggaggaggaagaacaaaccauaugacucagcuucuuaagccauauuugaggguuuucuucugucuuggguugaauucuggguguucauuguccuacaggguauggagaguggcacaauuuacugucagugaaaggaaauguaaaagcagccgugaaucuaagcaagaagacaguuucuucaguaacuaucuuggaaaggguauggagguuucacacccugggaauacugcucagccacaaaggcugccuaugcugguaagccaaguguuugugaucaguaaauuaaaaaaaaaaaaaaaaucugaucuuacacaaguauuuccuuggcacaguuagagcuuuuugaaagcaaaaccaauacagcagaucauuagcuuagugaaccauuuguuucagagccaaguuuccgaagucagaaugaauaauaauaauauugagacgggaaaagcucugggcauggaggucgagugccucaaaucugcacuauggcuuuggugaagaggccacagauggauuucuugugaaagaaaaggugcuugugucaggccacugcaaaccugucugccaguguaggcagacgauuuuggcacaguggaaaggguauggcuuucacacccccaguuccacugcugaaccucugaacccuggggccuuggagguggcaucacacagcccuggcgucucuuccuuacagguuugguuuguuugguuuuuaagaccaaugccuacuaagaguagaagagacccuucugguuaacuacauaacaacccacauuuguuaagauaauagcuugugugcuuuauguugcauagcuaaccacuguguuucuauauauuuuaauacgcacucuuuggaauccccuuaguucagcauuugaaaaccugaaaaaacauuucuagccuuucaaaaaaacauuucuauaguaacacuacugucugcauuauaaccacagaauggguuuuaaaacaaagacaguuaaaauguacagugguacaguacagacaauaaaccaugaggaagaaguaguggcugcagcuaugucucagguuuuauauaucaguauccuguuuccauccuggcugcugcaggcugucucuauaaugggaacucauuuuuuacuaaggugaagcuuaacugccuguuaacuuucuggugcucacugacccgugucuucugaaacucguccugaauguuagauaugaacauugcuuucuguugccaguuacauuucuagcauauguuuuacuaacucauuaccuucugugugccaaaagguucccuuuggcuuagcuuguuaauuuugacuugccuucuccugccauagaaauagcuuuuaggacuugaccauucuucuguugagggauuauuuguuucugcugggauggcagaucauguugcagccaagagcauagauggggcucagcucugcaagaauagagugggagugguaggaaagagcuaucaucuccauggacgaugagucuuagggaagucggaccacgcagaaucucccacagcugauuaugaguaaauggugaugaccucacugccaccaccccggacaagaaggacucguucuaaucccucagugagcacuucuagaaauuccaugucuucagaaguugucaaggaaauaggaugaucaguagugcacuuuauaaccuggcaucaguaaucuaaguuuauuugaucauagaccugcucugaauaggaaaagccugaacuugacucaacaucaucuauauauccacgcacucauucacucggccgugcugugcauucagucuagggccuugcacuugcgaggcaaacacacuacucugugcggcugcuucaccggcucugguuuuaauuguuuucaauccugagacagggccucacugaacugcccaggcugaucuugacuagcuauggcauccagacagacauguguaaauuuuccugagauuauaggcuuguaccaccaagccuggaauuggauucaguuuuaaacuuaugaaauaaucguggaaucuagagccuuuguguauuuaauacaagacauucucauuuguucccgugcuccaaguacuuggaucugaaccaggaaucuuaugcauguuaggcaaacauucuagcacugagugacagccccagccuguauuuauuuucuaaaugugauuuaaaacugaguuaacagugagguggccccacugcugaaagccaucuguuguauaacccugucaaccugaguucaguucccuggaaugaguccugagagcacucgugcacacccacucccacacuauugugucacacuagcuggccugaaacucauuauguagacuaaacuggcccugaagucagugauuugccugccucugccuccccaaugcuaggauuaagggugugagucaccaugccucauauaaacaguuuuaacugcuggagauaugucucaguaguuaagagcaguugaugcucucacagaggacccaggucugagugcccagcacguaugugguggcucaugaucaucucuaacucagcucuagaaaauucaacaaacacuucagaccugcauacgugcaagcgacacaccugaaaaaaaaaaaaaacaggccugggggauaaggugaggcagguagaaacacuugcuguacaaaagccuagugacgugaguugacugacucaaagauuugccucugaccuccacauacaggcuauaguaugugugcauucauaugccucuauaaauuuguaugcacacacaaaucaaaaaugaaaaagaauucacaaguaauauguuauccuuuugacaaaaugccaaguaagaaaaaguuuuuuuuaaaaaccagcuuaaaagaucucuagagagaaccuacaaaauuucuaagugaagcugcaugagucagauuuucauaccaguuucuucauuaauaaaacaaccccuguuuuccucaaugguguugcuaagaaugagccaguccugucacugcagggcugggagguuucccauaaaagcaacccugggaugaagcagaauccuuggucuuuuucucaguuccauuaacaaguuucaagugcuucuuaccuaacuccauccaaaagcagcuuugcagagcgaggauccugaaaaggagaacgauguguguucugucuccagguuuaucacugaaaacuacaagucucugcagauucaccaccuugguauucuuggguuucacugagaucaugauaauccgcugccccagcuucccgaucgguuaaucucacuuaggaaguggccucagcuaugacauuaagcuccuccuuagagaaggaaauggggaacugacugacuuuaaccacuauccagcugucuugagaagaauuccccccauuggcugcuucacucucggaaaggauacaguuuucaucaccuucaggguuccggggugguccuggcauauucaacaaaaccagcuuugcuucaugagacuuguugacuauaacuucauugagcuucacugcuguaugcauccgucucacguuggacuggucccugaguggggaagaaaucacacaguuaaggcagaaagaagaccagcucacauacucauuauuuugaggcucagagucuuuucacuugacuauggauagugugaucguuucuuuguuagguuaacaucucuaguuuucucauucuuuaaagguuguguguguguguaggaaggcagcucuuugggaguuggguuuccuuccaccaauuuacaaagaggugaguccuggugaccgaacucaguacuaaggcuuggcaacaagcaccuuugccuaacaagcuauuaucucauuggccuaguuuucucauuccauuugccuauuuuauaauaauagacaaauaauauugaaauaaacuauguggagga

SEQ ID NO: 982 - RNA, 5024 nt, Mus musculus
aaacauuaagcauuguucucaaccguuuaauuuauugaaaggagaagcugcuacugagcagcugcuauucuuuuguuuacauagagucugguuuuguuuguuuugcucugugcugggaacauaaauaaaguuuucuacauuauuuucagucauaaguugugcuguaguuucuuuucugcuguaacaugcugcacacuggccucaccacaggaggcucuucuccacaugcaugacuguuuuaagggaggauauuuaggagucaacagcuuaaaaugcagaugagguccauaugcauggugcuuucugggggucacagaaguaagccuccuccacugaacuccauucucuaaaaaaagaaacaguaaagaggucaauggcaaacaacuucuuaguuacuuuaucacaagcucugcuguacaugaccuuguaacugccaaaugccuguaaacuuccaaaccuguguuguuacuuaagaaaugaacacgugggcuagugagagugcucagaggguaagggcacuugcugccaagccugaugaccugaauucaguucccaaaacccauauauucagucggaaguugugcuaucguuuguuuguuuggguuuuuuuugccagcuaacuugcagcaccaaguucucugaccuccaaaacacacacacacacgggcaugcaauaaaaaauguaaaagcuuuaaauaaagcagcccucaauaccaacauccaaugagcucacuagcuguucacugcagacucuguuugccugaaauuuaacuuuaaccauaccucagggggcucaauaaaggcuagccagucugaugcauguguaggcaacagucccauggacuggcacuuguaaacugccaaugccaaacccaucagguucccaaugagauagaccaagccuugaagaaacuucugacuugaacucuccagcaucuugaaagcuguugggauuaacagacauugucaacaccauuuuccucccaauaugaaaccuagaauuuaaacauacagccccaaaauaagauuauaaaugguacgacgacuaccacuaccaaaauacccucuagcuaaaaauaugccaaagaauuggccuucauuccuuagcacccagggaaggaguauuauuuucugaauacuuacuggcugaaauggccauaagugcuugaaugggucgccaggccaucauacacaccaucauaguagggaagauggaaaugguguugccugccauguacaugaugaagagguucaugggaaucugcuugaggggacccaaggcgaugucccagcagcgcuaaaauaaacacacgguuuagaccucuaaucacuccccuucagucucucguguacuguacaacugaucuuaagucaugugaacagaagcuucaguucucugcuagacugaacuggcuuuucagcuccucuuuagguugcuacaaguugcucuacuacucuaccccugugcuuuuucccuauauaaacuuucuggggccuuuuguuuuucaggaucauuccucuguguagaucuggcuguccuggaacucccucuuuaaaccaggcuggcuucaaacucagaaaucugccugccucugccucccaaguacugaaauuaaaggugcgugcuaccacugcccagcaaguuuugagaaauuuaaaaucuuuuuguuacuugagacaaggucuugguauguccagguugaccucuaaauugagaccuuuuuuaacaucccccaaaacuaauaggauuguagauaugcaccaccacaccuggcuaaaauuccaugaucuuaagaacaugugagaagacucagcaucuacuucaugaaagucagggaaaggggcuggcgagauggcucagcggguaggagcacugacugcucuuccaaagguccugaguucaaaucccagaaagcacaugguggcucacaaccacccauauugagaucugacgcccucuucuggugugucugaaggcagcaacauuguauaauaaguaaaucuuggagaaaaaaaaaaagaaagaaauuuaagcagggugugguggugcacgccuuuaaucccagcacuagggaggcagaggcaggcagauuucugaguucgaggccagccugggcuacagagugaguuccaggacagccagggcuauacagagaaacccugucuugaaaaaucaaaaacaaaaacaaaaaagucaggaaaagaacaaacuaaaggauuuugagaagaaaacaaaaaugagagcucaucaaaaauaaaauuuucuuuuugcaagauuauaaauucaauucugguaagccuggaggggagaaggacaacucuuccauguccagagagaaggcacgcagcuuuacagacccuccaggcgucacacucaccaguuuagaaacuuguggacuauuugaaaguuucggaaauggauacauuccuagagacaugacuuaacaaauugcauaaggaaaaacaguugcauggcaauuagcaaagcugacccuauaauuaagcccagaucacuuucuuggcaaauucuaacuauuuaaagcuaaaaauacaagucuuacacaaacuccuuuggcagaaaacaaaacuaaaaauucuacaaaucuuguuaauacccaaacccuaaaagacuauuaugagauauguauguaugcauguguauuuuuguauauauacaaaauaaaaaguuauaauacuuaugaaucuaaaugaaaaauccuaacaaggcacuggagaagugacuuaguguuuaaaaguacucguugcuuauucaaggggaccaauguuugguuccuagcacccacaugguggcucacaaugauccacaacucuagagcugggggauccaauaccuucuucuaaccugagagcucuaggcauaauauauaugugcagacaaaacacugauaugcguaaaauaaaccuaaaagaaaauaaguuuaauccuaacaaaguaugaaauauauaaaucuauguaaaaauaaccauaacuauuuugauuauucacauuaaaacucaaccauauuuguaaauaacuuucuguagaauacagcaguuauacaaguauuuuaugauaugcuuuuaaaaaucauaucauuuaauaauuuguaaucauaauuugauauaccaagauaaaacauuacaggauaauacuuauccaagaaugacuaaugacugugugugucauuuucauacuguaacaacugaauguauguauuccauggaaucaaaauuauucggcaaaacuaaggcugcaagggaagcauaaacgcaagaagauaccaagcacccucugcacacugggacucgugcugugacaguccuguaaaacagcuacuaaggcagaugcuaaauaacauaagccaugugauauguucauaacauauaaaucaaacaguguggcacauggaaaggcuugacucuguaauauuagagagaccccaaaggagggacuuagcaaguuaugaaggaauccugaggaagagcauucuaagacuagagaacaaacacaaaaagcagggaagggggauuugucugguauccuuacagagcagcaagggaaucauuaugaaagaguaaacaaauguaaaaauaguagacagggcacaguagcuacaaggagucugacugguacaagcagaguuaugucuaauacuaaaaagacguuugguguguacgcggaaugaacauggaauuuuagacugauuuugaguagggauggucuggcauguuuuaaagggaucauuuuugauggcuguguuuggagacugcaaagaggacaagguaggacauaacaagacccauuagaacuccauacagagaaggauacugagaauuugagaaggggagacuugaauauaggaucucagggguuuauuugcagguauacacaaagcgcaccucuuuagaccuagaaaacgugguaaugcuggaaacaucuuuaguucacacaauuaugcaaagccauagugguaccuaauguguagagaucaggaguacuaaacaucuuaaaguaaguacccagcauaauucuccccaacaacaacaaaaauguacuuagccccaaagagaaaacagagaaaacagugcugagguugagaaagcaugauuuuaaauagagggauggagggauaggugguagaugguuagucuacggcuggugauguaacaguugaaggcagugagaaaugauagcaggauugggauguuuucaggguaaaagugacacaguauccuaacacaccgaaauuaugucagggaacauauacguaagauacuguaccauggaucuuaagcaaugugucuuaaugaccggcugcuuuaccuccacuccagagaguaaggcgaaacagggcuggccuacacgcuacgguaacgucuaauaccucuguaccuucuccaccaggauccggucggucucuugcacgcugguaucaggcacuugcuuguccaaguaaccgacuggauagagggagucucccuguccacugccccggucacuucggccccuaaagaaccaaaccaaaucaagagacuaaaacugcggguuuccagcccuaucaaucacaggaaaaagaaccucagauguagcuacccaaauuagacccucucgugcguucgucaguucucucugccuauugggaaaacuaaaagauccuggggaaaaauaccuuccacagcacagaagcuccuuggguaacaucuaugugcuacccacucgugucggagacuuagacgaggcccagguccgcuggaucucgggccguucuaggguaaggaucagauaccgagcuucacucgagagacucaccugcugccuccucccggcccacucagcucaauggcccauuugaaccgccggccucgguuggccacuaggccccccugggucgucaugacagcggccgcuggcuaaaaguacccacacccuccggccgcuugcguucugcagguaagaacuagcugcaacugcaagcucuccgacuuccucgcguucgccgcagugcacuuccggcgcauaauug

SEQ ID NO: 983 - RNA, 5024 nt, Mus musculus
caauuaugcgccggaagugcacugcggcgaacgcgaggaagucggagagcuugcaguugcagcuaguucuuaccugcagaacgcaagcggccggaggguguggguacuuuuagccagcggccgcugucaugacgacccaggggggccuaguggccaaccgaggccggcgguucaaaugggccauugagcugagugggccgggaggaggcagcaggugagucucucgagugaagcucgguaucugauccuuacccuagaacggcccgagauccagcggaccugggccucgucuaagucuccgacacgaguggguagcacauagauguuacccaaggagcuucugugcuguggaagguauuuuuccccaggaucuuuuaguuuucccaauaggcagagagaacugacgaacgcacgagagggucuaauuuggguagcuacaucugagguucuuuuuccugugauugauagggcuggaaacccgcaguuuuagucucuugauuugguuugguucuuuaggggccgaagugaccggggcaguggacagggagacucccucuauccagucgguuacuuggacaagcaagugccugauaccagcgugcaagagaccgaccggauccugguggagaagguacagagguauuagacguuaccguagcguguaggccagcccuguuucgccuuacucucuggaguggagguaaagcagccggucauuaagacacauugcuuaagauccaugguacaguaucuuacguauauguucccugacauaauuucgguguguuaggauacugugucacuuuuacccugaaaacaucccaauccugcuaucauuucucacugccuucaacuguuacaucaccagccguagacuaaccaucuaccaccuaucccuccaucccucuauuuaaaaucaugcuuucucaaccucagcacuguuuucucuguuuucucuuuggggcuaaguacauuuuuguuguuguuggggagaauuaugcuggguacuuacuuuaagauguuuaguacuccugaucucuacacauuagguaccacuauggcuuugcauaauugugugaacuaaagauguuuccagcauuaccacguuuucuaggucuaaagaggugcgcuuuguguauaccugcaaauaaaccccugagauccuauauucaagucuccccuucucaaauucucaguauccuucucuguauggaguucuaaugggucuuguuauguccuaccuuguccucuuugcagucuccaaacacagccaucaaaaaugaucccuuuaaaacaugccagaccaucccuacucaaaaucagucuaaaauuccauguucauuccgcguacacaccaaacgucuuuuuaguauuagacauaacucugcuuguaccagucagacuccuuguagcuacugugcccugucuacuauuuuuacauuuguuuacucuuucauaaugauucccuugcugcucuguaaggauaccagacaaaucccccuucccugcuuuuuguguuuguucucuagucuuagaaugcucuuccucaggauuccuucauaacuugcuaagucccuccuuuggggucucucuaauauuacagagucaagccuuuccaugugccacacuguuugauuuauauguuaugaacauaucacauggcuuauguuauuuagcaucugccuuaguagcuguuuuacaggacugucacagcacgagucccagugugcagagggugcuugguaucuucuugcguuuaugcuucccuugcagccuuaguuuugccgaauaauuuugauuccauggaauacauacauucaguuguuacaguaugaaaaugacacacacagucauuagucauucuuggauaaguauuauccuguaauguuuuaucuugguauaucaaauuaugauuacaaauuauuaaaugauaugauuuuuaaaagcauaucauaaaauacuuguauaacugcuguauucuacagaaaguuauuuacaaauaugguugaguuuuaaugugaauaaucaaaauaguuaugguuauuuuuacauagauuuauauauuucauacuuuguuaggauuaaacuuauuuucuuuuagguuuauuuuacgcauaucaguguuuugucugcacauauauauuaugccuagagcucucagguuagaagaagguauuggaucccccagcucuagaguuguggaucauugugagccaccaugugggugcuaggaaccaaacauugguccccuugaauaagcaacgaguacuuuuaaacacuaagucacuucuccagugccuuguuaggauuuuucauuuagauucauaaguauuauaacuuuuuauuuuguauauauacaaaaauacacaugcauacauacauaucucauaauagucuuuuaggguuuggguauuaacaagauuuguagaauuuuuaguuuuguuuucugccaaaggaguuuguguaagacuuguauuuuuagcuuuaaauaguuagaauuugccaagaaagugaucugggcuuaauuauagggucagcuuugcuaauugccaugcaacuguuuuuccuuaugcaauuuguuaagucaugucucuaggaauguauccauuuccgaaacuuucaaauaguccacaaguuucuaaacuggugagugugacgccuggagggucuguaaagcugcgugccuucucucuggacauggaagaguuguccuucuccccuccaggcuuaccagaauugaauuuauaaucuugcaaaaagaaaauuuuauuuuugaugagcucucauuuuuguuuucuucucaaaauccuuuaguuuguucuuuuccugacuuuuuuguuuuuguuuuugauuuuucaagacaggguuucucuguauagcccuggcuguccuggaacucacucuguagcccaggcuggccucgaacucagaaaucugccugccucugccucccuagugcugggauuaaaggcgugcaccaccacacccugcuuaaauuucuuucuuuuuuuuuuucuccaagauuuacuuauuauacaauguugcugccuucagacacaccagaagagggcgucagaucucaauaugggugguugugagccaccaugugcuuucugggauuugaacucaggaccuuuggaagagcagucagugcuccuacccgcugagccaucucgccagccccuuucccugacuuucaugaaguagaugcugagucuucucacauguucuuaagaucauggaauuuuagccaggugugguggugcauaucuacaauccuauuaguuuugggggauguuaaaaaaggucucaauuuagaggucaaccuggacauaccaagaccuugucucaaguaacaaaaagauuuuaaauuucucaaaacuugcugggcagugguagcacgcaccuuuaauuucaguacuugggaggcagaggcaggcagauuucugaguuugaagccagccugguuuaaagagggaguuccaggacagccagaucuacacagaggaaugauccugaaaaacaaaaggccccagaaaguuuauauagggaaaaagcacagggguagaguaguagagcaacuuguagcaaccuaaagaggagcugaaaagccaguucagucuagcagagaacugaagcuucuguucacaugacuuaagaucaguuguacaguacacgagagacugaaggggagugauuagaggucuaaaccguguguuuauuuuagcgcugcugggacaucgccuuggguccccucaagcagauucccaugaaccucuucaucauguacauggcaggcaacaccauuuccaucuucccuacuaugaugguguguaugauggccuggcgacccauucaagcacuuauggccauuucagccaguaaguauucagaaaauaauacuccuucccugggugcuaaggaaugaaggccaauucuuuggcauauuuuuagcuagaggguauuuugguagugguagucgucguaccauuuauaaucuuauuuuggggcuguauguuuaaauucuagguuucauauugggaggaaaaugguguugacaaugucuguuaaucccaacagcuuucaagaugcuggagaguucaagucagaaguuucuucaaggcuuggucuaucucauugggaaccugauggguuuggcauuggcaguuuacaagugccaguccaugggacuguugccuacacaugcaucagacuggcuagccuuuauugagcccccugagguaugguuaaaguuaaauuucaggcaaacagagucugcagugaacagcuagugagcucauuggauguugguauugagggcugcuuuauuuaaagcuuuuacauuuuuuauugcaugcccguguguguguguguuuuggaggucagagaacuuggugcugcaaguuagcuggcaaaaaaaacccaaacaaacaaacgauagcacaacuuccgacugaauauauggguuuugggaacugaauucaggucaucaggcuuggcagcaagugcccuuacccucugagcacucucacuagcccacguguucauuucuuaaguaacaacacagguuuggaaguuuacaggcauuuggcaguuacaaggucauguacagcagagcuugugauaaaguaacuaagaaguuguuugccauugaccucuuuacuguuucuuuuuuuagagaauggaguucaguggaggaggcuuacuucugugacccccagaaagcaccaugcauauggaccucaucugcauuuuaagcuguugacuccuaaauauccucccuuaaaacagucaugcauguggagaagagccuccuguggugaggccagugugcagcauguuacagcagaaaagaaacuacagcacaacuuaugacugaaaauaauguagaaaacuuuauuuauguucccagcacagagcaaaacaaacaaaaccagacucuauguaaacaaaagaauagcagcugcucaguagcagcuucuccuuucaauaaauuaaacgguugagaacaaugcuuaauguuu

SEQ ID NO: 984 - RNA, 2750 nt, Mus musculus
cuuacccgcagguccacuguucuuguggcaaagcgucggacgcaccuguggacacgagggggcgccgccgccccgcacccuggucccccuccggcaggcauccgagggggcggagucugagcuggguggggcccggcuggccgcccacgggguagcuaucccggcgggccgcgcgcggcgguguuugaauggcugugaguggggcccggcuggggauccgagggacgcuccgagcugccgggagcgguucaucagcacaguggcugagcuugggcgcugcgguaccaugaggcgccgguaagugacggccggacccgguuggggccuucgcugcugcucgcgcggcgggcuucuugagcagcuggccgggcccaccugcaggccccgcggcagcggccuuuccggggcugggcggcggggucggggcgggacgcaggcggguggggcccccggucucccgcggagcccccgggcgagcgguugucuggagguuggagcugcaggccucggggguccuggcaggagaggcauggaucaaaccuacugucauuuauuuaucuucggguggagucgacaucugcacccuacggggaaagacggggcgcgugagaagauugcucugcgaggacagguuuuccccagagcagccuaggcccggcugaggcauuuccuuauuuuucugaggaauuuuugagucccagacagaucggcuuuuguuucuaaggacagaaacuugacauagccgcauaagaaucauugacugcaacuuuuaaaaccucguugugcuuucugaaaaguuauuccguaauuguaccuaggugcuuaacugagcuuaggcauggagauaacaaagaguugauuuguuuuguacuggcuucuaaagucccuugaaaacagcuauaucaauuucuuggcagaucuggagaaaaaaguaacuggaagagauaauucuauaauuauugccgauuucguacuuaacgagcucgcugagacaccaguccaccuaauaucugaaacuuuauacaaaaucauucaggauuuuuccucucucauauauuuuugguugugagccuagccuuuaacggcugagccaucucuccagcccucuucucucuuucaaaucagcuucuucaagucagaaguuuaugcauggaggcuuuuugcuuggauaguagcuggacuuguaauaagccauaacgaguaauaacuuacuuauuuuguuuucugugugcuaagaguuguuuuaagagugcugcuuuggaauagguaguauuaucaucauuuugacacgggaaaaaggcacggggaagucaucuuagguaggguuacauaguuauuugcuccacaaagccacagggccgccuccucugccuugaucuuacuaauguccaaaguguuguuucauuugcuugagcuucggagauauuuaugugcguacgccucuguguacacuacacaugaaugaauccacacaccaaccacauucccugcucguauugaccacgauuaauuuuuguguuugagggaaaaaaauguuucuaagauaaauagaaauaagguuuaugguuucacuuuucagagaccagagaacagcuggaaacaugauucuuuaaaacuggguacacuauuuuguauuuggaaugaguauacuucauaacaccuugcagagaaacaccucaagaguaagcuaccuucaguagucagcacuuauucauauggaaaccuugaaacuucauucagcaauuacugagguuucuauugccucaguguccagcacaguacuggauccagugagcuauauucaagaaaugugccaggcaacagguauuagggaaguuaguuuggugugagauuaguuacaaaauaauauacucuuccuuggggcagugauguaugaugaucuggacuggguaaaucugcuauacagcuaagaaaugaagggcuuguguaagacauuuauagaaagggaggcaggguauuuuacugaagaaacuguucaaagacuaggaauccagaccaaaaauuacuuuuaaugggaacaguaaguuaucuuuuuaaaaguucauguugguuaacaucauaugaaauaagacugggaaauguuguaaaugacacaugucauagaggucugauacacccagaguucucaggcacacaaagauuugggaauuuguaaaauuuuguugcaguggcucucaacugggucaaguuuucuccuuaggauauuuaggguugucagacauaaggaaagguugauacugucaaucuacuguccauaggcuggaguacuuauaagcauccugcaucagacagacucccauaagaaacaaucacuccaagggucaguguugcugugguugcgaaacccuaauuuuaaguugguugguuauguggcuggcuuccacucacauauguuauagguaaguaggaaugacaaauuuuaggaacacaacuagacuucauaaugacauuaggagugguuuagaguucucccaaaggcuguuccaauccuagaggagagguguguaggagauaggcaggagcuuuaagaaugcuaaaauuaagguaagaaucacuaaauuuuauuuuaucuaaaugugaagauaacaaaaauucauuugaaauagaaaaugaacauaauagaaaauagaaaacagaacauaagcagaaauaagggccagcaggaugguucaagcagccagaagugcuugccuugugagucugaugacuugaguugacucugcaaucca

SEQ ID NO: 985 - RNA, 2750 nt, Mus musculus
uggauugcagagucaacucaagucaucagacucacaaggcaagcacuucuggcugcuugaaccauccugcuggcccuuauuucugcuuauguucuguuuucuauuuucuauuauguucauuuucuauuucaaaugaauuuuuguuaucuucacauuuagauaaaauaaaauuuagugauucuuaccuuaauuuuagcauucuuaaagcuccugccuaucuccuacacaccucuccucuaggauuggaacagccuuugggagaacucuaaaccacuccuaaugucauuaugaagucuaguuguguuccuaaaauuugucauuccuacuuaccuauaacauaugugaguggaagccagccacauaaccaaccaacuuaaaauuaggguuucgcaaccacagcaacacugacccuuggagugauuguuucuuaugggagucugucugaugcaggaugcuuauaaguacuccagccuauggacaguagauugacaguaucaaccuuuccuuaugucugacaacccuaaauauccuaaggagaaaacuugacccaguugagagccacugcaacaaaauuuuacaaauucccaaaucuuugugugccugagaacucuggguguaucagaccucuaugacaugugucauuuacaacauuucccagucuuauuucauaugauguuaaccaacaugaacuuuuaaaaagauaacuuacuguucccauuaaaaguaauuuuuggucuggauuccuagucuuugaacaguuucuucaguaaaauacccugccucccuuucuauaaaugucuuacacaagcccuucauuucuuagcuguauagcagauuuacccaguccagaucaucauacaucacugccccaaggaagaguauauuauuuuguaacuaaucucacaccaaacuaacuucccuaauaccuguugccuggcacauuucuugaauauagcucacuggauccaguacugugcuggacacugaggcaauagaaaccucaguaauugcugaaugaaguuucaagguuuccauaugaauaagugcugacuacugaagguagcuuacucuugagguguuucucugcaagguguuaugaaguauacucauuccaaauacaaaauaguguacccaguuuuaaagaaucauguuuccagcuguucucuggucucugaaaagugaaaccauaaaccuuauuucuauuuaucuuagaaacauuuuuuucccucaaacacaaaaauuaaucguggucaauacgagcagggaaugugguugguguguggauucauucauguguaguguacacagaggcguacgcacauaaauaucuccgaagcucaagcaaaugaaacaacacuuuggacauuaguaagaucaaggcagaggaggcggcccuguggcuuuguggagcaaauaacuauguaacccuaccuaagaugacuuccccgugccuuuuucccgugucaaaaugaugauaauacuaccuauuccaaagcagcacucuuaaaacaacucuuagcacacagaaaacaaaauaaguaaguuauuacucguuauggcuuauuacaaguccagcuacuauccaagcaaaaagccuccaugcauaaacuucugacuugaagaagcugauuugaaagagagaagagggcuggagagauggcucagccguuaaaggcuaggcucacaaccaaaaauauaugagagaggaaaaauccugaaugauuuuguauaaaguuucagauauuagguggacuggugucucagcgagcucguuaaguacgaaaucggcaauaauuauagaauuaucucuuccaguuacuuuuuucuccagaucugccaagaaauugauauagcuguuuucaagggacuuuagaagccaguacaaaacaaaucaacucuuuguuaucuccaugccuaagcucaguuaagcaccuagguacaauuacggaauaacuuuucagaaagcacaacgagguuuuaaaaguugcagucaaugauucuuaugcggcuaugucaaguuucuguccuuagaaacaaaagccgaucugucugggacucaaaaauuccucagaaaaauaaggaaaugccucagccgggccuaggcugcucuggggaaaaccuguccucgcagagcaaucuucucacgcgccccgucuuuccccguagggugcagaugucgacuccacccgaagauaaauaaaugacaguagguuugauccaugccucuccugccaggacccccgaggccugcagcuccaaccuccagacaaccgcucgcccgggggcuccgcgggagaccgggggccccacccgccugcgucccgccccgaccccgccgcccagccccggaaaggccgcugccgcggggccugcaggugggcccggccagcugcucaagaagcccgccgcgcgagcagcagcgaaggccccaaccggguccggccgucacuuaccggcgccucaugguaccgcagcgcccaagcucagccacugugcugaugaaccgcucccggcagcucggagcgucccucggauccccagccgggccccacucacagccauucaaacaccgccgcgcgcggcccgccgggauagcuaccccgugggcggccagccgggccccacccagcucagacuccgcccccucggaugccugccggagggggaccagggugcggggcggcggcgcccccucguguccacaggugcguccgacgcuuugccacaagaacaguggaccugcggguaag

SEQ ID NO: 986 - RNA, 141612 nt, Mus musculus
cucgcgcguucugcucgccggcggccucaugcaggcugagcgcggggcuaggggcggccgcgggcggcggggaggccgggagcggcccggaggggaccgagagccggucggggcagcgacggcgcuggcgagaggaggcugcggggacggaggcggccggcggggccgaggccggggcuuccgccgaggccgaggagguggcggccugcgaggcggccgcugggagccuggaggccggggcggcggagccagcacucggguaaggagcgcggguugcugcggccgcuagccggcguguggggagcgcgaggcacagcgccugcgcgggauggagccgggagggcgcgcgggggggggggggagggagaggggacaugcacguguaccgugcacgcucagccccuggcugcuuguggccgaaggacuaagcgaccggccuccgcguuuugcuggugccagagucccauggucugauggagacuaacggcggcgccugguguccgggcuacagccuggcgugcuaucccagaagugacuuccugcggagcgaagucuaccagaauacagauuuacacagaaguguuuacucugcccuccguuuccuuuaucccaucccacauugccuagguaacagugucuguggucacccauaccuggauggaaggacauggggggaagauuaugucuucauuuugguuuggauuggugaccucuaagaucuuucccacucuucagauucguauuuagucucgccgagacuauucuggguaccuaaagauuaaaugaggagaaacugaccgaccuucccaaggccuuucuguacucauaucuuauauguugggcacauuggugcucuaaaucaggauuagugcagugcucugaaagcagucaacagcguuccagcuguguagggaccacuguccagcugcaggauuccacacagucuacguccuuugcuuucccucuggaugauuagacugcaaauggaaacaacuucuagauauguacuccuccaaaguaacuuacuugggaacuaagaagcccugaaaccauuccuucuaaagaugugugguaugaaccaugagcuuacugagugugauaagcaaauuaucaggacagucaccuuuacugcaguguguuauuauccuuaaugcaauuguuaauuucgcaaaauacaagaauuuguuuauaucuauuuuuuguuuuuguuaaagaaguauauuaguuuuucugcgcccguggacccgucucucucuccucuuccucucuuccucucuuucucucucucucucucucucucucucucucucucucucucucucucucucucucuguguguguguguguguacauaaguguagugccagcagaggccagaaggcaucagauccuuugagcccacguuaaaggcaguuauguuuuccagaacaguagcaaacugcucuuaauccucuguaaggcacccacacucucgguauaugcacccccccuacauucauguaaauaaaaauaaacacaagaaugcaaauguuuuuucugcggggcagugguggcgcacaucuuugaucccagcacuugggaggcagaggcaggcugauuucugaguuugaggccagccuggucuauagagugaguuccaggauagccagggcuacacagagaaacccugucucaaaaaaaccacacacacccacacacacacccccccccccccccacacacacaauaaugcaaauguuugacuccaguuccuuugaauauauaccuaguaauaggauuguggaauccuuaguggugguuauaguuuuuauuuuuaaggaacagccguacugcucuuuguaaugcuauaccaauugauguuaccauaacauaugagaguuccuaucucugcauuuuugggaguuuuguuuguuuguuuguuuguuuuucgagacaggguuucucuguguagcccuggcuguccuggaacucacucuguagaccaggcuggccucgaacuuagagauccaccugccucuaccucccaagugcugggauuaaaggcaugcgccaccacgcccggccuaucucugcauuuuuugcuagcccuuguugguuuuuaaaauuccuccucuuccuucucuuucuccucuuccucaucuucuuucucaucaucuucuagauaggaucucacuauguagcccacccuugccuuaaaucaagaucuuccugccucaauuucuuuuuuuuuuuuuuaaagauuuauuuauuaauauauguaaguacacuguagcugucuucagacacuccagaagagggagucagauuuuguuugggaugguugugagccaccaugugguugcugggauuugaacucucgaccuucagaagagcagucgggugcucuuacccacugagccaucucaccagccccccugccucaauuucuaagguaugggauuacacaucuacuuuaccacagcuggguuuauuuauucauuuaacuguuuguuugcugugauauaaucuuaucauguaguucagccuggaacgcaaacucagaacccuagaacccugguuuuauuuuaacuacguuuuuguuguuguucuuuuuuuguuguaggcauauuuuauuuauuuucuuauuuuuuagacagggucucagcauguaaccuuggcugcccuggaaacugacucuguagaccaggcaggcaggccuugaacucagagaucuaccugccucugccuccuguguuggauuaaaggugaucuuucauuguguggguuuuuuuuuuuuugugguuguuguuuauuuguuuguuuuuccauuuauuuagaaguuucuagauacuguuaggugaguagcuuguucucaugauuuugaugaugagugacacugagauuccuuuucauauaugcacuggccauuugggucuccucuuuggggacauaucccuucaggugauucaacccuguuuuaaucagacccuuucugcuuuuuguauuugaguagucugaggucguuauaaauucugcaggaucaucuuuugcugggcgaacagcuuguagacauuucuucuccuucccuacgcaggcuguucuccuacucuguugguugucuccucuguccuugacaugauccccuuugucaagguggccucuguuguuugggcuguugaggucagauccaaagaaagcuuugcccagagcaauguccugggguguuucucugaugcuuucuucugauaguuucagguuucauauuugaagucuguuuuauuuagaguugauuuuguauauggcuuauuucuuuggggguguggauaugugcauguaucccugggguuuucuugcuccuuuuugguggcaggauugaacauaggguggcaugaauguuaguaagucacauuuaaaccacaugcugucauuuuuuuuuuaaaccaggacuguacaguuuagccuuuuaccuacacuuuguagugugucuuaaacucugaucuuaaaguuuaacuuucguuucuuuguuuaaaguauuuaggaucuuuuuacaguuucaugcaaguuuuaggagugguuguuuuguuucuuugaagggugucuggacaucuuagugggcauugaauucagucuguagaucacucuagauauuacguauuuuugaacauauuaguucuuucauccaugaacaccggaaggcugagugaaagcuuguaauuuagugucuucuccaagugcuuucauugauguuuuguaauuaucauugucgauaugaaucacuucuuugguuaaauuuauuuguauauauuucaucuaaauuuuuuguugcuauuguuuuuugauuuauucuucacuuucaccaaguuaauuuuguauucuguaacuuuucuuaauuuaucaguuuuaaagcuuuuugguggcauuguuuuauauauauauuaugcaucauauauguauaauuauaugaguaauuauauaauauacaaaauauacauaacuaaugucacuuuccagcagggguaacuuaaccccucauuuucuguuugcaugccuuucuuuuguguuuccucucacugagacuuuuggagacaggaucuuacuauguagcccuggcuguccugaaacucacuaugucaagcaagccgcuucaacucagagagaucuccugucucuacuucccaagugcugaaauucaaggagagugcugcugccgccaccacaccugggcacagacuuuaaucuuguacugaaugaagaugugaaaggcaaacuuggucuuuuuuguaacauuuauuuugacgagugguuaacaggaggccuguuaguagucuuugaauuuuuuuuucuuuuucuaucagauaauaguaaguaacauuuauugaacacuuaguuaugagauuugcacagcaaggcacagcuaagucacucacgguuaugguuaaauuacuuauucacaguuaaucuccaguucagugagccuggauuccacaugggucuguugacacuggagcccacucuuuugacuacugcucugagcuucugguaugauuugaaaagaggugucucagugguaguguaggacucuggcaagucuuaguuugccagggacucccugaaggaagcaugcugaacugggaaucaaugcaaaaagcaagaggaauuuauuguuccaauuuguuggagucauccuacacccggaggagaaguggcuuguuuguugaguauuuuacaguuuucagagcagcagccauuaggcacaaugugauuggcagaacagcgugacuuuuuuuuguuuuguuuuuauuuuguuuuguuuuguuuuguuuaucgagacaggguuucucuguguagcccuggcuguccuggaacucuguagaccaggcugaccuugaacucagaaauccgccugccucugccucccaagugccuguaucaaaggcaugcgccaccacgccccgcucagugugacuuuuaaacugacuggucuuuagggaaugagguggcaaggacuucccuugucucuagguggccaaggucaagguugcagaaugugucuacaagcucugggccuccccacucgcugguggguccaacccacaguggucugaggaauguaauuaagucucuccuuccgggcgggugggagggguaucuaacugcuucauggccuuucucuucccggaggggaggagucagguggaauuuuccaagugcccugagcugaccucuucaguaggaucucuugcugcacaagcaugaggaccugcauucagauucccaacacugggcacugcagcuugcagcuguaaucccagcccuguguagauggggcauagacaggaggaaugcuagagcuuguuggcugccagccuagcagagcuccagguucacugagacagugucugaagucaguaaggcagaaagcaauggagaaagauucccaaugucuucugcagacauacacacaggcaaagacacuuguguacacagauacauacuauacaugcauacacacauagacacacacacauucacacacacacacacacacacacacacacacacauacagagggggaagggagggagggagggggagagggagagaggagggcgugcuguugaguaauguuuuuacauaccuuuccccucauguuuauauaugauuacaaggcugaguaugaaacugguagcauauuuaucucuuugaauguuagcugaccuuaaguguuccuuaucuauauuuauguggcagaugucuaugucuauauucacuuaaaaaaagugagacagagucucucuuuguggcccagcuggcacaaguguucucuugcucagcuuuuccaguacuugggacuauaggccugugcuaccaucccuagucuggucaauaaaaagugagagggcuguuaauaaccacacuagaacuuugaaggcauauauuuuuuaaaaaaauaauuauuuuuaaccuuuuuuuuuuuugcuuuguaacuaaacccugucuugaguaguaaacaauacuagcuauugcagagagucuuauacucuaacaaaggaagugucugacucugaugcucagacagagagaggugauuuggugucauuucaggucuugacgcgugucuaaggcuuguugcaucccugaggcuggagugggucacuggcaucaugagccaguagagacuguaagcuuauuaaacucagacucaacagccuccaagacuguuuccgccuuucagaaagacugaagcuggcuuggcugguggcugaacgugcuuaagugucccaacagcaaauugcuuuaggauuacauuuuggagccaggcuacauagugaguuucaggccagucugggcuauauugcgaggaaaaggcuuuugacauuauuucucauugcugugagccauuguguggauguuaagugucucgguguaucuguucuuauuaagagugugcuauuuugaggugugcuuuuucuacuagccauuauuucaccuccauuuuuccaugaucuauauagauaccaauccucaaacaguuuaacuuauucggagaaaaccacgaauaauacugugucuguguuuacaucuaaaauauuuuaaaaucaaauggaucagauacuuucaaaauacauaauugccagcauauucugugcuuuuauuaauuaaaacauggagcaggacaacauuuuaaggguugaggauguggcucuuuugcuagaaugucuagcaugcacaaggcccuggguuugguccccagcaccacaaacucuggguaugggguugcauaccuuaucagaacucagaaugggaggcagcuaucagaagguacacaguaguuagaggccaucuugggcuuccagaaacccugucucaacaauggcuguagaagcacuuuaaaaggcacaccacuuuuaugaguagccuuaaauacaguagugacuugaaacuggcuuuauacauuuaaaaaaauaaugcaucaauaaagccuuuagcaguaaaauuucaacuguuccuuauauuuuuaaauuaauauuuucuucccauauuuucuucauaauuuuaucugggguaauauauuuuauacuugagaauuguuuaauaguugcuuuccacuucugugcaauaauuuuuguuuuauuuauuuauuuauuuuuuuguuuguuuuugagacagggucucacauagggcagacuggccuugaacuucugauucuccuaucucgccagugccaggguuucugaaugguaauaacuauauuauuaaaguguaauuaggaugacugacuuguaucaaauucauauacauauuauuuuaagaccuucaguucuaugguucuucuauuuuuuguauuuaucaaaucacguuauaacaccaagagacauuguuaauugauuguguauucagugagacagucacuguguauaaagagcuauaugugcuuccauauguaugaauggauccuuaucauuuaugacuggaaaauuaaaacuguucaguuagcgaauacuuaaaugugcugugugaauuucaugugugcauguauguuuugaguuccuugggcaucuagaguugugcuguuauaguuuaugucugcucauuugaccuuguguuuuuuugugugguuguuuacguguuagaugcagucuguacuuucuacacucuggaguguggauuacuuagaagugugacacaacagcauuguccaucaacaaaaguucugaucacaggauucucuuuuuucucucuuugauuguuauuaggcacggucuucuauuccacagcccaggcuguccuggaacaagauacuguagcuugagauggccuugauccuccuguggggauuauaggcaagugcuaccacaucuagcaggacaccacuguucccaagaaacaaauacuagagaccuagagucgaaagcuaaccuguaaacgggugugcucagagcagggggccugaggaauggcuccucuguuuauaacacacccaauauaaaccuggucaugaugugaggagggcuacaaaguuuguugccgucccccaaacacauguccuacacauuuaaaaacaaagcaaagcaaagcaaagcaaaccaaaccaaccaagaaacauaaaauugugucuuuuagcuucaucaaaaagcaguugacugacuucucugucaaaugcaaguuguguuaacuccaccuccaaagccgcuuuuccaacuccaaaacaaugaacauaaacaucagcccagaguaggagggugagggccugagccuguugugcuggaagggcccugggcucagcacccagaagacagcccggccagacuugcauccccuccccuggaagacagcccggccagacuugcuuccucuccccucucuagagcugggcuugcucucaagccucaugaaacuagcgaucaaagcacaguuuuagcucugaacagcagguggggcaaguagcacacuacuuuucaaaugagcccugggcccugggccacuggcagacagcagcagggaacgcuccuuauuggcuguggaucuuaacuaucaguguagugcuuccccagucccgggcucucugucccaggccacuggagagaucugcgaaaggaugcauccacaccacugaucucucuguuguuucuccucccuuuguuuuacagagacaauucugguuuuuaaacauugucacugugcauauuauuuguucacaggccuauguuacuugaaaacccuuuuuacaaguaugcaaaugcugcgcucccccuacccucuucccacucuggugacuuccuuuguuccucaguuucccuucuuucauacaggugcuuuacgcacacauauguaauuuuaucucucucucuagaaaccacagacagagaaagcacuuuucuccugacuuuggcuguauucgcucuaucacccccagccaagcccaucuuucugcagaugcugugccuccaucuuucuuuaggauugaaauaauccuguccagcauauagaucggauuugcuuuauucaucccagcagaggaaacucuuuaagugguggaguguuuuacuuuugggagaugugagacauuuugccuuccuggucaacagcaugcaugccuggcccaagacuaguugacagcugggugugcuuaacguggcaguggguauuuuaccuuaacgugacauuuccagauggaaauguuuccugaaacugguuugucccguaaauuucaggccuagagugguaccacgauguuaguacaguuuuacuuauuaauguauauuggggcucaacaucagaguagaacauauaucuauagaauauaccaugugaaguaucagauuuugggaguuauuaauuuuuuugggucuuuagcaucuucugauauauugauuuuuauuuaguguucguucuuacuaucuggauggcagaaauagaauuuacauaguuaguggcuuuuuugguuccacuuccauuucacccaacuaucauaccuuaaaaacacauuuauuucguuauuauuucuauuuauguguaugugugugagugcaugucaaguguaugcuggugcccauggaggccagaagacgggaucagauccccuggggcuagaguuacaggcagaugugaucggccucacuugugugccaggagccaaacuuagguccuuugcaaaaaguauuacauguucuuaaccuucucagcugcugagacaucccuccaguccuacacaugccuguaaccccagcacucagaaagcugagaaucaugaguuuuugcucugccaaaacuagagcaugaguguugguagaacuuaauuugucuuagcuuuccagcucuagucuugugcuguuauuuuucuuccccucaacuugacacaagcuggagucaccuggaaagagggagccucaguggagaaaugccuuccaucagauuggcguguaggcaagucugugguacauucuaguuaaugacugaugcgagaggguccagcccacuguguggugccacuccuagguaggugguccuagguuauagaagaaggcaggcugugcaaggcacgggcguggaaaggagcaagugaguaagcagugcuccuccguggccucuuugguuccugcccugcuugagugccugcuuggcuuccuucaaugaugugaucaggauguguaagccaaauuugcccuuucuuccucuuauguuacuuacggccauggucuuuaucacggcaauagguagccaacuagggcauuccucuugagaguuuauaauacaguuuauucacaggucucauaguuagaaguaagcaacaccaggauuuaacuugcacuuuccgcccaaagaauauuuagauauuuucgguggggaucagggacuguggaauugaguguugcuuuggauaucugagaagcagaggucaacaaucucagacuuugcaugcagaaaauaaggccaccuagugcugcuggcuugcacugcuaaccccacaagacgcacugugcuguggcucagcuuccaggcacucagcuugccuuaucuaccacugccuugauccugggauuugcauuuuguccugcuggaucaggagcuuugagaaaauccuccuuucucuauugcaaagggaaagcuuucuccuuuccuccaggcaucuuuacugcccuuuauuuuaauuaaaagauuucucuucuuaauguuggaagagcuuccuaaaggucacacuugaaaugagcugcagaagggagauacagaucucaggacucuguccuguuguuggagaaauggucucuugaaaugcacagaaaaaugccuuuucuuauuuuuuuuuuuuuuauucuggcuccaguagggacaggaagggaaggugguuucccaacauguagccacgaugucacacaauuaagguucaggggcaagggacaucgguucaacugagggguaugucaggcaagcaccuucugaaugccaugugccuuguggcaagaguaggcuugaagaacagugcauggaaggugcugucacacaaacaaugagcaugugggcauacauuuuuuccaacugacuuuaauaaacauuuaaccucccuucuagcccuacaccuaccagagguaguagaagagaaaaguuauuaggacaugggggaaguagacauguuuagaaauaguucuuugggggcaaguuuaaucuucguugucaguuccaguagcaaacaccuaauaugaauccgcagcugccguccaguucucucgacaggcaccauacacaaaccagcagcugcagcccaacccacuuggcaauaaucauucacaaaccagcaaggguaguucaauucagaagccaaccggcugcuuuggaagcugcaguaaccucaggagaaguucuuuggcgagugucuuucuaugacauuaccacaagugaagcucaacaacacaauguaaguugaacuaaaacauguguguaguuaacaagaagagcaaggcggagcaaaguagaccagugcucgagcucccgcugucuguggggucaugcuuauacuccugaacauaagaguccuguccccugugucuacuucagcaaaacauccuguuaccugugugccccagcaaaccaucauuugacauaacugacuuuccagaggaaccagagguuucuacuucacgaggcccuuccuucucuuuacaaaauacuugaacucucuuucugauuugugcagcaguugcuauuugauuucuuuuuuuuuuaaaauuggguauuuauuucauuuacauuuccaaugcuaucccaaaagucccccacacgcucccccacucacucccccacccacccacucccacuucuuggcccuggcguuccccuguacugaggcauauaaguuugcccgaccaaggggccucucuuuccacugauggccgacuaggccaucuucugauucauaugcagcuagagacacgagcuccggguggggagggguauugguuaguucauauuguuguuccaccuauaggacugcagaucccuucagcuccuuggguacuuucucuagcuccuccauugggggcccugugauccauccaauagcugacugugagcauccacuucuguguuugcuaggccccggcauagucucacaagagacagccauaucuggguccuuucagcaaaaucuugcuaguguaugcaauggugucagcguuuggaagcugauuaugggauggauccccggauauggcagucucuagaugguccauccuuuucucuuuuaugggcuuugggaaccacuucugagaauuuugcuagcauuugcucucuuuucucucuucacuaaugucauguguaaaugcucuugaugaagaaaugaucuuaaccugaaacaaaugcagccagcccucaaaacagaacggaacggcauuuuauacaccagccaccacaggagaaugaaaaggaagggaaauccaagaggagcuucaggugcugggaagccaggucccuuacacaggagcuucacaccuacuugguacaguggcuuguucucccucauuuugccauuguguagauaagacuggcaccauaugaguuaggccccgggaagacaaaaauucuagcagaucuguuacuuuuugugugaaauggcaaaccaaacagccuuugcuggcuagauugaacgugggccuugucuaagaagacacaaggacuguguggcagggcuugcccagcaugugcaaggccaguagguuaguccuuagcaacagcaggguaacuguuaggcuugugcugcauuugaguuugugacaauuggugcaguaguuacccuuaaagacuuuugucacaagagggauaggauuauaaguugaucaaggguccaaaugauguggugggacuagucaugaagauucccucucuccucucuccuuuccuuccuucuucccgcccuccuuccuuccuguuuuuccuuucuuccuucuuuauuccauaauuuguaggcaguugacuucuauuuuucuuugcuaugagguauuuuuugauauuuuuuuuaugagugacucgaaucuuggcuguuucagugacugcuaggaugaguuucaaugaauaaguuuuugaguuggagaucuguucacuuguguaguggauaaguuugggaguagggaugugaucuauuucaaauagacuucaucuguguaagauccucucuacucucuaggacuucacugaaauuaaguaagaucaagaaaugaaaauaaguuuggaaacauguaugauuugggauguagcuuagauauagaaugcuugccaacugugcaucagacucugaguucagccuucuggcacugcucagucucuguuccagccagcuagccuuccauuuugccacugguaguuaugagagcuuucacaagggcuuuagacacuaagagauuuuauacuccccccacccccuuuguagauggucucacucuauagcuucugauuaaccuucaacuuacuguguagcccaaccugaccuugaucugauuuuccuuauaucuuccugaguguuaggauuauaagcaugaaugaccacauguagaaaaaaauuuuuucauauuaauugugcucagugaaggaagcacggugugguggcauauauuuauacucuuggcuuucaggagaauugcuguuuggggccagccuaggcugcauagcaagauucugucucaacaaccuccaguccaaacauuaucugcuaguaaaucuucaauaaggugcacugaaaaauauuaagaauucaaccaagccuggugaugcagguugguaauccuaacuucucacagggcagagaaccacaaguucaaggcuugucuggguaacuuagugagacccugccagucucaaaauaaaaacuagcaauaaggugguagguauagcuuaguguuagcauacuuagcuagcaugagggaggucuuagguucaauccuaauacugucaaaacauuuucaagaaucuaaacauugcauggggcaggaggagcuggaguuugaggucagccuggguugccuacugaggcccugucucaacaauacucaguugaagcuguuuuggcugaagugcaucaacacaggcaggaacugcaagaaggcauugcgauucuuauuuugcaaguguugccagggaaccgaguucuuaaaaacuguagaaauuuaggcuuccaggagccauuuaccgugguaauuggcaucuuacuagaacugacggcuacauggcaacaggguuguuaugugaagaaucucaagagauagagcuuucagaguaguugaugaggugacacuuccuucagggaacugcucagcuuuauuggaucaaggugggugaguggcaucuggcaggcugcuuugcuuugcucugucucucuggagagacuugaacacuccuuucaggcuuuuaaaaaaugaauuguuaacagguagauugagugguggauuugggaaggagguggguuuaguuaaggagaggaaaguuggauagaaaaagacguuagaaaagcagugguuuagaacuccaaguugaaaaaagaaauaagccuuauacuacuacuacuauuaguaguguaauagaaauguguguuuuacucuguggucuagauuggccuugaacuguugaacucaagcaguguucuugcucuggccugaugaguguaagcaugugcuaccacacuacaccacuauugcaggauauuugcaguguucuugcucuggccugaugaguguaagcaugugcuaccacacuacaccacuauugcaggauauuugaucauacugggaaccccaagauuguguuauuuacuggaaaaaccucuuucuaguuguguggcucagcccugucacacacuuuuaauacaacuagaaacacauuuuuuuuuuuuuuccccaugaaauaacgcaaaucacuacugcuuggcuuuaaauggauuuucuuuuuaaagauuauuuauuuauuuauuaugaguauguguauaugccaaaauauguagcaugguguaccauacauauaugugcaggugcucacagaggccacagaggaccuugcauuccucgaaacuagagcuucaggugguugugagcugccuguggguacugggagccaaaccuggcuccuaggaaccaaguccagauccucuggaagagcagcaagugcucuuaacugcugagccaucucuccagucucuccaaacaaauuauuucaggaguggggugcagcugcaacaauuauuuuaaaagauagaaguggcuguugaacagggggguggcuggaaaaauuggggugguugcauuuuaggagucugaauugccuugagauuaucacuggaaaugugaacccuaaagauaauucuggauuggucucagauaggaaagagagguauguuaaccagacauugggagccagugaucguuguucaaaaguggcagagaccuucacuaaauccuugucuccuggugguguuuguguauuaguguacaaagaauugcugccucuacugcuuugagaagaaaaguguugucacaccauucacuauuagcggaaaauugauuugucuuuugucauuguuguuccugaguugcugggauuaaaggcguguaccaccacacccggcuaauggagaguuuuagcuugcccaucuugaggauuugcuucaucuccauucuguagagcaggugaagucaaauugacacuugacuauuagaaaagcugcauguaaaacaguccucauuuuagcugagccccucuguguguuccaguggaacuuuguuguuuuuuguguugccacugggcaggauaauagcucagcuguacuuugauuuauaaguaaccuaauuggguuucuguuauuuuaugaacacugaaaccagugaccagcauccagguacaaaguauuacugugaaaaugaccaguuuagcuuugacaugauggcaucauaaaaacaccauguuuauguaguacugugucugcuugcuauguccauguuuguauaaggaagcaaaugucuccuauguauuauccuucuuucuacucuccucugaugggggcuccuguggcccuugcauuugagucggagcaaugagauacuaguuuggugcaccucuaauuuggggucagggagucguucgucugcaggcggcuagucuguuaugaaugcucagggacucuggaauaguggcaauugcaggguccucgguucuccccaggucuccugccuuucauuucacuguugguuuuacugcagcagcaggcucucaggucacaguuguguuuuauaucagaaucauuaucuugcucagguauacauuuuaccuugugcuuuagcugcuuagagauuucaagcuaacuggagaagcuucuaugaacuuacuccaugggacaauaaaagaauauuaggcuuucccacgcuaacccugcucacacuuugagugcucguucuagcccccaagcccucaucagucucugguauuagucacucauuagcagaucucacucacuaaauaacuuaacucagccagcaucuuugggccuucagaaguuuauagagauggcagccucuaggcuucaggccacauuuuguaaucucuagauuuugauauaaauggccauuuucuuuuuuuuguuuuucuuuuuguuuuuguuuuucgagacagaguuucucuguauagcccuggcuguccuggaacucacuuuguagaccaggcuggccucgaacucagaaauccaccugccucuaauuauuauuauuuuuucgaauuuucuuguuuuuauagugagacuuaugauauuugagggcugaaagagaucuuggaaggccuauuuaguccauccuuuuaggaaacuuuaugcaguuucauuuaggugagaauuauugacuaauaugaaauuuguugggugaaugguugaugaccaaaguaaaguugcagaaauguccuaaauagaaauggggucauaucuguacugugagugggcagacccgccacucagcccucugucaguucacauuguuaguugugcugggguuuccuuuugucugucugucaacugauguguuguaacuauguucaggugaccacauacaguauauuuuagucaagaccuauuugacugagcauuaagcaacauuggaaauuaaaaacaaaucuauaaguaauuuaagaaaagcaaggaaaaagccagacagaagauggacucuucugcaugcucccaggccaggccuugucaauaaauugacacaauauaaagaaagcgugugcugguagcuucuaaugauguaggguaaggggcagguagaacccauugggaacuugcuguaagaaauaagcuuuaaaggaguuuguuuuggagggcgugggucuagaaguagucugugugguuugggcgugguggcauaugccugugaccucagugcugggggguggggggagggcgggcugaaacaucugaaucugagagccugagcuucaugauaagauuuucucagaaacagaacaggaccagcccuuucaacagugugugaguguguguguaugugugugugugugugugugugugugugugugugagacauagaaaaugaaauguauugaaauggaaagguagacaugcugacuuaauaaaauugguuaccaaaaaauaaaauguauuaauauaauagaggaaugaacugggaauauguguccuuugguacucucuaggugaugaaagggguuuuucuaggugguacuugggacuuugaauguagguccuuguguguacuauacaaguagccuaaauguggguuuuaaauuuuaucuuaauuuucaucuucaucaucuucuacauuucuguguuaguaaagugcuuuaaaaauacuuuaguugauuuuuugagaauuucacauaauguguuuugaucauauucaucccuuaaauuugacccugaccccuuccagauccucccccaccucccuguucuccccucaaccccaguaaucuauugaguccaauuggugcugcccauaaacuccuuuuuuuuuuucuuuuuuuuuuuuccauuuuuauuagguauuuagcucauuuacauuuccaaugcuauaccaaaagucccccauacccacccacccccacuccccuacccgcccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccggcauagucucauaagagacagcuacaucuggguccuuuugauaaaaucuugcuaguguaugcaauggugucagcguuuggaugcugauuaugggguggaucccuggauauggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcauaaacuccugauagugaggcucuccagcggagcauggugagccuaccaggagccacagccuuaaaggaagcugacucuuugucuccaggaagccaucccccguccguaggccuuacuuuguaaucuaggcuacuuccaauucaugaggaugguggaauuuugaguaugugcuaccauacccagcuaguuggauuuuucaaaaauucaugcuuaacacuuguauauaaauaguuggcuugaauauauuucacuaguuuucuuuucuugauaaggauauuauaaccuuuuggacuuuuuuugaauuaaguauuuacguuuuacaagcguuuuuuucuuuaaauaucaccucauuuauuauggaaaguuucaaauauacaacaccacauaggcuaacugaauaacgaauugcuacuccuccguucccaucuuggcaguagucaugugaguaguuuauuucuggccgccauuccucuccacacaccauuuuuuuuuaaagauuuauuuauuuuguaugaguacauuguuacucucuucagagacaccagaagagggcauggaaugucauuacagauggcugugagcuaccaugugguugcugggaauugaacucaggaccucuggaagagcagucagugcuccuaaccucugagccaucucuccagccccuccacacaccauuuugaaccagcuuccagaucuuucaucuuuucacuuaagguugacuguuuguaccuaaugcaugagaacauuagaaauuuauaauaucacuaucaagcaguaagugguauuaccaacucauucuuuuuuucuuuucuuuuuuuuuuccuuuuuucuuuuuuguuuuuuucaagacaggguuucucuguguagcccuggcuguccuggaacucacucuguagaccaggcuggccucgaacucagaaauccgccugccucugccucccgagugcugggaugaaaggagugcgcccccauguccggcuaccagcucauucuuaaugacauucucucucucucucucuuuuuaaacccaucugcuggccaacuuccuucuuucuuuuuuuucaaagauuuauuuaauuacuauaucuacacacacuguagacacugucucugucuucagacacaccagaagagggcgucgaucucauuacagaugguugugagccgccauaggguugcugggauuuagauucaggaccuucagaagaacaggcagugcucuuaaccacugagccaucucuccagcccccuuaaugacaugcucaaaugucuaaucauuauucacauucccucagcuguucucagaauaacuguuuccucuggcuagacuauuggaauggagauaaguucccugucuuacauuaugaaucauauguaagagagauuggcaggggugggggaguugcuauacuagggauggauccugggaccuucugccacugacaccaccuaagcccauuaaguuuguuuaaucuaucucuuuuuucucuucugccaccauuuaaaaaauuucauuauuuuauuuucuuuaaaaaauguauacagaugcuuugcuugcauguauguuugggcaccauaugcaugcagugccugcaggguccagaagaggguguuggguuccuugggacugaguuauagaugcuuaugaguugccaaauguuucucucucucucucucucucucucucucucucucucuucuguguucaugcacacacacagauauacacgauacacacauucacacacacacauacagacaugagagagagagagagggaggagagagguguaaguguggguacacaaugaggucacuauucauuauacauaaugauucucccauucuacuguggguuuuggggaucagauucaggucaucaggcuugugugguuaaaaacuuuuacauaacgaaccuucucaguggcuugcaauuuaucucuuaauacaacgaagucaucauuuuucuaaguauacuguaggauugcuacaguucuaugcaugcuuucucuuaaugcccaaaacugaaaaugcucaagaacgccucugagcugaauucuaacuaaaacauguuuguaaggugcacuuguaaauaucuguaaauuucagggagagcugauuuccaucuuaaauuaauuaaaacuauuuagugugugugugugugugugugugugugugugugugugugugaugggcaucaugugugucauggucacaggacaauuuauuguauugaguucuccuuucgccuuuuuaaaaaaaguuauuauuuaugugaguacacuguagcuguuuucagacacaccagaagaccgcaucggauaccauuacagagguugauaagccaccaugugguugcuggaaauaugaacucagguccucuggaggagcagucagugcucuuaaccacugagccaucucuccagccccuccuuucaccuuuauauaggcugcagggcuggacucaggucaucaugcuugugcaucaagugccguuagcuucugagccaucuugccaggcucugguccuacagccuuaauacuccuacagccuuauuauuuaacuagaugacauagcuauuacccguggggguaaguucaagcggaaugcccccaguuuccuuuccauuacuaauuggaaaguuacccuaagauaaaguuaagcucuuugacaauauugcuuaggaucccagccuuguuuacaaauucacuuuucaucaucauaacuguguacuauuguauuuauuuuaccgugaagacuucuaggucaggacuccacugccugccuauugauuugccucuacugauugcagguggaagaagacagcgauucagagaccuauggagaagagaaugaugagcaaggaaauuuuucuagaagaaagauugucuccaacugggaucgcuaucaagauacugaaaaggaggucaauggugaaaguggagaaucucagcggggcacagacuucaguguccuccugagcucugcaggugagaguuguaguugugugcuuguuguuuagagcugggaaggucgcuagcaugggcauuuuguuacuuuugaaauugcauugaaaauguuauuuugugugugugggugugugaaucccuuacgcacuugugccauguggagguuggaggacaaccugcaggaguuggcuuucucauucgaucaugcaauucucagggaugcaggcguggcagcaagcagugaguucucuuucuggcucaugccuauaauacugaaugucuacacuagacuaagaauaauaauugaugaacccauuccaagucggaaaaaaguuugagaacauuaaguugugagccagaagcacaagacugagucuaccgcugugaauggaugcugcacacagcacagcuccuuuagaugccagugugcaaaugcauucugcucugacuauucaagaacucaagccuuaagugauuuuacuggucggcugagcauuuccaucuuguucccugugcuuuggccaauuauagauuaggaacacuuuuuauucaagguaggaggaaggaaacagguaaaauggcuaguuaauucuuaccagcuauuuagcuaaaagaucuuggaggaaaaauugaaauaaugcgauuaaauuagcuucuauucuacauguggguuuaauucggucggagauacugcaugcauguuugaauucaauuaaaacuguagucuaacccagaaggaauguucauugguuuaugauuuugguuauuuuuuuuuuaacauuuuauuuauauaaguuaaagucaggcacaugguggaauccucuguuauguuuugauagucugcauacugauuucuucucagagguuugauuauccgucuugagagacuucaguugucaugucuuugcugagcucuuccguuucuucuccauucugcggcugauuuauuggcuucucacugcagcgggcuacugagaagagccgcccugccuuuucgugcauguugcagagcagcugugauggucuucugccgagcuguguuucauucccugaucauuugacaaguauccuccagauacaccgucucugcuccuuacagcaguucugaguuuuagcucuguucuucuuuauauaaauuaauacacuaaauuauggcaauugcuuggggauaggaaucaguggggaagggcuauugccguuuuauagaguggucagagaaguucuuacugagaagguuuguuuaaaguccuggggacgaugagggaggaagcacuguggguauacagaagaguuuccaaggcaaagacagcaagcucaaaggcucugagggagcgguguuuacaacugaucuccaggugaguuuuccaggcacagcaguuaacuuucgagaacugguaauuaaggagugaguuucuaucuuacccacuugguguuugcuaaugucgaaacagucacucuggacaguugauugcucuuuugcagugaaguuaaggaaccagcacuuguaccuuugaugaauugcuagagaauucuaguacaggugcaugaauuucauagaugaauugcucacaauucacaacugcucauacucacaaauggaagcaacucacauaucuaucaguagugaaaagaauguacagaaacacgagugagucucucagacgucacguggagcaaaagaaacaucucacaccuguaggagaccucuguguaguucuguuuaagcauggggggccaggugugccuauguucaccugucauccggugccugacguaggaggcucaccagugcagggcuagccuaggcuacauagugaaacuaucucaaaagaucagacacaagaaaaauuuaggagugagaagagggguaaugguuagaaagaggcauauagcaggugugcaggccuacacccuucugugauguuggugguacucugcuugccuggaugauggcuaccuugguuuaauuauuauuugauaauaaauuuaauaauaaugaaauaauuauuuuuuagauuguucauauguagucaccauuuuuuaauuguaacaggucuuccuaugaaagacuccuuugcagaacucacuagcuuguguaaagagguucugcuugcccugagucuugcauggcugcaagcaucuacaucuuuauuucuggaggacauggaaaaagauguaugguuuguuuuaaaucauacuuguucuggagggacugggaguuugcagcugucgacucuuucucuaagacucugaaccagauaagcaggccacugguuucuguuucuaaagaguguucuucuaauccucagcugugcuuuaaggauuugcacaguccgucccuuuaagacgccaugaucauaagagcuccugugugccaacuauauaugaacacaauagccaggauaaggcugaagauaaauguaaagaaaaaauuaagaguuaguguguuggcuuuguuuaguaagggaacccuccuguugguauguggauuaucugaaaaaacaaaacaaagcaaacaaaaaaaaaagaacuagacuuuuaacuuaaaaaaaagcucaacaacaaaauaauauuuguuacaucagaguauagaaguaggucucaaaucagauguucucuuuuaaaaccucaaaaagauaagagcagcugaagacuucgaacuuguuugcaaaucuaccgauccccagagugguuuacuuuuugcugcuguaauucaggcuccuugaguguuugcugguucugugcauccuuggcuccaucacagucagcugcugcauccuuggcuccaucauagucagcugcugcauccuuggcucuaucacagucagcuuucacuuucuuacucugaaacuguguuuagcagauuuggccugggaggcucauuuccuuuucucuucuuuuauauuugugaccuuuuggcuccuauuugcuuagggauccuguagaugucugugaguuucuuuaaugcauccguuuggaccucuacucccaauauuuccuacauugguucuuuguucauccuugugaguuaccauuaugggccuuuucaacuuuauuuaguguuuuuugaguuuuuuuuuuuuuuuugguuuuucgagacaggguuucuauguauagucuuggcuguccuggaacucacuuuguagaccaggcuggccuugaacucagaaauccgccugucucugccucccaagugcugggauuaaaggcgugcgccaccacugcccggcccguuuuuugaguuuuuauuuuuuuuuaaagauuuauuuauuuauuaugugaguacacuguagcugucuucagacacuccagaagagggcaucagguuucguuauagaugguugugagccaccaugugguugcugggauuugaacucaggaccuuuggaagagcagucggcgcucuuaaccacugagccaucucucuagccccggaguuuuuauuuuuaauuaaguagaauuauuuucucuuugcuccucuaccagucuuuuuuaucccccuaugcuauuugugguccuacauguggccugaucaucuuaagucacccagcagcuguuuuaccaacuagccagucuagagauugccguucugcucucagcacuucuguccuuucuguccuugcugaggguuaccuuaccuuuugcuuuguuuugcuuuuccuaauucauuuuuuuuuuaaaaaguaauuuucuuuggaaaugauuugugccuuuauaccaaaggguuugggcuaagcuaaggucuguauacacuuuuuuuuuucccuucagacucaauaccuucaacaccaugaguuaagaccuaaucugauugaccuguccucagcuuauccgcuggcauuucuuguguuaccuagguugcaccaguugggucuguuugcaucuuguuucuaguagucacuaauaaucugauagacagcauauacucagcagagagguuuguuuggaaccuguuuuuaguuuugucuucauuuauuuccacaaaugcugccuuguuugcucaacacuguuacuguuacauuaaagucuggaauauagacuuaaaaagacuuauuuauuuuacuuuauguguauugguguuuugccugcauguauguucaucauaugcaugcaaugccugcagaauccagaagagggcaucagguguccuggaacuggaguucuggaugguugugagcaugagguucugggaacagaaccuagguccucugcuagagcagucagugcucuuaaccucugaucuauagcucaagugacuaaaacauguuuuuaugacaucuauuuauuugugugcugaugugguauguauaccaugagcauauggaggccaguuuucuccuuauaccaccugagccccucaauugauugauugauugauugauugauugauugauuuuaauguauaugagugcucuaccugcauguauaccugcaugcuacaagagugaagcagaucucauuauaggugguugugagccaccaugugguugcugggaccauguguuugaacucaggaccucuggaagagcagcugcucuuaaccacuaagccaucuuuccagcccugguccccaggauuaaagucaggccuucaggcuugguggcaaagugcuuuuacuuacugaacuaucaugccagccuuaaacucuuguauuuuaucauuauauccuaagguacccagcuucacccacuuuggucuuuucccuucaauagauugugcccuagcaaaucaaagucaccaaaaucacucuuuguuggagaauuuuguucucuagggcagcuacugcuuucaccauggugguuuuuggcaguugugcuucuugcuauacccaguccccugagcagugucguaggaucacagcugugacugcgcagucuaaguucauuuuccaguugagugucaguuuauuuugauuauuugcuacauuagguuauuuuuaucucuacuaagagaaaauuaacaagccuuuuuugggauuggcuuauauuccagauacucuucaaauuaacaggugucuacuuagccacaucaucaagucuggauguugugugcuaacagcagguagcacauucuuuucaacugcucuuuccuccuuucugcuuggcuaucuuagucacuuaccugcuuaucuuaucacuguuccauugucgugaagagacaccuugaccaaggcaacucuuacaaaagaaagcauuuaauuaggguuuguuuauacuuuccgaggcuuagucuguuaugauuaugguggggcauuuggcagcaugcaggcaggcaugguacuggagaaguagccaaaagcuuuauauccugauccucaagcagcaagcagagggaggggggaaagggagagggagggagaaggagagagaagagauggggaggagggagagaagagggggaaagagauuagcauaggcucuugaaaccuuaaaguccguuccugggacacaucucuuccaauaagaccauuccuccuaauccuucccugacagcuuaucaccuggggauuaagaacucaauagauggagccuauggggaaccagucucaucucaacacuacacuguucuuguuccccuugaaaaggccaccaugggggugaggaaauggcucaacucauaauaguaaguagcguuugaaaacacuaaacaauauuuuaagaaaagaaagguuaggcacucugaguuuccaggaaauauucaauaauuagaaauucaagaaauauccagggacucaguuaucucugaggagacuugcuuucuaacccaaaguuccuacaauucuaaacagcagcaggcccagaaagugcagguaccugacugucucauauccaccauucucaucacaguguagugauuugggauucuguguggcuaauuuguuaugcaagauuauucauacugucacauuccauugcuaauuuuuauaaauauuauguucuuuauauaaacccaagccaucucaccagcccaaaaacauucuuacuaucacuaguuaauucauuuaaacuggaacauuugggaaauguggauuuauuucagccuugacuuggauuauuaugacagaggcauucaggaacuccaacacaaaaugaguuguccuugacugcugauaauuauuaacucaagcaaaaagauaauuauguguuauaagccaugcaugccaaaagucaagugaaauuugucugcuuucuauuuuuuaggaaaauugauaagaugccauuuuucuuacuguuuuucacacugcuucuuagcuuucauacucaauuaucucccccuggcauuuugagauaugauuaagaggcuugcugcuaaggccugacaauguggugauuguauagucgcaucuaagcucagugugugacuccagguggccacaguagcuucuggcuugauucuuuuuuuuucuccuccuauugguguuuuugagacagggccucuauauacagcccuggcugucuuugaacuugcuguguagaugaaguuggucuugauucacagagagccuccugccccugccuccagagucuugggaaugccugguccuuuuuuuagcaugagaaaguacuuauuuucaaagcauuucugauuucuggguugcuggaauucuuuugauugaaggcuuccgugaucucauuuuugguaucugugugccauauauguguguaguguccaugggggccagcagagggcaucagauuccuucaaacuggaguuacagaugcuuguauacuucggcauguaugcuaggaauugaaccuggguucucuggaagaguggcugagaucucaaccucucuagcccauagauuucugacugccuauugugacguacauaguuuccuguguucauauguacuuuguguguucucagggcuuuccugcuaggaauucuucauguauuuaacauucaguguguguugcugcugccugaggugguuacaugauagguaauauaucuggaguguugguauguggagccacaucagaacauccuuauguaagcgaaguauggggagaccacuuuagcacaggcugugucaguucaggcuugucaaguuaagacauucucaaugcaaagaucuuggaagguaugcuguuagcagaacaauaggaaauccagucuguguggcaguguaugugccugucaccuaacacuguaguuucuaaauaagaauuuguuacugcugucacuuaaaggcaucauuagccugaccaugggguugccauguaccuucucuuggcucccucugguugcugugagccacacgaguuuacuguguaucauuuugaaaagcagcauugaugcaguuaggaagucuuaauuucaauuuuuauccuuaugcuuguuuuucuugagaucuuugaggucauaguggaaaagugaguuagauuucauuuugaaaacuggagaauagacaggagcaccauugcgugggacuucauggcuagagaagccguugcucugacuggguucucuugaugccaggcuuaggucucuugaaucucccugcucuucuguuaaguaggcagaagaaaucguuagagggaagaugugcaggcguguaaguuguuuucucuggagcaccgagcgccuguuucuuccugccugugccccugagaucucugaggguguccugaugcucuuuguugugugaagucuguguguuuugagccauuggcaccucuucccuggagugcucaucucauuggcacaaucucagccauuuuuugagcaaaguauucacuuuguuuagaggacugaagcuccugucggcugcaguuuaacccagggcccugaagguauuuguggggauaagaugcugagagaagacuuucuuuuugguagcugcacagacugugcaguuucuaagucauggcagcaggcauccauuugaaucucaauguuuuccuuugcacugggguuuaggaauugaguccuguaugguuuuguccuguguggugcucuauaaaaugcuaaaaucacauauguacacacauucauacaaucacaaaguuuugcuuuauuuucugaaacaguuuuacuuuguagcccagacuggccuggaauucacuaugcagucuaggcuugauuugaacuugaaguaauucuuuugcuuuggccucugcugguauaaguaauuauguuuuguuuuguuuuguuuuucagaguuccauuuuucucagaccaauuauggaccaauuuguccaauguaggcuuaauuucugcuuuucaaagguucuucucuggcuuuuaaaagaagcccaccgagagucccaugcuuauguuaggcuuaugcuagucuaguacagagcaugcucagaggaagcucagggaauucugccggcacaugagugccaguuauucacaauggcccaccuucauugugccucuuuauaguuuuaaauaggaauagugaauuuugaacuagucuuuucuauuaugaacuuggaugcguuacagagaagccugaguugcaccaagaugccaucacggaaaacaugagaagguuuugucaaagacuuugcauuucaguuuccuagacguggauauagagucucaaugagaagacaaggaaguaugccaugcuuucagaaugucccaaaggagagagugggccagcuguguuccuuguggccccugagcuaagaugagcgacuugaaggcuaagcauguugaccuaacagagggcggaugugcguguuagaaugugcugugaugugcugugaugugcugugaugugcaugugaugugcugugaugugcugugaugugcauguuagaugugcugugaugugcugugaugugcugugaugugcauguuagaugugcugugaugcgcaugugaugugcugugaugugcaugugaugugcugugaugugcugugaugcgcaugugaugugcaugugaugugcaugugaugugcugugaugugcaugugaugugcaugugaugugcaugugaugugcaugugaugugcaugugaugugcugugaugugcaugugaugugcaugugaugugcugugaugugcugugaugugcaugugaugugcaugugaugugcaugugaugugcugugaugugcaugugaugugcugugaugugcaugugaugugcugugaugugcaugugaugugcugugaugugcauguuagaaugugcugugaugugcaugugaugugcugugaugcgcaugugaugugcugugaugcgcaugugaugugcaugugaugugcugugaugcacaugugaugugcaugugaugugcugugaugugcaugugaugugcugugaugugcauguuagaaugugcugugaugugcaugugaugugcugugaugugcauguuagaugugcugugaugcgcggugucuaaaggggaagguggagggucugcuucauucuguuucaucuucacauuucugaaaguguugagcagaugggcuuucagugauagugauucauaaaugguugccuuucaugauaacagcagagcuuuuuuucuggaaagaaacuccuggucuugugucaguaguugagccuuuuguguuucauugaauugaagcuguguuguucagguucuuucuaaaaaagcaaaguagguggguuuucugaaugucgagagggaagagauggauacuauccucuucauucuccugagaacccgcuugagcccauaguuauuuuuucuguauuaaucaugucguaaccagcugguacuguugugacuaagagcuuagguauugaacauauauugauuauaauaauggauuucauuggcauuuucauacauacauauacauguauuuugauccuauucacuacugcacuguccucuccuguccccucuccucucacugguuacgguucuuuccaauuaggguuguuaaggagagcaagggugaagggcuauuuacaggagcauggauacuuuacaagcugcuguaucucuaacgaaggucuuuuucccucacucaguagucacuaacuauucauagauccucagggaagagugaggacacaugaacccuguccccauucacuaccauuaacuaccuauaagcauucagagauggaucuaacuuuuuguuuguuguuuugacacaaggucuaauauacacaggguggaccugugccugacuaaccuguaaccugaucuguaacugcauacagguucuagcaugaacuguguguucugauccuccagcuucuaaaccucuggaguguuuggaauuccaagugugucuagauggugcuggagaugaagcccagagcuaagcugccucucuacccacuaggugacacucaccagcaucuaagucuucagagaaugacgaggccccuugaguaccuccccuguccgcgauaaggcauugauggguugaugguggaucaaaaucaaugcaaugaguugugaugaguuuguagaugcaacagccauguucuuucugaaauacaguguuccauaacauucuaucccuuccuccauuacguccuuucugcccucucuccugugauguucucugaaccugaagggggugauauagauauccaauaagguugagaguucagcagacaguuuuucucauugcuuugaccaguuuagggaugucuuuucuguauaagaaauggcuauuaggaguugguuuucuucucacgagauucuguaguauuguuuauuuuacccccauccauaguagauuauaccacaagagccuugcucagaagugggaggagagagcccagaaaagagaguaacucaugguucuacuaccuagggcauuugcuucaaaaguucaguuggcaaucugagacugaaaauagaaguuuaaauucucuuuuucuugauacuuguauuuguuggcaaugaagaugguuguauauuuacagcuauaacaggucggucugauucuuacaaaccuuuaugaguagaaaguuauagggaacucauaacguauuuuuagaauacuuaaggauaaaguuguacuggccacuggagcuuuucgucccauaucuauuucuagcugcuccacagaagcacacgacaccagaagagcucaacaugacggugaaagcuuucuaauuuuuucauuuuuuuggaaaaugagaccacagguuaccuuggaaacuguguuuguguguucacguacaugcaugcacaugugugagugcauguggaggccagaggacaguggguguugucacuuggauguggucugcuuuauuuugagacaggucucucaauggccuggagcucacagguuacgcuaggcugucuggccaguagguccccgucccagggcgguccucugcagccuccucaguggcuuacaagugugugccagcuuuuuuuuuuuuucuuuuucuuuuuuuaaaugugggugaaaggauugaauuaaguuuucuuuucuuucuuucuuuuuuuuuucuuuucuuuuuuuuuugcagcaagcacuuuacugauugaacuaucucaucagccagagauacuaguuuugaaauagaauccauuucauaacaauuaugauaacuccuuagugaauggaauaguccuggagaaggcuacugagcagaaaugaauaaacugucauauaaccaauaggucaaauauaaugaucaaaaauuucuuuuucauaggagaucugauaucugacuuuuucuuuugacaauauuuccuauagccuaggggcuugggcuuuacagccaaggguaaccuugaacuucauauucugccauuugcauauucccagugcugggguugcaggugugggucagcaugccuugcugaugagcuaguggcaaguacuggggauuggaugcaggcuacuguguauaggcaagcacucacucacuauguagcccuggccgaccugcuguccauguaugggaauuauuauuccccucuuuuaaaguuaauuuaaucuacuauaaugugcuacaauauuuacuuauacugaagcucagauuuacguacucaggcucugucuuucuuucacagucagguacguuucagagcccguacaccuggaauuugcuaggaauaauacaaugagugguaaaugauaaggaaagaacauuugaaaggguccugcucaucagaauuuccaaugaaaggguccuccuuaccggcaucuccagccauucucuugauuucucacacugcauucugaaacacuuuauggcaaaaucucacugcuucauuucuaugcuugguuuccugauuacaauuuacugagucuuuguuaauuuuauuuacuuccagcauauuuaacccaaugcaaauuauaguugucuaaaauaaacuuguaauccauuugaauccuagguuugguugacugaucauuguugaggcaacagaauaaccauggggcguucugucaguccaggcaaugcuggucugcagccggcauccucuuaggguaggaaacauuauugucucacaugacucauaugaggauuguggaguaguccuuggcagugucuguuuggaguacagaaacauuuaagauguagaguaccuuugugaauccucuagauggcagaacagcuaugauguauacacuuuaggaacuguccagaaagaacugggaggagauggcaaaagcagggaccuguaggcuauagccuuucucucucagagaacuagauuuguaugcucuccacaucgauguuuuuaucuaaaaucucuucugaagggauguaacugcuaaaauauaguaugacaacacucaaaaucuugagcugugcacccagagaugaaacuacagacuugguaagguaucuaauuauuucuuuacugcagcuaacucuauuccagcacccagggaugaguuucgaagcaauaccagcuuauguuugccuucauuuccaucacagcacaggccuuugccacugccccuucuuauacaggaaucaccacuguuggcauagauuuaacucaugggaaauccugagguucugguguugcugugacccacaaacucagaaagauuugacuuagguacuugucuaaguaggguuuccauuguuguaaagagaaaccaugaccaaggcaacucuuauaaaggacaacauuuaauuggggcuagcuuacugguucuggaguucagcccauuaucaucaugguugaagcauggcagcauccaggaaggcauggcgcuagagaagcugagaguucuacaucuuguuccaaagguaaacaggagaagacuggcuuucaggcagcuaggaagagggucucaaauccaaccacccacaguaguacacuuccuccaacaaggccacaccuacucuaacaagggcacaccuccuaauagugccacucccugggccaagcauauucaaaccaccacaguacucgagcagagucuaaguauuaaagcaaaaaggaaaacaaauguaagauuucgaaggugucauuuucucugcucuuacuauccaauagucaauuucauugucucuucaguuucuguauuuuguuuuauuucauuucuuuuuaugugugugaauguuuugugugagugugugucugugcacuacauguauaccuaguguccuaggaggccaggagagggaucgcuguguuucugccuguuugagaucguucuugagaauguaccagaauauauucccauacucauugaacacacccccugaugagcucauucugaacauacuugaaaauagacaauggaugugauuguuauucucauggcccucacccaugaguaaugcagaguuucauagacaagacaaacauauauuuucagugauacuuggcaaacuguuauaggagaagugguaucaaagugcuaaggaagguuuuaggcacaaauggcuuuucuguagauauuauaaguucccccaaaccucauaaaauugcaaagcuucuguaaggcaaaagacaccgucaauaagacaaaaaggccaccaacagauugggaaaggaucauuaccuauccuaaaucagauaggggacuaauauccaauauauauaaagaacucaagaagguggacuccagaaaaucaaauagccccaucagagcuaaacaaagaauucucacccgaggaauaccaaauggcugagaagcaccugaaaaaaugcucagcauccuuagucauuagggaaaugcaaaucaaaacaacccugagauuccaccucauaccagccagaauggcuaagaucaaaaauucaggugacagcagaugcuggcgaggauguggugggauugcaagcuuguacaaccacucuggaaaucagucuggcgguuccucagaaaauuggacauaguacuaccagaggaucccgcaauaccucuccugggcauauauccagaagauuuuccaacugguaagaaggacacaugcuccacuauguucauagcagccuuauuuauaauagccagaagcuggaaagaacccagaugcccugcaacagaggaauggauacagaaaaugugguauauuuacacaauggaguacuacucagcuauuaaaaagaaugaauuuaugaaauuccuaggcaaauggauggaccuggagggcaucauccugagugagguaacccaaucaaaaaagaacucacaucauauguacucacugauaaguggauauuagcccagauacuuagaauacccaagauauaaguuacaauuugugaaacucaugaaacuaaagaagaacgaagaccaaaguauggacacuuugccccuucuuagaauugggaacaaaacacccauggaaggaguuacagagacaaagauuggagcugagacgaaaggauggaccaucuagagacugccauaucuggggauccaucccauaaucagcuuccaaacgcugacaccauugcauacacuagcaagauuuugcugaaaggacccugauauagcugugagauuaugugagauuaugccagggcuuagcaaauacagaaguggaugcucacagucagcuauuggauggaucacaaggcccccaauggaggagcuagagaaaguacccaaggagcuaaagggaucugcaacccuauagguggaacaacaauaugaacuaaccaguaccccgagcucgugucuuuagcugcauauauaucaguagauggccuaguuggccaucaguggaaagagaggcccauuggucgugcaaacuuuacaugccccaguauggggaaugcuaggcccaagaggugggaguggguggguaggggagcgggugggggaggguaugggggacuuuugggauagcauuggaaauguaaaugaagaaaauaccuaauuaaaaaaaaaagaaaauggaauuguguauauuuacacaauggaguacaaaguuuucuuaaaacuuuuuuuuaugaacuucuaccuaugugcaugcaucaagugggaccacagagaguauguuaauuuaaaaaaaaguucccccaaaauuacuacaccuagaagacuauccuuguuagagcgccuugauacaagcuaagacuucaacuaugcuccagccagcuucuuuggauuauuauuucagaaaguucaccguauucacuggaguaauugaacuggacauuaucuuuuugcuuugcuguucaaagagcucagaauuugaugcuguauuucuccagugguaaauaggaaggcacgcaggcucucaugacacugccagcauggcaucgcaugacaacuaccaacgcacuuuccaauugaucugcauucuugaauuauuugacuucuauuucauguuaugugaaaaauagaggaugucaggacuguccaaccaccguucaauaauaguauaauuaaucagcacauaggagcaguuacaugcuuuuacaggccucucauauucuguuaccucaagcaagagguagaacaaugaauaaugagcuugccuugugaucacguguggagauauuauugcuuuguguugaguacuuauuuaugaucugaacuaggaggcugucacagacaaguagaauuuugagcuggggcaauugcuauugucuaaagggaaacugcaucaguauuuguggaaggauuuucuggucugcauuguccuuggaagcuagaagaauggugauaaaaagagggauugcccauauguguacauguuuguaagcucuugucuuuauuuccuuuguugaguucugacuuacaauuccagagauuuuuuuuuauuguuucuuugcgaauucauguugaaagaccuuauagaacaagaauuuuuaguaaugaagaggauucuuucuuaaugaauucuuguuuucuaagaaggguguuaacuagaucacaugcucacaugcuaccauguuaauuacccugggcgucacuucagaauauagacuugggacucuuacguugagagcuacugucuuucccauuuggaguauacagagaguuuuucucaagguuuuugagcagcauugaugucuccaguuguacuggaguguagucucacuccugagucuuuucugacuccggcucuacuaaugucuguugcuuaauggaagugucuucauuuucaucuuauccucaucugugaaauucggugacaugauguuuauacccccaugauguuuccaaugcuuagugguccuuuacaccuucauaguggaugcugcaaagugacaggugccagggaaggaguuuucuuucccuaaaucagcuccugucauggaucucucuggugucucaguggucugacuugaaaugagugugcuugcaucucuuuugcaucuagcuccccagaaaggguauaaucaugugugauaucggccaaucccccagucacagucugugaugucacaaaccaaagaucauuuucucccagcagggacaaaauggagaggaggagacugcccgugaugauuccauccuuauucacauucaguuacuucccaacgaaaaugaaccacagggccuaguccugcugaaauccuacugaaauacucauugacuuaagcagagcauggcacccccuuuauacuauagugaaaaacucaaaaaauuaaaaacuugaaaguuauacaaauauacauaagcagauacauacuuaaguaagguuucuugauaugauaaaugcuaauacauuaacaugaauuuuacauauauucuaauuagcauacaaauauaacaauaaaauuuguugcuugucauuuuagguaaaauuaccuuauuuuaaagacagguauaauaucagcgacacucaauggaaagucuuacuuuggcucauguaccuauuuuucuuguaguuuaaauagguaugcuuauaguguuuggcugauguaaauggucagagucuaugauauaugauaauggaugucacuaguaaggauaugguagccaaaacauuuaccccauaucauauugaaucauagaaacaauuuucagucauugacuauucuccaagauucaaaaugucauuaauuguacuuacuuugaaaccccuuacauggggcugccaggaugggucagugugcuaaaauaaagcauuugccauguagccuggcaacccuaguucaauccacauaaagauagaaggagauggcugacugcacagaguuugcucagaccuccacaaaaacaaacaacaaacaaacaaacaaacaaacaaacuugcugggcaugauggaacauucccagagaaaggcagaucuugaaguuugaggccagccuggucuacagaccaagauccaggacagccagggcuacacagaggaacacucucucaaaaaaccaaauaaguaaauaaauaguaaaaugaaauaauaaaaaaagcuuauccauugguaccuaugagaugcuaaagaucauggugucuuuagcuuuuuaguccaucagugauuguagacuguucugaguuacugcaguucuggggaagcuucacugagacugacauagcuuucugaauggauuauuauagacaggagagaaagugaugguucacuggguucauaucugucugcccauccauugucauaggaggauaagcuauggaaggaagcaaaguccccaagaaguggcaugugagucuuccucagaagagugaguaaaaaaauaucaggaacaucaucuuacauccccuuccauucugauuauccgaagccaaccaagcacaauguuguaaaucuccuuuuccuugaguuguuuaaauuguuuaauuauuauuacuuuuauugaauuauauuuuauuuauugcuuggcauuguucucuuaauaugcauuuaaaaauguuaaucuguaaagcuagguagaaacagaugaaaagaaccuuuaaggauucaaguaagucuuguauaauguguguggaggggguggggaaaggcaaaaagccagcacuuuuuaguuuggcuguuacauaaauaagacuuuggaauuuaugguccuuuccccgccugaaacacacugguguagcugugagucgagucacucccugugcugaaaugagagcuuuccucugguacuggaaagcgacaagugagacugcagaguggccucagaggccaaggacgugugucaacuaagguuaucugugcagugucuuggaaagaguaaaggaggagggguguaucucauuuucugaauuaaaaaccgaaaacagaaaucuuucaaugcaauggagacaauuuuccuucuuccaucacuuugugcugggauggaguucacgcccugcccugcguaggccaauggucugucugcuaaggcgcacugcacagugcuccucacauuuguguuuagaauaaucacuuugguuaguuguuuuuggauuagccaguuucuuuagcuagguguggcgugcuucuguuguuuuucuuaucuccacccuuccaagcuaauagaaauaugacuuuguuuuagggcuuucgguaagauuuuugaaucuaacuucucaguugaacuuaugacagugacuucauucuagugaaguuguagggagggcauugaaaugucaucaggugaaggagggcuggcaguuccugucugugcguuuuacacugcgucucuuuagaagccucccucuggaaugagugcgagggaguuucugcaaggcacucacccuuucaacuucucucauggcuuugcauucugaaguucaaaccaucagccuuggaugaaaacuuuuggggauugagugugccagacuucauuuuguucuguucuuaaauguuccacuugcucugcuacagaaacaucucugcuaucuuugggguaaauucaccccacccuggcagugugcacuggaggcguuucccucagccuggaugagaaugacaucacaguuuaggguuuuuguuuugcuaagaauuaaaucagucauugagccuuuuaaaagcauugacacaaagguugcuacccaugcuggugaguucuuucucccaguucucggacccaaguucgagcuugguaaagagcucugugggcaccuccuagauagcguucuagacacuucuugugcagauugcuuucaaauuauuaaauaaaauuauaauucuuaaaaaaaaagaagauaaauucagugaaaaauaaacgggauguuccagcccuguuauggcagcgcugucucacgugcccaaguagaaacagguguuuaccucagaaggcuuaaaucugcauaaagcuuacgggagaccacaugaaauucaaaccuccuggcucccucacugaaauagcagguaucauuucaguuaucacgcuaugaauuaauguuauaaaagugacucuuaccuggcaggaguugcuugaagcucagugaggaaggguaagcucucauacuggaaaugccucgucgacuuuugccguggugaucucuuucacccgugugucuuaguucuugcagcgucuuuguggccccgguaaucccauguuagcacagguagcagcaaggugaagauuccauuugggcaggauuauggaaaucaaagggugaauuuugccuuuaucagauaacagccauugaucugaccacagugcucagaacuuauuaaaaauucauugacuaucucagcagugagaaaucgugauugcucuugcagauguuucagccucuggaaaaguucugcucaccuguaauucagagaauccaguguccccagagcacgcuugcucuaacaccguguguuccagaagcacggguguucuuuagcaccuucugcuucccuuggcuuuucccuuaacaacuuuccguccuucagccuccugucugcagagguuaagaaucgccuuucuuucccgagugcuucuguuaauacaucgcucuagugcacugguuucugaguggugagggaaaaaauccaaaaggaagaacagcuuugccacaucccagacacugaacaugaaugaagcgcugaucggauccguucaaaucagacagccaaguggugggaugcugcuuucauacauaaugagcccauuaauuacuccuccccauggacagcagugcgcccuggcaggaagagaggagagagcagaggggcggaugcuguucacuaggugcucgcugagcagcuugccacugaggagggaaucaggagcugcugcagcucuggagugugaucagguagacuaggcaagaguuauuuugacagacaguuaaaugacguauuuuggaagggggaaaaaaaaagagcuuagcaagagguagcugggaugaggcuccugaaugcugugcgaaugugcaucucuccagcuugucccucuggcuagaaagauuuuccaccucugcuaugcaguauuugcaggguucuguccagcuguguuaguaucauguaguuuucuccagugaaagagaauuuauaaaaggucuuggguggaaagcauauacugugaguuuaaaaaacgaugacagggaaagacuuuccuuuccuuaauuaaagaugcacacauuuuuauacaucuuuuggcauaaguauuuuguugcuuuggaauaaagcauuacaaguccuuugauauaaaauguaaugaauggucuucaaccaguguuuuaaaacuaugugaaauucugaucaccuguauauaaaguauagaucuaaaaaugccaguucccuaauuuuuguucuuuagcuguuaacucugucagggaccucucacccucuucucaguggagccuuuuaagacuaugacuagguagaaggauauuuuaaaauguuuuaauuauuaaacacuuggacaaaggugaagggaaauacauaggacccaauagacccauuucccugauuuaauaacugccaguguuuuuucucuuuauugaaauacuuuaaaggaaauuucauuuuuuuuacguaacuauauguaguuuaaaagccacacaaacccuuuucagaugagcauauuacacauucucuguggccacucauuggccagucugcuugaaauuccuuguuucacagaagcucuguuuuacacaggguuucucaagugagaauucaaagcgaacuuaguugucaagcauuagaaacuuaaaaccugaccaugauaacuauauaugagaaagaaguaauucuaauaucauaguuaccuuccaugcaaauuuguagcaugaauaugcaagagaacaucucucuaguauuuucuugaacccuuuccuacuuaacacuauugccauaaugcuaaaaagaauuguaauauuggggcauggagaguuugcucaguaguuaagaguacauauugcucuuacagaggaucugagcacccauuuuaagcagcuuacaaccauccauaacuccaguuguggaggauccuacaccuucuggucaccaugugcacccauacucauguacacauaaauauaauuucaacaacaaaccuuuaaagaacuggcuguuggauugguucauugcuuucugcagauuuucuugacucuguuuagaauucaagauucugucccucugucuugagacauuccugggggcuguguaaauucagucaaauauuguugcugcugaguuaacaccacuuggcuuguuuucuuaucaagcacauaacauacuuguauaaugaauauuccaaaguuucaccauugguaugggacagaguucugugagauaagaccuaccuagccagugaggcugugguguuuaugaggaccugugacuagggcaccacacaccucucucaugucuagugcucuucccugugaauuuuaguuuuuauacuuggaagagugaaagagcauuugcuugucuacuuaacuucuccaggaacacaagaacaggaaguuuaagaaagcugugugccgcaccuccuuuguugaaguuuauucucauucagauucucuucucucguuucacuucaucucucuaaguggcugcguagaugagaaaugagaaggugaaauauggggaaucacuuaaaagaguguggaugaaaauuguuuuccuguaccgaucugggcuuaaagccagugcugagggcuuccaguuauggaaugccccucuugcaagguucucauaaaucauagauaacacacugccaagguguuugcucuguuguuauggugugaaugcaucauaacucuguguagcaguuuuacauguucucagucaugccuuguuucucaaguccuguuaaauaaguguuuuauguguuauacacuuaaguauguuauacacacuuaaagaaggcccagaaaguagugcuaugaccauuauauaaggaugagccaaaaugccguuuuccucuuucuaaguggucuguaguuauccuuaucauuuauaacauagagccagugucaggaaggcauuuguccuguugggaaggcgaggcauuggcagagggagcaguaauacuaggcugcaugguuuaggucuaaguucccacucuaguucaaacuaugaccucccaauagccuggcuauaaacugaauuauaaacauucauucuucuaauuuagaagacaguuccaaccccagagaagcugccuccuuuuuccucugcuugggacccucguccauggacucgauaccacuuacauuuaaggugggucuuccuaccccaguuaaccuaauuuagaugauuccuuauguacacacucagagaugugaguacauggugagucuaaaucuuuaaguaauuucauaguuaccuucuaugcauuaucaaagcauugacugucaaagcauuucugguauugaucucguuuauagaaaacuacauuuacuuuugcuuucuccacuguguguggcucucuucccaacguggaagauguuggguucugguauaaucaagacaguggccaagaguccccaucuggcuccuucuauuccuuacugggaaagaagaguguuucugaugcgccacacuuccaguaucauuuucaacagcagcucuucuccagcaugaccaccaaccuaucaacaagguacgaacuuucucugagauugcagaugaccugcagagaucuugagagucgacggucuuugagaagaugaugugaauuuaaagagaagagauguuuucuuuuucucuguuaugccuugaauuuauagaagaauguuaguuguuuugcuuugugguuuuuguuuuuguuuuuguuuuccaagaaggguuucuauguguagcucuggcuauauuggaacucguucuauagauggggcuggucucugccuucugagugcugggauuaaaggaaugcaccacaagugucaagcauuuuuuuuuuuuuuaaacuuucuagaauuguguguacuuuuccuucauggucucucaaauaguagugugucuuaaaaugcuacacguagauauuuuucucuuuuuuaaaaaauaaauguauguguuuauggcgugugcaucuguguuguauauuuguguuugccuguaugacacacacuuguguauagguuuguuugagugugcacauggaggcccagaguugccaccggguguuuuccuugauuguuccucguuauucacagaggcaggaccucucaguucaacccagagcucaucaguauugcugacuuaggucccaaaucacucugggaaugcuggaauuacggacagcggcuacaccuacuucacauaauagagguucuggaauccaacucugcucuccacacuugcuugucaagaguuuuaaguauggagcuagacacucaucuuucauuuaaaaauuuaaaauucaauuagacauucaucuuucauuuauaauuuuaaaaguuuaaaaauuacaguaaaguugcccauuaggaaacaauugcuuuccuccuauggauauaucugaaugaaccaagaguauuuuuaucuucaaaugaagauuuuagaaacauguguggacuucuugagguaucuaccccucugucagagcaucuugauuucccuacuuuggcauugaccuuuucccuaaagugaacugcaggcaaccacuagaggucuccagaccacacuucaggaaguucugacuuuacaggcuaguagacagaauggcacugguuacuaagguuggucauuaaagauuuaugaaguauucauuauguuccaguacugaucauagcuuuaaaaaaaagugaggucucugcccuuguaaggaugacuucauaggaccaugucugaccccaaacuguagcaggaugcaaaguguugcaucccgauugccagguccuugagaugcgcagaucugucagagucccuagaauauucucuaguuccucauucauagugaggucauuccuagccuccugcaaugggacccugccccuuuaucaaaaggaaccauucucuguaccaggcuguuuagauaggcuuuggcuuuuguuuuucuugccagcucuauguaucuaaucuuuagggaaucucguuuuauucucucucucucucucucucucucucuuucucucucucucucucucuuuguaaguagaccucagagaaguuugcugcuuuauucuagagaauguuuuguuuguuagggucuuuguuucucacuugaaccucugguucauagaaucuuugaaguagaguggcgucugaggguaacgugcuugucagagugcucugugcacucuaccugaaaagcacugaguacaccgauuggcacguuagggcaagugcuuccucgacaccagccguugucauuauugcaguggaacacaagaugcugucauuucugaaaggcacugcagagaagaguuaguuucuucccccguuucacacaguaaaugcuggagcuccaucccauccuuucucacauggguaggcagccuguucucuucagugcuucauuaggaaggcagucagucagugcagucaucacauuguuucguaccaauuuuauauagauggauauuuuccuuuuuuuuuuuuuuugagacaggguuucucuguauagcccuggcuguccuggaacucacucuguagaccaggcuggccuugaacucagaaauccgccugccucugccucccgaguguugggauuaaaggccuucgcuaucacacccagcagauaauuucaacuaaguuauaauugguaguuucaaaacaauuuuaaggaugauuuuagaaggcaaucaucuaagaguuuuauaauaguuaagaguuuauuuaaguauauuuaagccaagaguuuuauaauauaaucucauuuauauaaaugaaaugauauagaaagccuggcaacugguuagucucuuauaacagguucuguagacaauccaaaaaguuguugauuagucacuuucuagaugauggauggaucuauucuuaagcauagaaucacuguacauauaccaaaugggcuacuauuuagcuauuaaaaagaaugaaauucuauuauuuguggcaauauggcuggaaauagagauuauuauguaaaaugaaauaagcuacacacaggcaaguauuaugugaccucacuuaugaggacucuaaaagaagcugagaguagagugguuaccacaggcuggggacagcagugugucaggaacagugggcacugacaguucuguaggagcaguaaggucugcugagcuauuacaugguaacauaacuauugacuaguguacugcacaguucaacagaucauaacagaggacucagagaguuuucaucauuaaaaacaugcuugacacucgaggcagaggcaggcggauuucucaguucgaggccagccuggucuacagacugaguuccaggacagccagggcuauacaaagaaaccuugucucaaaaaaccuaaauaaauaaauaaauaaauaaauaaauaagcuugaagaacucaacauguuuaauaugauucagacauuauauagcacauguauguguaaaacaugugacacauggaacugaauccuguaggugcggagcgcagagcuacuacauuggugagccuucaugaguugggacacuucauuuaauaaguuuugugaauuauuugaagaguaaaugagagggacuaacuccaagauuagguaguauuacauaaagcuauuagggauacuuggguagaagcuagaaauagacacuuuaaagucaucguaaguagaaacaaccauaauuaugaggguaugcaggaagaagugugugugggguauacagcaggguuucaaacuggggacucagugaccuaauguuuuuuaaaggaccuuucuaagucuuaagguaguuaagaaaucaucagacuucguggaccucuggcucuuacagucuuuccuccccugagcuuuaggugcaggaguuguguuguaaauguauccauugggcaucaaaugacuaguugauuucugcauuuuaaccaguuuuuuuuuuuuuucuauaguggacucugcugcaaagaagagauuuuuuugauccaaggugugagcuauacuucccugugauauaaggacaaguuauuaggaguauguugggucuagugaaguggccacaguacauucucuaaacucuagaaccucaagguccuggguagcucaccuaguuagacaauuagacaguuguugguucccacuacuaucgagccucuggggcaucuuguuauguuggucauuguugugguucauagaugucacagcuguguaggaccauugauuggcccuuucuuggcagauuugucuccaagaaauggcaggaaguuauaucugugauaguucaacaacaaggcuuccugaguaagcccuaaagagugacaaccccagcagacauguuuaaugaggaaggggguucucuugggggccucuucauggucugagauuuaugcacaaacaucuuuuaguauuucuaauggcagccugcaacaaaaucucucucugacacaaacauccgaucuuucuucucagccuaaguaguacaguugccauaacaaccugaugaggguggcgcguuugcugcuguggugagguuguguccgucgcaauuuucaggguuuuaaaauucagcaugacauucacagaugugacaaagaauuccaucuguccacugauuugauuuucacucaguuaacuguccaaaaucaccacccacccccauguugaaaaggguccaugaguuucaugucuagcauugggcuuuuguguguguguguguguguguguguguguguguguauacauauauauauagugaauacaugcuuguuuucauuaguaaaugauauaauucacagcaaauauaaaguagaaaauauaaaguagaaagaauaaaggcugaagcugauuuucagugguuucuuauuugguaaaagcaauuuacauuuucuguuguucccaaacaaaauaaugggucucauugugacauuuucguacagauguuucauuuaacuuggcgucuuauccaucucccuccucuaaggccaccugacucccucugcccaccuccugguggccuccuaccucucccuucugcuuucuugucugaugugcuccacuauucucucuugucuuuuucccuuccccgaagauauaguccucuaauucaggauucucucccucucccuaccccgccccacacacugacacaugugcgcaugcgcacacacagauacacgcacaugcgcgcgcgcacacacacacacacacacacacacugucuuaugucuacaguacaucuaaaagaaaacguaguauuugccuguuuugaguuuggauuauuuugcuuaccaauaaucucuagcuccacuauuuuuccuguaaauauauugaauucaauuuucuuuauggacugaauaaaauucuauucuguacuuauaccacaccacacuucggccagucacgugcugggcuucaucucaauugguccauuuccugguuauugugaacagugcagcaaaaaccaugauugagagaauaucuguguggaaugcugguguagaguccuuagggugccaggagaguaagagaugagcucuacuuuuaguaauuuccacacugacuucuguggugacugcgccuauaccuguugccagccccuguauacgaggguguuugguuauuuuuuaucaaccggacauacaugagagucaccugggaagagggaaccucagcuggggaauugcuuccauuagauuggccugugggcagggcuguggggucauuuucuuaauguuuggugugguagcauccagcccacuauggcuugugccaccuaugggcaggugguccuagguuguauaagaaaaggcugagcaagccauggagaguaagucaguagacagugguccuccauggucucugcuugaguuccugcccugacuucccucagugauggaucaugccagggaaguguaagggaaauaaauccuuucccuccaagauaguuuggucaguguuuauuuauuuauuuauuuauuuauuuauuuauuuauuuauuuauuuauuuauuaucacagcagcaggaaaagcaaaguauaggauuaccucucucccauuuguugucauuuguuuucuuuuugugcaugugugugcaaaguaagcuauacgaaucuacuuucauuuauuuacagauccacccaauuauccuagcaccauuuguuagcgccugucauaucuucuucaguguuuguuauuaccagcuagcugguacaaccaccuaacuuaccacaaagaugucaaaaacuuguauuuuauugcugacagaagcccccauuucugagcaggucuuuccuuuuaacaugaggaaaucaaaucaaggcucuggagacaggguggacgaagaacagcucaccuggugggaaugccugauccucagacaacagagcaagcaaugcugggacucagcagcgucugcuugccgucgccuugaucucaggauggcaugccuuguccggauuuaugcauuugcagagaauauaugauggggucugaagacauacacagugugauaggaauuccuuucuggggcuggugugauggcucagcagguaagagcacugacugcucuucccaagguccugaguucaaaucccagcaaccacaugguggcucacaaccaccuguaaugaaaucugacgcccucuucuggugcaucugaagauagcuacagugaacuuauuuauaauaauaaauaaaucuuacagaaagaaauuucuuuuuuuuuuuuuuuuuuaauguccagacuccagggcaguuacuguguugaauucacguguucagugugugcacagcaaggccacuugcugcuucuagcuugcaguccuccuugcuggcuugcaaaccuucugugcugcuuuuuccuaguccuugaucuagugaccuguaacuuguuuaguguaacuaaggagcagcacagagagggggagaggaaugucucccaggcagggggagaaagagagggcuguagcugugggugugugagaggcuuaagagucaaugguaggccuaaagauagacuuguauugggcuuccuacuagacucuggaacuuccuugaaauaugcaugaaagaaagcacaguguagauagcaaugcagcucucauagcuuugcauucuaacccaggcaaaugggaggcaucagagccaggagucuaggugugcuggugggaaacuuagaaagcaggugauguuucugcuggcuuuuacacagcaggcaggacuguaccacacaggaagcugugcauggaggaugcugugcuuuagacccgagauggagugugagugaaggguuggacauguuaggcaaguccugacugccgccgccagugcagcaucaggucugaaggaauuagacauaccuuuaaucaaucccaacacucgggaggcagaggcaggcggauuucugaguucgaggccagccuggucuacaaagugaguuccaggacagccagggcuacacagagaaacccugucuuaaaaaaaacaaaaacaaaaacaaaaacaaaaaaaacccaaccaaccaaccaaccaaccaaaccaagagagagagagagagagagagagagagagagagagagagaaagagagaauuaaugugcuauaaucaccuggaauugcuauacuuuugucuggcuuuuccuauauaauacauugauucugagauucacccaggucaguaauucccuuuacuucugaguuguuuuuuuagcacauggccacagcauagccugucugugucuacuagcucucuuacugauagacauuuguuuuagauucagguuugagauguuauaaaauacccagagccuugauaugcaaguccucaugugaaagagcuucacuucuuuugaguaaaauacccagggauagaauugcugggucagagggggcuuuauccucaauuuuauaauaaccccaagucguuucccacaguggugggagugugaagaguuucacuguggcuggauuuucacucacuucugugaagauccgaaauauugagcagacugaaggacuuuuaccaacgaagaaagaccagugguggauggggaagcaagucagcguugcccuggggauuacacauuuacccucagugauacuccacagauagaucugagagcugaauguaaauaaaguucaggaugccuucacagaacauccacuaaugguugcugugugcuaaucuccuauagagcucauaaguaaaauaaguccuuauaaucuaagaaaauagaaaguaguacuuuuugucuaaacuaugccugaucuuaguuuaucugaaaaucguuuuccuagaaauucuaagcaucagggaaucagagcaaaaaaaccuaaaaauaaaaccucagaucauuucaaaucacugggauuggccccaguggaguggccagcuggggaagaaguuccauucagacugcauauuauauaaagcuuaagucugcaugugucgaaaagauaaguguaaucacacuuagacucuguuauaauguuagaguggggaaauauuuuaaaauacaauccauaaugcagaaaccaucacugaaaagacuauuacauuuuguugcauaaaaauuaaggauuucuauagggcaaaacuuacuagagucagaguaaaauagaggcucucugugggugggugcguggugauagugcaggggcuuagaaccuugcuccuugagaacuaccuuuggauacacuggugaguuuuaguaaccuucugaaugguuccaguauucuggagguggagguaggaggaucacuuguuauuuugaagccaaccuagccuacauagugaauuggggccagccuggcuaauaguucauauuaauaaacaaauuaaacaaacaaaugacaaaggcuuuaggguagauuguugaccgaaagaaaguaaaugcaaauaguucuuaaacaccaugaaaagaugcucgaccuacucacuacuuaaaaaaaaaaaaaaaaaaaaagggaaaggaaacuaauuaaacuuacauuucugacagaaaucaaaguuugccggacacuguacuggagaggauacacuauaggguggguguuggcugaggguaguucagauugggagcagagagcuggaggucagaaagcaaaguucuucagaacgagucaggcagaguaaaacagggguggggugggggcacacugacuguauugagcagcaauggcuggugaaacugcaaagggaaucaggaagaccagacccaucauugacacacuagucauguggaggcaggcagccccgcaugugcccacggcucaagagcaucacuugguagugcucccucagggucaugaugcaauguggcaucucucuauuucagaaagugguuaaaaaggauuaagugaaaaagcuguccacuuauuaaauguuaauuaucuuacuuagaguuacuauggcugugaugaaacaccaugacuaaggcaacuuggggaagaaaggacuuauuucauucacaugucuguauaacagugcaucuucaaaagcucugagugcaggaacccggcagcagcaggagcuaaugcagaggcuaugggugagugcugcuuacuggcuuguucagccuucuuucuuauagaacccaggaccaucagccuaggguuggccccauccacagugggcuggucccucccccaucuaucacuaauuaagauccugccuuacaggccugccuauuucucggucuuauggaggcguuuucucuuuucuuuucuuuucuuuucuuuucuuuucuuuucuuuuuuuuuaacuuuuuauugauucuucaccccagucccacucaucucccccucuccuccccuccacccuugcaaccuccccaucaaaauaaagcacaaccaaacaaaaccaaaacaaagcguagaaaacaucucaucagggaaguagugucacaguguguccacaguauaucacucuguccaccaaucuucacuugcauaugucauugcaaugaguucauuggucugguucaaggccucuggcuucugugacaccaucaguacuggaaacucacugggucuccucucagagccuguuauugcccugugucauaaaguguauuguggaguuuuuugcucuacagcuuugugcaccugguaggucgagugcuuccagccacuugcccaggaacucuuuggauuccugaaugaaaggcacacacacauuuuuuuugaaaugccuuggcuaacucaaugacugggcacuccuaaaccuuccccugcugccccaggcccaaucggggaaguggccaguugccacccaccgaauucucacauggcugguuggcuucuucugaagcuccugcaucccuuccuucugcccagacucaugguacaaccucucucuucuccccuguguccuagccugaggaacucuaagggugcgcccccccccacccccccgcccgucucccuuugcccagucauuggucgaaggcaucuuaguugaucggaguugauugaucaaaagccagcuggggacaaggaccuucaguguucugacaugcagauuccugauugaaucagagcuuuagaaccaaucuccaacaaugaagaucugcagcuuuggaucagcaggacugucccuuucaaacauuccaaccauuugaagaugauaauaaauuuugggaugaucuagcuagguuacuuaaugccucuaucugcaggaggcaggguuaucucucccucucucaugcucucagguuggcucaucugcaauggaggcauuuucugacuggagauugucuccuuucagauaacuuuaguuugugucaaguugacauaaaacagccaggacaguaauguaaaaauacacuguugguuaucacauauuuguagguaagcugaaauaucucuugauuuuguugcuuauuacuguuccuagauucuuuuaggaacaacauuuggcgcagagugggggagccguccucucgcuccccaucuccccgugguuacaaagaaacaggugauguaagucuacuaagugagagaagugacacuacaggguuggcuuucaaaaagcaaacguacaggaaauuugaagggauagcucucauuauuuagucccuccucuuaguuuucuuacuccuguucauuaguacugcuacauugcuugcuuuagucccagaacuguaagaugcaugguguuguugaaaauuaagucacugucauuuuuagacuuguuuagaguugaaagaaaaagcuagagcagaugacggcuggagauacccagugccccaggacacuggcauccuaaacauugcauauuaagccuucagauuugaacacuaggggucaguaggucagcaaauauuuaaugagauucuugucugcccacauuccugacaaagaaccuaauuauaugcucaaacuagaaagauaacuugauuuacauuuugacuccucacaauuuaguugcgauuuagauuuuuuccuguaguuuauuucaguguccauuuugagucacaaaggcacagacuuaaccaggaaggaauauauaguagaauaaaaaagauacuaaccaacacaaaccucuuggugauuuuucugacaggucaggucuuaauugcguucucacgcccggccaggaagaacacaacagaccagaaucuucugcggcaaaacuuuauugcuuacaucuucaggagcuaggagcgcaaacccccagccccaaaagcgaaagccacccccuauaaugaaaccgaaaccccuuuccuauuuaggagaguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacaucucccccuuuucuuuuaauaagagcaaauaggccacccauauuaaugagaguggagauagaggucaaauccccaguguguagguaaaggagccguacacauaaccuccucccaggcucaucacccagagggguccuggucuggucccguguuguuuuucuugggggaaggacacuugaacacucaaccuucuugaaagaugacaugucucccuagaauaggcucauuuuaugccgcagagcccuucuauugcagugcuuagccgugcaacucucuugggcugcugaagcacacucacucuaucccgugcaaugagacuagccucaugggauauaagagcugaguggccagcgaccuauugccuaagcauagauauaucaggggaagcuccauguucuaguccugcaagcgccugggcaauaaccaccuugucucuccuaguuugggccuuaagcuuacagaccaaccagagaagcaacacuaauccacagcaaaguguaucuccaaauaauaucaaucccacccauucuuuaaagaaggaaaaugcugaggagauccaauuggguaauccuuuggucagggacagguccaagcguguggaguugaccugaagucucaauucccgaaggaucuguucaaauucagccguccaauucuguaacauauacugaaaaagacuuuuugacaaauuagcugcccuaguaaauuuaacauacugaauggaaguaacacacaaucccggaaacuuuuguuuacaccccagcugagcuauuugccauaauacaucuaguuguuucuggacaagaucuaugaguugauuaaccagcaugagaccucccuguaucaugacauuagcugaggccuguuuaucuaugacuguagucacugaggcugacaaaguguuaauggugucagucaucuggaccuguccagacagagccaaggcugucugaauuaaggcuaaacccaguuccuaguuagugguaaaaaaguaggagaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacagaccgcuccccuggaucuuaucaaaauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccauagacacagacacucuuggugcucgggguaaaaucucuuuaauuccccucuuuugcuuuauaagauaggcuuugagggugcgaugcgcacgcucaacaauacccuguccuugaggguuguauggaaguccagucagguggguuacguccaucugacggcagaacugcugaaauuuuugagacguauaagcugguccauuaucagucuuaaggaguuuggguuucccccaagcacuccaugccucaaggcaauguugaaucacaugugaggcuuuuucuccgguuaacggagaagcaaacaugaugccagaacaugugucaauggacacauggagauauugaaguuuuucaaaggaagaaacauguguaacauccauuugucagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguaucugcugaaaaauauuggcaacucuacuggaaggcuuaaucacuccagucacuucuaaaagauuuacugcauuaaccacauaacaggaaucugacacaauauuaagggguucuaaaaagguuuuuaaaacuucuaaaaccacuaaacauucuaccacuugaggugaauuuuuauuauauuguuuggauaccacuuuaccauuagccacauaggcaccuaugccaguuuuugaucuaucaguauauaccacaaucccauuuuuaaguggguuucuuacuguuauuuguggaaaaacaacagauugauuuugggcaaacuguaaaauuggguguuuuggauaaugguuaucuauuuguccugaaaaggagguaacuaaaacugcccaaucauuagauguggcugccaagguuugaaccugugcagcgguauaagguacaauuaaaagauauggacuucgcccaaagugggugauugcugcuuuuaggccuuuaagggcaagcugugcaauugcaucaggauaccaaucuauuauuuuagcuggggauacguuuggauggauccacaacaauggcccauucugccacaaaacugcgguuggcaauugugcugucuuaaagacacacaaacugaaaggcugcgaauccucaauacguuguaauugugcauucuguaaggcuuuuuccaccuuuuguaaggccugguuagcagcuagaguaagaguccuaggggaggagauaugaggaucuccuucuaaaauaccaaacaaaggccuuaacucagcggaaggaaucuuuaaaaaaggucugagccaauuaauaucucccaacagcuuuugaaaaucauuuaagguauggaggugaucucuuuuuaucuaaacauguaaauauugauuucucucaaaggaggaaauaugugugacauccauuugucagaccuguaauggccugacgccacgaggguuuaccccuacgugaguagauaaaauuugacaacaaucuaaaggcauuauuaaguaaucagaaucauuuucaguagaaccaaucucucuggcagcucuaggaauaccagaggaagaaaaaacagccauguaggcuuggcaaaauuauuaguugagcuauucuguccccuugugauauagaaaagacaacuugaggacaagaacagagaaccugaaguuccccuuuauaaucuugaucuacaacuccaggguagacaauaagaccuuguaggcugcaagagccugccucugucauuauuguccaguggcuucaccugcucgggagagcgccuuccaggcccuaauagccuuuucaucugauucagaacuauuaagaacuggcuccuugagcucaccuagugaugaguagaggcuccuucuccuagaagccuccgcugauugaucuuuuuucuuuucuuuuuccuucuccuuccuucuaaucucuccccagguauucuuaccugaccuaaacuuuuccucagguucaagacccguggaaaggccuguaugcuuauuuuguguaccauauuuucucuuugcuccuacucucucuccccgcuuuacuucugauagauuguccugaauuucaucuagaauccucccugccuuaaccacuugauaacaugugaaaaggaacaaaagggcuucuaacacuagaaaaaauuuaaggccaaacauaucuuguaaagcuauuuuccacuuuacuucugauagacugucuugaauuucguuagaaaguucaaggccaggcguaccuuguaaagcuauuuuccacuuuacuucugauagacugucuugaauuucguuagaaaguuuaagaccagacuuaccucguaaagcuguacucacugguacucucguuccccagcugaaaaguucugaauucaugcaguugaauccuucucaacagucugcuuuacgggaaccuuuauuaccgcgacccgcaguucugguucuggaaugagggaucuuccuugcgccggucccgaguuuucuuguauuuuuucgucccggauuuuuucucgucccggauuucagcaccaauucuuacuagcguucucacgcccggccaggaagaacacaacagaccagaaucuucugcggcaaaacuuuauugcuuacaucuucaggagcuaggagcgcaaacccccagccccaaaagcgaaagccacccccuauaaugaaaccgaaaccccuuuccuauuuaggagaguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacagucagguuucugaaauuuauuaaaaauaacaauaaaaagaaaaagugcugugaaguugaguaaaugcuguuguuguggugucggaaaagcaggcaucuguugacuugaguuccuaccagcaggcccuguccaagcuaucguggcuccagugagcacuauacauaacuacuagauauuuuacauuagcccuuucagugacucucuaguuacaaagcuuaauggccgggaagauguucacauggauagcugaccuauugcuugccucaaaagaguugaacuuauaggacuuggaagcaguuggaaaacucuuaauguucuaacacuaaucagcuggagcuguguguguccuugauguauguaugcuuuuuuuuuuuuuuuuaaauguuaagccucuucuggacaguguuucaaauaaugagucuuuccagguucaacugaaagaugcccugagauggauuucagaugaaauagccuuucgcuaauggcaccggggaaagcuggaauagauccacagcagaguaauaaacaaguuccuuaucuuuauauuuaaagaggagggguccucagaauuuagaugagggcccaucuuugagcuaagagauaaagggagugucucggaauuuagcaggcaggaagcccuaauuuaggaagcuaaucuuguuuaagggcacugacugcucuuccaaagguccugagcucaauucccagcauccacaugguggcucacaaccaucuauaaugcgauuuggcgucuucuucugguguguuugaagacagcuacagugcacccauguugucacaucccaucucagagaugcuaugugauacaaguuuggcagcuuugggaaggaauuagauagguuuaaucuuuaccuagguuacaaaagccacaaggggucaccauagcauggacucuauuaguguugggaaugguggcuugcuccccucccauaggcuugguagcaaucugcuuucuaaugcccugauguugcaccucagacaaggucuuaguagaguaggagaguuugaguaucuucuggcucagugucccucuuaacugaauuugcagaaaggccucagcagcuaucucuuuucagggagaaaauaccucaucugcuauuuugccugauccccuuuuuacuuuuguuguuuugaaucuuccucugucguuaaagaccuugaaggccauuuuguaaggucauuuugagggucaucccccugcuuucugggcguuuugcuauuaugugaagaacucguugauaaaguggguauguagcgagcacuuuccugauuccguguugggacuuaaauugcuguguuuaaaaggugcugcugcaaaugagcucauaaggacugcugcauuucuuuuuagcucuuuggcugguuuccuggaucuuaucauaauuuucagccuugaggaagauguuuuucauacccuggaucaggcagguuaggaaaugagcccugugugacaaguuggcagagccagggcuccaguccugcaggauacugguuaggaucuuagguaugaagucuacugggaaauaccacugcugagcuccauauccagccuuguuuuucucuaauguuguagaagagaaaauaauucuugaaaaaugugaguguaugaacauguaauauguuggaauucuuugguauaucugacaguauuguccgagaaagaaccaagauuuauuuuguuuuauuauuauuauuuuauaaagcaaagagaucagauugagacacagggaugcguauacaugcaaaccagcuacagggggacugaaguucccacggaguuuaagaaguauuaaaucuuugaguguauuguagcaggggaaaagucugggccuauggaaaggcucggcaggggagugccagagacaguugggggugggcuggaaaugaguuguuugaaguuggugcuggaagggaagggagagcuugagacaguccugcagggagaguggugugcagagccccagggaggggagggagaaacuccagagggaaggugucuuagucacuguucuauugcuguaaagagacagcaugaccaaggcaacuuauaaaaggaagugguuuccuggggcucgcuuacaauuucagagguguaguccauuauuaucaugguagugaccaugaggcgcacagacagggacuggaacaguaucugagaccuuuacauccuggucccuaggcagagauucuaggcuuggugcccccaacaccuccagugugugaggcuauggaggccauccuuauucaaaccaccacagaagggaaagaaagggaguuggaagagaaaggcugugagaauuuucugucccaaguaccggaauuguaaagguccuuagggcagcaggagaaaguggcugaggggcuguggaggggagugguucuggggaguuagggaaaggcauaaguuugaagggcaggaaaggcagcccagagacacuuggggaaguuggggcaguggauggagugggaacguggugguauugcuccaagggaggggagcccacaccauuccacagacaggaugaugauccaagggagaggcacucaggccuuuccacaggaugaugaaagaaaucagcuguaacugggaaccaaaaggugauaccucaucacuuguaacuugccuucuaccaaacuuggugauuuaggugaauguagacaucuuucgauaguucccugauggguauuuaaauguagauacugauugguuuguauucacauuauuuuccgucuuucucagauggaaacuuucguuuccacaucuaguuuacccaucucagaaaauuaggcaagacgauauuuuuaaaguguauguugcuuacaucccauucuucaugcuguguuaggaacccacuuuaaagaguuaacuuaaugcugcucuuucgucaugucugcaauuuuccaucucuucagagguuacugugagcucuugccauugacucuguuggugccugagucagaaagggaagaaaaccugaaacugcagugaauuagccuuaauuuccuucuagccaguaaccagugcaggugcuaccaaugacggacaggcaucgggcucagcuccgccgugggcucagagucccucuaauagacaggggaaucguuuacaagguuuugucgcuucagcuuccuacauccguaccucugaaguggagagaauuugcuuuucuuccuuucccucuccuuucuccccucucuccccucucucacucuuuccuccuccugcuugcuucuauacaggaucucauauagcccaggcuagucucacacucacuauauaauuguggggugaccuugaacucuggauucuccuccguucaucucccaagagcuggggauuacuuucugcggugugucaugguacuggcagguaguaccaugaaguacaccccccaaccccaauuuguuuauuuacauaaaaaauacuuuaagguauugggcuuucuuuucugcuggccugggauguauagccaucuuucuuuuuuuuuuuuuuuuuuuuuuugguuuuucgagacaggguuucucuauagcccuggcuguccuggaacucacucuguagaccaggcuggccucgaacucagaaauccaccugccucugccucccgaaugcugggauuaaaggcgugcgccaccacgccuggcuuauagccaucuuucuaccucagccuuccagaaugcuggaauagagacaugcacuaacuacagugcuguugggagaggugaguguucuaaaaugccagacuccuggacuuagacugacccugcucagucuucuaaguagcugagcccacaggugcaugccaucagcccuagguauuuuuuucuccugaugugaaaaacaggaggacuuauuguuaaucaaaaaaugaugcuucucuugcccuuguuuguaagcugcuguucucugcacugccaugucucuggggauguugaaagcaaaguuagacagaauugcauugaacauaugucuuugauuacuucagccauguagacccugaguaaucuagcaauugcuauagaaaguagauggauuucugagcuuccauggugaaaaggcuggauuguguguggcggucauuugcgagauuaaugguggccuugguuucagccagcucuguggagagggcugcaauugauucucucaggaacagaagcaucuuuuuagugaagauccaguuuuauuuuaaacuuuaauucuguugaagcgcccucuuacauaauuacuggguuugguuuauuuuccuccaaaauuaguucuuaaaacuuuuuuauuuguuauauguguuguccugauaguuauaggucuugagcacaggacauaaucuuuauugugagucuuguuauacggugacucuaauauagguagguaccuuuuccuuccuaauuggaacuagccuaaucauaaaaauuuccuaaaggcuaaagacauuugucauauggccuaaagguagacuuaagacuugaagucacuguggcucauuugauaagaagcacuuugugacuuuucauagacuuugacauuugguaaaguagcuacuguagacauaauuaaaauggauuguaaaguuuuauuuacauguuuaaaauaaauuucauuuaugaaaauaaagcagaauuaauauugcauaaguuguguguauauuuucaaaguauaaacaauuucuauuaacguuuaguuauggauuuaucauucacuccagaaagauccuuugagcuguuguuuucagcauuuugcuuuaagcuuggggauacugguggggguucagagaagagcaagcaagcuuuuggucugaggagccuccaguuccuggagugggaguggaaggauuuguaaguguuugacuaacaccucauagaggugcauaggcugugcaacaaaaggggagugagcucucucuucugggagaguuauacaaaggaacucuccagagcacuaauuuccaggugaugcagaggggagaaaugagcagcgagggugcagaaacgcagugggggaaaagccaggagcucugggaacagcaguguugaaugcaauggagaagucaagucccgagaauauuuuugagggguuggggcuagaacccagggccucacauggaaggcaggugcuccaccacucagcugcccuccagccuccaugaagaauuucuuccucagugguucuguacaggaaccaccuuggagagggcagcuucagucgagcugugggggccacagcugcaauguaaacgguuaaggguacaugaggagaagauucgguguguaggugugguuuauuguaugagaaauuuguuagagaggaugcagagauguuuggggagacaugagcucaaggaagggcaugcagggaagacugaaagcaccugacagaaugagaagugugagcucacuggcaggcgagcuagaagaaaagggcuuggcauggcagcucggagacuggagucugacgaggaggagaaauuguaauguaaguggugugggccucugcauuuguuguugcuuuucgucuacuggcauugugugcacagcagugucacagugcacuuuagauauggcacauguaaagugccccaaaugcuccaucccgacaggugaguucagaaagggaacgaguuggaaauaguccauagagcuucaggaaugauuaguguuagguggagagcacacguaggagacagaugcagcgcugguguuggagaaugugagguugcguggcuucuuuucccaugcauggggauuauuugggauucacggaggcaggugccaugagauuggaggaguuggccccaggugaggaccauguaagagccuaugaggagcaugcuuugagucagugaagaguuuucaaggcuuacuuggaucuccugguucagggauugauggcuguaagucugaacauggcgcagcccaguauuaacuguucagaaacuaccagaggaauacugugaagaauguucgaagcacguggaacccgggagauuggagguauuuacuugccuugcccccacaggcugccuuuggucaggucuuggugugcagagugggaguggcacccagcucugccuuggcugagucucuugcccuggcugcuuacagcagucaccucugcuuuagagacaguaaaguaaguucuggagaauuucugagccacacucauguuucauuugauccagucugucccucaucaucuuucccacuuuccuuuagaccucuugccagccuuauuauuauuaauaucauuguuauuauuauuuucugaguuagaguuucccuucuguucaaggaaaccaggcucuuucacugaguuguauguaccuuggaccauggcuuuuacaugaauuguaguagcuugcucaacugucugugucuauuaccacccugggguccuugaaugugauuggggaaugccuuuugucuuugaaguuccacuaauugcaggcaucugggggaauaucagugagauaguuugaauugaauagccaugucuaaauagacuucaaaagccaggcuguuuuaggugcauucuuggcuucucaaacucccuucguuggcuuacaccuuuaacauuucaauccuuaaaucuuuguuaaaauugcuaaagaugugguaguauuauagggucucccugaagcauuaucaucuuuaaaauauagauagacucgugauauuugauacuucucaugcuuaagagugaauauugcucuugugaggacuggaguucacuuuccagcauuuguaugggguaccucacaaccacuuguaucucuaacuccaguggaugccaugcccccucugacaucugagggcaaaugcaugcauguguacucaugcccgcgcgcgcacacacacacacacacacacacacacacacaaauaguaacaacaacaauaguaagaaucacugggugugaggaaauaaucauuaaaucagagugugguggaauguauauguaaucuccgcgcagaggguugugaauuugaggccagucugggccacuauaaaagaaaauaacauccuauagucuuauaccuucagucuuacacacauguuaaauaucacgagcuagucacuuacauugauaccucgguaccuauguacucaagacuguuuacauuuagcuucagcagguuuuucacuggguggggguacuccauucucuaccaccaaaaugauuuauuuuugucaguuuuaauaauggaaccuuuaaagcaguggaauuguucaugcauuuuguacgugguaaaucucuuugcugcaguaguuuccaucacaggcacggcauagcuugcuuuuguuccauauuacauuccaagggcaucugcgauuguauuccgucaacugcuucuuuacuuagguagcucccagaugcaccuguguauuacagaguuuucucucucuuagcuucccuuccaaucuuuccauauagguuuucaucucuucuguuccauuuguugggauucacuccuuaccugaggugcaucagcugcuggcccuuuacagcuguugcuagaagcauggagcauuuuuguagguuuagauuuuucaaaauauacuucaguaaggguucucaaauacuuuggcaccucuucuagcccacuguccaaaggcaggggagaaaagaugguaaaugggacaaggggauguggaccuguuuagaaguaguucuuuggaggugauuccaaucuguuugucaggauaccagcaguccaguucaguagugucaggaugaaucagcaaugguggcaggauccagaagaaacugccaggccucugccaaauggacacgagucaauggagugaccaggaccagcuguaaugccaguucucugcugugccucucucaacgauuagcagguaugugagaccaacgaagcacugcaaagccagcuaugcaagcaccaugccucugaccauugaguccuucuuauacucucuccaaacaucacguguccucucacaaaugcugccucagcaaaacaccaugugagucugccucacguggcacaaccagaaauguccucuuccuauuuuugcccguuucagucgcugacugaggcaguggaggcagcaugcugguaguuucugggggauugguugggaaagaggcugaagaggcugcaggcuuuugcucuggauuuugccaucuuuuacuuugccuguuuaguggagacccugcucuucugcauguuguaccaggggugacuuaguccaguguucuguucuguggcucucuccuuuuuagaccuggggagguucugaaaauauugauaaccaggcucacuccauauguguuagucaguuuuugguugcugugauaaauaccuaaguuaaaucagcuuaaaagggaaaacauuuauuuugcuucaugguuuccaagaguuuggccuaauuauucuggaaacugugguaugauaaauauaucauaccaugcuagcauguuguggaggagauguucaccucauggugccuagggugcugagagggagggagggaaggaagagaaaaggaagaagagagaagaaaaagaaagggcaaaaggauaggguuccaauauuuucuucaaagaucucucuucuaaucaccuucuagucacuguucaagacucugcgaccuccugguagaaucacaugcuaacagccaaacugcccacccggagacuuuuggggagcaugucgcuauggaaauagaaagcuuaguaccccacaguuggaucagaagcucugguaggaguuaggcuccagucagaaguuuguaguuuguagcguagccacauguucagauagcugcuucuguuacuuggccucacacacuuggaucucccacuuggcccgcuuucuucccacgccagcaacugugcugcuucccaauggaaggcacgggugcuugggaucugauccauggagcgcucguaccccggaugcuugaguugacuucuuccuuugauuucuguacucugaagcaguugugucacacugccuaccccuggccuguucuccagaacagugcuuucaucaucucaaagccucuggaucccauaagggaagacuucucuuugcucccuggagaagucagggagagauccucaaacccagaguugcuuauggacucucaguugauaggauuuuucuagaaaugauguucuacugguguuggaaagaggauuaguuauguguugaagcaggaggguagccgccagguggggagggguggggugucuaacugaucuuacuaagguuuucagucaacuucucucuuucagcccuacuuguccucauacauugggagagaucaauaucuucuguucccaagcuuuaccuauaggcuguucuguauguuuguaugaccagaauggaugucaggucauuuuccuuccugcguuugacuacuguuaucacuucucauguccuuaucugcuuuaagaauauaucuuaguugagcaaaguggcagauacguguaaucccagcauuaggagacuaagggaguauuuugaguuugagguuaguuuggauuacguaguggucuccaggccagccuggauuauagugagagaucuuguuguuuagggauuuaggaguuauggguccuguuugaauuccaucugcacauuuuaaacagaagucuuuauucucauucauuuacuucuuuggugucacugaauacuaauaugugucaaaaaguaugaaugaaacgcguaacucaugcuuucaauagacgauggguuuggggccagugagauggcucagugggugaaggugcauacugcuaagcaugauuugaguuugaucaucaggcccacauggugggaggaagacuagcucugacaaacuguucucugacugucacacgggugcugucacacgugaccacaacccccuaugccugcccaaauaaaauguaaaauaaaaaaaauuaaagauuugaaaaaugauagauuuggaugaaaaguuccuucuacucaugugagguuucuguuugaagccauuuaaaaacaaaguuuguagggcagugucauguagggacuggaucauaaagggccucuugugcugcgccugcuuugugaauauugaaguugagaagcaguaaagagccguuguaagugaggaugagacugagacaugcagguaggucugcagcaagggacccagggagcaggcuuuuguaauaagccaggaaugaugagggccuagcaugagacccugaggauacagacaaacaacuuuccccauaaugccugcuuuaucagauuccugggagcugaggcuguuucugugguaacauagaugguggaugcaccauuacucaggauagcagcuuguucuuguggagugucucuuguggaugcauccagagacagaauacuaggauuuacagcaaaauugacauugagguguaauuuagacacagcagacaguggcaugagcccugcuccucggagaguagccccccaugcucugaucacagauaagcucgggacucagcgcaucuggucugaggaguaaaauuuuggaauuuuguaauaacaaauuucuucuaauuagcucacccauggauuuucuguuucauuggaguuuauacuuguguuucacgggacagcuuuugcucauuauuguugcuguggagauugucgacugcuguaccaggcuaauaugugcuguaaauauucucacacauuugcauggaaaguauuguuucaguuuuuucuucucacuaaacaacuuucauuuggguauuuguaacaacuggccaacacugucuuuguacuuugccuuauggaaacuuggucucacaguuuaggagggaauugaacauaaugccaaagcuguguaguucacugcaugcaucacaggcugucagcacugaacuaggaacugaggcuucuccugggccauucuggaacagggaucuugcccuuguuacucugucuggugagccagaucccaagucagcucuaugcaguaucuccuguucuuguuguauauaucaauuauuacaaaugaaguaauuaaaauguuuuaauuaugguuaaaaacacacgugccauaugccagcauaagguuauuuuuaagugugugauucaguuuauuucaucuuuaugaucuagaacuguagccauugaacaacuccacuuucuccuguucugaguucuugcucaucucguuuucugucuuaguguguuugauuacuuuagauagcccauuuaaguagacuuaaacagcauuuguuuuuguauaugacuuuuaauuugcuacgaugcuccaaagguccauccauggugagguauauaacaggauuuccuuuuuaagacagaguaguauuccauuguuuguauauauuacauuuugucugccauucaucuaucagcagagaccucugggcuguugugcauauggcuucuauuuauaacaaguugcccaaaucucucauugagauguugcuuucaguucuucaucuacaucuacccacaagugugaucucuagggaucauguaguaguucuauuacugagguguucuauaguaggcauaugguuuuccccacuucuccagcccuacuuuacagucagauucuugguuggggcaaagcccauuccuaucucagcccugggaccccaucugccuugagccucugcaacccugcgcaugcugccauggucucuugugaaucuacaugugccucagucuucuugagucuugaagacacuguuuccuuggaguuaucagucuccucuggcucuuacaguguuucugccucccuuucacucugagggggacaucucauuuagaacuaaguguuccaaaauuuggcagauuucugguggaaguaguacuuaguaaaaacuuugagaaggcccaaguuaugaaggaaaucugcaggacaauuuaguugugaauagugcacgcacaacacaaagaggcaaaaagguucacaaagcugcauguuauuagcccagcccauuuauauaccagcccaccucagucacauacuugucauagcugaguacuacugauaaaggcaguucucacuuugaaggaggaaggucauugugaaugauauagagagaugccaucuuagaguuacacaaacagacuugacauugggaacuaauaugcaauauauuuucuucugugaauuuguuaauauccauaauuagaagcauuuaguggauuccauugacacacaauaguaagucuucaagucuguaaugaucagugccuuagaauuagaguagcgugaauucagaggacugguggauaaacacaaccuuguuguguaauuuccuaggacuggguguuuuaggugauugugguuuaagguagacuguccuuuuguuuccuuuuucucugacacaguuagaacaaagaagagcacuuacuguuguaaaccaaauucucacaaacagaagagcuuggaccgcaauguguucugcucuccacauuucugguaaagcuacuuaagggauggcuuuguuuucaguaggaauacugaaugcaagucuguugcaugcauuuuguuguggcuguuuucugucuuuuauagggcaucuguugcugggagagugagggugcuagugagagaaaugggcacugugcggcacaugcuugcugcauuaguuaccuuugaguugcuauggcaacuuaagggcagagagguuuacuuagacucagaggggacccagcccuccauuggaggacugugugagauggcugguguuucugcacauaaguagagcagaauuggaggcugguacagcuaucaaaggucugccuuacaugacuucaucagucugcaaggcaccacaucccacagguuccacaaccaccgaacagugccagcuguggaccagguguuuaaacaugugaucguauguggugcauuucacauucaaagcuuaacaucaugcccuauucccauagccugugccaagguaccagaaacagaagggaaugagaucagaaacaugcagcagggucagacucccugcagagaggcuccaaggaggucaccagagacccaacgccuaggcuguggugauggagagucugaguuucugaaaaaaucucuaggcaccaaggguggcugaaacugucagggcagaguguggggcugcccaagccaguggagcccagauguugccaucacagguccuguggacuagaaguggaguuacaaaauuugauguaugcauuucuggauuucagucuugcuuaguccaaccucucccugauucucuuguguuccauucuguaggaauguuaaucugugccacuauauacugaaaguaugauuuuuuuuucuuuuuagacagggcucacagauaagacugucuugaucuaaguaaagaccuuggauauugaguuucugaacacucagcacuguuuacacaauggaggcuuuugcaguaguaggacugacuggacuuuacaauguguaaaagacacauuguacuacacuacacauuguaguacuguggcacuaguacucuuguugccuauuacaccuugugauccagcuuugccccuucccuccccucuccuuuccuccucuuuucuaaugaaaugaauauguuugaucagguugucauaacaaauucuguagacugaguagcuuaaacauaauaauuuuuuaacagguuuggaagacaagagacuaaaaucaagguaccagcauaguauccgaagguugucuaguugggcugaauauggucaccuucuugcuuuggaccaaagcauaagaauucuguagauuggagacacaauucacucagcaggagaauuuaauuauucaaaaucgucuuaacagcugugauggcaaaacucccaaauuuauauuuuucaaguuuaucuugguuguuuuuagccuuucuucccccacacagaauuccuccugcaaauuuaccaugauauagaaauccucuaguguuuuuacugucauggcugugaauacgugugcaugcaacucugucugcuugugccugcauuguugugugauagaauuugugugccugcauuguugugugacagucuugaaacaagacauaccucagcuccuccaugccguaagcuauuuuuauggccacauauagcaaagaguccuucaacuaagugcucaagauugucaguuuguguguaugugaguuaaauggaagaggaagccaucaggcuguguccgccaugcggaccauggaacuggcacuuugccucacccuccuuggcaaugggccuuagcaguaaucuguuuuacuugccucuucccuguaugaccaagcaaaauucagaaauacauccuggguuuugagguggacgaaauuauuuucaaaguaaauaguauguaaggacuguuguacagcaggcagugcuuuuccugagccugugaaaauguuucucauuuucccuucaccacagaggaagcagguuuagaaugaagguguugacucccucaaggccauagcacuggaaagucacuggagugauuucugcuugaugugggugcuguguucuguugaccaaguuacuucuuuucugagagacaguuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguucuauaagaaagcaggcugagcaagccaggagaagcaagucaguaaagaacaucccuccauggccucugcaucagcuccugcuuccugaccugcuugaguuccaguccugacuuccuuggugaugaacagcaguauggaaguguaagccgaauaaacccuuuccuccccaacuugcuucuuggucaugauguuugugcaggaauagaaacccugacuaagacaaauugguaccagcagagugggguauuccugugacaaccugaccauguuuuggggaggacuguggaaggacuuuggaacuuugggcuugaagauccauccauuguuaagagcucuaucagauguuguguaggagcuuggaagauaauguugagaacacugcagaagauggaggucugguuugugaaauuucagagggaaaauuaaagacucuuuucagggccauugcuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuaguggugauuaagaagagaccagcaucauugaggugacaucuucugggaaguguuuucugaaagcacaaagaggcuguguuccagagaugccaagguuguacuccugcugcagcaggacuugguaauauguaagggucacccaggugguacugguuuugaaggcaugaaggggucacgcaaagcagcugaggcucggcacugugagaggccauggaaggccauuggugaaggugcagccucaguugcaauugaaggcccaggacugaaggggucaugcaguguuuuggagaugccaguaccaugagaugaccaccaagagcagcagcagcaguggaguacaggcaucuggagccuagaggacggcgugugugcuacaaagggccuggcuggagaagugacccaagcccuuggaggagcccagaagaucgugaguuggaucccagacauuggacgguuggagauugacuuuugcuuuugcuugugacugugcccugauauuuucccucuugaaggaagaaacuguuuuaguggagcccacaguuaagggacuuuuaauuguaaaaagacuuugaauuuuaaaagagauggauauuuuaaagagauugaaauuuuaagaauauguaaagacugugggacuuuuaaaguuauuuagaucuuggggaugaauaagauuguaaggguugaggcuuacuagugauguuuuugugugucaaguugacaaggggucaauuguacuggcuaguuuugugucaacuuaacacagcuggaguuaucacagagaaaggagcuucaguugaggaaaugcuuccaugagauccagcuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuuccugaccugcuugaguuccaguccugacuuccuuggugaugaacagcaguauggaaguguaagccgaauaaacccuuuccuccccaacuugcuucuuggucaugauguuugugcaggaauagaaacccugacuaagacaacagugaucagauacaagugaggcaagaacacugcuuucaggcugcugcuauaguguauuguuuucccagugaagcauagacucauccuccugagucugccuccuccucagugaggaucucaguacaugcuugagggaggccacuuacagggagccugccaggauuagcucagaacugcaguuaguugcaggaggaagcaccagcacuggcuaggcaguucugcugucuuaguuccuuaggcaucuguguuaagggauuaaauaucagcauaagaacacaggagugccuuucaugagaaaagucccuguccucaaacucaucucucacccugauguguuuauucuuuuggcugaugcugauuucuaauuuucagcauguuugaaggugaaaucuaagacuuucucuuaauaauuugugauacgaaucuucauugcaaaaggaaaucacuuaucaguagacuuggugauauuuuuaaaaaaggaacaguuggaauaaagacuuugcuacagcucaugaauaacuuuuagaguuuucuaucauuguaaagggaugggcaacuuauauaaagacaucaaacuaugccgacuaggccgguguaagggauuugcacaguaauuguuacguguggucuguucucagaugagaggacucaucucuugugucuuagcaggaguugcauuuuaggaguuauuuugaaggcagagucauuuaauccuguggaauaaagauuucuucaugggaaaucucacagacucaugggagucucauccauaagagguagaguuuacuuuuaugugauguuguuaacugcuuuuuuugaguuuucccuuuuuacuuuuauuuuuaaaaaggcagauaguuucucacugagacccugaucauaaucaggguuaauaugugauguagcaagcuaaagaguaaaugagucaccaguaacaccucauuagcacuguaaagauaacuggggaguggggagacuacugcgggaaaaauaggcgguguaaacagcuugaacucugcaguuggaaaaacaucauuuucuauucugcauaucagaauuaccagguuuauaaccauuuguuggaucuagacaggauguucuuuguguccuugccacaaaaaacuggcuuccucugcugcagcucucugccuuucaaauauuaucaauacacagaggguuuuguauuguccauuauauagcuguggucuaggcugaggcuacuucucuaaccugccuuuuacaggccugagaggaguccacugaaggacgaggaagaaggggucaggcucuagggaaagguucgccaauuggaggccaggcccaguuuaccucucugagccuuauucaguuaagaguacuccucuggggugaaagaugccauggagcccaggcuucauugucaccuucauuuuccugcaucucugcacuccacucauggcuagccauaucuguucucagcgucacaguuguguucaugguuccagaggcuaucugugcgaugacucccacuccgcugggacucugggacucuagagcaguagcagugugaacagcugguucuuuuggccuuccauccccuuggguacguacuugccagucuugccauguuuuguaaagagagugcuugagccaacaaaagguugcugaaaguaaucaauauuauauuauugcaugcuguaguugugguaguuguuuuaguaugucuuuucaaauggugauaucuacuguauugagugggcaauccaccaauguaucaacaccuauaauuuaaaaauagcagucuuaagugacguuaauguguauuauuaacucuggcuguaaggucuaguagaguuucagucucuuagaaaacgagcaauuuucagaaucccgcauuguuacauaguaucuuauuuucauuuuguuuaaauuggacuuauaauuaguauucaguagguaagucuccugaagaaucacugaaguaguuuucaucauauuguauauugcauaaaauaauggauuucauugugacauuuucauauguaugugacauacuuuaaucauauuacccccucuuucccaguugauccucauugucacagauggacugagaacaacacuuuuucucuuggacaucuagauuucaaggcacuguaugaaccagguuauuguuccuccaauaaagucuuuucagucuaggggcaaaccagagaaggaugcaaaugguucuuaaaaugucuugaagauauuuguugaacuccuuucaguaguguggagacuuuccguguccuguucuguuucggacacuagggcauuuuggaggcucccuugcaggggacucauuugcaaggcuugugaagaagggacuggcuucuucucuguaggcagaacucccugcucuucagccacgagagaaacugggcaucuuugcucuucaucagucugguauuauagaugcuuuguuaauuuucucaguugcucacaauaccuuaugcuccuauuuguucugaauuaauucccugcuuaacugaucugcuucuccguguauuuaaggacauugcguuucccacuuaucaccugcugcuaaucuucagcaguaaaauuaaauugacauuuauuaaaggauguuuugaucuaucuuugaaaaggguaguaaagaguaauuagucagaguaauuacuuuuuuucauuuuaugugcaaauuuagguugguugcugaaaccgauucuaauuuuauaaugguggcagagaauuucagcuuugcuuucauaguuuguuuaagugguuaaaaucugauggcuccuuggagcaucugugaauucagcagcuuuauaaagcccaccugcuuugcuugggaaauaugaagcuggcaccagcacugguccuaccaagcaucuuuuuguuucauuuuggucagaaguuagccccuguucagucaguuggaaguauagacacuuuuucaaaacauggaguuacauggcuccagcuuauguagcagagaauggcuuagucaguuaucaaugggaggagagucccuugguucugugaagguuccaugacaguauagggcauagaauggcagggccaggaggugagacuggguggguuggugagcauggggaggaguaaggagaugggggguuuuuggaggggaaaccaggaaaggggauggcguuugggauguaaauaaagaaaauaucuaauaaaaaaaaucucuuaaagguagaaaaaccaaccaaccaaccaaccaaccaaacaaacaaacaaaaaaccccacagggcagaagucucuuuucagaggaagggguuuuguuuuguuuuuuaaaauuuggauguuuuguuuauugacauuucaauguuguuuguccccuuuccugguuacccuucagaagcccccuaucccaucgucccucucccugauucuaugagggugcuccccccccccuccacuccugccuuucaucucuggcauucccuuacacuggggcaucaagcauagagccuucucaggaccaagggccucucuucuccuauugaugacagacuaggccauccucugcaacaugugcagcuggagccaugggucacuccauguguacucuuugguuggugguuuagucccugggaacucugggaacaggggauggggggggguccuggcugguuuauauuguuguuguuucuaugggcuugcaaacuccuucagcuccuucaguccuuucucuaacucuuccacuggggaccccgugcucaaauaaaagaaaaugaagcuguaaauauaucaguuauugaaauacaaaacaugaaagcugacugaauugugaaacauucuugaagggauugcaaccugaauaaaagaauuuugaauaaaaaaaaaacccaugaaguuaacaaauugacaguguagacuuucuaggauucugaguugaacauuacuauaccuugguaacuagaaguugacauaaagguuaggcagaaggggauguggguggaaaggaggugucagaccaaaccaaaacuaaaauacaugcacuucaugugcuggcuguaauucauuauuccaggucagggacccugcucuccaacucuauggucuuaaaaucucaccaaaccaggugaagugggcugcagaauaaucccagcaucugagaggugaagcaggaggauuucaagguuucuggaacacaguacuaggcuagccugcacaacuauggcaagacccugucaaaccauccaccaauuaaugaaugaguaaauaaguuuuuauauguggaaaauaauggauauaacuauauugguacuuuuaaaagcauuuuuauaucauguuagauuuauuuuauuuuauguauuuaauuuuuuacauguauguuugugcaucaugugcaugccuuaagcucaugaagauuagauggugucguaggauccccugaaaguagaguuaugaacgauugugagccaucaaguggguguugggaaugaaagcuggguccuuuggaaaagcagcuagugguuuuagguaaugagcuaucuccagcccagucuuuggguuucuugaggucauuauuaucugccuggcugaagauucuuuguucuagacugugaacucuuaagagguauuccagcucuacugcuuccuaacaccagacaggcauggagauggagaaguagcugagagcuuacauccugaucuguaggccaagagagaagagaggacaagaggagagagagaggaagacaaggaggcaaggggagggagggagcgagggagagacugggacagggucauagacacagacacagaguguguguuugggcuuuugaaccgcaaugcccacaucuucuucaagagggccacaccuccuaauccuucccacacaguugcauuauguggucacuaagcauucaaauauaugagccuuuggggaccauucuccauugauuauuuugucuaucccagucuauagauagguaauuuugaaggccuggcuagaucuauuuuaggcuuagaacuacuacuguccugcaggaaccucuacaggacaguuucucuuuguugguucucauguaguugcucugugaaggacaaucaagcuccuuguguguuacuugcagaguucacacagcagugaagucagguggcuuacacuucauucugucuguugauggacggaguccugcuuucuucuuucuucuuuguuaaccuagugcuuggggagcacugucucuauguagaguuccccaucauuagcauuagccccuccuaaucucugauuaaccccaagaguucuaccugcaucaucuccauaguugugcuggggccaccuucucuguuggugccacagcccugccugccuuggauuaaucuccagcuuucacuuuacuggcccugcuuucuguugucaucuuuaagaacaccuuucacuucuuucacagucugagcucuggauuucagagcuacgauguuuucuuguucagaaacaguauuugaauugacagaauuaccaauuuguccaugccuuugguguaguggcuuauuuagaacuuuauguacuauuuuuaguaguacugcuuucuuucuucuuuuuuaauacuuuuuaaauuauuuuauuaaacuaauaaaauuuauuuuaaaauauauaacuuguaguacugcuuucuuaaagagaaacuuccaguucagcaaagcagagaagagacuaaauugaugauagggggaguuuguauggguuaguuucugccuuuauucuuuucuacuaucaucacugggcaugguuggauaugcagucaucuaucugcacggugccuuuguguucuuaggcacagggggagugggcauacuccuggaagccauuccuaucccaugaugccuggcucuguagaaggaagccacauaugucuccaacaaaacucuccuaaucuagaucagcacuucucaaccuguggguccugaccucuuuaggggucacauaucguagauccugcauaucagauauuuacauuaugauucauuuuuuauuagauauuuucuuuaucuacauuucagauguuauaaaccccucuccccuccaaaaacccccauccccucccccuucucccugcucaccaacccacccacuccugcuuccuggccuuggcauuccccuacacuggggcauagagccuucacaggaccaagggccccuccaccauucucugcuacauaugcagcuguagccaugagccccaccauguguacucugguuagugcuuuagucccugggagcuuuggagguacugguuaguucauauuguuguuccuccuauggggcugcaaaccccuucagcuccuuggguccuucauuggggacccugugcucaguccaaugguaggcugugagcauccaccucuguauuagucaggcacugguggagccucucaggaggcagcuauaacagacuucugucagcaagaacuuguugguguccacaaaagugucuggguuuggugauuguauaugggauggauccccaguggggcagucucuggauggucauuccuucagucucugcuccacauuuugccuccauggguguuuuguacucccuucuaagaaggaucaaacuauccacacuuuggucuuccuucuucuugaguuucauguggcuugugaauuguaucuuggguauuccaaacuuuugggcuaauauccacuuacuagugaguucauaucauguguguucuuuugugauuggguuaccucacucaggaugauauuuucuaguuccauccauuugccuaagaauuuuauaaauucauuguuuuuaauagcugaguacuacuccauuguguaaauguaucacauuuucuguauccauuccuauguugaggggcaucugaguucuuuccagcuucuggcucuuauaaauaagacugcuacgaacauaguggagaauguguccuuauuacauguuggagugucuucuggguauaugcccaagagugguauagcuggguccucagguaguaaguacuuuguccaauuuuuugaguaaccaccaaacugauuuccagagugauuguaccagcuugcaaucccaccaacaauggaggaguguuccucuuucuccacauccucgccagcaucugcuaucacuugaguuuuugaucuuagccauucugaauggugugagguggaaucucaggauuguuuugauuuguauuucccugaugacuaaggauguugaacauuucuuuaggugcuucucagccauucgguauuccucaguugagaauucuuuguuuaguucuguacuccauuuuuaaauaggauuauuuuguuuucuggagucuaacuucuugagcucuuuguauauauuggauguuagcccucuaagggauguaggauugguaaagauccuuucccaauguggugguugacauuuuguccuauugaaaguguccuuugccuuacagaagcuuugcaauuuuaugaggucccauuugucaauucuugaucuuagagcauaagccaucuuuuuuguuauuguuguuuuccucgagauaggguuucucuguauagcccuggcuauccuggaacucacucuguagaucaggcuggccucuuucuucucuauuaguuucaguguaucugaaagaucuaucugggcuugagcuuuguaacaaggagauaagaauguaucgauuugcauucuucuacaugcuaaccgccuauugaaccagcaccauuugucuuuuuuccacuggaugguuuuagccccuuugucaaacauuaagugaucauagguguguggguucauuuucaggucuucaauugaucuacuugccuaucacuguaccaauaccaugcaguuuuuuaucacaauugcucuguaguaugguucacuauucuagguuuuuuguuauucaaaaugaauuugcaaauugcucuuucuaacucuaugaagaauugacuuggaauuuugaagggaauugcauugaaucuguagauugcuuucggcaagauggccauuuuuacuauauuaauccugccaauccaugagcaugggauaucuuuccaucuucugaggccuucuuugauuucuuucuucagagacuugaacuucuugucauacagaucuuuuacuugcuugguuagagucacaccaagguauguaauauuauuugugauuauugugaaggguguuguuucccuaauuucuuucuaagccuguuuauccuuugaguauaggaaggccauugauuuguuugaguuaauuuuauguccagccacuuuggugaaguuguuuaucagguuuaggaguuaucugguggaauuuuuggggucacuuaaguauacuaucauaucaucugcaaauagugauauuuugacuucuuccuuucccauuuguaucccuuugaccuccuuuuguugucuaauugcucuggcuaggacuucgaguacuacauugaauaggcagggagagaauaagcagccucuucuagucccugauuuuagugggauugcuucaaauuucucucuguuuaguuugauguuggcuauugguuugguguguauugcuuuuacuauguuuagguauggacuuugaauuccugaucuuucuaagacuuuuaucaugaacacguguuggauuuugucaaaagauuucccagcaucuaaugaaaugaucauuuguuuuuuuucuuucaguuuguuuauauaguggauuaugucgaugauuuccguauauugaaccaucccugcaccccuggaaugaagccuacuugaucaugauggaugaucauuuugauguguucuuggauugaguuugggagaauuuuauugaguauuuuugcauugauauucauaagggaaauugcucugaaguucucuuucuuuguugggucuuugugugguuuagguaucagaguaauuguggcuucauaaaaugaguugguuaggguaccuucuguuucuauuuuguggaauaguuugaggaauauugguguacuagcuggcuuugugucaacuugacacaagcuggaguuaucauaaaggagcuucaguugaggaaaugccuccaugagauccaccuguaaggcauuuucucaauuagugauggggugggggugggggaggggcgggcuuguagguaguaccaucucugggcugguagucuuggguucuauaagaaagcaagccaguaaguaacaucccuccuuggccucugcaucaguuccugcuuccugaccuguuugaguuccacuacugacuucuucuggugaugaacagcaauuuggaaaugugagcugaauaaacccuuuccuccccuacuugcuucuugguuaugauguuuuugcaggaauagaaacccugacuaagacaauugguauuaggucuuuuuugaauguuugauagaacucugcauuaaacccaucugguccuguguucuuuuuugguugagagacuauuaaugacuguuucuauuucuuuaggggauaugggacuguuuagaucguuaaucugauccugauuuaacuuugguauuugguaucugucuagaaaauugucuauuucauugagauuuccaguuuuguugaguauaggcuuuuguaguaggaucugaugauguuuuggauuuccucgauuucuguuguugaugucucccuuuucauuucugauuuuguuaauuuggguacuguuucugugcccucuaguuagucuggcuaaggguuuauuuauuuuguugauuuucucaaagaaccagcuccugguuuuguugauucuuuguauaguuguuuucguuucuacuugguugauuucagcccugaguuugauuauuuccugcugucuacugcucuugggugcaguugcuucuuuucguucuagagcuuucaggugagcuguuaaacugcuaguguaugcucucuccaguuucuuuuuggaggcucuuagagcuaugaguuuuccuuuuagcgcugcuuucauugugucccauaaguuugggucuguuguaucuucauuuucauuaaauucuaaaaaguuuuuaauuucuuuauuucuuccuugaccaaguuaucauuuauuagaguguuguucagcuuccauguguaugugggcuuucuguuguuuuucuugcuguugaagaccaaccuuaaucuauagugaucugauagaagauaugggauuauuuuagucuucucauauuuguugucuguuuuuugaccaauuauauggucaauuuuggagaaggcaccacgcugagaagaagguauauccuuuugauuuaggauuaaauguucuauagauaccuauuaaauccauuugguccauaucuucugugaguuuaacuggaucucuguuuaguuuguuucccugaucuguccauugaugagagugggguguugaagucccccacaauuauugugugaggugcaaugugugcuuuuagcuuuaguaaaguuucucuuaugaauguggguacccuuguauuuggagcauacauguucagaauugagaguucuucuugguagauuuuuccuuugaugaguguguaguguuguuccuugucuuuuuuugaugacuuuugguugaaugucaauuuuauucaauauuagaauggcuacucccacuuguuucuugggaccauuugcuuagaaaauuguuuucuagcccuuuacucugagguaguguuaauuuugacacugaggugcauuuccuguaugcagcaaaauguuggguccuguuuacauauccagucuguuaguccaugucuuuuuuuaagauuuauuuauuguuauauguaaguacacuguagcugucuucagacguaccagaagagggcaucagaucuuauuacagaugguugugagccaccaugugguugcugggauuugaacucaggaccuucggaagagcaggcagugaucuuaaucgcuaagccaucucuacagccccaggccauguccuuuuauuggguaauugaguccauugauguuaagagauauuaaggaauagugauugcugcucccugucauuuuuuauguuauuuuuauguuuguuauuuuuaugugguuaucuucuuuuggguuuguugaaagauuacuuucuugcuuuuucuaggauguaauuucccuccuuguguuggcauuuuccaucuauuauccuuuguagggcuggauuuguguaaagcuauuguguaaauuugguuuugucaucuugguuucuccaucuaugguaauugagaguuuugcuggauguaguagucuggguuggcauuuggguuuucuuuagucuguaugagaucugcccaagaucuucuagcuuucauaaucucuggggagaagucugguguaauucugauaggucugccuuuauauguuacuugaccuuuuucccuuacugcuuuuaauauucuuucuuuguuuagugcguuugcuguuuugauuauuauaugaugggaggaauuuuuuucugguccaaucuauuuggaauucuguagguuccuuauauguucauggcaucucuuucuuuaggucagugaaguuuucuucuacaauuuuguugaagauauuuauuggcccuuuaaguugggaaucuucauucucuucuauaccuauuauccuuagguuuggucuucucauuguguccuggauuuccuggauguuuuggguuaggagcuuuuugcauuuuguauuuucuuugacuguuguguaaguguuuuguaugguaucugcuguaccucagauucucucuucuaucucuuguauucuguugguaaugcuugcaucuaugacuccuggucccuuuccuagguuuucuaucuccauuguugucucccuuugugauuucuuuauuguuuuuauuuccauuuuuagaucuuggaugguuuuguucaguuccuucaccaguuugguuguguuuuccuguaguucuuuacgggauuuuuguuuuuccucuuuaaggucuucuaccuguuaccuguguucucuuuuauuucuuuaagggaguuauuuauguccuuaaauuccucuaucaucaucauaagaugugauuuuaagucagaguuuugcuuuucugguguuuugggguagccaggguucgcuguaaugagagaacuaacugaguucugaugaugccaaguagucuugguuucuguugcuuauguuuuugugcuugcuuuucacugguuaucucugauguuagcuggucuugcugccucugacuugggcuuguuccuccugcaagccuguguuuuaguacuccugggagaccaauucucucccggaggaauuugccuauggagagcuaugguacagggucaccucuggggugcagacagacaccagaaguauucuguccccagcugauccuugguuccuguguccuaauggcucugugagggucccccuugggacaggaauuugaagagaaguaauggucuuaccugugcucauagguguguaugcacuccuuuggaggucagcucuuuccuggugguauuuguguguguagcucugugguccaggaucagcucugggugcagacagagacgacuccugucccaggcagccccuugguuccuguguccugaggguucuggcuggguuccucugagcagcagugaugguccuaccugcagucacaggucugucugcacuccugggaggcucucucccuucuggugcuauuugggaauggagcccuguggcauuggaucugcuacagguggagacagaaaccgacuacauuaugauucauaacaguggcaaaauugcaguuaugaaguaacaaucaaauaauuuuaugguguguguuugcauuuugccuugcagcuggggugugugaacacugcuuggggagacaaaacacagggguucuaggcuacuuuccuucuuguugccauaggggucccaugcucuagggauguggacaccuacucaaauaggugucuaagcccguguuucuccgcgugagaaaaggugugggcugggacccaggcugugguucucauguucccaggcacucagacacugcuggaaagcucgaggguucgagaacaaggugagugucaggaguagagaggccuuuuguggacccuugcccccugugguccgugaagaaggagacaguccuuguuuguccagacuguuuaaucaugaugaaaauugcaugcauaugacuuacucagggugaaccagagaauaaaugucuuuuagaggaaggaguguccaggaagggaagcuuauuggcuaaacccucuagauuggcagccuaucuagauaucuuauuagcauagagaacucugggcaauaugcuaugugaccaguugucauuguccucuuaguggggugguaugcuccaggacugggaccugguugggagcagauucaaaugcccaccauucucaauuuugagaauugccaggguuccuuaaucugcucaacuuuaccguuuuuccgucuggugacacccuaucucuugccccauaguaaggggucacaacaacaugaggaacuguacuaaaggguuauuaggaacguuaagaaccacugagcuagauccuccaaagguccagagcaacaucuugaggacucgaaggucugugugaauggaguuguacgagaaaaaaaugcuuugaauagauuauaaucaaaacauuauauuuacaaacucuauaaaaacauaugagcacuugaacauauuauuagaaucuucaggcggccuucaaagagccugugaaagugagugucccugaaacuuguuucacuggcuuuauguaaaccaauuccgcucaggccuugucucuacggugaaagcaauuccaagugccauauugaaauauggcucagagcaaugcuuuuacguuucuuaugcauguaguugacauuggagaauuuguugaaguaaauaacuuguuauugauaauaguggcagacauuuaacaauuucuacaugccagccucuguuuggaacacuuauuauaacaugcuauuuuguuuaaucuuuaggacaaugccagguaucagauuucuuuucuuuccuuuuccuuuuccuuuuccuuuuccuuuuccuuuuccuuuuccuuuuccuuuuccuuuuccuuuuccuuuuccuuuuccuuuuccuuuuccuuccuuccuuccuuccuuccuuccuuccuuccuuccuucuuuccuucuuucuuucccuuauuuuauagaaucaaaauccauggcacagagaacuaggauggucuauuuugaccauuaaacaguugagcuggggcuaagucuucaucccauagcccacucuucugcccucuucuccugaagccaccagucuuaaauucaugcaagagauuaaagagugaccuuaugggauaguuuugugugaaugucuuuugcucuccuaucuuaggaaagcugugaaaauuggggggaagggaaagcucaagaaaagaagcuaaacugaaagaagugcuaauuaggauuccugagaacacacaagcaaaggcugguuaaacaacaaggacaaauacgcacuuaauuguacugugucuucuacguuccgagagacacccccucuuccauuguuaauacuguagucagagugauuuccugguacauacagaugaugcaggagugucccuuccccauaucacacuuaaacuguuaacacagaugaaaauaucuuggaagaacauggauagguuugcuaaaagaauauuaucuaguguuugcauuuacugaauaagaaugaugaagagaaaguaauacagagaugguuugagaaagcacaaacaaugauuucugaauaauuuuagaacagacucuaaaauagggauaugggauuuuguuuuuaagguauauaaaauauaauuaaagcuuugugucuccaauaaauuuaggauugacuucuagccaugauaugaaauucuucucacuauaaaaagagaguuagcauguaauuaaccuuacuguugcauuuuggcggauaaauaagucucuuaaauuuucacuucauuugcccuaguuuuagccucuaauauuaucuauccuagcccaugcauauaugcagggauuaucuuuacauaucuugcacaguuaacagccauuagcccagagcccauggugaaagaaauacaggcuuugacuccucagagccugcauuucuacagugcuuccuccauacaguugcagaauaggaggaugccccgggagugagccagcccaauaggaggacaccccgaaagugagcaagccuaacaggaggaugccccagaagugagcaagcccacuuuccccuuuucuucuuuuacugaaguguccucacuaagucuucaaccagaaaguuucuuucuugauugcccauuuuaccucacuccuguugaacugagauaagcuguccuaguuuucacuuggugaagaggaguuuaauggagaaaucugagguggcuuucucuccaucuacugguaggugcauuccuaggauuuucuugaaaaucauguuaacuuuagauacagugggacuuuuucugugauaauugucuuggcauaccacugcggaacacacaggacaagagggcggugcacugaguuuagugaggaccgaguuucuauccuaauuuugauauaaaugauuaccuuuaaagcaaauuuucacaauguuaggguauuugcaaauaaggcaaaaugaaucuagaauaucuuucuacaguuauaauuuauguugcaaauauuauaaucuaaaaacacaaguuacauauuugucuuauuuaauucauaacaggaacuacauuuucuuaauuauauauucucuaauccauuuaaauaaugcuaauaauuaugggucuauaacaacaugaaauauucuggaagaaagagaguaauguguucugaaugcuuagaccugaaaaauuucaauacuucaaauuauauugaaaaaaaauuuaugaagauacuuaauaaaaaagaacaagagaaaucauaguggaacauuuaaagcuaauuuaguuugagauaugguuuaauauaugugggcauguauuaggauauugagagauuuucaagauagccaccaaacugcuggcugggucccgguggacuccugacucugggguuggguacuuggcuucucucgcuugcaagcacugaccccucuuccccuuuccacuuguuuuuuuuccugacauuugcacuuguugaugcuuaccauguaaugcaguuguauaauguccaucauuguagggaugucuucuggucagugccaugguagacacuuguauuaaaucucauagcuucucugcaaagcuugggaucauguacagguguccaaguccugacagugaccuugcacucuaacuacauuuccucccccaccuucaguuccuuuuacaccucuuggcagacuagaaugccaacuuuaagauuuaucuggaucuuuacuguucauucucccucuucccucuguuuuuacauuccugucucacagcugcagucucacagcugcaugcagucucacagcugcaugcagucucacagcugcaugcagucucacagcugcaugcagucucacagcugcaugcagucucacagcugcaugcagucucacagcugcaugcagucucacagcugcaugcagucucacagcugcaugcagucucacagcugcaugcagucucacagcugcagucucacagcugcaugcagucucacagcugcaugcagucucacagcugcaugcagucucacagcugcaugcagucucacagcugcaugcagucucacagcugcaugcagucucacagcugcaugcagucucacagcugcaugcagucucacagcugcagucucacagcugcaugcagucucacagcugcagucucacagcugcaugcagucucacagcugcaugcagucucacagcugcagucucacagcugcagucucacaccuauagucucacaccuauagucucauaccuguagucucauaccuguagucucauaccuguagucucaggcuguuacucuguccucugucuacacagucuagcuugaucugcgaucguuuauuuaguacuacuguguuaacuguaugacuaugugugugguuucugccuuacugaacucaaccugauguacaugcauacuugcaaaauguccaaauacauugucuucuacauucacuaagaauggucuaaaggaucuaggagacguagauccgcuuaaaugucguuagcguaaaacuuguucccugaguucgauucugacagcacagcaagcagacuccugccucuaguguugggcacuuggcuucucuaacuuugaagggcuuucugccucccccuuuccacuuguuucuaucugaccuuuauuugcauucuuuaauguucuccagaugucauauaccacgguacaccuuuuuauuuauuucaggauggccagguuuuacccauuucuugagggccacauaugcuuuagggauucaauaaacaguagauagaaaaggggguucccuacaacaugguggacaagcuauguugcgggggccaaaccaggcuugaauccagccuuuguaaauaguuuuauuagaauacuacucacacucuuugauuuacuuaucaacacucuuugaagaauucuagccagguguugguggugcacaccuuuagucccagcacucaggaggcagaggcagguggcucucugaguuugaggucagccugguguacagagcaaguuccaguacagcugggacuacacagagaaacccugucaggaccccuccaaucccccaaaagaaauagaaagaaaaagaaaaacucuaguuguagaaaaagugagcaauaaaggaggggugcuauuuuuaguuaaugcaauuagaguuuucugauuguucucuucagagccagauuuaacauagagauggcuucuuagcuacuaagagugaauuugcauagacuugucaaaguaguuauagguaaaauaucaucucccaucaaaucaacaaauacaagugagaagauaguuuaguacugaugugcaugguguaagauguuguucucaucaugcgguuaguggcaguaugaguugauaaagccuuuaagggggauaauuuuaauaauauauuucuagauuaaacuuucuguaaaaauauuauuaacuuuuuccaacagugucucuuagcuuguguuaaccucaaacgcucucacuguaaccuugaacucuugacccuccucucuccaccucucaaguguugagguugagguugcaagaaugugucgcuauaucuggcuuagacuuucuguauucauuuguguguguguguguauuaguaugugcgucccacaugugugcacguggagauggcagguaaagauuggguguuaaagaaucccauugcucuccaucuuauuuauuuaacuucuuaguuuacuuugugacagucugcuuuuguguauguucaugugcaugcagauguaccugaacaggugugcauuguauguagaggccagaggucaaugucaggguauuucuuaguuacuuuguugcucuugugauaauguaccaugacagaacaguuuaaggaagcuggggcuuguuuuggcuuauaguuccaaagagauuaauuccuucaagguggggaaggcauaguagcagacagagaaggcauggagguuggaucaggauccaggaacuauguaccuucuuuuuagaucugcucuuugcacccauuuuuaugguucucuguauuggcuguauguucaucacuuggaugaaucugacucauaccuaaguugcauggguacuauuugaagggcaucagauuuguccaguuagaaucaccuuauuuguagacaauauuuaaguuuagagcauaguguaggauuuauuauguaaacaagauacuaacaagaaucuccuuacaagcauaaaacaaugggcaagggguacuucacauguuggaggagaggaagucaacggcauuagccuccauuuaaaaauguagauuagcuuuggccacauuaaggaauuccuuuuuagucaaaagcacauaauuuagaagaaaacaucuucuugcaaaaugguacuauaacuuaagucuuggaagguguaacauccuucauuaacuuucacaacauugucuuuuacuuugacaaauuauagcacuguucagcuuauauugucugacuuauuuaauagacaagauuuagaaaagguuuugcuagguuuguauuagcaguuugaauuuauaaguaggaguaaauggacuuacauuuuuacuuuuuaaaauucuuuuuuguuuuuuaaagauuuauuuauuuauuuuauguaugugaguacacuguagcuauacagauaguugugagccuucacgugguuguugggaauugaauuuuuuaggaccucugcuggcucuggucaacucagcuugcucagucccugcuugcucuggcccaaagauuuauuuauuauuaaacauaaguacacuguagcugacuucagauacaccagaagagggcgucagaucucauuacgggugguuguuagcuaccauguaguugcuaggauuugaacucuggaccuucagaagagcagacagugcucuuacccacugagcaaccucaccagcccagccuuauauuuuuaaauguuagucuguguguguguuugugcacaagagcacaugaggguacauauaugugugcacaucaugcaugugaauaaaggaggcuagaggaagaucuuggaugucaauuccucaggucuguccaccuuucucacuuugaugacagggucucucacuagccuggagccacacuaaguaggcucggcuggcugaccaccaaguuccaggcauccaccuaucucugccuccccaguacagggauuacaagugugcacuacuaugcccagcuucauuauauaggugcuggggaucaaauucauuacuucauguuugcaaguacuuuaauaacugcacuauuucuuaagcccugguauuuaccaacuuuaggcauuuucuucucaaugcauccuugcugguuuaauaauguguauuaaaacuaacauguuuucaaaagucaaacuauauaggacaugcccacaaaauagcugccccaucuuggucuacccuccuuuccuucaguucuuaggaaccugcucucuggcuucuuagccuuuaacauuucuuaaagagguuuaauucauuuuauuuuauguguaugcccaugaaucauguguauguggucuccauugaagccagaagaaggcgucaaaucccuggaauugaaguuucaggugguugugaaccaccaugaagguuugguucauaaagauucacgcgcaugcgcuucugcuuucucaugaccuauugaaaugucugugauagguaaacaucagaauggugggaaauauauucaugguugccagggucuagggagauuggauacaguugaagaguggcuugaacuggguacugguuuuuuuguuuuguuuuguuuuguuuuuucuggaaugaugaaauguucuauaaccuuaaggaugauuucacagcuuuaaagaucccaagaaaauuuuaguugggagcuuaauuguguauccuauguguugucucaauaaaacuuuaauuuucuugugugugugugugugugugugugugugugugugcgugugugugugugugcuggaguuagagguuauugugagcugucuaauguggggacuaggaacugaacuugggucuucagaaagagcaucaggugcuuugaaccacggagccaccucuccagccuucacuugcauuuuauacaugcagcugcacuuugcaggaaggagcuguugcagaauuauuuccgaggaucuuugcucuuuacuguggugacaagugcugugcuguguaugugcauaccgggaguucacucagguuaucuucuguucacauacguguuggccauucuugaacguggugauucuaagugaaugaguaaggaugugcacauggcuuuucacgggugaggaguuucuccaugaaauauuccguuuccuuagaucuugucaguuuuccuucccagucuuggccuguuccaaauuucuaacagagugagugagagcgccugcuuuuucauuaccuugccaacaaggcuguugccaguuccuaucaagauugccagacagugcuaucucauuacagaucagauuuucauuucugagauuguuaaccaauuuucaaauuuuugaggccaucuuaagauuuugggaauuuucuuuuuauauuuguuugcucguuuuucuuucugcacuagaaccacuaguaaacaaacaagggcucugcgccagcuucugcucacagcacugacuccucuucacucgggaaacaaaagggaaagcucggcauccguccacaucucggggagggcugcugcuuguguucuaagucauucucugcugcuuagauuccagaaacaaagggucugauggauaaaugccuucugacagagugcaaacuaugccccacugucacccagaugacagugugaccaagaaugcugaauuaugaaugcuuccuucuggacagaccucugccuuuguugcuuccucuccuugacccugaagcucaugucaguacuccggaugagagggcugaggacacaggugcacccuuaugucccuguacagccaggcugacuaaaguuccucccuucauucaccaguacuuuuccaugugguuauggguuaagugacuagaccugacuugggcuuccggccuagaauucuaauacaauuuaccccuuaucucuauauauuuuagaaaucuuucuaccaguuugauuuuugacuuuguauaugcaauaauguauuucuuuuaaaacuguggccaaauauuuuuaaugucuuuaaaagcaaaagacacacaacaaaacauaggacuucauuuguguaguccaggcugucucugaauucuuacucuucuuaccuucaccacuuuaauucuggaguuacaaguguauaccacugugccuggcuuguaugucuagacuuuuucucauagcucaaaagcuuucuucaaaacucauauuaaaaggaauuuuaaaaaaucaaaacaaaauaaaaccaaugacaauauacagcauagcaacaaugaagugaacaauuaaagaaaaaaauuacuuauguuuucauguacuuguugaauuucacauuuaaauuuggauuuuaagugcauucagauuuuuucccauuuaguacauagaguggaucuaauauuuuuccuacucguuacccaguuauaacaguucuguuuauuaaaaagacugucguugccucaguaacuugcgauacagcuuuaucaucgguugcuauguaucuguuucuggauuuuuuucuuccauuggcaucacagauugugcgugugcuacacauuguuuugaucagaggcuuugauauggcuuaauguuucuuaugucuuuuccuuuugauugugucccuacccauguuuacgucugcauuugaacuuuauaaggaaccaacuguagaaugacuccuugcaguauggggaauugcuuuaaaugcaugcaucacuuuucauauauuccaucuuccccgccuuaacuauaagcacuucgcaucaguguaauuuuucuaugugccucuccccaccagcuuuuguuaacuugucccaacgagcccagcacacaaugguaugcguuuaaacgaucaguugucuuuugaggcgaugagagaagaacauucuugucucugcaccugcauagccauuucauccccugauuucuguagacccgaguuuccaugugguggucuuguccuaugacaagggaugcagauguuuucaucuguuccaggauaauaugcagaagcuggaagagaggaacuucuugccuucuuccuuccuuugggagagacauccagaaaacuaauuuuuuugaucauuuuguuaugagucagaggacugaguuuucaguuuuacaguagauguguaaaccucaaugcuuuaagauaauuugugugaagcaugcauuugcauuaggucucauccaggcaggaagggcagccacucagcgucaccuucacugugagucuaggaaguauugcaagaugauuagauaauacaaaacauaauuaggaauauaaauugguuccaaaucccuuauuuucuguaaugugcucuguaguuccaaauuagugauguuuugacugugucuguuacagucuuuauuaacacaauggcuucagucuuguuuauuggagaagugguaguauuuggaaccagcauacacuucuguucccuuuugucagcuuacaggccuuccagccuccaagcaggguguggcuacugcgucugcacuaaugauuucuguagucuccccucccccagccugaaaccagguuucuguaugcugugcuuuaguguuuucuccugucauguugaucucaugauaaucucgaaacauccagucaauaagcccuggguuaauuuuuacuaaggaacauugauaaaguucuacucagaaggagauuuuagucauuguucuaugaaaacuagguauuuuguuacacuucuccccuucuuuacugccugugcugugaauauauauguaccugaggguuauaggccaccagguuuuaaugauugauuugucccauagcagugcaagguaagcccuuuccuagaagaaaauacaccagagccaaauuaaucuaacaggcaagugcuugaaauggacagaacuuuggcgcacauaugcaugcaaaaagacccccucccccauuuuguuuuuggccuuuuccaacucauaacagagguggcugccagccacauggcugcgcuuagacaagauggccaugaaaccaugauuccaacuucuuuaucccaaagccaagauggcaaccagcuauguguuguuuauaucccagaauggaauuaugccauauggcuuaagauuaucuaagcauagauuuuuaauuaucaaccccaaguuacuaguuuuaaguuaacuuuuuguuagacauauuauagauuuuaacuguauccaauaacucauaagccaauaauaucuuuaguuuuugaacccauauuuuaaaagcaugccugggucugcaaaaggguaaaccauaacccaauuccagagccaggaauaaaguagaauagcauaagacaacuugaauauuauccauucccaaauaacauuugaaucucuauuauauuagaucuggugaccagaaagcccagagguaaauucugagcccaggcagguggaaggaaacagcauguauucacacauucaaggccaguuagaaucaaacaugcaguggcuauggacauucauacauacaaaauagacagcaaaacuuaacagacauagaaguuacagauucaucuguacauuggaauugcagcuaugccgcuaagccgucaaggcuaucacuaauucuguggcuaagcuucucugccuucuagaugcagguaggagguggggcuaggugguaccuggagaugguguguuuggcagugccuuacugcuccaagucagaacacacaaagauagaucaucagguucauaagauaagacaaaacaaggcaagacaaugacauuuaauaauuggacuucuuugcuucagaaguccauuaguucuucauguacaacccagaugcuaggaacucaucaaaggcaaggccauccugagucuucccuggguccucaaauccaugcuggacuuauccaaaaccucaguauuggcucucaaauucauggaaacccuagaugguugcuaggcuuuggauucuguagaaauaaccugugggcuucgagugccucccaaugccccagaugaaggaucuuuuagauuuguguccagcccucuucauuccagauagaguacccuauaaccagaacucagaaaccaauggaauaguagcuaaaacaaaugugugcaguucccugcgucucccccaaccccccacaaaaugugguuguucaccuuggcaguuugcuucucaaguaugcaugagugaagagugaauuugggguggagugaucuucuggggcuuccauauguuaauccugcgauucaccagaaaaaaaauuccauuauuuugggccaaauuuaaagcaauuuuuauuaacuauuaaauagugaccaagaugaacuuuggucaagaccauucccuggaauuuccugagaaaggccuugagccaccuguuucaggagcuuaugaggacaaaccuauaaaucacuauacugucccaugaggcuuuguuauuuuccaagaacuaccauucccagaauuccaggaagugaccugguuccugagcaggugaggcuuacagguuaauuuuagguauuacacauccuaauggaaagcuguacacagcaauauaauaccuuuuucuuuuuccuaaguguguccuugacauugcagauauugugaguaaccucacuuagaugcucuuaauuuuuuucuaguaauguuuuauguaauugugauuauuucaccucuuuuuauaauuugucauguuugcaaagacuuuauguacaucucguuguauuggccaccauuccugagcuaaucguccaauaguaagugauauuaccguagggaauugucuuucaugguggcccucuguccuugcagaaccuaucaggagaacuaaugcccaucaaaggacaacuggcucucugaaguuaauaauauuaaauccuaauuuucagaugggaaagagagacuaauuaacuuuacuaaggucacagaacuaauaaauuauaaaacuguacuuuaaccacguagauuauacuacuuccuucugcuuccaaagauacacagauaauuuacuuaugcagauugucaguguccuugccccaacccccaccguuuuuuaauccagacaccagaaaauucaucauuaaaauaguaacuuacauuucagcuccucuucacuguuugcccgacucuuaaagguuuuuaugcauagugacucuucucauugugucuguaauuaagacauuggaggaauaggaaagccaacaacugguugucugcuucugagaagcacaacauaugcugguuccugacugcuguucuaguccaugugcaguguguaauaaaugagauuuccauguuucuaugaugcuaauuagacagugaaaaugaugaguuuugaaaguuuuuuauagcuuuguuauuaaccauugucuagcuuguuucuaacucaaaaguuuuuuuugagaauuuucuguauucaaauuacuguauugaaauuauuuccgggccucccucuucuaccugcagcuucuauuauguucccacacuuccucuuaaagucaugacuccaucuucuucguugucaucucucucucucucucucucucucucucucucucucucucauaaucugcuuagucuuggucuuguuuguauugaggcugaccacuugauugcauaacacauuaggaggcacgucccuggagaacacugacuccaccucccccaccccacccuuaguagguauuaaaugccuggaguuuucccucuucaucuaggugugaggcccugugagauucccccaucugcauucacacgucaacugguguugucauuacgcauaccuuuuuaggugacuauauugucaagauuugauggcugcagcuucucuguuucauggcucuagcuucucugucauauauagaaacacaaucugauagcagauguucucuggugguuauaaucuuucccccucucuucugugaugucuugggccuuauguguagggguuuuaccauagauguauuaauugggguuagucaccuaccaucuuuggcagaaaagagccucucugaugaggggugaaaguugcacuucucugugaguauaagaaggaguuuucagaaugcaguuagaaacuguacugguuuaggaaaguggcaguaggagguucccuucuagggcccaugaacucaccauccaugaauaguuggcaagaccuacauacauaccaggcuugcugagcaggcuuuauuuacgucuaaguagacaguuguuggucacccucauguaaaguguaccauggucacaucacuggcagagcuuggccacagcucuugcaucauaggggagcauucuucugcccaugcuuucacaguuguauaggacuuugagaauuuuuuugaccuaggcaguuugaguaagaccuuuggguggugugaaagcuagaccucagggagggggcuccaguucaguuuuaguucaguuccuccagguccuauguccaaaaugagugaugccaucagcaguagagucuuaccuucaaguucugggagucaaggacagcagcaauacucuuuauucuuuugggagucucuuggacuccccugccaacaaccgaugggguuucucaugccugcuacugggaguuuuauuagaugguuaugccucuuguggggaacauuaauaucuaauguggcuuauuuaaauauaugaaugcaugugguguauauauaaaauaaaucuauaugcauauauauguauuuauauacauauacucauaaguacauaggcauuuuuaggugaacaugaaguaauguuucccuauaccuuuuucaaauauccuuaguguuauuuaacccuuuuucccccauucuucuguauugcccucccuuucuccuccguuuuaguuuuuuucuuauuucaugaccagaaauucauaaauguccuuguaaggaguuuauuacauuuaaaauauaauuuaucuauuuaaacaaaaaguccaggauuugggucuuguuguucggaguaggacauuuaugaauuuucuggguuuucuauuauuucaaaacggcauuuugaaagaaacagguauuuaucauaccaauguaucucaucaggcugauagugguggcucaugccuuuacuuccagaacucaggaggccaaggcaugcagcucucuugacugugagguaaaccuggucuacaaaacucaaagccgaaaccagaugggaaugacuggugauauuagacuuuguuucaguguaaacuguguaucugccucucuuguuucagaagaugcccaccuagccuuucucugccaccuuggcaguucuacuuggucaguggaauggguuuuaacuguguguauugcuuguucccuagugugguguugacacagaagugauuucgacaguaauaguaauaagaaagaguagaggcgcggcuagagcuuguccucaaggaauaagggacacuugcuuuuaaagaacaaagaaagaaugaacuuaaucucccacccccucugugugugugugugugugugugugugugucugucugucugucugugagcgcgcaagcgcauuguaugcauaccuuugugugaaggcaugcacuuccagaguaggguguuaguauucuucucuaacacuuacuccuuugaagcagggucuuucuuugaacauuaacuuguguuuuuuuuaaaauuaauuaaaauauaucacacccccccccccccaaugggagcuuguguuuuucagcuaggcaagcagccagcaaaccccuggugagccuccuguccuuacuuccccuccaagugcuggauuacaggcuaaguauaggccaugcccaccuuauaacguggguucugagaucugaacucagcccuucauaguugugcagcaacuaugcuuaaacaccaagccaucucccuagaacguucucaacuuuuguaacagcuauauaaaaguuauauaaaauauguaauauauauuuuacauuauauaguacauaauauauaucuuuauauauaauauauuaaauauaacuuuuauacguuugggagaacaaugaacugcauuuuaugcauugauugaauguugcuuuucuugcaggaaacucaaagcccuuuaauggaguauuugcuaucuugauauuuccuaaaauguuauuugcaacaucuaaaaguauauggaggagugggggauggagaguugaagggagacuacugagugguggcaguggaccuggugucugucccuucuguucauuugaucugccuuuacuggccgguaaagcuggacuucagugggacucauuucuucccagaucuguccuguacaaccaauuggcccacuuggagaguuuuugcuacuguugcucagcagcgugucucauuacuuagaucucuccuggcauaaugaacacccucuuguaugaguugggcauuuuaugagauguguucugucuccgcaggcauuuccaguaguuuccugaaagaaggugggagacuguguagcaucacuuagugggguguuagguguaugugaauaucugugcuaacugccccauaugccaucucucuugcccacuuuccuuuggcaucagcagcguuauagggccaagcgugaugcuguaaauugggcgcgcaguaaugugcauaccuuguuuucauuuucuuucucuuuauacuuuuccugcuaauuucuaaacagaaaucuuauuagauguuuggcaaaguccacagccaucucucagcuucccaccucaucuggguuuuggcacuuccucugccccucuauuagcagauuucagagaaaugauaggaacacaugcauuacacagacacccaggcguuccccacacaggugcgcuuuaacaggcagcacuuugcugacuaaugaacagaugucuuuaauguuuaaaauauucuacauaaaugcaaaguuguuuauaauuacaugugccuaauagguaauucuuugagucauuuuaaaauuauuuugauuuucaacuuuagaaaaaugaaacauuuggaugguuucaacugguagguuguuguggugggaaggaauauagcucacagcuguagcaucuaacugaaauucuuuuauuucuaaugacaaacuacuugcugaugcugugugcugaauggugcaguagcaguguccacaggcaggaaaccucaccuucacugccacaggcuguucguuaagguaaauguuaccagggaagaaaaggugaaaauguuaauccuugucacugggcgugugagcagagugugccaucacuuuguaaguguggauaccccgugguuuguucacacguuagugccuauauucugugauuguuguuacucuacacacucauacaucuuacuuuuacuuuugucucugaccugcuggccuacuuucucuuuccguaguaggcacaauaugucugcuuaggcagccugguaaccagcccucagcaaacucgugagugcucagacagccaagcuaagaacuaguguugcggaacagacucugagggacaaccacugagagcuguggcgacugccauggggagucuucaacaugcacagaacccugccgcuguucucugaagcggcuucagcgguccacaggaacuguguagggaaguuccucggguguccugucuugucuuuugucacucugggcuguuacuguguucuucgcgguugccuuacuuuuucucucacagccuuuuguguggacgagccccgcacuugcuguaguuuggccuacuaagugcacuauuuguucuguugaaacaccaggcagggguuauaauaagaacaagucuagaguuacugaugugugcacugaaagugaacaaguggauaauuauguuaauauacaguuuacaaucauuuuaagagauuuucuuuuuauuugugauauugugugugugugguuuugugcacaugagugacaugccuaggaggccagaagagcacaugugauuuccuggauucugggguugggagcuaucuaguguaggugcugggagcuaacagguauccuuuacaggaggggccuguagccacuucuugaauauauaauacaaacacacacauaucuauuaaaguauucacuuauuagacugaaagagaccuaaauuacugacuuuagugugaaauagugacagaacaaggguggggacuuacguaugugccacagucuucuccaacaaauuuugaauaaaaagaaaaguagucaaggauuuggagcccucuccauauuggccccagcacugccccuaguacagcaugacugucccagguguuccuagggugugcacaccuggcuucaguuccuugcugaugugucagguaccagguuagcugggccugucugugaagugcagaccugaccugaugaaaacagagcugcuccccucugcccucucugacucuguauugcuuccaggauuggcucggggaacuugaagggagaggaaaucuggaguguuagugcagcuacuggcuuggguauuagauacugcuuuuucaggcaccacuguuucuuaaaggcguugcccuccaaucauuuuuacagaugggaggggagacuuaauuuggcucauagaggagaaggaaauggaccuguguuucaugccaggcuguggccagguccucauagucuuuagcaguugcugcagaagcauugcauuucacggggcucccugcuuuccacuccucucugcugucuuucugacagcuggggacuagauaaaauucagcauugcagggaucaaauagagagcauuucugaagaccucguaauucuuaaaacaggcaaguacuugaaauaccgcuggcacaucaccaacuucaaaccugaagauagcgucauaugcuuagaagaugcagacaugaaaauaaguuugaagugaugagauaaaacauggguggaauuuauuauuucauagacuagggucuuauaaacacuguguacauguaucuaugugagugugacugcacauauguuagugucggagcgcauagccccaaauuaugaaagucaaaugacggaaugagagaaauauaugcaauguaacaaauaaaaaucauuagaauagugaaggaccuuucugugguugguuguuucacuuggcauaauguccugcuggaucaaaaauuaaaauaaaauuaccauauaagccagcaguucugcuucuggguguaggucccucaaaguuuaaagcaugaaucuuuaaaagauacuuguacacccaaguuaauagaagccuuauucacacacuagcaaaaaggugaaagccacgaguguccccaggcugguaaauggauaaacaaugugggucguauacauguaaugugcuacuaauuaucuuaagagguuaagucucauuuuuuuuguauauaaucgaaucuacaaagcuucugagauaucucccauuuuaugcuauuuuucaguuuagaaucagugaaaaccuaugaaauaauuuuuuaagaacauguguuccuaccaucccaucuguccuuugaggaaacauaauuaauaagauucuauagugacagaaaagcauaaaaugagucucaguagaccaaggugcugagucagagaccuaauugccagcaacagcagcugccuuguuugaauucaggcugagauggaguuuuacuauguugggugguucacacucuuggaggcccuagaacuauguucagaaaacagcggccaggaaggcucgucaaauucucuuacagcuggugagcgaguacacaccgcugcagugacacugacuucugccacccacaccaacacugcacagugggcgggcacugcugcucuccuguccuuuuaggacuggaacuccgcacagacgcugggucucacuacuagccuuugauucaaccacugggauuaguauugcugacgugcccacucuuguuuaugugccgaacucuuggagaaugagaggcugggggugaugugggggagguggauugcuauauuugucauuguuucauggcaguagguccuuaaagugagagacccugguggcuagugugugauaagugggcuccaguauaugacgauugcuuaguaauuauagaaggcacaaauuaaucauuaaaguauagggaugcuacuaaagaauaaacccugauugaagcaaacauuaauuaaaccauagguuuauccuugaguaaaauguuugguuuucucauuuccucuggcagcuguaauuuauguauauaaaugcauuuaugugcuuuuguguauuuauuuuguguccuauauccuuacccaauucauuuauuacguguguauguuugugaaugugugaguauguauguaaguguauguauaugugugaguguuugagaauguguguguguaugaguguacauaagacugugagagcauguaugugucuggauguaugugugaguaugugucuaaguguuuaugagcaugugugugacugucuguaguauguguguguuugugugugugugauauuuggguuuuuacauuguagaacuaugucuguaaacagaaauaauuuugcuugugguugggaugccuuugugcugccuguuucuccaggagccuuucuaugaccaggagccuuucuaugaccaggagccuuucuauaaccaggagccuuucuauagccaggagccuuucuauagccaggagccuuucuauagccaggagccuuucuauagccaggagccuuucuauagccaggagccuuucuauagccaggagccuuucuauagccaggagccuuucuauaaccaggagccuuucuauaaccaggagccuuucuauaaccaggagcauuucuauaaccaggagcauuucuauagccaggagccuuucuauagccaggagcauuucuauagccaggagcauuucuauagccaggagccuuucuauaaccaggagccuuucuauaaccaggagcauuucuauaaccaggaggaaccuuucuauagccaggagccuuucuauagccaggagccuuucuauagccaggagccuuucuauaaccaggaaccuuucuauagccaggagccuuucuauagccaggagccuuucuauagccaggagccuuucuauagccaggagccuuucuauaaccaggaaccuuucuauagccaggagccuuucuauagccaggagccuuucuauagccaggagccuuucuauaaccaggaaccuuucuauagccaggagccuuucuauagccaggagccuuucuauagccaggagccuuucuauagccaggagccuuucuauaaccaggaaccuuucuauagccaggagccuuucuauagccaggagccuuucuauagccaggagccuuucuauagccaggagccuuucuauagccaggagccuuucuauaaccaggaaccuuucuauagccaggagccuuucuauagccaggagccuuucuauagccaggagccuuucuauagccaggagccuuucuauagccaggagccuuucuauaaccaggaaccuuucuauagccaggagccuuucuauagccaggagccuuucuauagccaggagccuuucuauagccaggagccuuucuauagccaggagccuuucuauaacuaggagccuuucuauagccaguacguuaguagaaguaaguggugaggcuggcaucugcaccucuaccuggcgcugguuugccaaggugauccuugugccugugaugucauugacuguagcuuuuucagaaagggcuuugaucauuuugagguauucuucuucaguuccuaaaguauuuagucaaaggaugcugaguuuuuucagcugccuuuucuacaucauccagucuuguuuucacguuguuacaugguaauucauuaccaguuugcauguguuaaaccagcauugcaugccagggacuaaaucccaucucaguaauauaauagcaaugacauacuuugggguaaauuuaauuaaagagaugaacuauuucuauguuaaacuguaaaacauuaaugaaauugagaagguaauaauaaagauaaaguccuugaugauuggauacaaauaauuaauaucaguaaaauaucuguauuaccuauguuaguuuuuuuuccuuacuguguguggccugagagaaacaauaugaagaaaagagagauuuugcuuauggcuucaauccaucaugauggagauggcaaaacagcagagagcugaaacaauggggcccaaggaggagccuguugaccucacgguggacaagaaacagauaaugggaaugcagggaagagcuaggguggcuauagcuccagggacccagccucggugacuuacuuccuccacggagaugccagcucccacucucaccaccucccaacaauguccuuacgcugugaauucauccgacagugauuguucuauugauugagaaccugauccaagaucuguggagugcugcucagacacacacagcgauaugcuuuauucuaaucaacuugcuaauaaagacuaacuaggacacuucucaaaauaauauauauuuaguacagucauacacaaauuccauaaauagaaacacgaaugcuaaaauucuuguaaagcugggagaauaagaaacccugacuauccauagcaaaacugaggaaggaaagcaguguuggggggaugagaauuccugauuuaagauuuuaugucaaagcuauaauaaucaaaacaaacuggcacuggcauagaacagaaacacacaccaggcacaccaggggagugucaguaaacuagaaauaauucccaaccugugugccugacuuaagguuucuaaugcugugauauaccauggccaaagucaacacugggagggaauggcuuauuuuaucuuacagauuauagcuuaaaguugaucaugagaaaaggcaaggcagaaccucaaggcaugaauguggaggcaggagcuguugcagagaccauggagaggugcugcuuacugguuuacuccucauagccugcucggcuaccucaaacaugaaucaagaaaaccuaccacaaccuuuucucuuggccaguauggggauuccacaggcuuuuaugcuggccacuaugggugugguggugcacgagugugcgccaugugugcagucuuuucaauuaagguuuucucuuccaaaaugacucuaccuuguaucaaguugacauaaaacuagccagcacaguggccaacucaccaaaggugccaaaaacuuauacugggaaggauaguuucaaauaauaccccccacaacuggauauacacauguaaaugucugaaacuguaccuuugucuaauaccacacucaaaaaaugaacucaaaauggauauaagaccuggaauuguaaaacaccuugaggagaauuuaugaugaaagcucuuuggcaauauuuaauuuucuuuuuaaauuauucucaaagcuuagaaugaaaaagcaaaacuaaauagaagggaacuguauccaaagucccuccuauaugaaaagcuacugcacaacagagcaacaugcugcaagccauccagguaaaguggauucggaggagccaucccugaaccagaugaggggucaguagaacaguuucguacuaacugucugagcuuaguaucaucagagugauaagacauuuccccagagaagauaaaaagauguucaaaagauuaugaaagugugcucaguauccugaauccucagggagacacugacucacaccacugugaguugucacuucauacccaccagauggcugcuaccaggacaggugguaagcaggugugagugugaggagucagggaaccaccucguggcugcucuugguggcaaggagcagugcuccagccagcagccauuguggaaacagcauaggaguuuccuaagaaaaguagagugaccuaauugucugcugauuccucaucugggcauauaugccaaauagugaaaucagugcggcaaagaccugucugcagucuaauggucauuauccacaguaaccaagauauaggaacaacuuuagugauaaaagaaaacacgguauaaaauugcagaaugcuauucagucuuuuuaaaggagacccuuuguauauauaauguuuaaguuaaauucagcauacccguuucccaaacaacauuucuuuaacauuuuauaaaauguguuuuaacuuuauguguaugucugcaaauauguaugugaaccauguguaugcuuggugccuucacagauaucauguuagauaucuguggguguuaggguguuagagcccucuggaacugaaauuuauaaguuguaaguggccaugugaguacuggaaaccaaaccuggguccucuguaagaguagcaaaugcuguuauccacugagccaucuuuccagcuccuaucauuuauuuauugucacaggcuucaacuuguuuugaacguugacaaaugucucuuccuaauccauaauugucuggaugaaacauguagcuuauuauuacccauagccacccuacugcaugauagccuucuagaguaucuugcucauaucuacauugaccaaccuuucugucugcucccugucuucuuucccaagccccucuccaccgccauuauguuuucaauuuccaguaaaucaacuuuuuccuuuuuuaaauuagauauuuuauuuacauuuuaaauguuaugccccuuccugaucucccuccaaaaucccccuccccuucucccuucucccuucucccuuuucccuucucccuucucccuucuccaugcucaccaacccacccccuccccuacacuggggcauagagccuucacaggaccaagggccucuccuuccauugaugaccaaggccauccucugcuacauauguagcuggagccaugagucccaccaugugcacucuuugguuggugguuuagucccugggagcucuggggguacugguuaguucuauuguugauccuccuauggggcugcaaaccccuucagcucccugaguccuuucucuagcucuuucauuggggacccugugcucagucccauggaugacugugagcauccacuucuguauuugucaggcacuggcagagccucucaggggacaguuaaaucaggcuccugucugcaugcucuuguuggccuccauaauagugucuggguuuggugguuguauaugggguggauucccagguggggcagucucuggauggccuauccuucaggcucugcucugcaauuugucucuguaacucuccauugguauuuuguuccucuuucuaagaaggaucaaaguauccacacuuuguucuuucuucuugaguuucauguguuuugcaaauuguauguaaaucaacuuuuacaguuuccauguaagagcauguaucauauaguguuauaggaauauacaauaugauauagaauagguaaaauucaccuaugucauacagucaggacuguauuuuauuuggugacaaaagagacuucagucagcuuguugaauguguuguuucuuuguauaggcgucacauaugugagugcacugcccaaauaauccucagucuguauaguuaagauagagagcuacaugugcccaaauguauguuucaauaaaaacaggacagaguaaaacaacaaaugaggaagacccuggcauauuuuguacuaaguaaaauggcaugccgaagucccugagauagcucuucaguaccacaacaacaacaggcacugaggagugcuuacugugcaacaagaagcccaaguccaaauccaaagcaccuguauaaaagccagggaugaugacaugugcugaauguaacuccagcacugggggcagagauaggcagcucccaggagcucacuugucccccaaaaugauguguuucaggcuuagugagaaauagcaucugaaaacaauaagggagagagccaugggggaggaagccuuucucugaccucugggugcauguguauguaccugcaacacacacuacucucccauauagauaaacaaacauacgauagaagcaaguauaaaauauaaaaaaauaaaaaugcccacaacaaaauaaacccuacuaaaccggaaauuuugagaaacaagagucucauugaagguacaaaagagcacuaaaaaaaguaaacaugugguuucuccuaaauuguuaucauuauuuuuagaauggaauuuaaaauaaucuugagauagggucucucuauguagcccugccuauaguagauguagcuuggaggccugccucucuggcaugcuagaguugaaggccuguacuaccaugcucagcuuguuauugcuguuuggaggcaagguuuuacccuguagcccaggcugcucuugaacuugauuuauccugccucugccuccugagugugagugcugacacuguaggugugugcuacccaacagagcugcauuugccucagacucacuuuuaaugugauuuccuacucucuagccucaaccaagagucugugugagacgggaaacaauaucucacagucaauaauuaauaguugaguaaguauugccauuuuuaaaauugaacuguuaggacuuagguauauaauuuguuugaacuuauuaucucuagcuaaaugucaaauuuuauaucuuaugguaauugugugguuuaaaaaaauacagcaccaaauuacaguuuccuugacuuacauggcugugcagucagacuuuugugugaagagacauuuaguuguuuuucugaaacucuacuuuucuacacuuaaauagauuguaaccuccaauagauagcugagagcauuucaauuuuaauguggcuuugugggagaguugaccuucuaaauuccauaugguuucaaggacuugcuuccaauagaauuguaacuauauaguccuaguaaagagugcagagggaaggcggagggcccuggcuuauaaaugcagaaguagauguugagacaagaaugcgcgcacaguugugaccuuggcauucucgaguuucaguagaacuguuaauuauuuagacucucuguucucugucuuuaugcacauaggacuuuguccuuguauguuaaaaaaaaaaaaaacaaagcaaaacaaacaagcuguaauuugaggaucuuucauuuuuaauguaaaagaauauguuauccacuuuuggaacauauuuuuguagaaaagaaauaccugggagaacaguuucucuguaauuaagaaacauuuccaacuuuucugagagucaguuaacagcuaaaaaggcuugcacugaagcaagcaagcacuuguaaaucaaugccauuucaaguaggaacugucccagcagccgaaugaaacaaacggauuaacacaguucauucaguuucuuugggacccuucacccaggcuguuccugguucuauugccacacaguagccgaaucaauagagagaauugaguuugaacauugguaauuguuggugcuguggucugucccuguuguauuucauggaccucuuuggugcaggaaggaaaucauggagcuguuuuucagcaguuaccacucaguaguucccaagucacuugcugaauuaagcagacuuagauguggagcccuuguucccuggcccagcucacccuucuaguccaugggacaaagaggucauacacucaucauacuggacccugugacgguugacuuguuuguuaauuugucaggaucuagaaacaccuaagaaacuucuggacauaccugccugggaauuccuagauuggcuuggaaagaccuaaguguagacagcaccaaauggaguccuccacugagugaggagaagacaagcugagcacucccauuugucuuuuuuugcuuccugcuuugaggaugcagugugaccagcugccucaggcuccuccuuccaugacuuccccaccaugauacacucaaaccgugagccaacauauaucuuccuuaaguaaguugcuuuuucaguugcuaaucccaaaccaaggagaaaaguaacuaauacagagucccugguuaucaguccugcuguucugccugccucugcccuccuuggacggucccccacuucugcucucccuggccaucccugacugcucuucagacagucuuccccugacucucuagagcucugugccauugcacuucauucaccauuuguucuguccauucuaucuuugccuuguuuaguuaguuguuuguauaguggguucaaauguguucuuccaaaaaggcauuuucauguucuagccccuauucuuugugacguucucugggaauaacagucuuugcaaaugaugugaggauagggucauauagaauuaggguguuguucuaacuagucuuauggcaacuucacacaagcuagaguuaucugaaaggagagaaacucaauugagaaaaugucuucauaagagcugguuguugggcauuuucuuauuuagugauugauggggggaaggacaacccauuguggguggugccaccucugggcuggugguccuaggcucuauaaaaaagcaggccgagcaagccauaaugagcaagccaguaaauagcaucccuucauggucucuguaucagcuccuuccuccagguuugugccauguuugaguuccuguccugauuuccuuugaugaugaacaguggugaagaacuguaaccaaauagacccuuucuuccccaaguugcuuuggucaugauguuuuaucacagcaguagaaaccguaacuaagacagguggacucugguccagugacugguguucucaaagaagagggagguuugaccccagacacaguggugaaggacacaggcaaaugacuggacuguugcagcccgacugaugggauguuauggaugcugguaauacugacuacuaagaagcuggaaggaaggagucccagcuccuucagaggcucaugacccuauaacaccgcaagagcaguucuaaccucuagaacuaugaacauaaagucccguuguuucaagacacuuugguauguuuuuaaggugaaccuaaggaaacaauacaguguauuuaccugaucuugacucuucuacagacuuaaugcuaguucauuaagaguuugggcuguuacaaauaaggcugcuaugaacauaguggaugaucauguguccuuauuccauguuggacaucuucuggguaaaugcccaggagugguauagcuggguccuccgguaguacuauguccaauuuucugaggaacugccaggcugaguuccacagugguuguaccagcuugcaauccuaccaacaauggaggaguguuccucuuucuccacauccuugccaguaucugcugucaucugaguuuuugaucuuagccauuuugacugcugugagguagagucucaggguuguuuugaauuacauuuuccugaugacuaaggauguugaacauuucuuuagguacuucucggccauuuaaguuuucccaguugagaauucccuguuuagcucuguuccccaauuuuuaauaggguuauuuguuucucgagucuaaguucuugaguucuuuguauauguuggauauuagcccucugucagauguaggguugguaaagaucuuucccaaucuguugguugcuguuuugucuuauugacaauguccuuugccuuacagaagcuuugcaauuuuaugagguccuucccauuugucaauucuugaucuuagagcauaagccauugguguucuguucaggaaauuucccauguguuugaagcuuuuccccacuuucucuucuauuagauucaguguaucugcuuuucuguggaaguccuugauccauuugaacuugagcuuuguuuagggagauaagaauggaucaguuugcauucuucuacauguugacugccaccuagugagaaucacuugcaaaugcuuugaggccaaugucagaaugacauugaccauauguccucaaauucacagagauugccugccucugccucccgaguacugggauuaaaggcacaugccaccacuaccuggcuagguacuaccuuuuaaucguauaguuuacacauaacaauuagcgucuaagaaaauucagcuuaggaaaauuuuuuguggaaacuugcaacacauuauaagcaauugaauaaacucaaaacagcauuauauucuuuuaacuuuuaaauccaacuuauuuuuauuuuuaaaaaguauuggguaaauagauuucaucauggauugucauagguauaugucagacauuguucauguucaucuguucccugucucuucucccuaaguccuguggggccucuccagucaagauaguuucauauuugcuguuuuccugucucauaucaacauagucacauaaacacaaacgcacgcacacacauaccauacguguggaauccaggcucugcacaaagugugcacagugugaacaguuuuccccgcuaaacuagccuauugcucccuccucuuauuuuaguuugcuugcuuucuuccuuuuccccucuaccccuucucccuucccuucuucucccccccccccaaaucucuguaauaagaaggcucucuauaauuacauagcauacuuuauggggggcugggggagacaguuggugaguugccugcugugauagcacaaggcccugguuuugggcccccagcauucacauagaaaguggcaccauaggcagucccugugguccagugcuggaaaggcaggccaggguuccccagacuugcagcuccuagguucugugagacucugccucugagucuaaagagugacagaggaagaucuucaaacuuccaccucuggucuccacacaaaugcucauacauauaugcauguaugucuuuacagcuauauguguacacacgugaacacauguauacacauaaguaaacacauguacacauggcaaaaauauaguuaguaaauacuaagaagacauaauuucucauuaaaauuaugagcacaaauagaaaagauacugaguguaugaaacagucaaguuuauuuaagcauguuuucugaaagaggguguggugguacccuucugaaacuuugcuaaaguuucugcagaggcagaaagauugucacaaguucaaguccagccugauguauguagugagcuccgggccagcagagcugcauagugagaucugccucccaagcagcagcagcaacagcagcagcagcagcagcagcagcagcagcagcagcagcagcagcagcagcagcaagaacaaguuucaguaagcacucagaguauaaagcccgagagaccagcugcuuggugccgcauucugcaucgccagcuucuggucucuuacaugaugggcaaaguacacauguauguaaaagcauguaaauagacuguaaaauacaauaacauacaaaaauacauccaggauauauuuuauucuugggcacagugacuccaguuugggagaauauaugucaaaaauacagugcuaguuuuagcuugaggcugguuugugaaucuugaacaucauuuauaaggaagaaucuguagcguccuugugucccauggacaaggaucugcagcuuucucugcuuggcuuguaggaagccugaccaucuggccaugugcuguuugcucauuaagccuucgcuaggcuucagugucgguugccaguagugcugccgccauguucaaggcgccacagcugcuccccagccuccauucuuggagcugcuugaggccugcugaagagcccuuggcaccugugugcuuuccuucccauuccuuuccugaggagccuugagaaggaucucgcauuuggguacccucccaguuaauguugguucguggcacauuggauugaggcagagcucaugaggugagcccucuagcaaggugggcacacaggcagcuggcuguggccauucccacagccccgccccaucucuauucaggguguguugcuccucacaguggugaccccagcucucgaucaggaaauaugagauacaaaaagaacaaacaagaacuuuaagaaagaauuuaaaugggaucauuaugcacugcaaacagcacuucaaaaagcagacaggccugagggacauucugccuucuaauguaagcaaggcugcuguuuguauaaaucucuuccuauauauuaaaauuuuucuaggaggaauuucuuaaacuuguuuauuaugaacaaauagaauauauuuaaagccacuucuuuuugguaucuuaggacucguuauaacucccuuuaacaacugguccauugcuugcuaucuuacagaucggugguacugacuucaguagucaucacuaaauaugacuuaggauaucuuuaguuucuaauuauuuuugagagccauuuaagagcaacuucaacugaagaccucugccaucuuuuacuccauccuacuuguucucaucugaaguccucagucucagaaaguucugacugcaaacagaauucuguauuuuagacuuuuguuacauauucagcaaaacucaugaaaauguaguuuuuucuucuuauuucuccauugucuaccccuuuacaucacauagaccacuuagaguaauuuuuuuuugguuuagucuuagaauuguacauucauucacuggcucauguauucuuccucacauggauuuauggaguaagcacagcuucuaacugucugcagugugcaagguacugcagggucccagaaauagaugguagacugcaguguguauuaaugugcagaaauuuugacugcaugggaaacaggagcugggacacucacaaaggcagaguugcauagacuacuguaagucuggcaaagacugccuagaaacuccaaauggaacucuguaauaagauaugaaaaccuagauauuguuagugauaugugaaugucaccagaggagaagcacuccagcacaccaugcagggacggacuugccuuagcacuguguggcaaauugguagcuguggaaacuauaguuugugcucuuaugugcucugauuuuugucaggaagccuaaucaaaagucuuugaaaauucaaaugaccuuggauaauguuugcucauuaaaaucacagcuuaguaaaauaguguuuuccaaaagcaaacaacacacagagaugagaaaguaaguucauguugacuuucccugccuguaggagcucacucacacucauugaguuggauagaggaagagguagagaaacagauaauaagacuuacauugauaugugagauagauguauccaaggaacagugugaaauuauuagucuaauaaaauucccauaucaacagagggaggaugucuuaggguuuuacugcugugaacagauaccaugaccaaggcaagucuuaucaaaaaacauuuaauuggggcuggcuuauagguucagagguucaguccauuaucaucaaggugggagcauggcagcauccacgcaggcauggcgcaggcagaacugagaguucuacgucuucauccaaaggcuacuaguggaagacugaguuccaggcaccuagggugagaauauuaagcccacacccacagugacacaccuacuccaaccaggucacaccucuaaauggugccacucccugguccaagaauacacaaaccaucacagaggauaguaaaacauaaacacucaguggguauugacagaaaugaucuuggauuuggaaagaauaauuuuauuauccugacuaagauuaaagguaccacagaagccaaguauggugacacauaucugugaucccagcauugaagaggcugaggcaggaggauugugaguuuaaugcuagcucaaacuccuaggucaaauuaccugaccaaguaauuaaaaauacacaaauucaccauuguuugaauaauguggcuuuaaauuuuaaaacuuuuuacuuuauauaccauuuaaagucuuccucugcuguagugaaaugauacccauuuuacgguuuuuguuauuugaauagauuuugauauucuaauguagagcacuggaaaauggggccagagauacgguuuguuggcuauucaugcuacucaagagaacuuguggacucccuuuguaaacuuuauauauuuuguaaacuuuauuaagcccucaaggcaggaaaauggccaugcuccauuucccagaucucccuaacugucuuaauggcuuuucagccucugaaacagucacaaaggucaucuccagcccucaauaggacccuccccagaucaugcuaacuuuaggugaaaagucugaacaaaagccaucaauccaugaacuucccacugaaauccacugucccugagcaggaaacccauaaucccugagccccccaaaccucaggauuugaaaucccaccaaucaucuccauggaaaucucugcccuagaaagcuucgccacuccucccucccccaagaaacccuauuguaaaggcuguguuugcucagcucccugcugucugcucccucccaggagcagaggcggccacuccuggauuagucccuuuacaucuuggacccgccaauaaaucucuuuuaugagauuugcugccuggugugacugucaucagaagcagcuaagaagcaaugaagagaaggagggaagaagugacagaguggagcagggcugaggcuccucagcucagcugggagacccucccugggagcugcaacaccucuccugagaagccuuccuggcagagcugugugauucccgagcuccugugugucaggaugcccuugcacuggggaaccuucuucccuccacacugugugguucuugggcuuccuagucccaggacaccuucccauccuccacugcaacaugguccuucuuucugucuucuguaguugauugugauucaugaccucacuucaggcgggcauuagacaauucagauuuuuucuuuggagcaacacccugucaugucuaacuguauguaauuuuguugaauggauaaauaagguuacuuuacuauaaucuuuuguguguguauguguguauguguaagcauugacauuuuuuguuauguuugggcagugucuuaguuaagguuuuacagcugugaacagacaccaugaccaaggcaagucuuauaaaaaacaacauuuaauuggggcuggcuuacagguucagagguucaguccauuaucaucaaggugggagcauggcaguauccaggcaggcauggcgcaggaggagcugagaguucuaugucuucauccaaaggcugcuagugaaagacugacuucaaggcaacuagggugaggauccuuuccaccugaaguucuuuggcuucuucuauucagguuucucaaauuauuuacucucucuuagagugcugugccaggguuugauguuggcuuucuuguaaaauugauugaucuaaaaaagaaaauucucguguugucagaagugauacagaaguauuucaccaauaaugugaaggagauaacugcauucuaaguuccagaaugucagcagcagcagcauccuuaagucuagagcucuacaaggcucuggcucucugcgguccccuccacauacuccaugcagaugagaccugguuucuagggaugcuggaaagauaggugcauccuauauguaacauucaauguggacauuugaugcucaggggcuuugggggccccacggcuggugagaaagcucauugcaacucaugguugggcaggacaagagauuuugauuacccuucuugcuuaaauagcuugaccuaaccuuuaauggcuuguauucucuccuccacuguaacaguguuaagugcuggucuguuuuagguuaaacucugaaagacauccauaucuuaaauggugaaucugaaaauucgaaaaauugagagugauaagaauuuuuaugccuuauaggcugagcuuggcucuuuuucuggauugacauaucugaguuugugggcuuaagaauuacucugguauuuucaaauauugcaguguuucacagaugaggaacuuuaagagugaagaacuagggccuuccgucuccauggcaaccauuguggagaucauuggccuccuguucccugugggaccuuugucaaccuauaguguucaugugugauucauuagacucuggacccugguuugagcguaagggauggcgcuucuagugaagugcuugucuagagcuagugaaacaugggauacaagucaagucaguagguggguauguguuguuguaagugguaucuaauaacucuauuagugcuuaauuugacccagccagccccccaguaauugggacugaguccuauugauuugcugcacucguuacuugcuguucgagucucaaccaagcuacuuuuguuccauuagccuauccuaaggaugcacuucuggccacauggucaggguccaucuaucaggguagccucugccucucuugaguuuuucucccgcucccucuccaacccccagcccccagccaauugucccaccauugacacuugugagccugugccuguggucacaccagcacugcaaacauguuugucauauugacuaggcaccaaccuccaucugaggugggcagaagaacaagauacugucaggccaggauagagcgcugguggcaggacuguucuuccauacuuaagcuuucauccucucaaauagagagagaguggggaaaggcuuuucuugucugcaccuggagauuuauugauggugaucaguuuuacccagggaaucucagaaaucaaagcauuguacacugcuugaaacacucuuugauuuauuuauucaguguauucauuuuugugugugguguaugugugaguggugugugugugugugugugugugugugugugugugugugugagagagagagagagagagagagagagagagagagagagagagagaaugugcacagucuauaggaagauguucugugugcuguuucaucacuccgugcccuaauuccuugagaccagguugcuaccaggaccuggacuugagcaaccugucuugccugccugccagccccaaugauuugccugucucuaugcauucagugcuggggcugaagcaugcauagcuagacaugguuuuuuaggugguuucagguguaucugaauuccuguccuugugcacauaccaagcucuuuuaucuacugagccaucuccuuggccucuuucucaauauuuuuggaagcauccuuaaaguuguuucccccauaccuauaauaaucuaauacuugauucuuugcacaauuacuugauuuugagaaaacccuuuuuauuuuggauauggaagauaacugaaguuggcaauagagcaaggacuuucaaaauauaaugaaaauuucugucucacaucucagcuuuuuuuuuuuuuuuuuuuuuuuuuuuuuuuuuuuuuuuuuuuuuuuuuugguuuuucgagacaggguuucucuguauagcccuggcuguccuggagcucacuuuguagaccaggcuggccucgaacucagaaauccgccugccucugccucccgagugcugggauuaaaggcgugcgccaccacgcccgguuacaucucagcuuuuauuguauguacauaaacucugucgccagagcagcuccaagugggcucaacccccgccccccagccucccucuguaguguggguacagcaccacugccaccuaagcuuuugauauaagggaauguagaaacucucacuuuguaccaauccaucacugcccuuccugcugcuuuagcagauucugcagaucucgcucuuagaaagcauguuaggcuuuaguaggccugccacgcagguguucuuaucugcagaguggcacuugggcguuguucugcagccuacagaacagccucagucuuccauuuugcuuuaggauguuggaugaguguccaggaaggcuucgcuguagucccuuguaagucaugaagcaugucauuggugcacucccuuugugcuggaguaaaguugagccuacuguggaccugcugcacacuguuacuuagagaagagcccucaugucugauguauaagaaaggaacacauuggugagaacaccauucuuucuauguaugucacaguaugauuuaaaaggaaaauuuuaauuaagguuuuuagaagauuuguauucuguggcucucaguuuagaaauacuaauauucuuucaucuuuagugugagagugacaggguuagcuguugauagauccuagagcuccucuuuuagcaaguguguuauuugcaauuaaccucuaugugcuuuaucaaugaggacuauuuaaauuuaauucuuguuaauuaugugugugagagagugagugaguguguuugugggcaggaggggugcagagaaggagaggggggagagggaacauguguauguuccagcacauauaagaaacgaacucaggacaggccugcacagcaaagugcuuuucucagcacugggcaaggcugcuggcccugugaggucuuaaauuauaucauuguaauguuuacugaaagcaguauguuuuagauaucccauuuuuccauaaaauuuucauuucuuuaugcauacuugauuuuucuguggggcagaacagaccuccugagugucauuguuuuuacuguuaacgauuucugccuaugaaguuugacauagauuguaaaacaucaccagccugucaaucucuggaucucucucuacgguggcuuguguuuuucauucucuuuaauaaacuguggauuacauagauaaacuguaaguagcucugggcugcugccccgcucagacucccuguacagguuuucuuucuguucuuggcugcagccauaggcuugagcucgcucacagcggcauccaacaugaggcuugcuccugcaguccuucuguccugcuucuaguauuaaagaccuggggcccuaccugaaaacuuugacuuugcaacuauggucucuccauggcucuaaacuaguucaugucgucccguccuguguggacgauuuggagacacuccuccagcuucacgccaccccggaugcugcuugcaaucuccauggucccuuaaggaacuggcucagaccauagagcagucccggacggcagcuuaaccccuugugcacuucucuggggaagguucaguugagugcucuguuuuuuucagguggaauuugucugugggggagggcauuucuucuaguuuuuggcaaaaagauugauuuauaacaaguuagucaaucauuauuaaacucuuguugguauuuaaaaauugugaaaucuuaaaaauaauuacagcaugccugaugauugagccuuauccuaguuauaauuauaaucuaugagguuuuaugaacacacacacacucacacaugcacgggcacguguggauguucaagaaugacauaaauggggcuguggagauggcguagucagcaaagcgcuuuaagcaugagaaccugaguuugauccccagaaaccacuuaaaaagaaaauacugaguguagcgauacacacaugcaaucuuagugcucggaucgguggaucccucagccucacuggccagccagccugugcugcucugagaguuccagguaagugagaaagcuagucuaaugaaaaggugggcagccugaggaauggcaccucuggcuuccacuuauguauacacaugugcacccacaaacacucauuacucccccccaauaaugacaaccccaacauucaauaaggcaguaagcugcuggcuaauuuuuaaaauccuccaagacugauuuuuaauuauuauauauguuagaggccaccuuucuucaucuauucucuuguccuacauuucucuuggguugcuauauucugagagcuugcaggagcuguuuauauaguacuaacaacagccuuuugucugugcugaaauacuucuuguuacugugccaucuaugaguuugguuuuuauugucacagaagacuuaaaauaauuuuauauguuaauuuuuauggaauuuaauuuauaccccuuuagcuucugaauaauaaaaaguucagccuuauauguuguucugccuuucucaaaugucuacaucuuugauccauacaaaauauguuuugaguaucagaauugagauguagggauauagccuuaauuuacuauagguuagccugcugacuuaacccuaauaaagacugauuuucuacagauaaucauguucuucugaugucugaauauccacacaccuggaucucuuuggugcucuccuauuuuaagaguaacucuauuuuauccauuuuaauauuucauucauuuaaaucaaaaagucaaagucuucacucuuugaaaaggaauacguaggacagaugugguggcacaugccuuuaauuccagcacauggcagacaggcagguggaucugaguuugaagccaucuuugucugucuauacaguaguuucucguccuccuccucuuccuccuccuuuccuuugacuggauuucaugguggacugcuggccugccuggccugggauuugcuauguagaccagguuggucuggaauuggaguccuacuuuccucugugcccccagugcugggauuaaagguauauaccaccuuuauaagguauauaccaccguuauaagauugguugaugugcauacuucuuuaagaaaaaauaaugaggcuuauggauauagcucugugguaaaguacuugccugguacgcacaaaccuuuggguuccagccccuucacugucaaaagaacaaaaaauugguucuuccuacuccucucuguuuugcuuucucugcccccuaacuuuguaaaacaauugcauucuuguucuuuguucuuuauuuaguaaugaagguauuuuaagacuuccacuuuuucucugagaauucugcucuaaucuucuggguagauuuguuuuagcuuauaacucuuuccugaauuauaaccccucaguuucauuucuucugauaaaaaguagugaggguaaaaugaugaugugcaggcauuuacaugguaagcauagagacucacaguagaagcaugcauagauggacagucgaaguccauuuucagaauuuugaaguaccaaauuggcuugcuaacaacggaaaguauugaucuucccugccuuugguccuucucuugcauuugacuuuacaauauguuaaugugcauuuuaggcuguuggauguagaggguccuacuuuuuaccauugucuauauuuuccuuuuugacuuccuuucccccaaauuccuuaaaugaaagaaaagaauaaauucugugguuauaucaccugguagguagcacacagggaagaagcgagucugcugaguuuaaaauucagguaggagauaaaaagggagaggcccggggauuuucagggugaaaagaugagagagcauugaaguacauagacaaaaauacaaaacagccugccuggggagauagaaaguaaaugaaguggagccaaaguuuagaucccugugaaagcuagggagagaauucuucauguguaaaugcauuguaaaugcaaauucuccaguguguguccaugcacaaagcaagccucguggccgagcauagagcuugcugcccgugaucauucuccaugcuugcuuauguugcuaucauacauuguucacuuaccucaagaucucagagaagugcacucugguuuacacaguggucuaaggcacaguguuuugaguuggcuuuguguuuguagucagacuagguaggugaagguuggagugguaauggggguuuauaauguauaaaggagaucaucuguugcacugcaggccaauccagagaugcuuccuguacucucuucucuuuucugccuuguugucgucccuccccccaaaauauaaauauaagcuucuuuaaauacacugagcagaagagauggacauagacuagauauggguaaauggccauauuugcacaccuguuugcuugauccuuaaaaugugggauagugguuuauuuaguaaaaaacuaaugaaauaaguguagcugucaagagcauauuccacugcccagauguauguacuagauccaggacguguggauaacaucgcuguauuggggagguucgcuacucagaauguuacuuguaaucuaaaaugggaaauuagaaagacuagguguuuucuguauaaaacuauacauauauguguauguguacacacagauauauguguaauacacacacacacacauacacauauuuuuuuuucuauuucuaggggacuccuuuucacaguuccgauuugcugaggagaaagaaugggauggugaaacuucauguccaaaacagguaagacaagugugucuugaauguaguagcucuucucaaggccagcguucuccaccuggcagagacgaaguccugaucuguaggaaguagcuguaguucauaugcuaauuacuacauauaccugcccuggagagaaaguguacagggaacuaguugauaagguccuuccagcuugaguuuauuuggcuucugauaaggucucuuauauugaauugcucacaacuucaggaggaaguuaaugguuaugauuuuaacaaauagauuacuuuguuauuuguuuuuuuuuuucuucugcuucuuuuugccaaucuuccccccccccccacauuccuucauuaaccuuguacuuuuauuaccuuucacuuaguaggauaaguguacgaaauaaaaacagacaucauagaaggccuucagucaguccuucaaccacaaaggcuguguuugucaugagcaaggaauggaggaagugcugaacucccacucuuuccccauccugagcaucuguaaggaaggauuucacuguuucccggucugaccuugaacucauggcccuccucugucugucuaccaaauguugagauuauaggccuguacuacuacauacuugguuuuccucacauucuuauguggugggaugcaaaugcaugcccccccuuuguguguguguguguguguguguguguguguguguguguguguacaugucccagaagcugauaugagaacuguauacaagaauacuauacaucuauauuauuuuccuccaacuccuucuuuacuuucacccccucucagaugaugacuuuuuaauguuacuguuuuacacacacacacacacacacacacacacacacacacacuacuuuauccauuuccuguugcuuuugugaguauauguuuagggcugagcaugugggaucagauaaccugccaagggguugucucuggaaaagucugauucuuccucucugcagccauugauugcuuauagcucuucaucuaggggaugggacuuuugagauauccccuaucuacguuggcacuucgauuggugguguuauucuuugaaucuuguuuaggcaacuauauugguuuuuuuuguuguuuugguuuuuuauuagauauuuacuuuauuuacauuucaaauguuaucuccuuuccugguuucccuucugaaaaccccccuaucuccuccccgcucccacugcucaccaacccacccacucccacuuccugucccuggcauuccccuacacuggggcauagaaccuucacaggaccaauggccucuccucccauugauaaccaccuaggccauccucugcuacauauaugcagcuggaaccaugagucccaccauguguuuucuuugauuggugguuuagucccagggagcucugggguacuaguuaguucauauuguugcuccuccuauggggcuacaaaccccuucagcuccuuggguccuuucucuagcuccuucauuggggacccuguacucaguccaguggaugguuaugagcauccacuucuguauuugucaggcacugguagagccucucaggagacagcuauaucaggcucuugucagcaagcucuuguuggccuccacaauagugucuggguuuggugguuguauauaugggauagauccucagguggggcagucucuggauggucauuccuuuagucucugcucccuacuuugucucuguaacuccuuucauggguauuuuguuccuccuucuaagaaggaacgaaguauccacacuuuggccuuccuucuugaguuucauguguuuugugaguuguaugcagaugucccucaacagaggaaugcauacaaaaaaugugguucauuuacacaauggaguacuaugcagguauuaaaaauaaugaauucaugaaauucuuaggcaaauggauguauguggaggauaucauucugagugagguaacccaaucauaaaagaacacacaugguaugcacucacuaauaaguggauguuagcccagaagcuuggaauacccaggauacaauucacaaaacacaugaaacucaagaagaaggaagaacuauauuguuaagagugaaugggugaagcuuuuagugguaccaccguacuuagagcagcaggcuggagagagcaaguugcuguuuucugauuugaagagaagcagagguuacccuccagcuucuuugaggaugccuggcaacuccauguuaccaccuaaucaguucuucuuucuucugccuaggauggggcagucugaguuuaggggauguuucuggucagaugucuauaaaugcuaguuuucuuccaguuugaagguuagagugccugcucaaugugauggugaucacuguccuaaaugugucuuagagagugaucugugggcucccuguuugguagagagacauuaaaacucauugauucaugauuggacucccagacagaaguaacuccagggaaugguuuuuuauaguuaguuuaucaucucucccuuuaaacaccccucuagaauucagcacucuacguggacagugagucacugguucgagcccuugagcagcugccucuugcaguccggcuuaauguugcuucagaauugauccagguaagccagagucugccugcugccugggugggggcagaggaaggaccagagggaggaacauagccuguagggugucucagccugagcucuucucaucagaaacugacgucuuagauugagguaucaucuuguaaagguucaaggaaaacaguuguuugagguuacuguauuauguuuuauauaugaacauuuuaaugaucaaauguaauaggauugaaugcaaaaaagucuauaaagucuugcuauugacccagaauauucaggugucaggcucugaguuggcacuagggacacgugguaaguaggugaauguggcuucuccuucccugagcucaaucuacugggaaagauuaguauuaaucuauuuaguggaguaauuacauagcugcauggaaaugauaauaauguggauuacagugucucaggagagcuuuuagugaggagucugauguuucaggguguggcuaggacuggguuuccuaaggaaacaauggguaaacugaagucugaaguauaagaacacuugagcugcaaugaaaggcagaucagcauuagugaaaauaaucacaguaaacacugcugguggacuaggaagcaggcugggcggguggcguguggacucauggcuaugucugugugcuccugugcaaggcagaguagggaagccaucuuaaagaagcuguccucuggguccaggugagagacacuagcgcagacccaguaaugaugguggacauaaaaaagagcagacuucuguaagaagcauuucaaggucacauuaacaggaugggaaagaacaguugaggaaggagugugcuuggacacacacgcuugcauccauagucugucguucugcucucaacugugcucuugaacugcagguucucacagagaucugugaagugacuauaggauuaguacagaggcucacauucugacuuugcucuguucaacuacaaugcugggcauauugaucacccaccagccucuuuggggaugccuggcaacuccauguuaccaccuaaucagcucuucuuucaugcuuagagggccaugcugaaguaaacuuccgagagagcuuugaggaguuacuggcaaugugggucuugaaguaagagcaguagccaguugcuucaggacacacaccaaacuuuacucugcacuuaugccagcccuguggccuaccuacccccaaaagagaguuucucaaccuuauaacugagacagacuuuccauagccauaugugaagucuuuggagcacagcacagacaggggagaaaguacagcuaaguaugcauaaccauggaauuggcaucuauauuaggucagaagauuuccaguuccuuagaggccaucacacaucccuugaauuaccauccggucccucgacugucauuaccauggcuuuuguuacuguaguuuugccugguuuugaauuuucuauaaauguaaccaaaaucuuggcaaaugaucuugucccuuuguaucccugcauccaagcacaguaaacaggucuacuuggcuaauuucuucuuacuaacuuuuacaaauagguggucauucuuuguuacagucuuaaguaccaacuugaauagacuuauguaauaguuaaggauaggaaaaugugggcuuuuaacuucaccucugagcuaguuagcacauaaugggggggggggggggguagagcggaucacacagcccuaugauuuuccacaaagucuccucauuugcccuggguggaucaagaagagugcuggaguugagcuucaacagaagauacuucaugggcugucagaacugagauuccuacuuacaggguuuuacagcucaacuucuucugcuuaaguuuaacaaggacccuguuaaucucugauaauccugcuucuuuuuucagaccacaauuccuuuagaacuuccacaggugaaaccaaggagaaacgaugauggcaaggagcugggcaugcauuuaaggggacccaucucugagcucagaucugcugcuggugcuugccccaggucucugggcagaggcagucuaaggcaaagcccuuuagaagguuugcagaaagcaccuaccccaacacagucaguggcagaccaccuggaagaagaacuagauauguugcugcauuuagaugcaccugugcaagaggaaggcaauaucucuccagaccagacaucucgggaccaggaaccagaaaaagaugggcagguagcccaggaggaaacagguauggccuucauucuguuucccagccaucuucucaaaauauaccccucugugucugacaucgaucgagccaugucccagguaucucuucccaaggcaaaucacagcuuccucugagcugaccuuucugacaguuucccuuacucaauaucccagacuuccaaaguggcuaccagccugguugcaguauuaaaguuaaagcuccagauugaacugcuguaaaagccuuuucauagaagaccuuuuaaucgacugaacaggcuaggaaaacuaacucuucaugcuucuugguauuuggguuuguuuuuuaaagcaaaggaaugcuuuauaguuugugaauauuuggugagcuggucgcccaucugaugugauggggccucagauaacugucaugucaugcacaagagucaugauguuucaagauugccucaaacagaaaaggacacugagccacgcuguuggccuuuuguguuaaaaccccacaaaacuagugagcaaugagcuuuaucucccgaguuaauagaagagcgaaccuguaucuuuucuuacuuuguuuagauacuauucauuauaucuuagggggugacaauaaugaaaauuuauugcgcugaaccauauccucgagcauacccccaaggaagccuuaucuaaccucaccaugaggacugacguggaguggcuaacguugcuucuguuuccauagguccugaaaaaccuucugugaccagagagaagaauguggaaccugagcagccaagcacaucgaagaaugucaccgaggaagagcuggaggacuggcuggacagcaugauuuccugaagcggggucaagggggaagagugccugaagcaaaugcugguugccuucuguguaaugagcccgucuugugaggacgggcucguuuaccagcuaccccaugcuaacacguccuguuaugcuuacagcagccaacaccuaccucuguguuugauggcaucugaauauauguaugaggcuuguuugaggcuucauuucuguuguuaucuggcuuagucaucuaauagauuucauuaaggacaggggaugucacagcuacauuuugaaccuccuuccugucaacauuuacagcauaacaggugguauuuaagggaauuagucucaaggcaugaaguuggucaaaauaaacaccuucuggucuauggauguuuccuuucuucacgaagccccugggccacuugucucaugucccugacuccaguagucaggucacuguagaauaacuugagaguggcacaugacaagaguucaaacccagaacuggcauguuuuacuuuauugcagugggcacuucuuuuuauuggagauugaccuaaaacauggcagcuccacuacuuacaugggaccauauugcaucacucaaguuugguauaagauugagauuuuuucugaaauuucaguacagugccuuucuccagauaacagcaggugacaagcuguuacugaagaaaugacgugaauaaccugcaagugcagugucaugacguaagacagaggagcagcacagcuguuuaauggaguuguccuucuggaacacaaacauaaaaaacuugcauagcuauaucuaaagagauuuuuuaaggcacuuaaucgauauuucaguuucgacaaaguguuuguuuucuauuucuuuagcugcuuaaagcuuuucaagcugauucuggagacagucacuagcaaguaccauggaaaaauuagaucgaagguaacaugaguugaacaugauuuuguguaguucugcccaucagucccuggcaaggguccucuuacaugacguucagguguucaagauuucgcauuucucucugaaccaugucggugaaaaacuacuaaguuuguagaaacgagagcuccguuagcagucagguggauuccuugacacuuugccauccuucgugcacaaaagccaaguuaauuaccaaaucuauuuuuuguuguuaaaguguaaaagacggacucuguugcauuagaagguggcuguucagaacuguagcuugucgugaacucagguuuacccgagcugaucuucauauugcuuccgaaagcagucuccagcugggaagaagucccaacaccuuuccugguacaucuuccacacauaggauuccugaaacagugcgaacaagugauacuugugugaaaccacaauaagcuaaaguccaguuugcuuuugcucugugugacuuccuuuaggaagacuggugggaauugauucgcggccacacgggcauggucucacucugucccuagcccgcucaguucugugagcaagaaaucacagucuucccgucaugacugaagggguaacccaaccugugccccuucuagcauauucaaugccaugcuaguuguaacugggggacuaaaggagaguucaaguugaggggacauuugaugcuaccugaggccuggucuagaagccuaguguuugcgcuaugaaguuuuccugcccauugacguuuggauuuugaguagcuaggcuuuucuuccuguguucuccaccuuucuuuucauaguuagucacagaauucugugacacagcuccucacucauccucucuccacaccuccacauuccuguugucgcccacauacaaggccgcucuuucuuaugcugucucucccacugucuuacucugcaucuccugcucuuguuccagccacccacuccguuugucguugucguuuucucucugcuguccucccaccuccagcuauuguacagagaagcaguaagcacaguggcuugaaaugucaguguuuguugagcaggauuaccggggggacuuggggaagagacugacaucaccauagaacucucacgucuuaguaaggaacaaaaaaaggugauggagaaauacaucuaagagaugaacagcuucagguaucccguuguguacuacucagugucaagacccaacacaaaccuacuuaguucuuaguuaagaggaguuucucaccuggcccguauguucuguuucauccuuguuaaucaaauacaucagaaagaaucugaaaaaaaaaaaaaaaagaacaaauagaggaaaggucgaggcuuuuuaaauuaaaaaaaaaaaaaaaaagugugucauggaggggcucaugcuuaaucccagcacgcaggaggcggaggcggaggcggaggcagaggcaggggaaccucugggcuugacauuagccuggucuacagaacaaguuccaggaaagccaggguuaugaggggagagagagaaaccaaacacaaaauuauucauguuuguguguguacaaaugccaaaguuacagacaguugugagcugcuugugggggcugggaacugaacccuggguccucugcaagagcaacaaaugcucuuaacagcugagcaaucucuucaguccaaaguacuucucacccaaacuaaugcuguuuacuaagguaauuggaaacaggguuugaaaacuaagauggcuuuaauaaccagggaagcaucuaagaaugauagaugcuuaucuccaagcaagugaggggagagcuuuaguaacucccaaagaccuaagcccauuugcaaacuauuuuaccauuaaaaacagcccggcccuuuaccauaagaucaucaguaagccagguuugaaaucauacaucuaggaugagucaggaggucacacuccuuccagaaguuucacuuuucuuuuuuuuuucuuuuuucuuuucuuuuuuucaagacaggguuucuccguguagccuggcuguccuggaacucacuuuguagaccaggcuggccucgaacucagaaauccgccugccucugccucccgagugcugggauuaaaggugugcgccaccaugccuggcucacuuuucuuuucauuguggaaaacuagggaagggcauuaugauuucacuugcacuaaauuaucuguaucaaagauuugagucugucugugacaagugucccaggaggcugcacucucaguucauagucuacaacuuuagagaugguuucuagaagaaccagguaucaugcccuuuaggaaagggauauguuauacugcugaaaaauaaaaagacgaagagaaagcugagagaggauaaugcuugcuggccgagcuggagcccuaaaccuugagugcucacagaguagugcuguaucguuaucucaggaccuggaauacagagacagcuuacaacuccaacagcagcuucuuuaccucucccaagguugaggauuuauuuccaccauacagaagagaugggucugggaaacagguucuucuccaggcacauuuaacuggcagcugaccacaagcagugcugcagggaaccauggaagggaauccuaaccuagaugacuaacaucuccucgucugucauucccugccauagggcuugugggcucaaccucuguaucuugacugagaaccccacuuaaugagaaaugauugauaaaugcucacgaugcuagggaaugaaugauauuuauua

SEQ ID NO: 987 - RNA, 3358 nt, Mus musculus
ucuuugaaccauuuauuucgauuaauuuuuuaaagcaaauaauuauucuuaagguuaaauuuuauuauguguuuuccccuccacucucagucuucaucacguguggauugcuuuauaagucucagaugaacuucuauagauuggugagcuguggcuaaguauucacauuuacucuucuuuuuaccucagacucaaaucuuggauuccaacagcaucaccuacucguagcucauuagcaaccucauuaccuagaaaagagacggagaacaugccagccauugguaaucaauaccucuuggaaugcacuccccuucaguuuucccccaaacccuacauccaggcacuucugguugcaaaagauuuuuaagaaaaacauuaccccgacaucaagagaacauuacugaagacugcuagaggauauucacaacaauccugagaucauaaaaccaguuauacccaggcagggaaagauguuuccuccuugaugaacucugucugcacaauuggauuauuaguauuuucaucacagauaggucauguuugaacuuaaugcuacauuauuauuauuaucuaugaauaauuaguuaaagccugaaaaaaauaacaugaaagcaaacaaaaaugagaaacugauucggaauaguuucguuuuguuuuguaacaaauauaguugagauuagguuguuuuaacaaaauuuggaagaaaaagugaucuucuugccaaucccuauaaaaaucaaaauucuuuucuuccaaacaccucaaccacccuaaccaguuucauaugcugugucaauaccgcguucaagugcaugcaaccagaaaaccuucuccggcucugaugcacagugcaggaaaggggaugguccaacuuggaauuccuaggaaucuaaauauuuagaaugugagugguuuguaauuguuuaaggcagauaacuggcauagucacuuggcauagucacuuggccagcucauuuucuccugaaggguagguacaugguagaagacugagaaguuaucgcuugcagcugauacacccauuuuauaagacagcaaaauggccaucauguggaacagcauagcugucaugugcuuugauggaaccugacaaggcugaccgucuuuccuuagcuaguuauuaaccuucuuaugacaugugaaggaguuacagcuggacuuucagguaagacugcccacaucucuauacccuguucacaugugcagcuauaaagucuaagauggguuguggggaggaaaaagaaauaguaaccauccauaauccucugucacaauaaauuugaaaugauaucuaaacauugggcagaauuaagauauaugaugaaaaccuucuguacauuauacuucaguuuugaucagcuagaaaauaagacuuauuuaaauucaugucaucuacuuacuuaggcuaaaaacuggucuuguagcaauuauccuuugaaaaaguacaaauuacagagauggguaucaaucagaauuaauaaaguuuaaugaagagaggagggaggaaggagaaugugguuugccaauauuccaggagaauaaaaucaagucaaaaugagaucggaucccaaguucuucugacagcgucuuucuagguuggcauuucaugugagucucaguguuccaaggaucaccagccaucuaguaaucaaagcccguguucugccaaauccaacuuauuaucuuaacuguuuaaggcaucaaacacccgagguuuauaaauauauaauuaaagccccuacuuaaaaauaaaccuagaugggagauuuacauuuuuuucuuaauucauguuuauacaaagaacagaucuguuuuuaaauaguacaucaguucucuuugagcucaaauaaauuggugugacacuuggacaaaaccauuucuagaaacaauggguauugacaccccguggucaagaaacccuuccuguggaguuuuagaauugugcuguuacucaaaaugaacuguuguguggccccacugcugucugcaggcuggguugcuguggauucacuuuagaacuuguauccuacgaguucuaaacaggcaaggauccuauauaaagcaauccaacucaagaaauauuuauguccugucuuagauaaaccccuagauguccaugcucugguaaacuaaauuacuuuuguucagaaacuuagaaauauucuuuucacuacaaagggaaaaacaaaacaaaacaaacaaaaaaaaaaccucaucacucacauuguauugcauacuguguucaccauggugaaaaacacugagaaaaacaauugaaagugacaaaagauuuguuugggcucacaauuuuaaaaguuccugguaggccagcuuuauuauuguggucccaaggguacgguggaucaaaguaagucaucucacaguagaugggaagcagagaagcacaggaagggaccaaaacaagauacagacccugaggacauaccugcagccuccaccuagaccucaucuucaaagcuucuaggcccuuccuaaugcugccacacggaaaccaaggauucaauaagagaaccagggccggguagaugaauuucuuguccaaaucauagcagguacuaugucaagguucuuuuuguuauucaaggcauuucuaugcccauuuucaucauuuuuuuguguguguucuaaugaaagagaauugggaauuacaauaaucagugugugugugcgugcacacacacauuuaaaauagcugaaguauauucaucaaaguaaauacuuucauucuuuaaagauguuagaagaacaguguucugaaaauucuuaaacagaacuguggcaucuguucacaguuauggcaauauuugguguacugaaaaauguuuauuuugaccgauucugggucacuucguuuguugacucucuucugggcccuguguguauuauauaauaauucagcuggagagaucaguagacaaaacaaacucaaugcugucuguaugagauggaccuagaacuuuggacaucugagugcugggauuucaugcgauuuagagaaaagaucauugccaccaucagcuguguccuuaccagcuaugggcuuguuguucuucauaaggaugagucagcuccacauauaacagcccuugcaugggcccuacucagucaucacccucccuuuucccuuuacuaagugaguucacugcucccaagcaaaguaacuagaaacuucucaggacugaggacauagaaaacucuuccuuaagucagcaguauaugcucuaggggaacauaagagaaugagagaaaaaacaugaccucaagaaguugacacguaggugaaugguagaauacaagagcauaggagguagaguagucu

SEQ ID NO: 988 - RNA, 12521 nt, Mus musculus
gcggcauuuaaaccggagaccgggagaugcccgacacuaggugcgcccuucgcagaccuggagacccagaguaccgugguagcggcgcucuccuucgucuuccucccgcgucgagcccaaguggcucgagccgcggucucacgcagcgccacucguccacagcgaagaaccugaggacccacggaagugacaggugagcgcggcgguauucuggugugugugugucucugugugugugugcgcgcgcucgcucgcguguguguugguaugaacccaggcuagccaaggaguccccaggguucauaccaucucgaauucuucucaguugugacacagccccuuggugcaccaaagacccuugagugcgcauuaaagaaccgaaccugguccuuccugccgcagagguagauguggugacugaggggcacuggguccacgggggagggaggaagguagagagagaaguugucaaaaaagugcaucccguuuccaugugcuggaacccugcaaacucgguccuggugcuugaagcacagagcccgcgggagucgccugccgggacagggcacuguugccgagucagagccccggagcuggcaucucugugagcugaagccgaccucgcagcaaguugcaagcagagacagccuugagaguuggguacagggcugggacaggggcgucuguaggaguggcggucccagggcuuugagugguaacugcuaaggacuugggaauugguggcgugugcauuugcggguauggcagaugcaacugaggcugguaagacagaauccgcgcggcuuaacaagucggggucggguaccucgaagcuugagugcacgcgccacacacucuugugcuggcugugcuccggccggcgcguggcugucuuuuuugagccucuugggggguuccacgcucucauccuccauacagcagaccugcaggcgccgggcagccacuacuggcuguuucccacuuccguagaugcuggccgaucuguaccccacaggccucgguaacgccucgcugcgccucgcuagcgacugcgcucuacugcgcgcuuugccucuugcuccucgcucgcugccgcugcugugagccauuccggugagcccucucuagcuccugguagaagucuagagugaagggaaaggcauguggcugucaucucccugguccuacuuauuuccugaauucuaguuugggaagaacaacuucucuauagcccuggacuggcuguucccucucuggcguucuucagcuuaguguuugccuaugcccggcucuggcaaccauccaccagcgagacuggcuggggaggaugcgagaugacuagccuuucguccgaggaccuuccagagaaccuuagggggcucucuggucuagcucagcagccgucuuuccccuccccaguagaauccaaaucccuacccuuugauggagaaauauagccuagaagugagggguuaaaaucuccucuuaacuguuggagggcagaaugacgaccaucaguaaguaauuggaucucuugguggaaagagcaaacccaaguggugcgcacgucuguuuauguuccccugagauggugccaggauacgaacugauuaaaacaaucuacuguguucaaugggucaccagggcuuuaagcugucccaggaacuccagaguagugguuuccuucugacugcucuuacaaguuaaauaaauagcguagaagagguuaagauaaccccaucccagggugagggcucuucuuucaccccagggcugcccucuccucacccccuccccuuuuucuuuuugggacaaggcaggcaggcggcacagggcacuugggaguacagacuuuucaaagcaacgaaggaaaaggaucuuaagaaaacaagauccuccuucacuaucaccacaaccaagucugcagauauagguguuuucauuacucuuauuggacacauugcaccguuggauuaaggcuccuccguguguguguguguguguguguguguguguguguguguguguguguguguguguguguguuuaaccuccgggucauuguaggaauuagugucuuuuguaaacuuuguaacuucacagcuuuccuaugaucuucaaaguucacucugaguaaaauguuuuguuaacccacaaucuguaggaaguccaaauuggcuaaugcgguuuucacagcagcacuuagggagagaagaacagaaacacgcuaaguccuuacaccccucaauguccaccucuuguccuucuaaauugaugcuauuggugaccucagucucaaugguccagucuacaaagugacagaauacaaagaacccccauggucccagaccuccccaagaaaugcuugcuggcagcaaagcuucggaguguguuugagaaugcaaagccaaagacauauaggagagcuucagccuuuuaugugaggaggagaagaggaaggcauuucggagcagcaacuacacauuuaacugaaaggcacugaccaggcaagugcuaccagcccaugucuuacaucugcaaagaauuuucuuuaguuuuaacauauguucuuagagaugcaaaauacaacaagaauucccaugacagaaggagucuuuuccucugcuugcaaacacaaagauacaaaauagauaauuauuagauuuacaauauuuuucaaaaucuacugcauuaaaaaagcaaagccacauguuccuuguuaaauaugcugugcugaaugucacuggcguagugacuaaggacauguuagaauuagaugaaacugggcucaaacccuggcuauccacauuauaaacuaugugaccuuggauggauuccugauuaguaacaggaagacauuauuauauaccucauaauuuaucaugacaaaacuuggacaguguuuagcauaaugucugauguaguaaaaacuaaaaaaaaaaaaaaaaaaaaacaaaccaaaacuaagagguaccuuuuauuacuaguggcuguguugggcaugagagaccagagggugauucugaauuuaaucccaaaucccaaauauuuguaaccauuacaaaauguagcauaugacuuggcugucacucaguacugcugcuuggugagcauuugauauuuauacuuucuaauucauuuccugcggauucaaauaauuguauacaauuauuaacugcacuaaaaaaaaaaaaaaucuucccggaaacuacaaagauauuuaaccaccaggugucuccuccucaccuugugugguguuggauuccagccugacuuagcccuagugggcagauuauuuuuaagagacuugcaacaaacgugcaggacauacaauuuaugacacaugccaaucauuaauuuuucuuaucuccuugguaaaauuugucugagaaauaagccaaccuuuauuauuaauaaggaauucccuaguuaauuucuauaggauggcucuaaaauuuaaaguuaaagagcuaacuaaaauuaacuuucacucuccuuaaagauuaaggcuuaaggggaaaaagaaauggauucuuuuaaaaucuggccugucuauaaagcauuugcagcaaauuccguuguguuuucugccaggagaaugagcucaugucauucuuguugccugucuuucuaaagaucguccagcaggaacagugggcccguucagguacagacaucuggaguucacuguaauucuuaacaaaacuccauuuaagccacugaccaagcagguugcuuggcuaaugugagagccacaaugagaaguguguggaaaggagcuggcccuagauucuguaaauacaucaauaauauuggaaacaagucagacauauuuuugggguuucugaaucuccagacugugaagaccauucuuggugcuuuugugaaauuuuuuuuuuuuugacaaguuaccagggcagaaguaauuaccauaccuuuccuugcuuggaaguguuuauucuugaacaccaagagaacugaggacaaaugggaggcagcgaaaaccuguuuugaggaucuguccuuugagauaagugauuggaggaguguaguggcaaaaugaaaaagagaugaggaugaaguaacagcuuguuggcaaaggcaagcugcagagagagcucaccuccaaaauauuagcacaucacucaacagcagaaaugcacuaaggggauguuaaggcaggguuugggaugaagaacgauaguaucuguauaggagaaccaagagacaugcuuacuacuugucaugauccacucugaggucgggaugugucugaauacaacgacuggacacaagugggaacucaugagagccuaaucuggaccaguauuuggauugauuuuggaccauguagcacacugcuagggguugauguggaaagaauuguccucaaggacauaccaucuucuuuauuugguccauaccagggauacacagaaagugcuaagcauuuggugaaaacagacuugcaauuucaagaagagaaugauccaguuccuugauugaauaaucaacacuaguugguagggggcuugggugaauggacacagugaucaguagagccugguuucauccuuccagugcuguucaccucacucuucuucagggagaccaucagaagcacacuggccuuucuacucaagccgggaaacugcccugcugauuucuuuuucuuuucuuuucuuuuuaauuggauauuuucuuuauuuauauuucaaauguccccuuuccugguuuaccccccacccacccacccgaagcucucuauccccucucccuuccccggcuucuaugaggguguucccccaccuacccacucccaucuccccacccucaaauucuccuacauuggaguccccaauggaggagcuagaaaaaggacugaaggagcugaagggguuugcaaccccauagaaagaaugauaauaucaaccaaccagacccucuccucucccuccccccgaccccagagcucccagagacuaaaccaccaaccaaggauuauacauggagugacccauggcuccagccguauauguaacagaggauggccuuguuggcuaucaaugggaggaaaggccccugguccugugaaggcuagauagcccugcugauuucuguuuauugauguucuuggaaggcuuuucuuucuaacacuaaaguuuaagaaccugaaagccucacaauaaaccagcaaauuugaaucauuuuaaaauggaaaaaaaaacauacuuuuuacacuuaguaauuuuuaaauauuuguuuauuuauuuauuuauuuuuacuuuucuuuagugaaaagucagacgguguaauguagacugcuaugacuuaugggguauucacucuugcauaggaacagaaaaaauuucccaaauuaaaccucaaaaccauagucaacuaauuaugauuuuauuguuuuaucauuuggguuaaaauaagacucauauuaugcuucauagaaccagaaaaacaaacaaacaaacaaaaccaaccccaaaaagcaaacauccaaacaacauuaacaaaacuugagagcaaauggagauuuccuaaaaaaagaaagacaaguguuagaaagcugucuaggcugggagaagucuacacucccaagggucaggagacaaaagcaucucauguagccggccuuggcaacagugauggugcuuuaagaugcaaagaacagaaacuguaucaaaccucugugguauaauaacaaucgcuuaacaaauguaggagggacuccucugugucaggaacaaagggucagaugaugaauuagccuucauccauucugaagguagauauaacaagguucauuaacagauguaaauaagccaggaaagaaaaguuuuauaagacaaaacaaagccauuauuuugugaacggauauccuaucuguagaacaguauggccuuaugaacgaauacugucacaugcagucagcauacauccacagucagccccagguuggccucugugguugugaacacugaagcucuggacccaaaaggagugaauuagcuuggagguuauuuuuuaauagauguagagauugucaaccuagaucuagggccaucuaugcaauauuccuuugaaauagcagugaauggauuuuauuuuagcacuuggccuuuuauuuuagacacuggccucaauugggagucaccagaaacuugugaaacugucuuccacuugcacugugguuccuuagagccagaacaggcauggcuuaaguuaucuuggccucuggagaaaaucuguacuauuuuauaacugaucuauuuucauaagugauguuuuauaagacaaaacaaagccauuauuuuuaguuauuguuguuguaguggucagauugguuuguuuaaagaucagauacauaguaacccaagcugacacaagcuuagaaccuacagucggagcaggaguugaaugucacauuaucagcuccaaacuugaaccugcuccaaaguauuaaguuaaugucagaaaaacaaugacauuuaagaauauuuuuaaugaaacauucaauuaucuugguucgaugcuagccuuaggguuggauggcccucacuugccagaaguuguccuuuaaaggagauccaucuuaggcugcuuuuugucucuuagagauaauuggucuagauaaugauaccaacuugucugguuccuuggagaugaagguuauauuaaaaagguuauguuaauaugcacuuagugguugccacaugcaauacugguauucagcggacagaaaauggaugcuuccuugcuguucuugugcagcaaaccuuaagcauggggcagaggaaaccccagggagcugccaugccuggaagagacauuauguauuugaaacuguucucauuugaaaagaaagccuucaaugcuuuaauaacucuuggugugccccaggccagcaaguguuccaggcuuuuagcugggugggaaggcuggcugacugaguuaggaucuucauauuaaugcuuucccagaggacuguguccagggauacugccccaggagaauccugacagccugcugccucucuuucccuuuuccgccugucugcccugucuuuucugaacaacaccgccucugaaaagucuccucuucucuuauuugcuuuguuuaccucauguuccugucucuguauguuucuucucccaccaggugggagaucaugcuuagacuuauugcuuuauuuauuuauaauguauuuauuuauaauuuauuuauuuauuaaauguuauaugcccuugccauauacgagucauaucaagguccacauuugcucacaguucauuggcaucaauucuauucuuaugaauugaaauauucccguacuuacucuauugugcccauuuuucuaccuuacacacacucucucuucuucuucuuucuucuucuucuucuucuucuucuucuucuucuucuucuucuucuucuucuucuucuucuuuuucuuucuuucuuucuucuucuucuucuucuucuucuucuucuucuucuucuucuucuucuucuucuuuucucucucucucucucucucucucucucucucucucucucucucucuccacauguggcuugaaagcagaaggacuguuuggggaaaugacacaguaaagcagcagggggaggcaaaugugaacaaggugaggugacagauaugcaugaaaauccacaaugaaacuccgucuuguacaccaacuuaaaaauuaaagccagagaaauuaaagaccuaccuggucaauuaaucagacaaaaaaaaauucuauucauacauacagucacauagauggguaauguauuuuaccacuuagaaagguugaaaaguggggucuggagaaauggcucaucagcuaagaacacuuucuguucuuccaagcguucugaguucaguugccagcacucacauugggggcucacaacugccuauaauuccagcuuuaggaguucuggguguucuauugcccucccuaggcacacacacggauuacacagacacacacacacacacacacacacacacacacacacacacacaaguuguuauaucauggcagaaagaaugauaccagccaucuuuauccucuuggccuuccguacaucccucuuuuuagguucuuuuuuuuuuugacagguuuccugggcuuuuuccaauacuggaacagugaaaagucucaugucaaauucaagaauaaauacaguuaagugagcauuaaaaaaagucacaugcaauugugucaggagccaguaaggaauucuaauaggagcugguucaaaagagagacggguccugacugaguuuaaagcuuggcaaauucacugugugaccugugucgaauuacucaguuugauggcugagagaauaauggaaauaauaguaucuaauggcuggugauacuguuagaagucagugcaacugaaguguguguugaguacaguguguuaaguguaauuauugauuuuuacuaaauaacuuucuuauugucugugucccccucucuuuguccuuugucuagaaugaaucgcaccgcauacacugugggagcguugcuucuccuccuggggacccuacugccaacagcugaggggaaaaagaaagguucccaaggagccauuccgccuccugacaaggcucagcacaaugacucugagcagacccaguccccaccacaaccuggcuccaggacccgggggcggggccaggggcggggcaccgccaugccuggagaggaggugcuugaguccagccaagaggcccugcacgugacagagcgcaaguaucugaagcgagauuggugcaaaacucagccccugaagcagaccauccacgaggagggcugcaacagccgcacuaucaucaaccgcuucuguuauggccagugcaacuccuucuacauccccaggcacauccgaaaggaggaaggguccuuucagucuugcuccuucugcaagcccaagaaguucaccaccaugauggucacacucaacuguccugagcuacagccacccaccaagaagaaaagggucacacgcgugaagcagugccguugcauauccaucgacuuggauuaagucaaagcgggcacauucagccugucauagccaugcugagagagccacacccaaaccacccgauuccuacuuggcuuaaaccuagaggccagaagaaccagcaguugcuuccuggcuggaggcugcuuaugcauaguguaugcgcaugagugugcaugggugccuguggguguuuccaaacaccagccggaaacagccuuugcuagaaggcacuuccuguuacucugcuucagauggucggaaaugcccacaccacuggacccaaacauccacaggggcagggcuguaguuggcuuugucauuguguuccaugugccuccugggcaccaggauuucacuugagaaugaauacuaaugggggagguaacucugagggcugcauuagacucggaacuguucagugcucgcccuaugcucccauagcccaucccuuucuuugcucucccugacaucucagucguagcccauguuccuaaauuaauucacuugaccgcggguguaagucuuuugucuugugaagaaccuucagaauguggggagacacguggugauggcaaacgggacagaggacugacgcaggaacggucaggcugaggaccagucugggccagugaaauucaguagugagaugucuagaguuuaaaaguuguuucccaaaacaauauuagucuuguuuuuagcaaaaggguuuuccugauauuuaaaagaacccagacacacagaggaaaaauauaaucagcaaaaaaacaaaacaaaacaaaauaacacaacaauaacaacaacaacaaacaaaaacccaauucucugugccagcuucugugaccuacugauacuagcuguaacugauacuagcuguuaagggugaaaugcugaccacuccuguuuuaagaaccaagugaaauuaaaaaagaaaauguggccuccuacuuuacuuugccucucugaaggacaacugagagccuuguucacugggguaagagaaggcaaaaccuccuaagcuuaguuuugcuggauuaacauugcuuguccgucauuucugaaaaaugcuuuagacguacagaaucuuucaauaaauuccugcuuuucuugaggcccccugucaacaagaaacaguguaagaugaagagccaccugcugcauuugaguuagacaugucuggggccuuuucuguuuggcuuuuguuauaggagagaaucagaggagagggagggagagagagagggagagggagagggagagggagagggagagggagagggagagggagagggagagggagagggagagggagagggagagggagagggagagggagagggagagagagagagagagagagagagagagagagagagagagagagagagaggcuagguagugucuggagaaguaagggcuguguuugccucacuucauuugcucucagagggucaauaggaaaguuccauuaggaaaccagcacacuaggguacaugaauaguccaccuauucccaguggaucuauguggcauuguaaccauuaugccuacuagggaugcuguccucugaguacacguggcuccccaaaugucuacuuagcauuuaugucagggccagagugaaaggugggugggccuugcuacauuuugguuugcuaagcaauacuccuuaagacugagauucuagcuauaaaugccccaaauauauauauauauauauuugucuuuuccucucagagugacuagucaaguuauaugucauuuggaaggcagacauucacugcccaucaaagauaccacagucaaagaaccauuggaaguaaagaaacuuuuuaauuuguuuuagcccacucccaugugacaucuaagcaggaaccauauuguaaggcaaaugcuaucuucaauucccaaaacagugggucuaacuuugaaaguuuaaaagucacaacugacgaauccacacuaaaugaauuugcacaagcccagccugugaguuucauuuguacugagugcuccuuccccgaaucucugagucuuccauauccauagccaauaagucacaggauggauuagauuaggcucacaaaugcaaaugcagacuuuggaggguagugaagagagaaaaauaagagaggaggaagcugaaaauguaggaccacaccagagaugaaaaaugacaaugcugagaaacaugccacgucuaaauucugccacaaacaugcaguauugcuaaaaauaaaaaauaauaaucaaaaaacaguuuggcagccacaguaaccuucuaggagcuuguaccacagucuuucauauaaguuggauuuagauuugguucaugucaaaaggauugccucaaaacuaacuucuuugaaacuaucagcagccuaaguauccuaaaagcacaucacuggucaaagacagggaugucugccuuccucgcugugccuauaacgagaccaucagaaauauguguccuucauuguuuauuggagaugcccugucggucgcuuauuuuggacgcacuggugacguaauggugcacauucucuccaacauuguagcagaacuguucuuuggcgagacaaguugcaaucuccaucuuaccuauuaaaauaaugccagaaaccaaauaugaaucuuauggccuucaauuugugcuuggcauugaaagaggaaaaccacauaccguguaagucugagugcuucuuugcaaugguauucuucaaagcuguuaaguaaaaaaccuggaggaaaggauaguuuccaccguguggaaugugaauaagcaaaaaguuaugguuauuuaauguaauuaggaauucaaaguccuucgguuacugugauuucaaacauguuuucuuucucuauuuuacauggcagccucugaguugggcaaagaagaaucaggcccuugcauguugcuagagacuuuugucaggucagagggaaacagucuugucacaugugaagagauguuaccaagucaaggacaagcuuuuauuuuuuaaaauugaauguuccuuaaaaguugacaauucugaagcaauauuaggaaagacuuuaaauguucuuuugagagacuuaugauguguguauauaagcaaauagcagauaaugauggcuagcuaguucagacauauacgaacagaacauuucuaaacaagaaguccuagcugaacgacugaaagagauucuauugguuugucauuucucaagauauuuaauaucaccuacauuguguauuuaauaugcuucaaucauuuuaaaacaaagaaggauuauauaggcuaugauggaauuugcuuuggauaagggcgaggcaggauuuaauggucucauaaaagcuaauuugacuuaaaguuuuaugaaucuguaacuagaauuuuauuuucacccuaauaacauucuauauaaccuuugccaaacaaagcaaucaauaaauuaaaccucuucuuuuugugu

SEQ ID NO: 989 - RNA, 79890 nt, Mus musculus
uccuucgccugcuugcugcgugagacugaguaacugcuagauccuuggacuuccauucacagcugcgacugaacaauuguugggaauugggcugccgacuguaagucaucaauaaauuccuuuacuauuuagagacuauccauaaguucugugacucuagagaacccugacuaauacagaggauauggucaguucaggcuccauaucccccauugguaggagucuuaggguuacucucucuuagauuccugggaguuuccacugucuuagguuucuagcucaucccagagaugcauuccccaaucuaguugucccucauccaguauacucucccuccacccucccuccauuucaucccuccugcuccugcccccauucccucuuccacccauuucccuccuuccauccaccccaaugucuaaucuauuuccagucuuagugagaaauucaagcauuccauucuugggcccucuuguuacuuagcuuauuugggccugugauuuguagcaugguuaucuuauauguuaugacugaucuacuuauaagugaguacauaccauuuuuaucucucugggucuguguuaccgcacucaguguugauauuuucaaguuccauccauuugccugcaaaauuuaugaugucauuguuuuuaauggcugaauaauacuccacuguguaaauguaucacauuuccuuuauccauucuucaguugagggauaucuaggcuguuuccaguuucuggcuauuacaaauaaagcugcuauggacauaguugaacaaauguccuuggaauaugguggagcuucuuuuggguauaugcccaggaguaguauagcugggucuugagguagaucuauucccacuuuucugagaaacugccaaauugcuuuugaaaguggcuuuacaaguucgcacucucacccagcaguggaggaggguuucugugcuccacauccuugccagcaugagcuguuguuuaacuuuuugaucuuagccauucugauggguauaagauggugucuuagucaggguuucuauuccugcacaaacaccaugaccaagaagcaaguuggggaggaaaggguuuauucagcuuacauuuccacauugcuguucaucacugaaagaagucaggacuggaacucaagcaggucagggagcaggagcugaugcagaggccauggagggauguucuuuacuggcuugcuuccccuggcuugcucagccugcucucuuauagaacccaagacuaccagcccagagauggucccacccacaaggggccuugaaaggaaauaaaacuguaauucauguaauguauguuaaauagcccaaagaguuguuugugagcuuugaaaccuggggcugagaacacagcagaacagaccaggacaugcccgggcaagcccaucuccucccuagcucccaccccucugaccuaaguuaaauguuacaggcugcugauguuuaaauggaccaaucaugugaaaccgcgccaauuccucccccagccccacuccuuuucuauaaaaaccccuagcuuccaagccucguggucgaauccacugucuccuguugugugagauacguuucaacccggagcuccgccauuaaaaaaccucuuguuguuacaucaagguguuguguucuauucgcgauucuugggugcacgccaaaucgggagcugaguggggguuuccccacugaguucuuucagccuuucccccuugaucacuaauugagaaaaugccuuacaauggaucucauggaggcauuuccucaacugaagcuccuuucucugugauaacuccagcugugucaaguugacauacaaaaccagccaguacagauggauucucaaagucguguugauuuguauuucccuaaugacuaaggacguugagcauuucuugaagugugucuuaccauuagagauuccucuguugagaauucuguuuagauuuguacccagauuuuuaauuggauuauuugguuuguugacaucuaguuucuagguuucuuuauauauuuuguaugucagcccucuuucagaugugguguugguagaaaucuuuccccaucuuguccuuuugauguuguccuuugccucauagaagcuuuucaguuucaugagauuacauuuauuaaugguugaucuuagugccugagcuguugguguucuguuuaggaacuuaucuccuauguuauuguauucaaagcuauuucccacuuucucuccuaucagauuuaguguuuccaguuuuauguuaaggucuuugauucacuuggacuugaguuuugugcaggguguuaaagaugggucuauuugcauuccucauucuuuuuuuccauuguauaguuuuggcuucuuucucaaaaaucaaguuccauggguguguagguuuacuucugguucugagaaggcuaggcugaguccaugacagacuucaaauugggauucaaggagacaaauugccuaaaaacugggcaagcccaggcaagucaaauacuaauagaaaaaaaaaaaaucccaggcuccagucuuuaugcccagguaaugggaugcuccagccaucuggccuaaagcaaggacaaugggucagcaacaauuuccagacuuccucaguuaguuacuuccucaguaacaguucccagaucuccccagcaaguuuccagcccccacaucccaguaauggaaugcccauggagagggacccaacagauuaacauagagauuaacaucccuaaugugcuuuaaucaggccugcaagcucacuuggaugucucucugucuuggaaaugaggcagccccaggaugcuggaagaaaacacucuguguuuacauacuguuugauucuuccaugaagcaaggaccuuuacagcuccuagguucaauucaauuccauugaucaaccugucuguuuuuaugccagugcuguggcauuuuuacucuuauugcucuguggcuugaaaucggggauggugaugccuccgguguuugccucccauguuggcggugcuggcgcaguucugcuuccucaaugcagcuugucugggcagguguuucagacagggaucuuugcagcaacuuguuugucuugagcuaggggagguggagguagggacagggacuagagguggggcuugggggaugacacaauuucacugagacaauuuuuaguguuacagcucucuuuauuuggggguaguggggccuauguagacccuggggagugaguaaggguuuucggggugagugcacauuacuggcuggggcugagguguuggcgaugcuucauuuccauaagagggaauccuuauagggagagaggaaguuaaaccuguaauuuuuccaucaggcuaugugaccgacuaccucaaggaugguggaggugcgaguauuaggucugugugccccaagcuugcaaggccagaacagggcagagauuugggguguauacugccuuuauaauguuuagauaugcaccuguaucccugaucucuccaagacuuuuaacaugagaggguguuggguuuugucaaaggcuuuuccagcaucuaaugauagcuaccucagaucuauuuucuauucaauggaaccaguuuccccuuuaaaacucagccuauuucuguauuuuuugaugugugguuuuuuacaccuuuuaacuacuuagaauagauuugugcucuuucuguucgccaagugucuucacuguuuguuucuuccauuacaucgguccugcuggagcucacccuuggcucuuuccacccuuugauuuuguuacuuccagcagaaauccccaccuccauguuaccuacuccaaccucucugauacaccacucaaaagguaucaucccaaaauaauccccaaccgcuguuuccacacugucuuuacaaggucuucccugaagauuuaaggacucgggaacucaagucucauuccuaauuccuaauguccuuccaccaugaccugcauucaaggccugauggguaguuauggugaaguauaaaaauaacgauuucagcaucuuaagagucaucaucaaagucauuugaaagccugcccuacuguuuuauagaugccauaguuggcaauaacaugucagugguaguuauauauucagaaugcuuuacauuuaaaauuguaaucgagcaaauuuuuaucuauaugucuacaaaccauaaaagauggagggacgaaagcuacaacauguauauacuugauggccagaccuacagcuauuuucuuucacaguccucauuuugggcagauggguauauaucacaaauuaagagagagagaaugguguaccagucuacugccuauauuccucuagagaggacuuacuagagauaacuguucaaccuauguaugaguuuguaaaugggaugggugugcuaacccaagaauuauaaaauaagugaccaaauaagaaccaggcuaaaguuuuaaacaguuauuucccuagugaggauaaaagcauaaaacucacaagaaguugugaguucagcaucauggaccauuggaggaacaugaauuacaccuauacugugauguaccacauacguaguaugccuaaaacaacuuuaaaaacuauccauauuaaaagucgguaagggaaagaagacaacacaagucucaaauguuagcaaggcacaacugcuuuggaaagacagacauuucuuaaaauggcaaacauacaccauugaauguguugcuucagaggaaauguaugucuacauaaugacuuagaaucgccuguagaggacuuucuuguaguagucagcaacuagaaacaaucuaaacgcauaucaacauauuacuaaauuuauggauuguaguaugucugaaaaguuggcuauuauuuagcaauacaacugaaucagugacugauaugaacaacacagaugcaucucaaaauaauuuugagugaccaaaaaagaacauauucuaaaauguauguaaaauaguuucuuuuuaaauuuuauuuuuacuuuuauuucaugugaauugguguuuugcgugcauguaugucugugugagggugucagagccucuggaccuggaguuacaaacaauugagagcugccauguggcuucugggaauugaacccaggucaucuggaagagcaccuggugcucuuaaccgcugaucaaucucucuuuuauuccucugcaaauuugcauaaaguuuauauaaaauucuguaguuaacagugacccagaggauccaugauaguagaagacugugugagaaaaaggggugauagguugaaggcagaaggacacauaguaacuuuuaauggcuuuggguaaucucauugccaugauucuggugauacaauaauagauagacaacuauuucaaaguguauuaaguuuuacacuugguuuauguuuauuguauggcaaucaguacuuccaggcaguuuuugaagucacacggugccucaaauucuaagaguauggguuuugcuuuuuacuauauuuuucuuuagcguucaaauaaagucgacauccuauucuuucaacucccaccuuuauuaaucacauucaacacaucuuucagcccccucucucccuaugacccaauccuacacgcuguauguuaucuuucuuccuuccacuagggggcaauaaagagacagguaaaggcagccuacuuucuagcucaagcuuaacucuugccuugacuuccgggcccacuaguucugcuuccggggaacgccgggacuucucagguuccgggaggaaccgugggagcccagcgugucugugccgggcgcucuggcaccucggggcugggucgccgccgcugcuugaaagcuuucgagagucgccgcuacgagccucuggucagcuucaguggcgaucgcugcgauggcggcuccugcgcagcccaagaaaaucguggcccccacggugucccagaucaacgcggaguucgucacucaggugagccccggcgugcccgcuuguguaaggagggaugccgaggaccuaaagcccgggauugggauugauuuugauaucuuguguacgugcaaguugcuaguuaaacauuggaaaagcugcagugaaagaggccgcuccucguuagaccacaaagcgugcuucugaauuguauuacucugacaagacucugucuacaaguagaucgcucuauggcaguuaauugucauuauaaccuuucauuuaggagacaacagagccaauuccgggccuguagccuuucacauccuuguuaauucuuaggaaauuauugagaguguaagugcgggaaaauuuaagcccucccgcgccucuucuggcuccgcagauuugucagggcagaagccuagaaacuguuuccauucgcuuagccccagcaugucuacacaguguuugucuguauuucuggaccucucucgcccaaagaugccuuccccacuaagacuuguugaucugucauauuuccucuugcccuccugcagccuguucuucagauugcuccagagugcucacuggugcaaaccugcucacauuacuugucuuccuacagugucccguaaacaauucugauugucccugggauaaugacuggaaucuuugaaagugcugugaucuggccuaugcuuuuacccaaagugcccuuccuuucuucuuuccucccuuccuuucucucuguaccugucugucugucucucccuccuuuccccccuaauuuuaugcuuuuauggcuauagcugcgguuacuugaauaugccaugguaacuaaaaaguggauccuguuaacuugguuuucuuuauuuucauccuuuuauacaauauuagagaggcuaucccgacuucuuaaccgcauuaaagcuaaaugcagauaaguacacaguuugagaaagaacacaaaaacaguccaggcaagugcugauaccuuaaaguuugaauguaaagaaagagcuagaaugacaggaacacaugaaccgagagggaaagugcggaggagagauggugccugucuuucauucccagcaugugagaugugaagacaguggggaauggaguucaaggcuagccuugucuguuuugaggccagcauaggguucacaagaaaguuuucacauuguagaaggucucuuauaaagucugcugauuguaagauauugagcuguaaaugaaaagaacacacagguaccaucuucucuguuucacuucaaugaggaugaauaaucagugaaauguuuauaauacagaaauagaagaauauauugaaacuguuuacaaccugaaagauggaagcguuaguuguccguuaguguugcagaagcuucuuggaagaagaacacuucagacgugguuucauuuguccguucaucuuucugucugugugucugucuagugauacaccaagcauugaagucuaccagacagugcaguuaccuauuaaaaaaugugcucccuagaguuucugguuuuuuaaaaagagauuuuguuuuguuuuuaaaaaucaguaagaacuauuuuguuuuucaauuuuaauuuuuaauuauguguuugggguggggugguaugugcuggugagugcaguuaucuguggaggacagaagaggcugucaguucccuagaacugcaguuggagagaguuguaagucacucaggauaguacugagaauacaaucaggcccucuggaagaccaaguacacuuaacugcugagccacuucuucacccccagucuauguuucuuaacaguuguauaguccacuucaaauucuggagagauuauauauauauguauuuaaauuucuaagcaaagcuugaccugcuaaaauauacaacaccaacuucuaauaaucagccuuucuacuccauuucuuaaugauuuuugucuacuuaugucuggguauaguagucauuuaaaggcuuauuucuuuacauaucaacauuaaugaauauuuugaaacuguuuuuaaauauuuagucaacugaugacuaacuaaccaugggcagcucacuaaaucucuugagcucuggauuuccuuaugacuggaccaaaaaauguuuuacucugauuauagacaagccaggggcuugggaugcuuggguguuuugagcaucaugguggccaguuaccacacuaagcaucacugguauuuauuggauuguggccaaggacgauaacuaagugguacgccuguaugguaccuuuaaaauuguccaguuaguucuccaguccuagcucugugcuaagaagcagcuuugcaugucuagauggugcacuguugugagccuggaacuuaaacuuaugcuguucacuuuugcagcuagcauguaaauacugggcuccucauaucaagaagaaaucaccguuugauauaaaaguaaguagcuuuguuuuacaauauauuugcaaacagcugcgcucuugguauuguuuuaaagauuaauucaacaaaagcuuucaguacauuuuuuuuuuaaaucuauucacuuuacaucccacuuacugccccuccuuccagugaccugcuccaaaacucuucccucuucccccacuuucuccuuugagaggguggagguucaucuuggguauuucccacucuuguacaucaagacucuucagggcuaggugcauccuuucccaccgaggccagauaaggcagcccagcuagaagagcauaucccaccuacaggcaacagcuuuuaagauagcuuccacuccaguuguucaggacccacauggagaccaagcugcacaucugcuacauagcuucagggcccagccuguguaugcucugugguuggugguucaguuucugagagccucgggguuccagguucuuugacucccuuggucuuccuguggaguuccuaucuccuucugagcccacaauccuucgcccaacucuuccauaagaguccucaagcuccauccacuguuuggcucuggaucucugcaucccaccgagucagccgcugggcggagguucucaagaggacagccauguguagacuccugucuggaaguauaacagaguaucauuauuaguguuagggauuggugcuugcccaugggucucaaguugggccgguuauugauuggcuguuuccucagucucugcuuuaucacccauuccugcauuucuguagacaggauaaauuuugggucgaaaguuuuguggguggguagguaucuuuauugcuccacugugauuccugccuggcuacaggagguggccucuucaaguuccauaucccuaaugcucugaguccuagcuaacuaaggucacccacauugauucuuugggagccucccuuaucccaggucucugucacauccuggagaugcccuuccccuccccaaccccaucaguugcagauuuucauucauucucauagcccuaucuggccaucuuucugucccuccccagaccugauccugaaccccccccccccaauucccuauccccucucccacucaguucccucccuccaucugcuuccugugacuauuuuauucccauuucuaagugagauucaaucauccuugcuuaggccuuacuccuguuuagcuucuuuuaaaaaaucgaaaacugcuuuucauuaccaaacuaauaacuucuuaugucagaaaauguggaaucuuuagaaguuacacauaagaacauaaaaaucauuaccuagagaugacguacauugucauuuuguuuuauuucuuuuaauccuuuccaaaagauguguguguguguguguaacaauuuuccccucuguggauucuuagauuauuuuaaauauuguauuauuacagaugagcauucaacaaauauuccuauuacuauauggcaaguuuuuauacaagaguuuuggcuguucauuacaaauagaaucuuuuguuuccugauugaccuuagguugcuagccugaggaaaagaguggaaagacuggaaacuguuuuggguagaauagaugaaaagaugaauauucagugguccgagggguucaucaaagcaguugucaaacgaguguaugacaggcuucugccuggaagagucuuagagggcuaggcaggccuugcugcagagugaaugcugacgcugcagagcgcugacugguaagugauggacacucagacccucugcucugccggugugcagaguuggaugcuuuaggcggcuuugcuaaagcugcacagagugaguuuugccucugccuccccagugcuggaauuaaagcuguccgccaccacaucuggccuuguggucaaaccauaucuuuuuuuuuuggggggggggggcggguugagacaggguuucccuguguagcccuggcuguccuggaacucacucuguagaccaggcuggccucggaacuccgccugccucugccucccgagugcugggauuaaaggcgugcgccaccaugcccggccuucaaaccauaucuuaaaugaggaaaccaacauuagaaaggucagccacuuguagcaaggucacagccugccacagugaugguuugaagcugucuuucaacuccagaggccaauuuuuaugugcccuagaucaaaugaacagaaagcaugacguuauacucauuuggauauagcaguuauccuuuguuucuguaauauccucacacuuuuaauuuauugucugccuggcuuuuggaaugauuauuagagucuaauagcauuuaaaaucauuuaaaauuaauuuucgaaaauaugacuuaugagguuugcuugucuagaaauguuauaacauccuguuuaaagaauguuguggauuaaagcauauugauuaguuuuuaugugaauggauuuauuacuuguacuacuuuauuuucuguuauucuauacuugagacauauaaugucauuacugaaaaggcuccuguuagaauauuugauauuucuuauuuuauguaaucucuguaauuggaaacuuucaguuuagauuggaaaucaaggugauuaacauauuaaacauuuuuauacuuuuggcaacagguaauugaagaaauauaugaaaaagagaucgucaaaucacgguaggaguaacuuuaauugugguaccuugggauuauauagaccauguggguguaucugaaugucugugugguaccuuaaguuuauguagaccauguggguguguuugaaugucugguucuggucuuagcuugaaaggaucuuuuuauuuucuauucaaaguuacagagauuguauugauuauugcauaguuucucugugucuucuaguuucagagucagaucagagggauuaaacacauaugccuuguuugguuugugaagaaucaagauauagauagauagauagauagauagauagauagauaggugauagaacagagcaagcauacauuuauaucaaguuaacuaauaauuuucuuacuauuucugguaaaucuucuaaaacacucuuaaaauuauaaaaccaagauauaaaauaucuauaucuauauauugcauaaaaccaagacauauuuuuaauaauguacauaaaggaguaacuuaagggcucugccagcgucugacuaauagauuugaaugcucauagccaaccaucaaacugaacauggggaccccaaggggggaagaacuaaaggagcugagggcguuugcaaccccauaggaaaaacaacaauaucaaccaaccagacccucccuacccccccagagcucccagggacuauacacauggagggaccaauggcuccagccguauauguagggaaggguggccuuaucugccgucaaugggaggagaggccuaugguucuguggaggcuugaugcccuagcauagggggaugcuaaggcagugagguggaagugggugagucgaugggugagcacccucauagaggcagggaagaggggaugggauaggggguuuauggagggaaaacugggaauggggacaacauuugaaauguaaauaaauaaaacaaucagaaaaaaaaaucucaccccaaaacaaacaaauaaacaaaaccaaaaaccccuucccuguuccuagucgucaggguguccaucuucauauggaguuuuuaucuucccuuuucaccucacauggaagggcuuaggcccucauucugucaugagaugccuuaaaagaaauuaauauguguauuggucaucauuuaauguauuuacuuguagauaauguauggccaguuaauauuuuucgaugauauuuguuuaaauguuguaauucuauauuuuuuuuugagauaaagucuuauacagcucaagacuggccuugaauccuccugccuuagccucuuaggugcugggauuacauuuguguaccgccaugcaagcucaaacuuuguagaguccuuugcuuaguauuuuaaugugcuaaaucuuuaagaaguaaauuuuccaaauaauuugaaggcaaaauaagguaguugguugcguacaccuuuaaucucagcacucaggaggcagagaaaugcagaucucuaugauuucaaggucagccuggucuacauagugaguucuagaacagccagggcuguuacacagagaaacccugucucaaaaaaccgugacgaugaggaagaggaagaagaggaggaagaagaggcagugucagaauaggggagugaacguuuaaugguuugugaggcugcuaagaguuuuuauaacaaaaauugccaccuacauuaaaagcuuuaaaucaacaguguuuuagacuagugccugaggaaauuauuuugcugagcagugugucaucuucaguaucuagggaauggcuugauguaauauuuauuaaaugguuauaauauacucccaaaagaagcuguuuuaaaauccugagauacuuuuaauaucacaguacucauuuauucagaucuuaauauacuugugguauaaaaauagauacuucaaagacuuuuuugccuagucaaguggguagagugucauguuacauaauuuguucauuuucauuauuucuugcaaugucaguuuuggaaagcuucccuuacugcauuuuuaugcaacuuucauuuaaaaucagaguuguuacugucuguuuccugugugcuggcuuugcccuaagcauuuuacauagaguaguucauguaccccuccccuuggaguuugagauacucuuacugcauauggucuaggaacuugauucaggcuccucacugcucaguagugagguacuggucuauucccuuggcucuuguccacuacuuaguuuauuagcaggaauggccuccauuuucuuacaggacuuacuaacuuauacccuuugaauuauucuuaauccuguugugaauccaucagguggguuuuaugguagaaaaauaaaacagugacuuauaaaauacuguaucuugcuacuuuguguuucugucuauuugacacugaaagggugcgguagcccuuacagguuagaaugcuguaccugguuagaaacaaagggaacuuggauuuugucugcauaccagaggcugcugcuuguugcuuccucuaacaucuuaauucauaagugaaaacuaaaggagaugaaaaguaaauaugauaggcucacaugguuuuugaacguuaaauaagcaggcaggcaggccagccagacaccucaccagguaaaacacuugccucccagaccuggagguucagccuucugacuuccacacacauugugcuguguguauguccacacauaucauguauucauaaagacauggcccuguuuagcaauugaaaauacuuuuuucuccuuauacaguuuucagugugguugugagggugauguacaacuccaagucccauguuuuugcacaacuacauccugggaaguuguaugguaguauagcaacuuacauaucugccuccuguuuuuuaucagcuaggggauguggaugccgguagagucagugcaccuagguguuauacacaaguugcccaccuuucgauggacgaaugaaacguguguuagguuaugagcacagcaucaugcuugaugcaugcugucagucaauauuggcaucuuagaaaagcauaaagacugcuucccacauuuauagugugguuguuauuuguagcuauucaucucuccagaacucuucagugcgaggacaguugcugggugguugcucuaucuuacacucacccuuuaguaaagcugcugcccagagugucacucaagcugucacauccacuguguagccuugcugaacugugggagcggauguuugucauuguuccuucagacuucugcuuuuauaguaaaagcauucauuucauccuugugagaguucugugacagugugcgcuuggugaaacuauuuaggagaucagaaagccguggaguaggacuuugacagguuaaugaucuccugaggagugguaacugugauuuucaaaucuggaaacuauugccuauggcaguguucaggucaggcuacuauuuuucccaacuuagaaaguaauuaagagaaaauuagccauuugaacugacuuuggagauauaucucauuaguaaagcuugguuuauucauauaaagccaccuuuauuauaaaggaacaguguaacaaaagaaauaucuaguauucuccgcaaucaagacucaaaagcaugagacacaucggacgucugcauuugggaugcaggcagccccugugcccugugaugaugagagccuuagagcuuuccaaacugccccaggccggcuuuuagcaccugugaucagauguuuuugauuugucuuuuuuaauuuguuuacagaagacuccaaaugagugagaauuacggucucugaaauguuucuauuuucuauucaaaguuguuuugauuuuuauguuuuagguuugccaucaggaaaauaaugcugcuggaauuuaggugagugaaaucauugcauggguggugaugaggaugcccaugagucgaguguucauuuccaauacagagcagaguucuguaggcuucaggaacagcuaugauacagguuauacuuauuuaguuguuuuucacuacuuauaaguggucugugggaauaaaucgggguauacucuauaucuacucuauacucuauaucuauuuucuuccuucuuagcuaaauuuuuguuacuaagacaucauuguuccaaccuaguuauaaaccuaaauguuuuauacagaagaaaauguaauauucuuccugaggccauuacacacguuaggcaugugccaccccucugaccuuuaucuccagccggagaacaggggguuuuuuugguggugguagugguggugauuuuuguuuuucguuguuguugucgucguuguugaguuuguucguuugcuuguuugcuugaggaaacguuucucuauggugcuuuggcuggccugaaacucacuguguagaccaagaugaccaggaacugagagauucaccugccucuguuccugagugcuggcaugaaagguauauaccaucaugccuuguucacacacaacuuuuaauuauaaagguagaagagaccaugccacguccagguuuaucuagcuuauaaaaauagaaauaguagcacuguucagcauagacugaacaugucuuaaucaguguuaaaugcuuuguauacagagcacaccuagccacccugaaauagagguacuauccgcucuaauuacugaacaagcagaacucacagacauuagguaauuuuuuucaagauggugcagcaaaguuauugguacaguauuugaugccaaagcucaaagccuuucuauguuuuuuauacuuccuugaauucuggucugcaucagagauaagagccucuguguuaauuccuuauucccuacuguaugccuuucaugccagcacucaggaacagagacacguuaggcugccagcaccagguaaaaccuuggcuuccucuacacuacagcuucugugugcagagcuugagcaaacacuucccaaaagguuucaccucagugaugccggucuccucuuaguccccgcuccuuuccuggcucuaggaaagcagcaucaauuauccugacuaagcaaagcuuuuacuucauuggugauggucucuuguuaauuacagcugauucuucagcccuaucugaccagagccauagguuauuaauuaaaaacauuaaauggcccccguccucuaucaugcuccuaacucucagcauuacccuuuaaucuuucaaauucucacagcagcucacuaagcuucgaauacucaguggcuuugcuaguguaaaguuccaaagucuuccacagcccuccccagaaccugaucaggucuguccugaaaauaccucgcuccagguaucaacuuauguauuuguugggguuacuauuacuguaaugaaaagccaugagcaaaagcaaguuguguuggagagcauuuauuuugcuuauacuuucauaucacuguucaucacugaagaggucagggcaggaacucagacagggugggaaccuggaagcaagaacugaagccaugaacaagugcugcuuacuggcucacuccucauggauucuucagccugcuuucuuacagcaccugggccaccaacccaggaaugaauggcacaauccacagugggcugggccguccccacacuggucaucaauuacaaaacugcacuacagccuuguccuuaggccaaucuaguggggcauuuucucaauugagauccccucuuccaaaaugguugucacuugugucaaauugucagggaacuacauaggacaccgauguaaacuaauucaaucuucauuaaaagcauggcauuaaguaacugaucuuuuuuuagaaggaaauuguaaaguuuaugguuguaaauuagcuaguauacccuaaggagucaguuuuauucucacaguaaucuuagaaagaucuuucuggauuauuguggagaaaacugaaucugggaaagagcccuuucuugucaugggauaaguacauacuugcuaccauaccagaccucuuuucaagcaggacauuagguugucauuaccauaacaacauaccugaaguagucagaaaagcuuuguuuuggcuagugguuucagagggaucugucagugguaauuucagcuuguuguuuuaggcuugcaauagcacaguguaucauggugagaacuguguucaucucauggcagccaaaagcaaagaaaauucaggaagggcuagagccccagaauuccuuucaggugcauauaucuagggacuucucuucuaccagucuccacuuccugauggcucuucugccuuccaguagcacaaccagccagggaucaggccuuuaguucaucacccucugggugacccucacgauccaaacucuggcaaagacagauaaaaaagaagauguugguauacaguuaagguuaauuagucuucuuagugucaagaaaccaaaauguuuuaaugacugcauuaaggauagugcaacauuuuuaauuacugaaagguguuaauugacagugugauaggaucuagagucaccugggagauacgccgcugcguuuccugugagggcuuguccugaccaggauuagcucugggaaugucuuccagggauucucuugagcaggugucaguuggugugggaagaacccucuuacucaugggcagggccagauguggaagacggagaagcacuggcauucaucaucuccugauugugacaaugaguuuaagauauuuuaucugaggaaauuaauuagaaaauaguaaacaugggaaauaagaaaguaggaaauacagugucuagaaugccaaagccuaaugggacauucaggagguauggauagacaaugggaaaggggcaguacugcagacagacucuuugaguuuucaagaagugcacaacuucauuaaauuccagaaacacaacaaauaacagugccgcuaccaagaacuaaaguagaacaaagauuuaaaaucugccagagcaaaagucaucgggaccuagaauucuacacccagcuaaacugucaagaaguaaaugucagcuaaagaaugauccucaccacauuauagcugacagaaacucuaagacaugauuuaagaagaagaauauucacauaagagauaaaacaaauccucacucauggacuggauaacagucuggucucugacuugauucuuuuaacuagcauuuguuuaaaaucucaucgggcuuccuaaguuauugcaaacuaaccaagaaggaauucuauaccagcucuggugagcuccuaagguacagaagaacacagaaguagaaaaguauaacauacacacacacacacacacacacacacacacugugggcacaaguuuguagaaaguuauagcugcagucauuuaacaugcaggagcacagaguucuucuguuuucaugaaugcuugacaguaucuuguagcccaauacaauaauuuauguucuauuuucuuuaauaaauaguaacuuauguuuagaaggucagaaauacuuaaauuucauauguucacauuucuguaagucuauaaagaguuuuaguauccagaggggaauuaucaguuaccuagaaaauuauguugaauuaccuuuuaagcugaguuguaaagccucuuuuugaugguugcaauauguuauaauucuuuuuuuuuuccugauaagaacuaguacaaauaucugaguuauauuuguuugugaaaauuccuaugauaucauuuugguuuaaagcuaauguuuguuaaaugauuuuauuuuuacuccugugugccuucaggucagagaauauucagagguagagacuuuuuauguuaguggauuaguggcuucucuuguuguugugacaaaguacuugccaugccauuuaaggacagaaaggucugguuggggucacaguugaggguacaguuguccauaugaugguagaacaagugugaaguuagagcagcuggaguuguggcagcaggaaccaagaugacuggucacaucaccuccugucaggucauggagagccauggggacugcucagcugccccuguacugucucccuuuuccuucacuccaggaugucugcauucaggguuagauguccuuccucacuuaaauaucucuauaaauguucucacggacacacccagggauaugucuccuaggugauuaaacucacccauaaagaucugacacuaacccuccuuugauagcuucuugcuuggaaguguggcugugucauucucugagccacgguuucuacaucuacguguccgguggcagcacuggggcagagcacagggaaauccagggaagacuugucagucauaaguaaggauuuuagaaaauagaaauacuucucuuucaggugagugaugcaguacagggucuggugauaaauaaugaaauauucuauuuuuaaaaauccuuuacagccaauaccuugaaaauuaucuuuggaugaauuauucuccggaaguuuccagcaaggccuauuuaauguccaucugcuguauggugaaugagaaguucagagaaaaugucccagccugggagguaaaaacaacuaaacuacuucacaguucucaugaugguccuucuuaaggcgauacagaguagcgggaucuuuuccugguagcaguguccucuuacugccaacacuuacccaagggugaagagaguauugugagacaaaguauggcuguguaaaagguaguguuaguuuucuuuugauuguauuacuuccaacugauuuucuaggacauaaauaauaugaauguagaguuauuuuucucuguugugauugagaaaaggacuaauauggauuauaaugacuuacauuuagaauuggcagaguaaagguuacauugauaacuauaagagguaauaugugagccuugacgggugcuuauacuguacuugcagauccuucucuuuuuuccccuuucaauuugggacugcuuuugccauuugaaaauuucuaaugaacugaagguuucuuuagagucagcagagccuuccucacaguguggugcccuccagagauggccaguucacuaagaguuuccuuaaguaaugaaaaagcaucguaauugccgucuuuuugaugaagugguuuacaaagugauaaaguguugaagauagaguuuagagcugucgagauuaaagcaugggcauuucacucagauacuaagugacugucaucucagggcacauuugagcucagguuaaacuauggaccauaaaccuuacugagacauccuagggcucucaggaaguugcuucaagacauuauagagaguaagauggauuuauuuuuaagccaaguaauacuuucaucaacucauuuauuauagagaccacuuuaguaauuaggauuugaaacagaggagugacaaugcaagaaucccccauuuuguacagggauacauucuaagaccucaguagauagccauauauguuuguguuacuccauaguaauauauacaguauauauguucauaaauuauguguucauauauauccuuuccuauaagcauuagaauuaaguucuauguaaguugggcagcgugacagaaagcagugauuaauaauaaaauagaauuauacuaugcuggacaugaauugucaggaguacuuuucuuguauuguggagugauuauuauggaaaauaaaaguuaaguuagccugcuggcugagaugaagagucuagauggcaaacagguuauauagacuggauacuagggugugauugauaugcugagauccuagggugccauugauaccccaggccaaaucaaacacgguuucagcacacuccucaaaacccugugcagcugaaaacacagggauuguuucuuucuagaauuuuuccuuuaauaauuuuagacuaguuggugcagguaacugaaauuacagaaagcaaaauuauggauaaagugcagcuaucauagauucagaggacaauauaagauuuuaaaauaaacaacugacuggauuugauaauugaagucguguuagggaaauguauuauuuucaauagcuuaccaaauguaggcaacuaaaaauaauaggugacggugccauuuaccguaaagguaagaauagaggaguggaggaacucaugaaaggcuuuuuguuuaggcuugaaguuuaaauugccuugugaugaguaguaaaacggacaaacgcaaggaucaggagcuaagggucuggacucuccagaguccaucuucagagucauuagcauaggaagaacagugagccagagccuuagaacaaacugccuucaagaaacaaguaacuaugauaacagcugcugggcuaggaugugguucagugaacacuuucuuagcaggaaaagaaagaaaugagauggugcggguccuguaggcuuggcugccauuagugucacggggauguuguugguagaggcugauuuagagaguuaaguggaaacacauacacuaauccacacaucucauucacuugucugcagggccuugaauauauauauaaauuaauuuacauuguaagagucacgagcagaauugagcaggagaagcugucuugagauuaauuacagcaugaaaacuauaguuuuugcuggaaauauaguuguuuuguuuaaaucaaaggaauuaagauacuccaauaucuuaauaagaaaacaaagcuuuaucuaaauaaaguauaacugaacaaacacaagaacaaguaagagaauugaaggcucuauucugucagcuugaggucucucauaguucugucaggagcucacugacuuacugucagugaugagaggucugcaggguuucuuuuaucacauacacacaucacaugaaaugacuuguguuaaucuaucccuaaaacccccaccagggauucuaauaaagaaaaaugcaagcaagacucaaagugaauuuuuuuguuccuuguuuguuucuguuuuuugaaacaggauguaccacugacuguccaggaacucaugcuguagaccaggcuggccucaaacucagagaucugcuugccucugccucccguggugcugggauuaaaggccugcgccaccgccuccuggcucaaggugauuuuuuuuuuccuuugcagaccuuuaagaagaaaccagaccacuucccauucuuuuuuaagugcaucuugaaagcggccuuagcugagacugacggcgaguucucccuccacgagcagacacugcuccugcuuuuccuggaucacugcuucaauagcuugguaauuuuacucugcgcucacaguuucagagugagauuagaggagcaccugacggcugccacuucuugcguaguagugguagagagcaaagcggaugcugggacuucaguucagcaucucugacagagauagauaagccuuguugccuuuagaaguuuggacuugauuccuccucuguuacugaacuuaaaaaaugaaaaugagaggaagaagggagagcaugaaugugaggaggagccaagggccugguuaauaaauacuuugaacaaugaagucugcacaguguucaugcuaacauacagucuuccuuuguguggugugucgugugcaggcuagcuagucggugggagcgagcuaugcuguaaucacguugauugacuggguggucuuugagaugucuuguuuuguugugauacauuuucauccuucaugaaaucauccuguaaaaaaggaaaugaaauauuuuuaguaacuaauaucuuaccccagcuuccucccuaugcaugucugaaaguguauacauacuuguucaaagacagaugcuucugagcuaaucaugccuuagaccuaugcaggaaauagaguccauucuucaccugaagacaagauacuguuagaugagugaugacuagguuucuaucugcucccucauggcguggcccuuguaaagacauauaagaaagccuacgaugguuugugcucucucugauuacuacagggaguauucauuuggacguuacgaauacaauuugugaauaagugauuuuuuaaagcugaaaauaaugaaaacugccauuuuaaagugaaaauuuuuaaaagacugauuucuguguguguguuuauguauauguguguguguauuguguguguguguguguguguguguguaccagaggacgccagagaggaugucagauuccuagaguuggaguuacacacuguugugguccucacaagguucaugcuaggaaccaaacccuggcccucucuaaaagagcaagugcucuuaaccguuguuaccacggaaccaucucuagucccuuguugaacuucuaaauaggaaaauauuuagauacuccaaaaucuuaauaagaaaacaaaguuuuaucuaaauaaaguauaacugaacaaacacaagaacaaguaagagaaguauugaugacaucuuuuucucccaggacucuaaaaggaaauaaacuauguauguaggaacuuggaaauguauaucaacuauaaacguguuuucuuugucuuuaaacaggaaguagacuugauaaggagucaggugcagcagcuuaucucgcucccgauguggaugggcuugcagccugugaguacccauugcagaaugucuccauguagcugauagauacaguuucugacugaugguucuaacaugaacucaaaagugugucagcugacaucuacuuccucuguaggaaucuacuuuguaauaacuuccuauaaacggagcuuugacauuuguaaggguuguugcuugcauccuaauguacuuaauuuuaguacuguaaggugaaaugaggggcuaauauugaacuugaagagaaaagugaaaacuuagcaaacaaaguacaauuguuauccuuuuguauguauuuggaugagguuaaaugcaaccuuggauuuuauuuuccuggcuguguaugcagcuguagauggucgggaucauacucaauauuaaccacuucuguuuuucuauucucuuuauuaaaugcuaugugcauaauagauuaauauauuuccugugucaacuaaacaugaccacuuuucaguguaaugcuuuguuuggcauucugcuuccuacucuuguuucuucacacacccaaugugcagacauugguacagguuggcugagugagacacauauaaacaauacuaaugagaaagugacagguagagaggagaaagugugcuggugugagcaccuuuuguuucuuuuguguguuugaugagaugggaucuuguguagccuagacuggccuggaacuugcauuucuuuaucaguacugaacauaugggcaugccccuugcucagacaacuacuccuuauuuuggcagaaguuucucccucccaccuuccgcuucccaccccaguucuagggauugaaccuagaaauuugucaugcuuagcagagcauguaucacuaaacuccaggcccagccuugacaauuauuuuaauguuuauuguuggagauucagauuuuuuuauuucaguaauaaugcuuguaaacauuuaugcuauuuuucagauuuuuaaguuuaaaauguuaauuuuagaaauaaauuauuagcuuauaauaaugauuauuaaagguaguuucuuccauuuuauuuuuauuaaaauauagaauaguguuuuuagaauuccauaguuuucauacuuugucuuauuguguucagauugucauaggccacauaucugaagagacuagcuaauguucaaucuuaguaucacaucuguuaguguuacugauugcuguguaucauauuucucuuuuaggcacgauuggaauuagaauugaaaaagacaccaaagcuaagaaaauucuggaaccugauuaaaaagaaugaugaaaagauggacccagaagcaagagagcaguaugugggccaagcuuucuuccaccuuaggcuuugggucgugacacugugguuuauugcuuccuuuuauguagugcugaauccaaauaaguuaccagcagacgcuuucccuuagauuaauacgaguauuuuacagagaucugcagugugugcuuggaggccagagaucagugucggcugucuuucucuagugcucucucccuuguuuuuugaguaggucuuugacuguguagccuccgcccccugguuccuccugugccuccugugucugguaugacagagagaugcacagccccaugccaggcuuuugacauggcugcuagggaacaagcucaggucuuccagcucguuguacaagcacuccacugcccacugaugcaccucuccggcccccaaguagauuuuggucacucaccgugcuuuauauuucuagcaggguuuauuuuacaugauuauuugcagcuaucuauugcucgauguuuucuuaauugaugguuaaaucagggagcaggaauugacuuuaaaacugauguuuaagucucuagccauuauaauccucuuccuguauuugcuaccuaccuuaacuacauuagggauuuguuuuuuaggauagccucacucuguagaccaggcuggccuugaacucacagagucccucaugcuugugcuuuccaaguacagagauuaaaggcaccugccacugugccuaguuaaacaugagauuuuuuaaaauguuacguguguggggauauuuugccuauauggguagaaguauaccacaugcguguauugucgugaaggccugaggagugcaucccaucuccuggagcuggaguuacggaugcuugugagccaccacguagguucuuggaacugaacuccagcccucuggaagagcagcaagugcucuuaacugcuaagccaucucuccaguccuuaaacauuagacuuuuaaggcuaguaacaguauagauaaaauuuugaaauguccuaugcugcccugaccccagaauuuagguagaaacuuauaauaacuggaggagguccuuagcagggaaauggggccagugaugaggcugcuccuuucuuccugugacuguaugaggaggacacuguaucaaagacagagcauuugagcagcucagugcuuacauuugccuuuuauagcuacuucagagauaauuggguuacuguuugauccuuagggccuaccaagaaagaagguuucucucccggcucauccagaaguucaucuccguguugaaguccaucccgcuuucugguaaccggccgccuuuccucugcucgcuguguauuguuacguaguugccauccuggacuucacuuucgucuacucugaacaccgcuccuagaaugauuuaaaacucuaauaacagacguguguccuuuucauuuccuguauauugccggccugagaguugguucugccugggaggguuauuaaagcaccaaacaguuauugaaauguuuauuucguuaguaaauguuuguauuugcuuaccaggucugaguucucugcaggaggcuggggacaauaguacauuagguguuuaugaucucauuugcuacuuuauaauacagcacugaauaguguuuucacgugguaggaguugggugggaggaucagaaguguuuuuaagauaguuagcuaccacauaagaugggggaagcucaucuuucuuuauauaccaugugucuuuauauaucauguuuuuaaguuagcguacaaaguaaugggucucauggacuguuuguuuauacuuuauucucauucuucucccucccucccaccaucacugcccucucauuccaucccucauuccuccuguuccuagcuucugauccaccuuccucccgacaaguaccuucccuucagauuucauguccccuguauucaguuggcuaccccgccaaagaucuuuucucuucucaaggucaccuuuuuagucucaugaccuaagcacacauaagacucauggucacaugugugcacacacacuugucugucugucuguauguauguacauaaguuuaaauuuggguucugcauaugauagggagcaugguaguugucuuccuugucuuucugcaucuggcuuauuucccauaagaacuucuaguuuuuuuuuccauuuucuugcagauguugugacugcauuuuuccuuaugcccaaauacauuucuuuuaugcauauuauuacauuuucuucaucuauuccucuguugaugauaucauugauuguguuucuuagcuuuugugaacagugcagcuguaacaugcauuuguaagugucucagcaguaggacuuauaaguccuuuggauguguguccagggcuggcugaguuaggguacuucucuuuguagucuugagaaaccuccaacugacuuccauaguggcuguagcccuguacguguucuauaaguaguguaaacauacacuugucugucugucuguuugguaccaugacagcauggcauuagggacuaacgugacugggguggcaagggaaugaagaaaagacagacauauggaggcacaguaaagcuggagucagguggagaagccacaguacccagaagcucuguguauuuuuguauacaguugaacaaggagacagguuaugguguauaauugaaucgaggaggcagguuuaauuaaucucaguaggagcagucucaggaggggugcagucuuuagauugucgucauccaggagguaaagaccugaggaaagcuuaaccaugcuucugagcuucaccaggaggacuucgcaacuuccgugaagcugagcugugggagucuuugauguggcugugccuuuggcaacaguacacacccacuggcgucuuauuuuguguauuuauauaguuaguuauucauuaaucuuguguauuuaaguauuuauuuguuuauuuuagauuagaucuuucuguauagaacauaguagccuagaacucgcuaucuagcccaggcuagcccugaacuugugcuucucccagagugcugagaguguaugagcuggccuaccugguuucauuuggccuaggauaagguuagaaaaccaaguucuaauucuccauccuuggcugcuugcuuucucuuucccucaguuuaucucuuagaaaacgaauuucuagaagagacauuuccugucucuucuagauauuaauuuguauuguuucagcaucuggguagcagguaugccagcuggaaaagucugugaggaaaacuauagauaacauuuucauacaguagauagaaacuuucagauuucuguaacauuugaccuccauuuuccugcaaauuacagauaaauaaaagcauucuaaagcauuugugggguggcuuuuauagauacgguacuggguuagucacugcuuagagucuuagcuaagcaauggauaaaaaacauugugugucaauugaaacaauguugacaccaugauuuuaggggguaagugguaggccauuuccugacauuaaaaaaaaaaaaaagccaaaaacuuacacccuguaaguauuuuauuucacaagacuguaguuauuuuaaaguaaauuaaaauaaauaguacauuguguucaugaauaccauaaaucaguguuagauucuuuaaaaauuuauauuuuucaauauaucauugaaagucaauguucauacacucuucuaaaucaauauaauccaauccccuccccccuuuuaaguuuuuuuuuuuuuuucaagacaggguuucucuguguaacccuggucaucuggcuguccuggaacucacucuguagaccaggcuggccucgaacucagaaauccgccugccucugccucugccucccaauugcugggauuaaaggcgugugccaccacugcccaguauaaucauaaucuccuuuuaagauuaaaaaaaaaaaucugugcagggacaguagaagaauucuuucuuugguguauauauuuacuacuucaaaguuagcuauaaacaucgugugugugugugugugugugugugugugugugugucuaucaugaauaagcacaaucauauguaggcaugcacauguguuuauucaugagaauauuuaggaguuugguauaucaugauaaugaagaaagcaaacaaacucuggauagaaaacugccuuucguuaaaaagaaaacuaccuuugauuuuuaaaaacacuguauuuuuuaagacugaagagauggcucaguauuuagggcacuugcauuucuuggcaaaggacccagauuguguuccuaauacauacauggcagcuuauuuucuauaacugggccuagaggaucuggugucuucuguccucugcaggccauagugcacacacauacauacauguacacucauacacacaaaauaaaucuaacccuauaaaauaauucaucauuuuuuugcacaucagauuaauaaaacacacuucugacccagucuaaguauuucaguuucucauauuaguagagcuaaauaaugaugaccugccuuugagaaaauaugagaucuuauucugaaugauaguuccgcuagaaagaacaagacagauaauuuuguuuagauuauuaaauagcugucaaucuuaagaacuggcacauaaaaugguuugguaaaauucugacauguuucucucacgucuagagccugucaccauggacaagguucauuacugugaaagauucaucgaacugaugauugaucuagagguaagaaauaugugguggcuugcuguauauucaacaguaagaugaagauuguugacuacaucugaaauacuuaccugagaugucccuuggucugcuucuacuucaagcuuuuauagacaaggaggucuggguuugauuccuugaggguuuguacuaacuauccuauuggcaugggucauuauugccuuuuagaauuaugguuuuuaaagaaaauuucauauaguuaggugcaagauucuuauggaaguucagaucuaaaauuguuguaguucggaguaauccauuuccuucucccugauagaggaaauugaaagaaucugucccuuggcuugaagugaguguuaaaacuauuagacuagcaaucauauaugcucucaccgugucauaccugagugacuuugucuauuggaugacgucauugauuagauaaguaauuauccagccaucagucucaguuucuccucacugucugucuuauugccaucagggaaguggggacaggaaauggaaaagagcuuugcuuuuacaguuaaacauggaacauguacugcauguacuggcguuccaugcagauuuuauggaaaaacuacaaaaugaagacaggcagugagugauagcacacaccuuuaguuccaccacucagaagacagaggcaggcugaucucugagugccagccuggucuacagagggaauuccggggcuucuaggucuacacagagaaaaucugccuugaaaaaccaaacuaagcaagcaaacaaacaaacaaaaaaagccaacuccuacacgagauggucugugaggcucuucugugucauccuuuguaaaagggaaaacauugccacuggguguuucuuguuuucauuuguuuuacagcguggaugagacccuuuguucucuauaccgugugucugugggcaggcgggagggcauuuugugaugucgauuuaucuuuggcuucggggaguacguggaaaaugagcgcuuugugcuuccccuugccaggcucuacuccccacgaggcgcugguuuaacaccauccuggaugacucccaccuucugguucacugcuaccucuccagucuuguucacagagaagaggacggccaucuguuuucccaggugagccuaggggaucagacacauuuaauguugaaaucucuuaaguugguuguugcuuagccuuauagcugggaggaccaaggcuuaagccaaagucaagucuuaaauacugaccuggauacuauaaauuucugguuauuuuaaaguaaaaccagaauguauaaaccgaauacauacuugaacgcaccugcacaacuauaguaauugccuaacauguauguuaacugcauguuccuuuauuaucaagcuaaauuaugacuuuggaaguguagucccauguguucacauauuucacuugugugcauaaccacugugggauauaaccgguauaagcauugacugcgagugaacuguaccccagugccauggcucgcuccugucugugacagcaguggcaggcaguugagaguauggaacuuagaguaggaaggcaaauguacuuuauugauuuggaaaggaaagaauguguuuauuucagacuuccuguauugucaagugaaagaaaauguagugagaauaaauuggagaugcaggucucauguguaugacauacucuuaucuuaucuuacuaaggacuuuuuuuguuuucauucaaaaaaaaaauucugccaagagacuggccacauauauuaacuccuaguaauugacuauaauguaucacagguuaggacuaaaaauaauaaauauuuaagugauugcagccagaauacuccaugugcagaaaucaaggccucuucauacaugcucuaagcuuaagagagaauccuaagagggagaaauaguacacuccuguacuacgcuuuucuguugcucugauguuacgcucugaugagagcagcuugggguggaaagcaucuguuuggcuuaaacuuucaagucacaguccauccuuggaggcaaagccagcgcuuaaguaggaaaucaaaguggagccacggcgggaaaggcuugguagauugcuuuuugguucaugcuuagcuuuuugaaagagcguagacccaucuuccuagggaugucaaucaccagccagaacagucugucacaggacagucuaauguggaaaauuccuccauuguauugggauuguaguugauacucucuauagcaguggacuauguauaucgcauauaggcuuaauaauuuauuuaaaaaauacauuuuauuuucaugaaacuuaaauauguuuggauaugcucucaaguauuugcugaauaaugcugaauucuaaaauuuucaaccccugaacugaaauacacauagaucuuuuauuauuuuuaauaaauagcgcuguauacuuucuuggccccauguucacaugguuuauuaauuuaaaugaauccuuccagcuuuuagacaugcugaaguucuauacuggcuuugagauuaacgaccagacuggaaaugcucugacagagaacgagaugaccacgauucacuaugacagaauuacaucucugcagguaagugaaugcaguguacccaguaugcaguuccuuaugcuccuuguugauccagccuggaacuucagcuuuguaauaugcaaauaaaaaugguauuugucuuaggguuuuacugcugugaagagacaccaugaccagggcaacucuuauaaggacagcauuuaauuggggcuggcuuacagguucagaggcucauuacauuagcaucaaggcaggaguguggcaacauccgggcaggcauggugcaggcagaggcugcuagcagaauauuggccuccaggcagcuaggacaaggguauuaaaguccauaccuacaaggcuacaucuacucaacaaggccacaccucccaacagugccacucccugggccaagcauauucaaaccaucacaguauucauauuguuucauccucacuuguuuaaauguuuuuuauuuugaugaauuuaugaaaaaagugacuuucaugguccaucugaaaccugugaaucuaucugcuggaauuuuauuucaugguauuuauuuauauuagagggcaugagguccuuguauucacagaguggcugucuuuucauuuacucucaguugguuagacgacauugauuccagaggauuccagagauccaaacaagaguagagcaggaacgugccauauuuucagcuuccuccucuauacacucuccagugcugugccccuuggggguuuccuuuaguauucuucggcuaguuuuuaguaauaaaaugauauuuggggcucagggggguuguuuuuuguauuuuuccacucaugccaagaaagcuacauacaugccauuuucauaucaacauugugggggccgcagaaaccuggucuguagcucugacaguguuuccuuaucauagacaaagcccuggguucaaucaccagcaguggcagggagggggcacuaaccagauucuguugucgcuuuccugcuguaagacccccgaagcugggccucugcucaagucccgggaugagcuggccagcaccccaaugacucgagagaaaaccacaccugaugcaaacugcaagagguuuauuaucagcuagcugaggacaaacuccuucgcugggccgggcagggaguucgaccccaaguggugacaguaggggacuuuuaacagcuagcugaggaguugagaggaguugagaagaguugggaggaguugggaggagaguucuucucuuccagguauccuuggugaaauuuacaaggcaggaguggagagugaguucuuucugaauuuuuaucuccauguccucggcacaggaagccaggcaagugccuggcugggucuuuuacaauuauugcaucucugguuguaaaguauagaaacaaaaaggcuuuuugcuggcuauagagaacaaagagcuccuuucuggcuguauuuuuagagaucggggaaacaagcuuggggaacauccagggguuuuaccuuccagggagaaacacucuaagucggggucccacacugccagaacaauuucuuccuucccuauugcaugauacgccucuaguuuaaugaggcggggagcacgugggagauaaacguaagaaggagugggaaauauuuauccguuuauuuacuuacuauugaagugacagaucaaaggcauguaacagaugucuauaaaguauucacccaaacacuacaguucacacgcuuguuucagcagcucauggaacugguuccaaaauaguucacauauuaagaaaaaaaagccagcccccaaugaauguaugugaaagugaaauaauacaguguguuuuaucuggccacaauggcauaaagccagccagcagcagcaagagaaaugaaaguacgcaaacucguggagacuaaacagcacacggguaagcguaugcgcuguguguggccuuggagcuccaggggcacagacauuaacuuggcuuugcuuucccagagggcugccuucgcacacuuccccgagcucuaugacuuugcccucuccaauguggcagaaguagaugcccgagauuccuuggucaaguuuuuugggccucucagguaagacauggaaagaacagcauugucuccuaggcuucgcugugggcuuuucuuucuucucuggcgcugcgggcugcgggcuggcccuuugcuaaccucaccuggugcucaucucuagcaguuugggauucuugacucacuuaaacauaauuacccaucuuuuucucaggaagugaugaaaggauguuuaauaacuuaaacauuguucuuugaguaaaacacuaaccuggccaaaucucacuagccauaaacagcauauaacagaaaccaguaaagcucauguuugauguuagagauaugaccuacaaaaauauugugcucuuaagauagaucaauaauaauaucuguuacauaucuacuagucuauuuuuggggaacaguaguaguuaguagcuuauuugcuuuuuguuuuacucuguacuuccacaagccguggcucuucagagucugcgcaggcugcguuggugcccacugugcugccuuuggguggcuuuccuauugaguugucagugcauuacacagucaaugucaaaagcuguuucuuuggccuggaaaaaaacaaaaaagucgaaaauagauuagcaguucugguguucagaauagaaaagagggauuuuagagaaagacaaaacauuuguguugugaaagaaaaauguuacuaauaaaaggaaaaaagaagcauaauuuauucuuucacauagcaaauuauaugcaaaaugcauauuucacauuauguuauauucuuuuuaaaaauguuucuuugagagucugguguugguaacuuuuucaguagaaacauuuucuguuucguuaauguuguucuuaaaugaaccuggcuuuggauagucugcaugugggagugaggaggggcuacaggagcugcugggccucggcugggucugcagugguagcuucagugguagaagguccgugcuaucugucaguggauucagguaccaugaaaauacuuuaaauauuuuagcagaauucaaaaauucuaauuccuguuucucauuuuuguuguuguugggguuuuguccauuuguuuguuuugcugccugugcgguagggauaucuucacuuuuuaagauaaucaauaggaaaacaggguucaagaggaaaggugaaugaccugaauaaaucuucuccauucugcaguucaaacacacuccaccagguggcaucauaccucugccucuugccaacgcucccuaaaaaugaagacacaacuuuugauaaagaguuucuucuagaauugcugguaaacauuaauauuuaacugucuuauaacuucuccuguggcuuuucccacauuucugagucacucagugauauaaacaguacugacugcuagaguucgggcucaguacuuugccucuuguguuuggaacuaauuaaauuagggguuuggggggccaggccucaggcuugguuuuucacgucugugguuucuuuucucacaccucucaaaccuuuaagcuccguuacggcaggaagucgcuguggcacugagcagcuucugugucacccugcacucaugcucuggagauucaaagagaccacagcuagacacagugcauguuaauaaccguggccauguguuauuuuaaaggcaguuauucaaaaauucuguauucaguaucaggucauagccuugauacuauaaauucaguaacuuagaaauacaguaaaugauuucuaaguggcuuaagaauucuaagcaauucuucagucgucuuuauuuucuaaacuagcuuuuuguugugguugugguuggguguggugacuuuuuacuguuguugcuguggcuguugucuggguuuugggguggggcuuggcuuacccuguacauagcgcaccacugcacagucguucaaaucagggaaugaaugggcuucucaugcagugggcuucuccuguugccaggagggagcacggagacucuucaccugcaccuuguggagcucucagaagacuucuuggaccuauuaaauuacgugacuguuaacuagguacauuuuauuaauguggagguagacauagcacagugguagagacugcuuacuuacacaauauagugacuacuauaccagcaccgcaggacgaaagaauucaaggaauuccauaacuucuuaaaaacucuuuaguauugucuucauuucaccuuguuuggacauguaguccacugcguugugucgggacaccuccuuuucauacaacauuuucugaaacagaugacuauuuaugucaaauauuuagccaugucacuaacuuauggcuccuuaaguguugacaguuuucaccuuuacagauaacgcacgcgcacgagugugugugugugugcgcgcgcgcgcgugugugugcguguacacccauaugugaacauuuaaccagaaccaggaacugguuauuucaccaugugugcuuauggcugcuggguuaaccuccaaaaccaacacucugaugagccugcacugccuucgcaccagccuugguuuugcucagucuuccugcuuuuccagcaaaacaaaacaaaacaaaacaaaaggauuuaaaguguuaguuuuucuguuauaagauuaaguagcuuuucaucuauuucagacauuuucauugcugagcaaaacaaauaagaacuaacuaacuaaauaggcauaugugucuguugauuuuucuucauauugaaccguauuaggcaugccguuccgggcuuuacuuuccaagcuuguucuuguacccgacagagagcauaauuccucccuguaggaagaugaugguaauaugcuaaauguggagagcagagacaaagcauuuguaacagguguuuaaggcccagugacaggugucugagugucauuuggggagcgcuucagauuaguuccagaauggaaacuacuuuuuucuuugcauguuugcucugagcaugugccuuagaugucugucuuugccuguccuccuacaagucacuugucacugucuguaacugcaaacgcuuccuaaaaauucccugagcucuuuucugacaagaaaaucucuuucaagucaggcuguugguaccaauacgaaguuuuuaugaacaaaagaaauagaaaccuuucccagggaugauucccauagaaaagccgugcgccauucuggccuuguuaauuagaaaucacaguuucugugugagaugcacugcugggagaucaagcgugcauagauaucauuaaugagagggagugcagcucagccaggcucucauuuacaguagagaagccucagaccggggauuaaggagcauucucagaucaugggagagucuuagaaggaacaugaaaacaaaguccaggguucauaauuucuauuuggggaauuuguuagguuuuuacauagaugcuacaguucuuaaacucuuggcauaugccagggaguuugaugcaguuuuauaguacuccuucucgucaccauggaacccugguuagagaccgauacuuccgcuguuuuaguaaaaggagacagauuaagacgcuuauaguaacuucuuauaaauggaggagcugggauccagcucgaguucauuugguuaauaccuuguuguuggguguuuuuuuuuuuuaugauuuaugagggaaaacagaaaggggaaaaaucaagucuuaucaaacugucacagagacugaagcccaggaauaucucacuccaugccuaauggcagugaagacaggcucucuccugcuggcucugauuacccuggugucacucauguucuacuguaacuccacuguuuccuucccuuaggugucucgccacgaacgccgcaucucucaaauucagcaacugaaucagaugccuuuguauccaacugagaaaauuauaugggaugagaacaucgucccuacugaguacuauucuggggaagguagguaagggaauacggagcucauguguaacgugugugugugugugugugugugugugugugugugugugugugugcgcacgcacacacgucuccucuauacaguagauuacuguucuguguucuguggacuuagaagcuagaaaagagugaggauuaaaagagugaagcuagaaaaaagugaauacuuagcaaaaggacuuaauuauccuaggauguauuucucuauauaaaauaugauuauuaaaccacaaugcuguuuuugaguaggcuuaagaguaaagaaaguguagcuuucauugaucacugugauaugcuguuugauagacaugcccuucaaaagcucugguagagccuuuuuaaaguucuuuaugaagccagguacugagaaccaaaaaccaaaaaaccccaucgccagcaguugauaacagaugcuuagggcuaccucccaagugucuguacuagcuauugaaccuguaccuuugauugaaaacuaccuguuuuuguagaugagaacuuggcuuaaauguaccaguaguauggcacuagugguaucuuuaaaguagucacaauuauuuugaugguuacuguuccaagaguuuccuagaauuucucuugaaauccacccgcagaaagugugugcaguuggaaaccaugguguuaaacagcauaagccagagucaaaaggacaagcauggcuuauucuuuuccguauccagaacauggaaauuaaauuauauguagcugugucuguuguaucguguguguguguguguguguguguguguguguguguguguguguguguguaggacaagacagucacaggucaggagacuggaggaagagauuuuaaggaaggugagaaauagguuagugcaauucauguaauaaagccgagguuggucuaacaagggaaggaggagaacuagcuggccagaaaggacaacuagggagacaaagggagggcaccuaaugaaaacacgguaugaacauauacaugaagaugccaugagaaacccauuccugucuauguagccauuuuuaauucaaguuaggguugcaagguacuaacagguuuuuguuuuuuaaugaaaaugagguaccuuuccuucagccuaugccugcgagacagugacucagaguguaagucaguguguacgaauauaaacagugugaauauuugguacaccaucucuugucuuuaaguucucuuauuacagugguacuauagauaauguauaaaaaugugauuugucagguaaauguauuguggcuuugguagugcuguugaguacuugaucucuaaauaaugcuaagacugcucagucacagagaagagaugaguuggaguaacauaaagacagugcuggugccgggcggugguggcgcacgccuuugaucccagcacaagggaggcagaggcaggcggauuucugaguucgaggccagccuggucuacagaguuaguuccaggacagucagggcuagcugcacagagaaacccugucuugaaaaaacaaaacacaaaaaaaccaaugccuugaccccuaaagucuagcaaaaagcacguuuggaguucucuuuagguaauguagcagcaucguauuuacucucucgugcuguguuuugccgcagggugagcuuaugcuagcguuaggcacgucagguuuuggguggcuugaauuggguacaagaagcuacuaacaucgguaucaggguuaaauaucuuuggaaacauuuaagacgcaugcuggccugugaaaugcugcuguuugauuaauugaacgaauaguuguauccuuacaucgguucucacaagauagccuguguaguccgugcaaauggaaaauguggagaugugucugcuccacagaccucaguagcugcuucuccagcugcuaguguguuuuuggauauagaccagaugguugauuaaaggaauaaugcagucauugaugcuguuuuccuuuccaggcugccuugcucuccccaaguugaaucugcaguuuuugacucugcacgacuaucuccugaggaacuucaaucucuuccgcuuagagucaacuuacgaaauuagacaagacaucgaggacagugucagcagaaugaagcccuggucaguacauugaugccgucuguaaugaagugugugugcagugucugauacagugugguaggaaaaucaguauguuagcaguaugaagauaucugccaaagauaccuccuauuugagaauguuuacaaugugaauuuacuucagaaguguuaacguauaagauacauauuugaguaccuuggagauguggcagggguccuggggagaagggagaagaggucauguuagucagggaagcggaaaacucaguagugaucaauaacaggguauagagggcccagcaguccuggacuagggcagguuagacucuguuggucuugggugaaguucagcagccaggagugcugcucucccacuguuguuccagugacuguagccagaagugugagcuggaggaccgagccugguguggaacacuaugagcagcacauugcaacucaacugcauuggcaggauucacuuauagaucuacuuacuugagaacuuuuucgguuuaaacucgacucucaaccuccuggcuuuaucugaagaguuucuuuaagaaaaucccuuuguucuaacugugguagaugggguugcauuaugagauuugugaagguuaauuuuggaguuuuauccauugagugacuuuggguaaauucuuuucauucacuguuucuaaguagaugguuucaaaaauuucaagugauuacaaaugagcaaacuuuauuugugaagcgaaucauuaccuuucaggcauaguagagauacacacgugauacugacucuguauggaaagucggacagucucugcagccugaaccuccucaggugucccuagccguagagagcgaccacaggcucugugguaaugaucuguuucucacuuccauauuuuacuuuauagucaguucuguuuuuuaaauuacuaugugagaaguuauucuggaugagacuauaaaacccaacacaaaguauuuuugaguuaauaauuaguugagucaguaaguaggcuaggauugugagauuuguauagccacuggcugcucaucccugcccacagccuugcugacacgauugcccauuguugggacccugugggagcacuugauccagaaacuccuuuacaauuuaugguuaccuugcacuuagaugucuacauuuagagccuaauuuuggccauuuugcaaaauagggauuuauuaacuaguacuuaaguaaauagaauucacuuguacauuuaauuuaaaugucaagcacacauacaaagaaaacaaacaauuacucaugguuucuauucucuauuaauagaggauuuuuuuuuaauuacuuuuuuuggggggggggagaugaaagaaaauguuaacuuuuggaguuaauuuguucauaugugaaauaauaaacccuucuaaaguuuuugcacugaugccccugaagggauuucuguaggugugggaccacaccacaagggcgggaaagaagcccaagcacucuuauguguuauauguuuugggucacguuuccaguuguguuucccauggcugaagccacugggacagcaguaaaacaugaugugcuuccacggggcagaagccuguccuugaugugucauauuucagucuguaagaaaacgaaaagugaaaggaccagaguagaggcugccuggggucgugggagauggacugcuguuagaagucuuucuucagggacaaagcagauguucuaaaggcggacuguggugguacaugcauaucgugugcacuuacuaauccuccugaauuguacauuuacagugacugagucccacaagacaauaggagcuguccaaggguaaagugauuagagcggaggaagugccaggacgccuuugcgaggguucagcacacugucaugccacccugaagcuugcuaagcaaguccuacacuguaggacuuuuauucuuaguuuugccuugaugucauaaaauuguacaguucuuaguuauagcacagaaucuuuauauuagagguaauguaaaguuuuuggaaugucguuuuuggaauuaacuuuaaguuucaaagugcugccuuaguuuguguuccaaauaaaccauuucauguaaaaacaauaauaaaguuaauugaaguaacauaaauaagaaugccuaucugggcguaguuacuacugguuaacuuccccucugaccuuuuuuaagugauaagauauuuuaagggauuuaagguaguauauaguucaaugaggagucuugcauguuuuuuuaaaguuuuuaaaauaauagcuuguucuagaaauguauuuuaaguguaaccuaagaacaugaagaacaaaagaugaaaauguuaguaguugaaauuauuuaagagagacaaaggauaaaauaaacaugaguagaacuguccuuuaaaauggaggagaugccacagggacagaccccucucuucuguaggagaagcagagagcaguucuccaagcagcggggauuccgaucaguaaaugaacgagagagcagcugaagcaguuucuguuggagacagugaaacuagagacauugcauuuccugauuucaaauucuauuacaaagcuacugugaugaagacggaguucaguagacauaaaaacagggacacagaucaaugguggcgugugccuuaaauaccaacccucuggaggcagaggcagguggaucucucauucaagacccgccuggucuacuauaaaguuaguuccaggacagccaggacuacacaaagaaacccugucuugaaaaaccaagaaaagagaaagaaaagcaccccgcucccugggauauacacaaauaggcagcagcagaaaggccaggaagaaagcugugcagagaagccacagagaagcaggaaguguuuucagugaggaaagcuagaccugccugcagaaucccugccuaguaguaaaacauggacucaagcagauuaaauaaacuaaggcuugcuugagacacgacauuuuuggaagaaagcagaggaaaagcuaccaugacauugcucuuagcacucuuuuguuuugcuuuugguuuuugucuuagauuuugacaccaaaauagaggaaacaaagagaacaauacugucauagggacuagaagcgcaugagaguggcaagccucuguacagcugugccaugcaaggaaacacugugacgugugucaguuagacguaaggccagagguauaaggacacaggcaacucaacacaaaaaauaaugugaaaaaaaaaaaaaucaaacauccuaaaaggacaugcuugcaaugaggauguaaaggcagccagcagauaaacaagcggggcucaggccuguaauuaucugggaaauggagauccagccacuagcuagucagccaucgugcuaagaaggaagauaaguauuggcaagguuauuuaagaaaaugaaagcucuaugcauuuuuguugaguauaugauuuuauagccauuauagaagacagcacagacauucuucauauuaaaaagagaaucauguuuaguaauccuacuuauggguauauguuaauaggaacuaaaaucacugucuugaaagaaauacuuguacuucauguucagagcagcacuguugucagcagccaagauagagaaacaaccugugacuauguagagaugaacaaguaaagaaaaugugggucacguauacaauauagcauacuauucagccuugacgaagaaacgacccuuaucaaggauagccagugcuagccagacuucacugugagcuaaacauguacucucccacgcugucccguguaaagcuguaaaguucuuguuuguguaaucaugcacugcuuuggauuucaggcagucugaguaugguggcguaguguucggugguugggcacggauggcccagcccauuguggcuuucacuguagucgagguugccaaacccaacaucggugaaaacuggccaacccgaguucgugcagaugucaccaucaaucugaaugucagagaccacaucaaggaugagugggaagguaacuuggcaguucaaaagugaugccaccuuuugccucugugauuuauagcuuuucauuuagagcauugguugaguacuuuuacuaaauauuauccuuauuccauuuuauucuuaaaauuuaauugaaagcacuguaguagucuuuguaauuacuaguaaauacuaagaauugagccagaguauuuuaaguauuucaauacaaauaacacugucagaguauucuaaagauugcgguuugcaaagcaaaguaagaagaaacuguuaaauuaguagagcuaauuuaauaaucuaguaaaugcuagauuuguacaucaacauaaaggcaucagugugcccuagaggagaaucauauauaacuuauacacacuugcgguguaaguagagauagucauacucugaaaagacgagagcagccagaguagaaaagagacgcaugcgcgucacggagaaugcauggagaagcuggugaggagacgcggagugaagccgcuccggaggacaguuugccuuagcacaaggaggaagauggacgggaucacugaaacuagauuuccuucagauuggaugauaauugacaagaaaguaaaccaguuguuuuucuugguuuuuuuccuuacugccuaaguuuuuagcaaugacaguuguguaucauaauuagcuuuuugagaagcaauguucuaaagugcuaagugagaaggaguuaaaacuuggcuaacaucuguguaagagcuggcucuggaccaaccugcagugggcacuuugcaucauuacauacacacucacacacacacacacacacacacacacacacacacacacacacaccacaccacaccguucccagcugucuaagagacuguuccccuugcugcccuguggugagggauacagccaggaggguuaaucuccugccaccuucuucaaaugccagaaggaaagggaucaguuuucagaaauuauagcuccccgcauagcaguagcauagcaugaggagcauguguuagacucuaaaggaacccagcagugaaguuggccaagugugugacaaauggcugcuuugguggguaucauuugugacagauuguuuugaguccuuuaugguuucuaugugcuccagucuguugccuucuacgcuuagagcauugugcgccuuucugaucgcugcaccuugagaagucauugauugcuagggaggguauuguguuuauuacuccuggaaacuuacguauacucacgacagagagccaugaugucuccaauccuauuagccacacacugacauuggugucuuaaucuagcuguguguucuucuuccaagauuauaagcagacagacuauauaaauuucauuucuguaauauaaugguaaaaauaauagcuugggaagaaacagggacgaagcuuccgugugguaagugucacuaacacuuuaacuucugugucagcguuacugaggaagcuagacagcuuuggguucugacaccaguaccuugccccuugacgucacucagaaagauuuugcugacugaaacuguaugcugagccauauuccgugggugaacuucuguggcuaacacuccugugcuuugacgaguuauucuugggcuaaccuguuuuaggacagugcacucaggcuguaugggaugacacugauagauaaccuaagcgaugguagaaacuugaugacuaugaguuauaugccagccauauuuucaguuauuuaauaagaauuaaaauaagaacggugaugaacauccaauuuuggaucuguaacaugacuugaaagucuuacucaguaauuaauucaugauacaggcuucuaauuuuaauauaagaauuucuuccuuuuaauuacugcuaugaaauauugacuauuaaaaacuauaggaaacauaauuauguucuaauacaaaauauauuauuggucaucucuuuuauuuuuaauguuauuuuuaaaucuccucuccuuuaaaaaaguuaagaauuugccaacgaaagaucaaaaacaauguaauucuacuaaguaaaaaugucuuuauauuuuacuaggucuucgaaagcacgauguaugcuuuuuaauuacugugcguccaacaaaaccuuacggcacuaaguuugacaggaggagaccuuuuauugagcaaguuggucugguguacgucagaggcugugaaauccagggcaugcuggaugacaaagggcgagucaucgaagacgguacgguaacccacccgugugugagaaugacacguuuuugugcuggcguacuugguaaaacugaguuguuuuauguaguaaacacagacagucauauguaagguaccuacuuuacaacuguagacuagcugauaucuacgaugauagggcucuggccggacaugugcaguguaccuacaccuuagguuugacuccccagcacugaaaaagaaaaggaagacaaaaaacuguuaaauguauugaauuuuccaaaacaagauuuuuaauauuucuaagcaugccaggcaugguagcaaacacacauauaauccuucuggccucuauauacacacauacacauauauacauacuccuaacaugcccauauacacacacauauacaacauacaaacaaaugaauagcuuuaaaagcuguuuuguggggucaguuuacucuucuugguauuacugggauaucugcaauuguugguccgucuugacucuuuuacagagcacacacuauuacguuggcacuccugauggcucaugcuucuugcacaguuuggugacuggauuucccuuaaaacuugaauucacuucacuuguaauuuugagcucaggcuauuguuagacugcugaugcuuaauucagcuauucaauuguaguguuuaaggaaacagaaggaagugaaggcuaggggggauaagcauugugccacaaaaugagacccaaguuagaccacagcgaagggagggagggaggcaggcaggcaggcaggcagacagacagacagacagacagacagauagacagauagcugaggccgcugagcuucccaguguuccuccucucacauuuccuguaugugaaauccuuuccagcugcugauguuagguagaaacuggaauguugagaaaaguaauaaacccacugucaaauuaagaaauagaaaggcuacuucuuaauuccuaaaauaagauacacaucugcuggcacaacucaugugugcuuagucuaaaaaacacuuaaugugugcucacacgugagucacuaauagggacugggagagagggcguuugaccaccaagcaugccugccauaggagcaucugcauugguuacagugugugcaauuuuaucagcauaggacagaguuguaagaaaugauaagccaggcaguguugguguacgccuuuaaucucaguauuugggaggcagaggcagguggauuucuaaguucgaggccagccuggucuacagagugaguuccaggacagccagggcuauacaaaaaaacaaaagaaagaaaagaaaaaagaaaagaagagaaaaaaagaauuuaggaaagcaggaauauacuuuuaacuuugaaucugaagugucuaaguaugggacaguucagucacgggguauuggaggugaguggaguucauugacuugccauuucuaugaaggaaagacuuuuaacuugcuuuuauaguuaguuaaaaaaaagaaaauacauguuucacuuaacaaauucuuuaaaaauauuuaggaccugaacccagacccaaucuuagaggagagucaaggacauuucgaguauuuuuggauccaaaccaguaucaacaggauaugaccaauacgauacaaaacggagccgaagauguguaugacacuuucaaugucauaaugaggaggaaaccgaaggagaauaacuucaagguaauguucaguucugcagcuaaaacuccuuauacccuagaaaugaaauccaaaagaggaccacauacgugcuggggagagggguugcagugaauauuaacuucagucuuaaauucguagcauacugauuacauaugacacuucauccccaucccugccgcagagccagccaccccaacuguagcaccugcagcuccagugaacuuggcagccgugccaaugucccuugaaaugaugcuguuuuggaagcugugacuagggauaagugaggucagaggccaccgggccaagcugcugaggcccucaucuguuggcaucuguggucucuucagcuccacugcagacagcggguggcucagcagcugagaggugcuccugaucugggagcagguagagaugaacuuggagcagacauccauuuuaaggggugagaggccaaggcaggagagcugcucccaggggagaaaggacagagaggccacccuguucuuuagauaagacuuuacacugucccucuaaaugauuuuccucagguauauuuaugguuuguuccuccacuugacacaagcaacucaguuuaggugucacuuaagagagcucuguuuccagguuguacaggagcuaggcuggucucacauuuacuuuucaauaaaugacucucaggcacauaacugaagucuacagaguauuccucucuuugccauucuaaugacugucucuguugugagugauguugugcuuaguuaccugggacuuguagaggugaauaagacgcaguugauaccuuaacuguuaaucaagaaagaaauauaaauaguuaucaucaaagguuagcaagugccaaacaugacuuuuuaagggaauucaaggaggcguucagguccuggugcagcgagcaggagcugcccgugcuguguguuugcuguuucuggcacaccuugguagaauccucacuuggucccaugcugcaguuguauuuccaguuagugcagcgguucuagccuggaucuuccaguucuugccuggaccguugggauggcuaccuuucucuacugucuucauaguccuguugauagauauuuucuaauucucuugaauacugaugcuuuuauucugcuacuuagaacauuuccgaaacuacccauuaaugauuaaauaaaucagaaauucuuuguugcauuaaaguaaaaugccaccuuccuccuugaagcuuuuccucauaugaaguccaucccccaccacucacaucuccugugguggaguccucugaauuguguaaaauucuuuacuaaucaucacauucugcugccucuuggcauggucugugccuuccuucaccucuacgugguuuauauaagauuccauccauccagagcucuccucuuccucauccguguucuguggaugugcuuguccgucuguccaucacucaccuaucccuuacuucuacugugcuaggauacugaguuuuaaaaacaucgauuugguugcuggguucuuugagauuaggccuuugagauucuccuaguuuacauguuaggauuuguuacuuuaucagaaugguuuuugaauauucuaaaaaaaaauguucucggcucuguuaauuccuuuuggcagaaaugugcuaacuccuguagaauccuuuuauuguaguaccaguucuucucuauauuguuugacacucuuaucaauguguuugcuuguuuauuucuuucuauccaugcugacuuuuauaaauuuauaaauuguacugcauuucaccaaacagcuauagcuauacacuacguaugcagagagaaaaacucgaguuuauaaggaagcauuuguauuucagggccuguuuuguaacuuucuuuaucuuguuuuuugguauuggguugacauggaucuuauuuuuauccuguucaauaggagucaagcggcaagcuuauuuaugucauucuaucuaaacgaauucuucguggauaaacugugcuuacuaacuuaguucuuuuguuugacucagucuaugguaucaacugaaaauauagcuguugguucagucuugccaagcaccugucagcagaaaguagcuucuugccuugaaacacaugggcauuccggauuggugccgucagcucugcauuccagggaagugccgguguccgagaugucuacugacgcgauacucuucugucucuuuacugccaggcuguguuggagacgauucggaaucugaugaauacugacugcgugguaccggacuggcugcaugacaucauuuugggcuauggggacccaaguagugcccauuauucaaaaaugcccaaucagauugccacccuggauuucaaugacacuuuucucuccauugaacauuuaaaggccagcuuuccuggucauaaugucaaagugacugugagugacccagcacuccaaauccccccuuucagguaaaaucagaauggaucugcucuuaggcuuagucugucuguaguagaaucagcacuggugacuaagugaguuuuaagcauugugucuggacuucauuuuggcaguccuuagcuuugcuguaauaaucacugggauaagacuauuauauuugaaucuauuccugacucuuauugcagaagcuauuuuuaagacuacauuaaaaguagcuucaugucucaaaagagaucaguaagugucugugauuuggaaagaacuguauaaauauaguagcugacuaaggaaauaugccuguaccucucacacguagucuaguguguucccuaacuaccaccauacaggcaugugagguugaacuucauuuugauuuuaagaagcuaaaaguuuucuuucaacucugccugccucauacagguuuuaaauacagguugagugcccuuuauuuaaaauguuuguuaccagagauauuguaaguuuggaguuuuuuucagauuuugaaguauuuccacagauaucaccaguuggauauuccuaaucugaaaguccgaaagccaaaauguuccaaaauucaaaauguuuugaaaauugaguaucgcaaauguuuaagauuguagaguauuuucaauuucacguuucaaauuguggauaugcaguaugaauucaaaacaguuauguuaaugucaaguggcuuuagcucuuaaguaggaauaaagugaggugcauggagccauuggcugcuuccggaguuuguucauaagcaucagaagcuguaugccaagauggccuugggagaguucagaucuuacuucuuuagcuggaagccagagcaugcaccuuccacaggaccuauuaaauacaugcagugacucaguaugcuuccaacauaguuuucagaauagccacaccucgucuuccuccuuucaucucuaaauucuguuuauuacaaaagcacucuugucuccuggguuuucucuaucuguauucucauaacucuucaguagcauagacuguuaaaaacagucuuugucccuccuaacuucugcuucucuaggcccuuagauuucuuuuguuuguuuguuugguugguuugguuuuuuauuuaaucauuuauuuauuuuacacuccagauuuuauccccucccccauccacccuccaacuguucuacaucccacaccuccuccccacccccacccccaccccugucuccacaagaauguccaacccccacccaaccagaccucuaaacucccuggggccuccagucuuucaaggguuagguguaucaucucugauugaacacagacccagcaguccucugcugcaugcguguugggggccucauaucagcugguguaugcugccugguuggugguccaguguuugagagaucucagggguccagguuaauugagacugcugguccuccuacagggucccccuccuccucagcuucuuccagcuuuucccuaauucaaucacaggggucaacagcuucuguccauuaguugggugcaaauaucugcauuugacucuuuucagcuacuuauugagucuuucgucagaguguggucaugcuaagucccuuuuugugagcacuccauagcgucgguaguacugucaggccuugggaccuccccuugagcuggaucccacuuuugggccugucgcuggaccuuuuuagguuucuauggugguauauuuuuugaacucucagaugcuuuugcuagauagagccauuuacucccuagcuugagaagugcaugcuucugccuacaaguaagggaacuuacucgccacuuuaguucuaggcagcuuuuggcucugucuauacuuuaagaaugggaaagaagauugggaaaaguacacagaaugagaguuaacuuuuuuuggcuuaauuuuaggaaauuuauugaaaacauuagcuucuaaccccagacuaagaaccucuugccugaauugccacacccgacuucagagugucugucucuccuuuucucaguuguccucugugucuggcuuggcuguuuguauguggacucugcuguuccuuauuucuuuggggaaggcuuuucucucuggcuguguucuuugaaaccugucucuuuaagucuucuuacuaaaugagcaugaauaaagcacuuuacauugcauaugacagauacuuaauguuucuuugauuuauccauuaguuggaugacguuuucccccagagggaagacuuaacacccauuuuaguaauuguaaauguacuuuuauuucaaaguuuauauagagauaaaucacaaauauuucucauucaucuguucgccacacaacuucauacacgagauaguaguucuuucuuuuuuauugaaagcuaaauuuuucuugcaauuugcucugcucacauucucccuucccucaucuucuauagagccucccuacccuuccagcucuaugccuccucucucccucuaacccucccuugaaaaaaacaaaugaagaaaaaaggaaaaagcaugaaauacaugcacacacauaugugcgugcacaucucauaaaaucacaaaaucagaaccauauguaaaagcaaaagaccaauaaguuuaaaaaaaaaaaagcccaaaauaaagcauuaugagaaaagaaauccccagaauuaucauugaauuuguuuuguagagacuauccacugcugggugagucagguuuccaccuauacccagugggacucaguuggagaaaacugauuuuuccuuuugaagugguugacaauugggagauaacuuguagguuagggacgggaccucauguccauuccccuucccugcuccaguacccgauguggucugguccauuucuuauuuuaaauauaaauggggguuuugcuuuuguagaauaacguucccaguaagaaguggaaaggggaagaaaagaaaagaugcagacggggaagaagaugacacagaagaagcaaagaccuuaauuguggagccucauguuauuccuaauagaggcccuuauccuuacaaccagcccaaacgguaaugugacugccuacaaacuugguuuuaaauucucuuagucuuuuaaagccuugggauggccuuuuucccuuugguuuaucaauuaucugaauaguugggaaacuuuagguugcucucuagcugcauuccaaagggaaauguuuccuggcacugaaaaguccacauugcacagcuacuggcauggcgcuccuggguaaccguggccuuuguaagagugugugggacuacaggggcagugcauuugggacuagaacuucugcuggccgcauaggccuaaaauauaggcuaaguguauugggaacacugcucucuccauaagccucauucuguguuugagacgugaaugggaaccgcaggguggauguagcagagggcuguggaaugaguacccguggauguuugagcuggucauggcuaugugggucugcacuggaugccgucuuacugcauuucuaaccgucuuguauuuaacugucuauugcaguaauacaauccaguucacucauacacagauagaggccauccgggccggaaugcagccuggacucaccaugguaagcaaagccaacuacuuuguggcucuuuaagugauugcagcguuguguguaugaggagagggugcugcucaucgcaguguucagacacccaguaagcuguggccauugguuaugccaccugucccccuuuugcuguagccacagaaguauuugcagcagauuuuuggccagcaaagucuauaauguuuacucacugacccucuacagagaaaguucugccuugaguguguuuaauuuccaaguucauggaaauguuucucuuacuuucaguuguuuucuugagucuaaaucuguuagaguccaagacgauguauauacuaaagaguacauauaugaagauguauauacuggagaguauacaucggaguacacacaaacugaagcguauacauaugaguaugcacacacugaagaguauacauauaagauuaugcauacgaguaugcacacauagaagaguauaaauacaaguacacacguaccgaagaauagacauuugaggaggauacauacacuaaagaguauucauauaaguacguauacacugaagaguaugccuauagguacacauauacugaagaguauagauacaaggauagauacugaagaguacauacgaguaugcauuuaugugauauuucuuuuucaucauuucaacuuugcuaguuuuuuuuuuuaaugauuuuguuuuguuuguuugaagugaguuuuuuucugaagaggauuuuugagacuuagcaguuucagccauuaaucacugcacguuuuuuucucagaggucgaugacaugacuucuugguguucuuccauagauguaugaguuucugagauuggguucucuguccuguuuguuacauuacugaguccacuuauuuuuuuuccuaaguuuuuuauuucuauuuuauaauaacauaauagcuuaguguuugauacguguuuguuguuuuauagguugugggcccaccugguacaggaaaaacagauguugcaguccagaucauauccaacauuuaccacaauuucccagaacagaggacuuuaauuguuacucauuccaaucagguaauugacgcuuugucugugccuaucugucugugugcauucacaugcccauacucagaacuuuguauuuugagauuaaaagcauuaacccuucucaguaauuuccuuacuuaguagauuggguguuccucugacacagagaucuaacauauguuaguaccuuauugggguuacauaccuguaaggcuacauguaaaucuguucauaaaggaucguuuaugcuguguuaauccuucugaggaugucagaaacagugaagagugaguacacuugcuuagcucuggcauaaaaugugaccaguaacucucagagcaucccaacucgugguaaaauugcuuuccucuaaaccuggaggaagauucucagaaucuaccaaugaucuuuagaaaucuugguuuacuaugcacuacaguuuuuauauuguaagucauucuguuauuugcuuucuuuuuuuuaauuuaacuuuauuuguaauuccuuuuuuuacacuccauauucuauuccccaccccuccucucccaccuugcaacugcuccacagcccacacacccuccccaccacacccggucuccauggaugcccccacucuccaucccaucugacuucuaaacucccuggggacuccagucucuugaggguuaggugcaucaucucugaaugaacauagaccuggaaguccucugcuguauguguguuggggaccucagaucagcugguguaugcuguuuggugguccaguguuugagagaucuuggggguccagauuaauuaagacugcugguccuccugcaggaucacccuucucaguuucuuucagccuucccuaauucaacaacaggagucagcugcugcuguccauugauugggugcaaauaacugcaucugacucuuucagcugcuuguugggucuuuaggagggcaguuaugcuaggucccuuuuugugagcgcuccauagccucaguaauagagucaguccuugggaccuccccuugaccuggaucccacuuuaggccugucacugaaucuucuuuuccucaggcuucucuccauuuccauaccuguaauucuuucagacaggaacaauugugggucagaggugugacugugggauggcaaucccaucccucacuugauguccugucuuccugcuggaggugggcucuguaaguucccuaucccuacugucuggcauuucaucaaaggucccucccugucucucaccucccaggucucugguguacucuggggguggggguccccccaaccuccuauuucuugagguugucuguuuacauucuuucugcuggcuuucagagcuucaguccuuuucccucacccaauaccagaucaggaccccacauccuguacccccccaaccacuuuuccucccaagucccucccuccuuccccacuugugauugcuuucuucucucucccaagugggacugaggcauccucacuugggcucuucagcucguugagccuuuugaauucuguggccuguaucuuguguguucuguauaugggcuuuuuuuguuguuguuuuauuuugaugcuguuguuguuguuuguuuuuuuuuuuguuuguuuuuuggcuaauauccacuuauuagugaguacauaccaugcauguccacauguccuuuugggucugaguuaacucacucaggaugauauuuucuaguuccauccauuugccugcaaaagucaggauguccucauucuuaauagcugaguaguauuccgauguauaaaugaacuacauuuucuguauccauucuucugucucgggacaucuagguuguuuccagcuucuggcuaucacaaauaaggcugcuaugaacauaguggaacacaugccccuguggcauggagggccaucuuuuggguauauuuccaagagugguauaauugggucuucagguagaucuguuuccaauuuucugaggaaccuccagauuaauuugcaguuuuauuuauuuuuaguaauacuacacuuuauucaucuggaaugcuuuagcagugguuuugaaauuuauaaauagugguagcuuguacaauaugccaaacauuuguugaccuauugauuugggaagaauguuaauuuguucuuccccugaauaauugcaauaaaacaaaguacuagaacuuuuuuuuuucuucuuucuaauuaaugaaguuuauuguacaaucaaagcuaauaguuaguuuuuaagaugcacgaucuguaagucaugcauuaucucccaggcucugacugacuuuugucccaugccuugauaggaccuguucagugcaaaccacuuagggugggauugugcagcaguccuggagaagcccugucacagaaauagccauagaaggccuuguugcugaagcucaugucgccucugacauucagaugacccucaauucugucaguguggugacaguguggaguugcagucacgcagucuguuuucauuugacuuguuaacugcuuuguuucccagguugucacuugacuguccugucuaaguacgcccccaacaacuuuccaucucaaaagaaaauauugaugauauucugauuuuacaacauaaauuuucugccuugauuuuuaguacagauaguaaauaauacuaugcaguccaaaccaaauaaugagaaauuuaaauuaaaaaauaaaaguaaugccuuccauuucuuaaagcugcuagaauguuggcagcaaagggugcauggaacguuauggagccuggauauguacgcuagcuuagggcagggugggacugugagcggugagaaaggaugcugaccaaccaggggguaaauauuguaaguggugccuuuauuuaguguuaucuucccaaguugugaaacuuuuacuuuuuuuuuuuucaaaacuuuugccuuucuacaaaacauuuuccuaaccacacagguugaagaguaaauauuagaauuugagagaacaguuaagauggacauuucagcaguagaaagaagugaucuccaaaugguuucugucagagcaugcuguggcaacaaaugcugccugcucacuguagagagagcugggcuuugggccugggagcugaggaugcucuuucuuucuuucuuuuuuuuuaaauggguuauuuucuuaacaaauuacaaauguuagccccuuuccugguuucucccccucucagaaaaccccuaucccauccucccucccccugcuucuaugaggguguuccuccauucacccacccacccacucccaccuccccacccucaagucaccuacacuggagcaucuaucuugagcuuucauaggaccaaggaccucuccucccauugauacaugacaaggccauccucugcuacauaugcagcuggagccauguguacuccuuuguugauagcuuaguuucuggggggucugguugauugauacuguuguucuuccuaugggguugcaaaccccuucaacuccuucaguccuuucccuaacuccucuauuggggaccccaugcucaguucaaugguuggcugugagcauccacaacuguauuuauaaggcucugacagggccucucaggagacagccauaucaggcuccuuucagcaugcacuucuuggcauccacaauagugucuggguuuguacucauuggcauauacccagaagaugcucuaacauguaauaagaacagauguuccacuauguucauagcagccuuauuuauaguagccaggagcuggaaagaacucagauguccuuuaacagaggaauggauacagaaaaugugguacauuuacacaauggaguacuacuuagcuauuaaaaacgaugaauucaugaaauucuuaggcaaauggauagaacuagaaaauaucauccugagugagguaacccagucgcaaaagaacacacaugguaugcacucacugauaaguagauauuagcccagaagcuuggaauacccaagauauaauucgcaaaccacacgaaacucaagaagaaggaagaccaaagugugggugcuucaguuuuagaaggagaacaaaauacucacaggagcaaauauggagauacaguauagagcagagacugaaggaaaagccauccagaggaugcucugucucuuucucagccccucucugugaaucugcgcucgcguucugugcucagcugccucgcugccguuugcaguugcuggauuguuucccauucucuccagcccuuggaauacugcugggugaagugaaccucagcagaguuuauuaucuuaggaaucauugccacuuggagaaacuagcccuggaaccaaugccuugcagucuauaaauuagacagagacguuuaagguagugaugguuuuauaguuuucagauagucuugggcaagaauacauaaugcaaaugcaagcagucaguauuaaauauaaucuugguaaaguuucuaaauggcugaauguuaaaccugcuuucuucugacuguuuuauaccuacauauuagucuaucuaccuagggacuagucuuuguucuauuucaaugaauuuaauaugucuuuuaaacucacugccaucuguuugccuuacugaccaggcucugaaccagcuguuugagaaaaucauggcuuuagacauugaugagcgccaucuccugcgucugggucauggagaagaagagcuagagacagagaaagacuuuagcagguaagacagcagugguagaugauggcgcaugcacaaaggaauuuuuagccuuuugccucuuauuagguaaauaccaaaaaaagaggcauggauaaucaaauuuccuuccgacaguucugguguccccugcucagucuguugaacugaaagugcaggcauggugugcuuuagcucggcucuuuguggcuauaucacuuguuguaaguggaacaaaauuguacaaaucuaagcuuucuuaccguuaguaguuuguuucuucaaaauuauaauauuucauuuacauagcaauucagguauuacgcacaauuaauaguggacauacuuaacauaucauuuguuucauaaauaugaccuuugacuuaaugugaagauagacaucagaaggauguaacauuacugugcuuggccuccucagaguucacucauuacagaaaucaccaaguauauaagaagcuagcuagcgcguuacacagaacagcacggugucagccagugaggcuguagcuucuuggguuggauggccuggcgauagcugugaacucuucccguaggguuuccucugguaaggccgcugacaagcauggagcaguggagguggggcgcucguggcucccaccugcagaugcaaacuucuguucucucucacccagcaggauuucugauccugcuagguuugaguucuagaccccacacuagaaacugcagaugacauagagugcauuuucagacuuugaaacauucugcuuuuaugacaguuugagcaggacagugcuguacagaguaccccgucuguccacucuguguucuagcccagaauauacuguaacauaugggaaguuuuauauguacaaaaaacugacugcuugcuugcuugacuuuucuuucuacucagacugcuaacauguuugcauauaagcacuuugccuucaguuauauuuuaaauaacuuucugugguguggcccaaaauauacuacuuauaguuuaacuuaucaaccgcucauaauuaaauauaaauuaaauuggucuuccugcuuuuuucuuucucugugaucauuuagaguuucuauuaugcucccuuaaauucugucuuugauugauagauuuuuuucaaagccuuuucauuacagauuugccuucuuaccugucugacaauucuagguauggaagaguuaauuauguccuagcucgaagaauagaacuuuuagaagaagucaaacgguuacaaaagagucuggggguucccggagaugcuucguauaccugugaaacugccggcuauuucuucuuauaucagguacgccuagagggcuuuagaggagacuucacgguacuugucuuagaaggagaguacuucguguccuagagaucauucuugaaagguuauuguuguuuucauacuuuaaaauauuuggcauuuccaaaacuauuaugaauacgcuuuguuucuauuauuacuucagcgguugcagccuuuuccuguuuccuuugugugugcagacagcuuuguggaguugguucucccuuuucacacuguggacuccagcgguccagcccgggucacagggucgcaggcuuggugacaagcaccuuuaccccgagccaucucaccaggcccugugguuuuguuuuaugauucuguuuucuuuguaaacaacuccaagcuaaagccaagauugcugccuuugaagucauuuuccuuacuccuacuauucuuauauccccccccccucucaugauaggaauguaacuaaauauucuaccuacucagucauagcaaaauacaaagagaauucuaugaugucauuuaucaacuaacaaggaaaagcauauuguucuuucuaguacacauaaauaaagugucucuuagaauugauuuacagcugugacuuuguuaagauuaauuuccuaagcaugaaacuauugagaagcaggaaaccacauaaaugaauaaaugcuaaguccuuugcauuauuaauuaagugaauuaggaauaaucaaauaguguaggcuucauguaacuuguucucauuggaguaaggccguuuguauauuuuugaaaugaucuaaacuugaaauuuuuaaugaauuugagagaaugggcuuaaucucaucaguggcugcacagagcgcucgagugcaugcaaaaugagauuuuaugggguuugugaagcaaacaagacaugcacugucuugcaaaguaguccacuuuagauuccgccuguugagcucauuuucucuagauucccuguagcuuuauuuaaagcauaauccagccaggaaggaacagccuggguuguuccugcaggugaugucccgcugggaagaauacaugagcagagugaagaacucggggacugccugcccggacgcugccccggacgcugcacaggucgccacguucuuccccuuccaugaguauuuugccaaugcuccucagcccaucuuuaaaggcagaucuuaugaggaagacauggaaaucgcugaagggugcuucaggcacauuaagaaaaucuucacccaacuugagguaaagguuuucaauuuguuuucaucuuucuuuaaaaguuucugguuuaucuuuuuaacggguaaauuaaauaguaagauauugcaaaucaaauuguuaauuuaagaaaaaguuuugaaaguauuuacuguaugugugugugagagagagaggcaaacacaucgaucgaucgauagauagacagacagacagacagacagacagacugcacaguauuacugugucagaacuagcuuucugcauaacccaggugagcuuaaacucacagaagucuucccacuucugccuucuaaguacuggcaugcacuaucacacacagccagauacauuuuuuaguuaagaaauaagcaagaauuaaaaugaguuauauccgauacuacaauuuaagaaaauaguguccuuuuuauaccaaauucacuguguaacugaacaugaccuuaggccucugcucucugccucuugaguaguggaauggcagguguuugcagguguacaccaccacaccuagcucauacagcaguaaggcucaacccccaggcuuugugcgcagucggcaaacacucugccaacagaggggcaccucuaguucucugucaggaaacucagcaauaguucuuugaaugggaauuugagauaauuguuucuuaguugaucaguagacacaaaguaaggguccuguauuaaccagggugcuugauccugauaugaaagugaaguaaggaucaucacuaaacagagauagagaaggcucugcugcagauccaggagggagccccaggacgaacauucauugcagcaggcuuauaagccaccaucuucaggcuuguuuccuuaguaagaguguggagaagugucacucuagguacagagaagaggcacuucguaucuuuucuaucuccuacauaugcuucccgcccauccccuaguaucuggcacauaguugguaaauauugauaacuuauggauagguagaugacucuauaggauaaugaugauuuuauaacugaaaauuauaauaucaaaauuauacuacucaauguauaguagcagcugccuucuuggggaguacagagaggagguacauacuaucuaacuugaaucagcuaaauuauuugcuuagauuauuugagaaacacagcaaaauguuaagaaaaaaaauugaagugggugugugucauuuucaagucuggggaaaccugauauggucguaccaguccauccuccgccacagcugagcuucagacugguccuugcagauucaagggcccucccuauauucuaugucccuauaguguagacuuuuagcugaauuaagcagauccugagagcugugguaggaguugagaagagacagaccagaguuuggcaaagcagaguccauucugcuuugguuuugucgccucugucccuccagcuccuauuagacuggccaagucccuggucgggaaacccaagucucugggcucugccaacaccauggcuccuucugauccuuccuaguaggagugacagugacuuucuuguuguugccagugucuacauuggcucauccccuggcugacuuuuuaggcuuugucauuuguacaaccaguuguuuacuaucuaauaggaauauaugagauaguuuuucuuuucuuacggggacuuugaauaaugcagcuauauugcugguugguauuuuauucagugcucuuuuuuuauaaugaaaauaguuuagauacaaaaaaguccauauuguagcuugaauaucaccucuuaucugaacucacaggguaccaauaacaaaaagaauuguaaaucacuagccuuagcuuuuaguauuaguauauucuuaugguucauuagguuuggcuuauguuuauguauuauaagaguaauacauaauuacauaauaaaugauuauguaauauauuguguauauauauauauucucaagaauugucugacugggcagauugugccuggauacacauaaacuuuauuaugcuaaaguugucucugggacucacuucauaggaguucagagccucggagcugcuucgcaguggacuggacagauccaaauaccucuugguaaaagaagccaaaaucaucgcuaugacauguacucaugcugccuugaaacgacacgacuuggucaaguuggguuucaagguaaagacuguaaauccuuaguucauguccucauuagguuccuguuucuugacuuuuuucuuuuugucaugaucuagauugguucacuucuuaugaaaggucucauguauaauuaauugcuuuaauggucucuuuaaaaguagaugguaauguaacauuuauaugauugaugacguuaaaucuaauuuaauuuuugaguaauaugucuaucaauuaauaucaaucacuugauugucuuaccagaccgucauucuuaagguuuaucuuuacugaguaucacuuguuuaaacagauauaaaagcuaugaaaguaauauuucacaauccuaugcacccuagacauuuaucuacaaacauuauucacaaaguaaacaugcauccaguucccaucgucugucuguuguagaaugacuuuauuuaugccaucaagugagagauuaaaauaacuuaguaucuaauaaauaugagcaggauugauguuuaugacucaguuaaaguugaacauaacaauugaguaauaagucugaauuuucagucuuugucacuauuaaccaguaacuaaccaaaacucucaccagaguacagaucuguaaacguguaaccugguugguauguuguuggagaaagaguuguguacagguuugaacgcagugauaguugaggaaaguagcuaacaacuuuaagauacauaaauucacugaaagauaguaccaaguaaaugcaaggugauaguaugcuuguuaucuuagagggaagguuccugggcuguagggcagggcagauacaauaucugaguaaugcauagugcaaacuuacccaaaugugaacgugucgguuuuugcaaaauacuagugagaauuuuucacuugaauauuuucuucuugggacuaauauauaucuguggguauauaaaauuugauauuaaauuauaugaauuuaauaacaaaagauaucaguauagucaauacuagaauuuauggcuuguuuuguguauagcuuuguaugaggucuaaaaauauugcuuaucaaaauuuugcugaucuuuucuaauacuuaaagugauaagcucuaaaguuauuccaugcagguaggguuuuuuuaaaaaaauauuuuaaauuuugauuuguuuguugagucaaggucuugcuauguagccuuggcuggccuggagcuugcuauguacacaccaggcuaaucucaaagucauagagauccaccugucucugucuccagaauacuggaauuaaagcugugugcugcaaugccucgccaaacuuaaaauuuuuaaaucuuauaaauagauguacuuuagacagaccacaacuucuuugaguaggucaugucuaaggauuauuuuuuuuccauaaaagaauuugaagaguugaaacaacaugauaaucuuuugacugucaguggcuuagagcaggaagggaaugguggagauucccccgcccuuaguaaugguggcucuagagagugggcccuagagaauaaccucagagccagcuugaagguaaugugauagacucuggcagugucugagauccagguuugaggaggaaguggauuauuguggugauaggacuaaggaaaauggccauguguacagucgaucuggcuagccuguaaagaauguggagaacuaaacuggaaagaaccaaugugaaacugccaugagcuccucuugccauagaugauguuggcacuccugagguuaaggacaucaacuggagaucaaucaggcugcgaacuuauuugcagaguucauugcugucuuaguacacaauuacuaaggccuuuugaccacuguuuugcuuacggugauaguugcuuggcuuuuuagcuagucucugacguggcuuucuuuuucaguaugacaacauuuuaauggaagaggcugcucagauucuggagaucgaaaccuuuaucccucuacuucugcagguaggagauacagggagagaaaucacuaagaauccaugggcguccuggcuacacuuaggguaccgauugcccugaucccaugcucuccugacucacuguuugcuguuccguuugcagccugugaacgcuuccucggaucuaugcauggcucuguguucccugugggcacacuauuuaaacauuuaugguuuaagccaggcauaguggcuuuaauuccaguacucaggaggccaaaguaguuggaacucugugaguucaagaccagccuggucuacaaagugaguuccaggacagccagagcuacauagugagacccugucucaaaaaaaaaaaaaaaaaguaaaaauaaaaaaauccaugguuuauaucuacaacauaguuuuuaaaagaugacuuuuaaacaggaaaauuauauuauuagguaauuuggaaggaagaugaguucuuuugucuuuucuuuuguuagaguuguuucuacagauauuucugguguucuguggauacguugcuuuuuguaauuaugugacuaaauuauaaaaccaaguaguguuauuuuaagaauguuucuuguuauacaacauucuuuacuauugaagcauuacaaacaaaauauggaauuaccaauacaagacucaagcccacuuaauccacagauaaauuuaguuaucaaacuugccuuuauaaguuaucauauaaaaguuaauguguauuauauccaauguaagauagaguuccuggacaaggggccauguagaguaaggaacugaaguuaguauaugaagcucuugaugguuuuuacucucgagcucucccucagaacuucuuggcauacuuguaauaccaguguucacuuuggcaucuuuccacuucugucccuggccuugcuucuuccugcuuacauuuuccuuaaggcugaccguaaccuucaaggugucuucugauuguccugucucacccaguccugcuuaucacgcagucaggagcacuggcacccuugcuucaguaccagcccauuguguaaauucacugggcuucuuuacagagcugcugaagguugggaaucuguaaguucaugaugucgucugaugaacaguucuuguguguggugagcuagaaaccguccauaauguauuaauugaacuacuuuggugcuuccucacaugucguuucuagaauccucaagacggauucagccgauugaaacgguggauuaugauuggcgaucaccaccaauugccuccagucauuaagaacauggccuuucagaaguauuccaacauggagcagucucuuuucacucgcuucguccggguuggaguuccuacuguggaccuugaugcucaagggagagccagggcaaggugaggagucacuccaagucaagaacauagguucccugaaagaucuguuacaaaaaguuuuagccuccucuacaaaccuaggaacuuuucucuacaaaucuguauacugaccaaauaaacuguuuucuucauuaaauugauauuaagugauugaaaaggauucacuuuauccucucuccaagacacaaccauaguaacauaacgauaaaaccuaaagcaaaggugaacaaggggaagacacugauucuuaauguuauaaggaaagccagccacuucacagguccuccuguguccgcgcuuacaggccuuccuggcucuguaguugaugacauaguaguaguuuacacgggagcacaggagagcuaccagcuuuggaacaucuucaauccccucucuugauuacuuggagcaaggagccuaaaguucccaaaguauuaaucaucuuuuuuagugacuaaguuuggccacuaaaacugaaacagugugguuccuuggaauguccuugugcauacugaagggucccaucuuguuaaucuuuguguucggggucuuugucuuggggcagcuuguguaaccucuacaacuggcgcuacaaaaaccuagggaauuugccccaugugcagcuccugccagaguucagcacagccaacgcgggccugcuguaugacuuccagcucaucaacguggaagacuuucagggcgugggagagucggagccuaacccuuacuucuaccagguaagacagggcgugcggcuuuggaguuuaucuuguauaugccugccugaaguacuauggaauucagcagugcugagccaugugaucagcuaccaagaaaaagagagauugcagccuuuccuuacgacucaaaagccaucauuuucagguggaucaaagagacaccgagaauaacuaaacuugguagaaaguaggaaaagcaaauauugucaaguuuguaauaauguaaggaagggcuuccuuguuggaucaaaaauaauaaaaaaaaacuuaaucaauuugagaaaaaaaauauauaaauaaaaaacaauaugcugaaaauucuuacuaaaaucuauauagagaacucaguugcuuuaaaaaaaaaaaaaaaaaaaaguaguccagagagauggcucagcaguuagaugcacuugcugaucuugcagaggaccaggccauccacaaaacagcuaaacaguggaacauaauauuaauuccagaggaucuggugacuucuucuaggcucuaugaguaaauuuaaacuauuaacccagcagaaaaacacaaugaaggaaaauacuucacuagagaaaaaugagugacuuccuagcaguaguaaaucacuaaaucagacaguacuugauggggaagcagaugugggcagaguagacuccuggauuccugcaguucuaguaggaaaauaauuuccucauuaauugucauauguacucgaagcacuguucucacuccuaguaucaaacaagaaguuggaugaguuuauaaagacauauacugaaauauuuucacuacacauuauuuuagagauaauuuaaauagcuaucagauuaaauuuuuccuguuauguuucaaauauuuaaguuacucucucauauacuugcagccuagaaacaaauaugaccuuuaaaugguaagucauuuagagucuuauucaacguagacacacauuuccugauaucugccuuugagcguaguuugggaguugguuuguugucuccugauggcuucauugcuuaauguuucugaguacuugccugaucuacaugacaguguugaccugacauagcauauccaaguuacucaucucuuuccuuauuuguugauucugucucugggugagguuucaguauaucaagaaauaagggcauucucaaugauuauuguuuuuguucaauguauuucugaaguauuaaaaaccuuauccauccaaaugugaucacuguauguuuaaguaauacauguuuaaaaauuagugucugagaggagaauagaugggacguuacuaaaagucccuacguugaagcaaccaugauugacgugguccagcuucuaaaguauuuaucaaaauacgcuuuugacuguuaaacuucacaucagacucaggcagugcgccgaauuaagcagucuccauugcucacauaaguaagacugguuucuauuugcugagaacucaguacauuaaucuugcccaaaauaccugaauccucaaaacuggauuuuauucagccuuagcauuuauuauauaaggucauuuucauggucccugguuuguucuuuuaucuauauuagagcugauccuuggauaaauguguuuugcuaccaauauagaaaauggagauuuacacagucauguggcuucuuuugucuccugucuuccaaagaacuagagaauuuaaaugaaagagaaaauugagacugucugucaucaggaaccuggauauaaauggugucucugaaguccguccaguaauuuuccucuugccuuugccuagcuucuugucuuuguaucuugcuuuccaucaugugcuguguucuugcuuugcuuucccaucuccugccugaacucaggcuccacggagcuggauuaaacagcucggcaucagauuucuuacuuugaaguucagcaaagcccuugcuuuugugcuuucugucacccaucuuuaaccaguuugagagcacaucuucucaccucggugaguccagugcagguggcaacaggaggacaaugaaacaaagucacagaaacaccaggaagcaugagaggcuaggaaagcacugcacagagcggucggcuguagcccugcuacgccuccagccgguuagacuggauacuguacagcuccuuugaugguuuaccccuucauauuauauuuguuggaacagcugcaguuauagugcauuauagggacuauauaucgugauuauuguggccucuuaguugauaacucuaugucucauauuacaaaccucaagguuuuaucaauauuaaccuagaauaagacuacccuucaacuuaucagaaauauccaccuguuaaguuuucacuuaagguauacucaaaauaacuaauugauggcuagguaagccgcuuuacgaaguagacgcaaaggggaguuaauguauccuguggcugugcuugcguuacagaaccuuggagaggcagaguauguaguggcgcucuucauguacaugugcuugcuugguuacccugcagacaagaucaguauucuaacaaccuacaauggacagaagcaucugauucgggacaucaucaauaggcgcugugggaauaauccacugauuggaaggccaaacaaaguagguuuaugaauguauauguuuucauagucaucuuuuugucaaggaaaaguuugcaguuugcauuuaccauacguuguuuauauugcuccacuuugucucacagacaaacuuucuagaagguucaggauggcaguaucuguacaugagaaccaaagacuuauuucagaaugucaguuuuuauaauuguagaaggcuguguuaaguaagacagacuaauauaaaaugagcaagugaauuggacaucuuucauacaagaccuacaaguagucaauaaagcaucccuuuccuguaauuuugucuuccccaucauuagcugucaggagcuguaaauggaaacagaguaagggagggggaugcaguucagccuagagugcuugcuuagucuucguaaagcccugggugccauccucagcaccacuuaaacucagcgcuguggugcaugccuguaaccccaacucagguaagguggaggcaagaagaucagaaguucgaggcauuccccaguuauauagcaaauuugaugcagcuugggcuauaugagauccugaauaaaaaauaaaauaauuuuuuaaaaacaaugcaguaugauaguucugcacaucaagagaauggguaaaauuguaaaaaugucaggcaauggagcaguuggaacuuggggacugggagaucacuggugaguauauaaauggaaucaagcuuuggaaaguaguuuaacaguucauaaagucaugcauacacggaacaaagcccacaguucugcuuucugcaaugaaaacauguccacaaacaauauuacagccaguauucaaugcagcuuuauuuuaaauaccccuggaguaaacggacaucuaguguccauuaacaggcacauucauugauggaagcauggcugcugagcagcaggacagagcgaccaucucuauacaacauggaaaagccauggaaaccucaugcuauugacagaaacugccuuuaagacuuuaugguucuacguuugugugugugcagagccugcaggaaauaaggaaaguagaugaggcacugccuggagcuggagguugccugcuuguauacaacaaggcaugaggugguaggcauuguggauguagugguugugugggaguauaugggaguauauguugucagaacucauuguacauaaauuauaccucugugaagcccacuuccaaagaaguguuuucuagacuuccuuaaaucagagggaccauaaauggugacuuaugucauggaagcaguagcuuuguugaauucauagagcaggggugaagaccuaagaguuaaaauuaguggcuagaaucuuagugaaccucccuucauaguaaaaaguguaugaaguuuguuuguuuguuuguuuucacuuugacaagaaugcuagggacacacauugauuaauaugugaguauacucugcuauauuuuugaguauuuggaacuccacucaauaagcugaacagagccugccuucugagucuguagcgugagugggaguugcaggaggacauggucugggaugccuaccuugcuuuagcggcacucacugacuuguuagaguugauaggauuggguuucuucugagaucauuuaaagcaaagaugcuugccucucguacuuuguuaggauaaugccuuacuaugcuuuugaaacucuaccacgucccccuucguucccuaggugacaacaguugacagauuccagggucagcagaacgauuauauccuccuuucgcuagugcggaccagggcugugggucaucugagguacgugggguacagacugugcacgcuuacuaaagcucacugucugcuucuguugugagcuucagugacaaaguagcucuagacuuguuugauucauugcuauaguuaaucauuauggcagcguguaguacuuuuuguaggaauaacaccagaccccucaugugguuuaucacugcucuuacuacugcagguuugacucauacuguaaugaguguggcuauuguucacagucagugacaugcagagagaacuuuaugccggaggaucuugauugucguggaucuguuagaaacaguguccgaaugaaucaaaggagcuagcgaggaaggggccucuuaugggacgugcuucagcgcauaaggcuuccggcuuuccucuccccacugucuuuccgcuucacgagaggauaaaggagcccuuuguucucccaggauuaagaaugguccgaacaaacaauaaccuauuuuuaucauuuuugugauguauuuauguacuagagauuuaugggaguaauaucuucuuauuacaaagcagccguuugguuuuauauaaaucuucaucucaugugacuggcuagcaaaacucaggcgagccagaguucauugucuuaauuuauucgauggguauaaagagaagguucuccaagcgcucauaaauugucauuaagucuagaucucuuuggagcuuaggucacauucuauuagacugauagucuuuauguaagaggaaccaaagacaaaaguguuuuaagaaauuguuacaaaaugauagcagaaaguuagcuuauucuugcuuauuaacaucucaaacauacuguuacgucuuucccuaaccgauguaacuacugucuggauggccauuacugcugaccuuagaccccucagcuccaagugugcaugcuugaauguuauguccucuucuuccucugcagcuaccaggccuacauuuagauacauucaggcaaaagacccauacauauguacaaggaaaauacaccuuuuuaaaaaaauucaguaacuugaauucuguagugaucucuaccuaaguuucuguaaacuaaaaaugcuuacgacuagguggugacucaaaaggugacuucaguaugccacgcaucaacagcuuuccuaaucacacacacccuuauccuucuauuauuugucaaugugcgagcuucuggauaugcaggaaucaauuuagcuuccacagucuccacccuugaguuuggagcccagugugagacacauucaaguaacuuaggaagaugccucuuaccgaauacacccaaaaggucugggcuauggggccacacuugugaaaaccuguuagccacuacaguaccagagacuaggguaaauguccguucacgaggaccuggacagugcuauuugcuugagauagagcuggagccucuuggaugugaggaaaccacacagugggaaagugauuugucaagaacggcuaaaggcacuuccuucuuccaccgcuccgcuccguuguuuccuagacagcacuguuuacaugaucuguucuauuucuguggaagaacuaaugcuaaggaauucuagcacuuaccagcuagaaacauacacacacacauauauauacacauacguacacacacacacacacacauccagaagcuaacacacugccaauugggaucucugcauaacucuacauuaggaauuugaaaagaagcaaaagaaauuucuacucguauauaaaacugguaaauuuucuaggaaggaaaauuuuuuccuugauagagcguaugaauuuguuggcagaaaagugaaagaaguugacuguuacagugaagauaacuaugcaguaaucaguugcuggaccugagccguaugauucugcuagggauccguggauguuuuaaaccagugccuugguuauuuugucuccuaugugggcacgcaugcccaauaacuaacaagguguuggcaaagaagcacucacuugguuuacugaucaauauauugguuugcuuuauuguuauuaaguucccaaggauuuuauuacaauaguuucaugagacuauucacuagauuauguaaaacgaggaaaggggcuguauauguacauuacuaauuuuaaccuaauuaccuuguuuccuaaagggaugugcgucgcuuggugguagccaugucaagagccaggcuuggccuuuacaucuucgcucgagugucccucuuccagaacugcuuugaacugacuccugcuuucagccagcucacugcccgcccacugcauuugcauaucauuccaacagaacccuucccaaccuccagaaagguaggccuuugucacuggguagagcaauaugccccagagggacaguggguucucuuacaguugaccgauuuagggagaaugcccagucacugauaugacaugcucuuuacaccaaagaaccagauuauauaaaagucauauaucuggagucagcugcacacauccauuaucucauuagaucucagcagcagaccugcucuggaggcuuucuaaggguaagacaggcuagaguuugccauacaucagguagguagaagcaggcaguggagcaaggguccguguucuaaucagcccacagcaccuccugucacccaucagccugacaccugaguaaccuggcccaguucuugcauucuggggagguggggcagggaagacaugugcaaccucugagcugcaugcccucccuucucucccuucucaccucuuucuuugcaggcucuuccuucuccggcacuucucuugccagagcugcagacacuggaucaugcucggaguguggcuguuuucuuccagcugcagaguucacuguucugcucuuuucacuggaugaaaugucccagagaucuaggaaauuucaauaaacagacaguuuuauaaauauacucaguaaaacuauuuuucacuccucuaaaacgaacaaaauaaguuugauguguuuguucuaugguggugauguuaacuauuucucuuuaaagacauuucugauugcuugucuguuuguuucauuuuuaagaaaagccacugagagagaaagcaggagggaagggggggagggcuguggaacagcaucgcaaagcucugaugccacacggaugccuccugugcagcucuccauugggucuuuuauagacuuagcauuacaugccagcuacucuaaggugggguccuuuuuuccuggaaaacuugucuuuauacugauagacuuccacaucaaccccuacaguaaaaggagaagauuuuauguaugaucagugauuacaaauaggaaaguuaucaaucgucaaggugacugaaagagaagaacagaucuguuuccuucacuugcuuugcugauuuacugcuagagagaucuuucucagcaauuuuaaauccaugaaaguccccucaucccacugcagaccacagaauccagcucucaggguggugcaggugaggggucugugcugcgacagugucucagcagagccggacagaugcugcagagcuuaaaaacggggauuugaauauuacauccaugggugauagcuacauguuaauaauaauaaauguuaacaucucaugcuucagaaaauagaaauaggagaaaugguucuuguauuuucauucugaaacauuguagauucucuggauucuagacacggguagaaauuguugccuuuagaccauguugauuuaguuccucuacucaugacgucucaucuuacucuuugauauuaguuuacauacgaaaauucuuaguuuacuuaccagcccaaagaugaauuaaaaccugacgacuaugcaguguguugucuuucauuucucugaauuuuaugagguaguuucuggacucuggcguuggauuucaugaccuccauacucuagcgguuguuacagauucagaaaggggcuuaugcugaaaugauagcugugguggguuuauucacuaaacgcuucucucucucucugcugucuucuagaauggagagagaccaccucaugaagugcagguaauuaagaacaugccccagauggcgaacuuuguguacaacauguauaugcaucugauacagacuacccaucauuaucaucaggugaguucucuccagcugucaaaagaaacuccucuguagagugaauaguacuacuaauauguuauggaaaauccauaguuggauaguauuauuuaugaaguauucauaucuuaaugccuuuauauaaauuggcaucaaguacacaagcucaaaauguacaauuugaugcauucuguauuuaucacauauguauauacuccugaaacuaucaccuuaaucuagauaaugaucauagccauuguccuuaguuuucuggugucacuuuguguuuucugcccuucucuaagcucacccgggcugucugguuagcauagcagaucuuaaaauuagacagaaggaaugauuucugccauuguggacuagucucugguuucuuuuuuuguuuguuuguuuuguuuuguuuuguuuuuuucgagacaggguuucucuguauagcccuggcuguccuggaacucauuuuguagaccagggcuggccucgaacucagagauccaccugccucugccucccaaguacugggauuaaaggcgugagccaccaccgcccggcaaaaugacuaucgugccuccccgucaggaaaucgaacccugguguccugcgugacaggcagggauacucaccacuauacuaacgaggaaaugcacucugguuucuagauacuucacuaaugccaacguccagugugugugcuuacuuuuucagucagcuguuacucagccguuuuaagucauucauauuguugcaugcucuucuccaggugguugguagagugugacuguuuccauugugagguguuacaaaguaauuguugugaaaggcuuugcaguuuaccucagaggaaagagucuggcugaucuguuacaugcacacuuaacuuccuaaagccaaguuuucagaguaguuucucaaauagaaggaauucucucuaggagugugcaaguguucucgcccugcauccucacccgcacuugccacaggaagccuguuugugagcaggaacaagagaggaagcucagugagcugagugggcuuuguuauugaugauccguuuguauuuugaguucguuuguccucauuugagcaucauuucugcuacaaguuccuuaucaaacauguguuuuaccaauuuuccuuccuaaauuguaaguuggcuuuuuuaaaagcagcuuuaguagaauuuugaauuuugaugccuaauauaagaaauuacuuuccuuuaacucauuucuuguauguccuaaaaauaguuacuuuauccccaguugacgaagacuccccucccccaguuacaguuuggguuguaguguuuacacguagaauagguuucagcuccuuucuggcaugguuccaugcaguguuguaacuauuugcucauauuuggaucuucaguaguuugacugccaucuccucaauagacuaguuuacucuccuuuaaacuacuaguugugagcuuaguaaagaaccaaacacacacuguccgcuguggcugucugucccuccaucaucuccaugcugccugcauugcagugguuagcauagcagaucuuaaaauuagacaggaugaauguuuuauuuccauucuuuuucuaccuagacucagccggccgcuuuccagcccuauaaaagcccgcugugaucgagacagaaugacuccaacagggaaauuguuuggggucaauuugggaaaauuagcaccuuaccaguuucaagucugucucuuugugaacauugugugucugcaucucuuagcucugcucugagagcccauugcuauucugagugguacuuuuaaaauauuuucaaauuuccgacuggcuaacaaaguccaggaggaaagaagcuauggcucugccccaggcugucaaggcauugagaacaacuggaggccugagcuccccuccuuccccgccauguccuggucuuaagauuggcucuccucacagcugccucagugaaggugaaccuugugcugauguggcaguugauccuaaccaacgacugcacuuucuuggaagcccuaccaaaaauuccuuuaaaacucauaacuuuucauguggguuuuuauugauuugugacuuguaggcauagucuuuggcauaagcagaaccaaggucaucguuucaaaggugccaaauugguccuauaagauggauagcaguguuuggaaaacuguagcacaagcaguguguucacagcgugguguaauaugagagccugaucagcuucgagagccaguguucuugacucucacauucaucuguauuuuuuuauuagacuuucuuacaacugccaccugccaugguggaagaaggugaggaaggucagagccaagaaacagaaauggaagcagaagaagaaaccgugucugcucaagguaaccucacacccaguccagcggaugccagccugagucaagagaccccagccgcucagccugacugcuccagucagacagaagacaccucugccccgugugacauugcuacugcagcugagccugucucugcagcagcagaagcugccaccccacaagaugcagagucuguccccacagagaccgaguagccuaucugcagcacagccugggacauuccauuuauaaacucuaagugagguuaccuuuugaauuucauacuuaguuacuguaugacuuuaauaacaccagcuaauuucaguacuuaugguuuuuagcugguuuccuuauuuuguauauuuuuuauuuguaaauauuaaaaauaacucuaguuucauuuguucauucagaagagaaaauaauuuugauugcugaauguaucugagguaaucccugcauuaaaaucauuuucuaucaaacauguaaggcau

SEQ ID NO: 990 - RNA, 8016 nt, Mus musculus
ucagagcgcgccugaacgccgcgcuugcgcacucagccagucgccgcgcugacccugcggacgugagcuugccugccgucuuggcgaaacccaggcucugagaugcgucccugcccggcguuugccagcuccgggugaguguggaggaccccagaagccugcgugcgagauggaacgaaucccggggagggucaggccugcccaagucccgccgagguuccuggggauccgaacagggugccacgaccucggcuccuugcaugugcuucgucagagcgguaaacucaaaagagcugagccccgcgccccaucuccuggggucgaaucacuuauuucccaucuuucacucagcucuuccccugcaccccaucuucuggcugcagucaguggagcuuucacccuugcccuucuuuucuaggcaugggauaucacagucccugaacucggcuugaccccugcagacuccuuacuugcacagcagaugaggccaaacacauagcuuccgucuagggaaaggugaugcauggaugguucaaggccaagagagugggccauggagagaaaaagaaaaaaaaaaaaaaaagaaagaaagaggcgaagacuguuguaaauguuaccauagauaauucuccaguuggaacucuuaaguuucucuacgguguuuuauuucuuucuuguaauuuauuuuguauuuugugauuuucuuuuaaagagguauuugcaaagacagugcuacuuucaaccuugaaacaacauuggauuuuaucgaugucaguuuuuauaguuacuuggcuuaacguugugugagcuccuaucauguuauaaugucuggauagucauugaggcacauccauugguuugucauguuucacuuuaacgugaaaauuagcuuuuguguauuuuuuaaaaaguuuaaaaagccaaugggggaaaaaagaucaggugaaugggauuuaaaccucuaaguccacaggggggauugugcuuggaguguggaaaucccugaccuuuuacuuauaaauaggaagugagaucaccacuugccacaaaugauucugacaagguaggguucgcaguaagugcguauccaauccuaauacuagugauagcuacuugaccgcagacccuuuugaguacaggagcuagagguagccagugccuguuguuuauaaucauauaguugccuuguguuguuuuagugcgagacuuuuuguuuuuuugagagagggugguagucuguagaaucaguaaguggaaggagaaguauacaaaaagauuggagaaguucuugaguuccccacacucaaacccuauaguuugaccuuaggcaguuacaagguuuugcccaccaacuuccuggggagaagcugccuucccauuccauacuuaguauggagucagugcaguacagagguuuuuuuccucccuuuagcccuucaccagcccucuccuggcacagcccauaggaaaaagggaaagcccuuuguuagacauuuuccucuugugcacuauauccauuaacacucacuuggugucuuucuguuuaagagaacacuguugcagcaagugaaggaagguuugauuauuuaagcuuggcucauuguacugauugacgaccaucuugacaguuguggcucagcaggaauucaaugaauugccugacaggaauuaaauauauuucugaauucuuugcagucugcuggguuuaugauaauuuuaauccuccuaacccuuaacucuuugccaacaaguuugcauguuguucguuuuuagguuuuuguuguuguuguuugguuuuuguugcuuuguuuuguuuuucaaagcugagagaaauagaaauacccauaaccccaacagguguuuguugcuggguuauaugauauauuuuauaaauuaguagaguguuuuauggucuaauuguuuuauuucguuauuuaaaugaauuuuuucuuuugacuacuaauaagauaauuuugcaugcauauuuuaaaauaguugaaccaaugggaagaaaacaggacucuauuguguuccuuagagcucuugccugugggcacuuacuaugugguauauauucugcuacuuuaccuauuaagccaauuggccugccugugauccauugaguugacuuuacagcuaauaaugaguauggaccuguacaucggaaaacacuguuaaaagcaacuaguacaaaauagucucucaaauuuuauuuguuccuuauucagauugcacaaugaguguauuugguuuuguguuuaaagugucgccuaggagagauaauaaccauauagguugacuguuugccaaguugguagacaaaagaauucuuaguuucuuguauagcuagacauucuguauacuauaaugaaagaagagguguagcuucaguuaguuuaguuuuuauuuuaauugcuggcauauuuaaggcuaauagaauaguaauggagaagaaccuugucuuuucugggugaugauacaugagaauugugaaauguuuguuaaguuuuaguuugucucaaagauauguguacugaguacaucuuagaccagaaugaccuauuuugaauauugccugacaaaggaaccacauucaacagucuguucuuuguucauaaauacacaugugagugugcaggaugucagccucguucuuuuguacuuguuuuugucaggaagucuucaacaaagcagaagggagaaaagaacuacauuuugugugucugucuaaggaaccuaaaauauuauuacagaaauaagagucacaacauaaaauuuggcaucuccuauuucuguguugcuucaggauuuccugacaugugcacauacguuauugccauucauuugcacagcauugcucccaguuuaaagaaucucaaauucuccuuucuuccugacacacgaacuauacaggaaaaaaaaaaaucuaggauuaaaacucaggucuucugggaauauucuccuuguugaucuuaaauauuugaggagaaagaaggagagcgcuuuguggguuuuuauuuuuuuguuuuuuguuuguuuguuuguuuguuuguuuuuggagacuggaucucauuuuauagcuguggcuguauuggaauucuguaaagcaguauagacuugaacucacagagaucuacuugcuucugccugccaucugccgaguucaaaggcaugugccauccagcccauugagaauaguuuuaauguugugucaaccaucuaaauauaauuaaaugaaaugguuuaugaucagagcaugucuguaguauugcuauaauucaaugauaaugucuuguucuuaauauuuuauauuuuuaccuuuuuuauaaucaauuuacaaauauuuauuuacuguuagggcaggagucucacuagcugagccuggccugaaauugcugaauagcccauauugaccucaaacucacggucuuuccuguguuuaauguaugauggguagcuuuagaggugcaccacaauaacaggguguuuuuuuuuuuuauaaugacaaagcaacuuauuggcauaucuaauaaugaagaaaguuggaacugaaaggguuauugaauguuaaaaaauaagguuuggucauuuuucaguauagcuuaucaaguuaaaaaaguacuuuaaaaacuuguagaauuuuaaauauuuuuaagacuuaaaucugucuaaaauuaguucuaugauuauaaagaauucaucuaagaugguuguuacaguacuugaaaacacaagaaaaguacaaauucucccauauuuuuaaucuuuagccuaaggaaauuacuugcuuuuauacaaaucuuaaaauuaauacuucguugguuuuguuuguuuaauuuuuagaacucuguggaacuuaagaaugccauggaacucaucaggauaugccacugaggaaugugauggcugaaaacaacuuuaaaaugcugaagauucagcaauguguagccaacaaacuaccuaggaacaggccauauauuugcaauaucugcuucaagcacuuugaaacaccaucaaaauuagcuaggcauuaucucauucauaccggucaaaagccauuugaaugugaugugugccauaaaaacuuuagacaacucguucaucuggagaggcaucaguuaacucacaaucugccuuucaguuguaauauuugccaacgccacuuuaaaaauuugaagacauuugugaagcaucaacagcuucacaaugaauccuaccauaaugauguuaaagucagaagacugcuugagaccaagcaagagaagccgguauauggaauguguaauacuuuuacugcagaugagagaugggcacuacacccaugcucuaagucugaugccacauacagcaccacgaagagaagaaagaauauccacgcguguacgaucuguggcaaaauguuuccgucacaaucaaaacuugauaggcacucacuuauucacaccgggcagaggccuuuuaaauguguccugugcaguaaaucuuuccgacagucaacccacuuaaaaauccaccaacucacacauucagaagaaagaccuuuucaauguuguuuuugucaaaaaggauuuaagauucaaagcaaacuucugaagcauaagcaaauccacacuaggaauaagacucuucagaaucuuccuuuaaaaguaaaaaguccugagucauguccccuaccuaauaaauuaaacgcaaagcaggaugcuuuugaaaguggugauaugggugaaucugaggagaauaauccucuugauguccacucaauuuacauugucccuuuucaguguucggagugugaagaauguuuugagucagagcagauucucaauggacacaagugucuuccugccagagguggcagaguuccaagcagacucaaaagaagcuguaacuauaagaccauuguuaaaaagcucuuggcuaaacuuaaacgugcuggggguaaaaaaucagaugaucuucagucagagaagaagagaacauuuaaaagcaacuaccugaaaaauugugaacgcucuucugguaagccgaacauagaacaaacucagagaacauuuguggguucucuuagcagacaugguucauacaagacaguuagcaaaaagaagaagaaaacucuggcuuugccauuuucuuggcaaaagcaauuccagagccaaaauacggguaagaguuugcaaggcauccuuacaacgggaagcauauuaucuauggaugguuccgucaauaauaaagacuugucaaucuaugguucgucaggugaggaauacuuaaacugugacaugcuucagugugguuuuucagauucaagugaaaauauacauacuggacauaagaugugucccugugauaaaugugacaaaguguuuccuucuauuucuaagcuacaaaggcacuauuuaauucauacuggacagagaccuuucgacuguaauguuuguggaaaaucuuucagacagucagcucacuuaaaaaggcauaaacuaacucauauugaaaagauuccuuacaguucuuuuuggcgaguggacuuuggaaaugugaaccaacuuuucauccauccaagugaugauguuagcuauaaugccucccaacagugcgaggggcuugguucccaaagcugugaaaguucagaguccagucagguaucagaaauugaagucaagguagaaccagaggauuuucuucuugguucccacuguaggagcaggcagucuuaccucgccaacgcacugguggagucagagcagagccaucauuguuacaguuacuuaggccguccugaaagaagugacgggcuccuuuaccagugcaguguuuguuguaaacauuuccgaucuccguccaaacuagaaagacacuauuuaauucaugcagggcagaagccauuugagugcucagucugugguaaaacauuuagacaagcaccucauuggaagagacaucagcucacucacuuuaaggagcgaccucaagagaaagugguucuagacucaacuguguaacggaaaaccacuaaugugauauaauaccccauaaggcauuuuugccaaaggccuacauuuggugacuucauaggcaauugcuugccaugcauaaucaggaguaagauaaauaaaauggguguuuuagacacaguuaaaugacuugagaaggaauagcauggucugaugccauccauaggacucuaagguugucagcauauaacucugguuguauuaaaagcuaggaauccaucauguccaauuuggccucauguguugaauuacucaagaccuugugugucuuugguuuuaugcguaucucccagaaggaggccagaauugccauucagcugcaacuaaccauccugcccuauuuacuucuacauggaagcguacauuuuauugcaaaacaguuuucuuacaaauuaagaguaauagauauggaaauagguuggggaaauuaaagcauuuuacuuuucuauagugguuucuccccccccccaccccuuuuuugagacugguaauuuuaccuucuaagacaaaaguuuuaccccccccccccaaaucccaaucuagguuacuauuuucccugaggaauuuaaaaguagcaagaagcuggguuguacccauguguauuuaccauccacuaauguuuacauuugcaugguguuuuccaagggccauuaugucagcaguuguaucuuuuuaguuaaaugcagugcaccuguuugcuuauuagugguugacagcagacagcaguggccaggggcaagacuuugcuuuaacaacucuuuggccauaagaauuaaaucucuucugcuaaauucaaucaaauggcaauagcuauguaguuucagacuucacucuucugugaaagacacuaauguuacaguauuuuuuuuuuuugaccuucguuguuccuucaguuagcaaaagucccuauacaggaauauggugcuuagaaagcucaaggcaguauuuguuucuaaacaguauugucaugacuugacaaaauauuucauuuaauccuaauaugaaagaaaugaccuagucacgaguccuucacauuuguggcaguuuguaaaaucuuugacuaacauuuuuucgcaauaaaaaggucaacuguuuuguuucuaaggugaaaagaaacagguggauauuucacaugcuuaaauauagugaaaagcccucuguuggaaguaugggugauggaguaauuguaaguuuugaucaugguguaagagcuguacuuugugaggggaaggaaggaggaaagcuuucgccccaagugagccuuaagaaacuuggauauaauuuacacagaugaaaugugacgguaugaguaaaauauccagaugauaaauaaaugugccuauucugaaguagagaaucugucuaaagaggagagccgcaugcuccaaggaauagcuucuguuucuuuaagacuugagguauguguuuccugcgcaaacaaguggcucacagaaccgaaugcacagaacucuuaaggaugcaucuguugguuaaaagcaaagcauaaaucguucauguuuuccaagaguaaaaguucaagaguuauuuagugugugaaauuguggauuugggcauuucuuuaaguaauuuauauaauuuuauuugaaaagaaaugccugauguguuucuuuccccccuagacagggaaaguucugaauguugugcuuguaugaccaugagucuuugccugagugauaagauacauuuuuuuuggcucaugccuuuugaagcuguuucauauugaaaguugaaauauuguaaaaauuuugucaagagauguauuguagugcucuuugaaguaccuguaacaaaaaaaacuuaccuuuauuaccauugcaagcuucuuaugggaauuguaggaguggaaauaaaauaugaauuuauguuaagauaaacauguuaaaugaugguuugcugcaugcuagaacuguacuuacugagucaauuauuuugauuuuuuuaaaaaaauaaacuuuauaaauaucuuuuaagagaacuagag

SEQ ID NO: 991 - RNA, 1231 nt, Mus musculus
uuuauuuucaacuuacuucucguuuauuuccccaccacuccucuuggcuccugccuaacugggucgcguuggggauguuuggcauggcgcucuagcuuuuguucguuuuaauuccgcggcccccuuccucugccggcggauuacuaggucccgaacucugccacuacaaccuagagcagcaagcuccgccaacugcaccaccgccaggcuaggauuuuuguuguuguuguuguuguuguuguuguuaagugguacuuucuuucucgugcagaugcagagcccuuuuugucaauauucauuuuugucuaguacaagauaugagcagcugaacucggagcauagucccucggugcgcugcagacaguguagaccaccauugagagucuagggguccugggcucaaucuggagggagaaagcaggaugagaguuaguagggcgggaguuagugggguaggaguuagaggagagggaguuguuugguguuuguuguuuaccgauguagacaaguguguguguguguguguguguguguguguguacgcgcgcgugcgugcgugcgcgugaccgcugugcgccucuaaagugaaucuuggaucuaggaagcaccggaggagaaagauuaaaaagcaugugagacagaagaugcuugcgaggaguggcuggcucuggcugcccagcuuuguugugguugcccugggcgcagcgguuguaaagagggcuaaaggcugaguuaauuacaccgggaggauuucgcuggauggggaccaugggacuggcuccuaaaguuuucccaaaaggaaaaggaagcgaguaggguuaaaaagguaaauacccgacuagguuuugguagaaacuaguucuggccggggucccgcccaaucccuggccggaguuccagcuggcuuuaccucugcucugcuguuuccccgcggcugcgcgucaaucaccgagagacgagagcugggggcggagcuuuggucacccggcgcgcguagccggguucacccugccgccaccaggcagcuggcagcgcgacccagccacgcacugggagcgcgcccucuccccaacuucucacccucgcccuggguuccgggccccaggcccagagaauagcaaacagaguaaggguuugcuguucaacugcggccucccuccccaacucugaaccaucccgugacagaaagcagcgccuccugcaagggugccuuugacuggacuuucucaug

SEQ ID NO: 992 - RNA, 1231 nt, Mus musculus
caugagaaaguccagucaaaggcacccuugcaggaggcgcugcuuucugucacgggaugguucagaguuggggagggaggccgcaguugaacagcaaacccuuacucuguuugcuauucucugggccuggggcccggaacccagggcgagggugagaaguuggggagagggcgcgcucccagugcguggcugggucgcgcugccagcugccugguggcggcagggugaacccggcuacgcgcgccgggugaccaaagcuccgcccccagcucucgucucucggugauugacgcgcagccgcggggaaacagcagagcagagguaaagccagcuggaacuccggccagggauugggcgggaccccggccagaacuaguuucuaccaaaaccuagucggguauuuaccuuuuuaacccuacucgcuuccuuuuccuuuugggaaaacuuuaggagccagucccaugguccccauccagcgaaauccucccgguguaauuaacucagccuuuagcccucuuuacaaccgcugcgcccagggcaaccacaacaaagcugggcagccagagccagccacuccucgcaagcaucuucugucucacaugcuuuuuaaucuuucuccuccggugcuuccuagauccaagauucacuuuagaggcgcacagcggucacgcgcacgcacgcacgcgcgcguacacacacacacacacacacacacacacacacuugucuacaucgguaaacaacaaacaccaaacaacucccucuccucuaacuccuaccccacuaacucccgcccuacuaacucucauccugcuuucucccuccagauugagcccaggaccccuagacucucaaugguggucuacacugucugcagcgcaccgagggacuaugcuccgaguucagcugcucauaucuuguacuagacaaaaaugaauauugacaaaaagggcucugcaucugcacgagaaagaaaguaccacuuaacaacaacaacaacaacaacaacaacaaaaauccuagccuggcgguggugcaguuggcggagcuugcugcucuagguuguaguggcagaguucgggaccuaguaauccgccggcagaggaagggggccgcggaauuaaaacgaacaaaagcuagagcgccaugccaaacauccccaacgcgacccaguuaggcaggagccaagaggagugguggggaaauaaacgagaaguaaguugaaaauaaa

SEQ ID NO: 993 - RNA, 8067 nt, Mus musculus
aaugccaacuuuaacaauaaaaauaauaggaagcaacaauuacuuuuccuuaauaucucuuaauaucaauggacucaacuccacaauaaaaagacauagacuaauagacuggcuacacaaacaggacccaacauuuugcugcuuacaggaaacccaucucagggaaaaagacagacacuaccucagaaugaaaggcuggaaaacaauuuuccaagcaaauggucugaagaaacaagcuggaguagccauucuaauaucgaauaaaaucgacuuccaacccaaggucaucaaaaaagacaaggaggggcacuucauacucaucaaagguaaaaucuuccaagaggaacucuuaauugugaauaucuaugcuccaaauacaagggcagccacauucauuaaagaaaaucuugugcgcgcucgacuggccaggaagaacgacacugcaacagaauccuucuguacacguuuauugggagagcuugauuguagaggugaaaagaccccgagcccagaacuggugcugcuuauauaggccuaggagaggcgugucucacaucugauugguuaacuugucucucaucuuggcaaaagaaccuucacugccuauguaugugugguggucagcaguagccaacugccacucugcaacugccacucugcaauggcuucccacaucuccuguuuuaggucguuccucuaaugucacagccauucccaucauaggguaacccuaucgccacugggccccgugucuuagguuggucugugcaugaggaaaguugcccgucucuggauaccgcagugcugugugacaguaacugcuaaaugaccuagggugaacuuuuggcccacaaagguauacuuaucccggucucaaucaucaggagcaggaucaucuucggauucaucuugaucauucacaguccuugucagucccuucagaacccaaaguggauuuucuucacccgguaccaccguuccugagcugaagaguucugaauacaugcagucggauccuucucagcagucuguuuugcaggaacacuucauuaucaccauuccccagcuuaagaguucugaauccacgccggauccuucucagcagucuguuuuacgggaaccuuuauuaccaccguuccccagcugaagaguucugaauccaugcuggauccuucucaacagucuguuuuacgggaaccuuuauuaaccgcuccuuccccgugaugcaguucugaauccuuccuguagcaggaugucuucgcuugugccugaagauguuucuuuucccggguuuucggcaccacuucuugcgcaugcuugacuggccaggaagaacgacgcugcaacaggauccuucugcacacguuuauugggagagcuugauuguagaggcgaaaagacccgugcccagaacuggugcugcuuacauaggccugggagaggugugucucacaucugauugguuaacuugucucucaucuuggcaaaagaaccuucacugccuauguaugugugguggccagcaguagccaacugccacucugcaacugccacucugcaacggcuucccacaagaaacuuuaguaaagcuuaaagcacacauugcaccucacacaauaauaguaggggacuucaacacaccacuuuuaccaauggacagaucauggaaacagaaacuaaacagggacacagugaaacugacagaaguuaugaaacaaauggaucuaacagauaucuacagaacauuuuauccuaaaacaaaaggauauaccuucuucucagcaccucaugguaccuucuccaaaacugaccacauaauuggacacaaaacaagcuucaacagauacaaaaauauugaaaucaucccaugcauccuaucagaucaccauggacuaagggugaucuccaauaucaaaauaaauaauagaaagccaacauucauguggaaacuguacaacacucuccucaaugauaccuuggucaaggaaggaauaaagaaagaaauuaaggacuuuuuggaguuuaaugaaaaugaagccacaacauacccaaacuuaugggacacaaugaaagcauuccuaagaggaaaacucauagcucugagugccuccaaaaagaaacuagagagagcacacauuagcagcuugacaacacaccuaaaaggucuagaagaaaaggaagcaaauucacccaagaggaguagaaggcaggaaauaaucaaacucaggggugaaaucaaccaaguggaaacaagaagaacucuucaaagaaucaaccaaaggaggagcugguucuuugagaaaaucaacaagauagacaaacccuuagccagacucacuagagagcacagggaaagcauucuaauuaacaaaaucagaaaugaaaagggagacauaacaacagauccuaaagaaauccaaaacaccaucagauccuacuacaaaaggcaauacucaacaaaacuggagaacuuagaugaaauggacaaguuucuagacagauaccagauaccaaaguuaaaucaagaucagguuaaugauuuaaacagucccauauccccuaaagaaauagaagcagucauuaauagucucccaaccaaaaaaagcccaggaccagauggguuuagugcagaguucuaucagaccuucaaagaagaacuaaucccaguucuucacaaacuauuccacaaaauagaaguagaagguucucuacccaacucauucuaugaagccacaauuacucugauaccuaaaccacagaaagacacaacaaagauggagaacuucagaccaauuucccuuaugaauauugaugcaaaaauccucaauaaaguucucacuaaccaaauccaagaacacaucaaaacaaucauccauccugaccaaguagguuucauccuagggaugcagggaugguucaauauacggaaauccaucaauguaauccauuauauaagcaaacucaaagacagaaaccacaugaucaucuccuuagaugcugagaaagcauuugauauaauccaacaugauaaaagucuuggaaagaucaagaauucaaggcccauaccuaaacaugauaaaagccaucuacagcaaaccaauagccaacaucaaaguaaauggagagaagcuggaagcaaucccaauaaaaucagggacuagacaagacugcccacuuucucccuaccucuucaacauaguacuugaaguccuagccagagcaauucgacaacaaaaggagaucaaggggauacaaauuggaaaagaugaagucaaaauaucacuauuugcagaugauaugauaguauauauaagugacccuaaaaauuccaccagagaacuucuaaaccugauaaacagcuuaggugaaguagauggauauaaaauuaacucaaacaagucaauggucuuucucuacauaaagaauaaauaggcugagaaagaaauuagggaaacaacacccuucucaauagucacaaauaauauaaaauaccuuggcaugacucuaacuaaggaagugaaagaucuguaugauaagaacuucaagucucugaagaaagaaauuaaagaagaucucagaagauggaaagaucucccauggucauggauuggcaggaucaauauaguaaaaauggcuaucuugccaaaagcaaucuacagauucaaugcaauccccaucaaaauuccaacucaauucuucaacgaauuagaaagggcaaucugcaaacucaucuggaauaacaaaaaaagccaggaucgcaaaaacucuucucaagaauaaaagaaccucugguggaaucaccaugccugaccuaaagcuuuacuacagagcaauugugauaaaaaaaaaaaaaaaaacugcaugguacugguauagugacagacaaguagaccaauggaauagaauugaagucccagaaaugaacccacacaccuauggucacuugaucuuugacaggggagcaaaaaccauccaguggaaaaacgacagcaucuucaacaaauggugcuggcacaacuggcgguuaucauguagaagaauucgaauugauccauuccuaucuccuuguacuaaagucaaaucuaaguggauuaaggaacuccacauaaaaccagagacacagaaacuuauagaggagaaaguagggaaaaaccucaaagauaugggcacaggggaaaaauugcugaauagaacagcaaugacuugugcuguaagaucgagaauugacaaaucggaccggaugaaacgcaaagcuucugcaaagcaaaagacacccucaauaagacaaaaaggcugccaaaagauugggaaaggaucuuuauguauccuaaaucagauaggagacuaauauccaauauauauaaagaacucaagaagguggacuccagaaaaucaaauaaccucauuaaaaaauggggcucagaacuaaacaaagaauucucaccugagcuaaaccgaauggcugagaagcaccugaaaaaauuuucagcauccuuaaucaucagagaaaugcaaaucaaaacaacccugagauuccaccucacaccagucagaauggcuaagaucaaaaacucaggugacagcagaugcuguugaggagguggagaaagaggaacacuccuccauuguuggugggauugcaagcuuguacaaccacucuggaaaucauucugcugguuccucagaaaauuggauauaguacuaccggaggauccugcaauaccucuccugggaauauauccagaagaugcuccaacccgugagaaggacacaugcuccacuauguucauaguagccuuauuuauaauagccagaagcuggaaagaacgcagaugcccaucaacagaagaauggauacugaaaaugugguaagaggaguuugguugagcugcagcuguuugucuguuccacacaggcuugggcccuaugggggauauggagccccaggacuguugaggccuggaagucccucuccuuccccuucccccuuugccacuuuguggcauuccccucccucuaccuucuccuacuuugauaaccuggcuaugacuagcagaaguacagccaggcccaaugggcaaccccaggccagcaaaauaugccaguucaaauugguccugcugggagagucugcaguggggaagucuagccugguguuacguuuugucaaaggacaguuccaugaauaccaggaaagcaccauuggagcggccuuccucacccaauccgugugucuagaugacacaacagucaaguuugagaucugggacacugcugggcaggagcgauaccacaguuuagccccuauguacuacaggggugcccaggcugcaaucguggucuaugauauuacuaaucaggaaacguuugcucgggcaaagacauggguaaaggaacuacagcggcaagccagccccagcauuguuauugccuuggcagggaacaaagcugaccuugccaacaagcgcaugguggaguaugaagaggcucaggcauaugcagaugacaacagcuuauuauuuauggagacuucagcuaagacugcuaugaacgugaaugaucucuuccuggcaauagcaaagaaguugccaaagagugaaccccagaaucuggggggugcggcaggccgaagucggggcguggaucuucaugagcagucccagcagaacaagagccaguguuguagcaacugagggguggcucgaagcaaauauguauggaguuagcacgagagcuaagaaauaaccuccauccccaccccucagcacacagucccuacgguaacagcacacugagcccuggcucccaagggcugccuccugacagcuccaucauggcacuuuuuaaugcuucagcaaccaacaccaggcagcuguugccacuacuaugcccuuccuggggcuuggggucacauuuccccaggaccuuccuuccaaaacaaacuucuucacuuguguucuaggugcaagacagugaccuucucauugucccccaccccuguguuuuuccaguguuucagagaagacuucugucuccugccucccaucccaccuuucaucauuacucccucuucuugauccuguuucuccucuuuacaagaugaugaaggguaaucccagggacugagaagggagggauauacuuuuaguuacauuaaagaccuuguggggagaguaaggcucgcagcaggagggagugaggaaacauugcuuucccauuuuauuuaucugguaagaguuucuugucuaugaaacacuguggcaccaaugaguaggacuuguggagggcguuccuagguaggagugagaacagggagucaagcucacaggcacugaaugggaguuuauuaguaggacaaagguugaggugcagugucauccguggcucuggaacuugccccgaggcugguuucccuuuuguccccauccacucaccccacucaaguguggggauuggaccucagagugcuccaaagaaucuucacugguugccugcaccuuuagcucugcugugaucuaauuggaggagguacucugauaccguccucugaggccuauguauacauaggcauuuccccuacccuggccuugagauggccuuaaccccagacaccaugccccugcaguuugcacuuuaauugaugguaguucagucaagauacagguuuuuguguguguguguguggggggggguugauugauuuaccuauccuucaaccguuuuaauuaaauggaaucuacaaugaaugagguuuggcccuauagaagacaguaacaguggcagcuacucacacccagucuccacugcuagcuuccucugacugauucauaccucuauucuuggguauagguuugucugagcaacuggggaguggccucagaauagcaugggccaugguaguggaguaaggaaaggucaggcaaaaggaguguucuaucuucccaggguucacauucaguuugcuaugucuuaccaugucuuuucuacuucccuguaaauacguauaagucuuuauucucuguacaaucugcucugccuccugguucccauuagccuucuuuucuucuccuuuuguuaauaucuuggguuuaguuccuccuucauucccccacuuacucuuacuuaauccguguaccacuaggggcuccuaccacaaaggcugcuuguccaaugacagggcagcuagaacugaaggugccucacaacugccuuguaucaucagagggcuuugguccuuccuaagucucuggccucucuacguccuauauuagguguuugagggugucugugggaagccaucaaagcaagaggaaacuugguauuuuagccagaguuugggagaaacaugcagaagaaaggaaaagaccacgguaaccucgaguugagccuuucugccccuugggcuuagagacugacuuguguuccagagcagcugaggaauccaugaggccaagauucucaaggacccaacuuagguuccuccacuuaggacucaauucucuuccuuuuccaggggcagccuuaguucucauggcccugaaacauauauuuacuuuccuagaaccuguucaucugcaaaauauccaggcauauccuuuuuacaaguggagacucgagggaagcucuccaaguuucuuagaaacuuaauuccuucucugcaaaagugaagauguuuuauugccuuggggcugggaaaccauuucccuaggcuuucccucccucccucccucccuccccccucuccccccucuuaggaacaguauuggccuuaguuccuggccuaccugcugccuucccucuccuccugccagcucuccugccuucgcuggagcucuguugggcuugagggguuuuguucucucccuccccucccccguuaccuuuuucuuuugaucaguuuuuagggggagggcucaacauuuuugccuuuauauuucuuuccuaaggaagcauuugccuuucuuucacucuccuaacauaacaaucgugguaacagaaugcaacugcugauuuaucgauguauuuaaugcaaguaaaaaaggaaaaaagaaaaaaaaaaagaaaaug

SEQ ID NO: 994 - RNA, 1222 nt, Mus musculus
ggagcacccugcucauuguuuugggggagucccauguaaggauaugggaacagguaauguuucauguaugugguauuaaagggcauuuuccuuaaccagaauuuccagacaauuggaauugacuuuuaagcaccaauacuuuuaacuguccagauggaacucuuccuaaaccauaauucaacccacucuaaauacuauuucuuuaugccucuguaagcagguuguauggaacauaauuugaccuuuccuugccuguggagggccuucaugaauacuaauuguucuuugcugacacaauguuucccucuggaccaauauguucucagguuuucaaaucuuggaucccuguucguuuaaagaauuaaaacaauuguuccgugcuggauacuguuagggcuuuccuuccacaggugugcucuguguuguuacgccugcugucgaugguguacacuuucaucuaggggcgcugaccccuucccccuuccuguuugucauugccacugggggacucuaugcaucaagcuacuucagacuggaagagaaagggaggaaaugugauguggccacaucuuuuguggaaaucaagguuucuguuccucacaacugcuaaguggcugaccucugacacuggaaaguugaguuugucaauugccuuugggucagaagucaugccauuagaacugagauauucaucagcaacacagucugcugcugcugugugugagugguuauucuuaucuagauuuuuuuuuuuuuugagauaggguuucuguguagccguggcuguccuggaucucucucucuguagacuaggcuggccuuggacacagaaaucugccugccucugccucccaaguacuggcauuaaaguugugugccaccacugcccagcccaugccuagauuuugcuuucuggcagaguggcuaaaucugacuccuggcuucuuagcuuuucuggaagaaaaaauuuuuuuaccagaaaauugaucuugcuuaccuuuuacugaaccucagugccccuuuacugaugaagccauccuagaagaaacaccaauaguaaauacacaauuucuggaagcugccagauaaacacuagugaaucauuaggugaauguuaugguuauccgaaccuuacaauuucuugacauauguacaaacagauguaauuuuuaaagaugaaaguugcuuuaauaaagauuaauuuuaucuguucuuaaacucg

SEQ ID NO: 995 - RNA, 3848 nt, Mus musculus
cgcaggccagcaggggagagggaaaggaaacaaaacaagacaaaaaaaaaaaaaaaaaaaaaccacacacacacacacacacacacacacacacacaaaagauguuuauugcaaagcuacagucccagacuaaccuggagggauguuugaauucuggaaaaccuuauggauaagccucgcaauuauguacuuagucacaaccagaggggaggaacuuugaaggcacugaauugaagagacacaaaagucaggaagugacccuuucguggggacugcagaggccacagaggagaaacaaagucccuucacaaccagggaagacggaccguaccaucccggggggccggaguggggaagagggcgguggaaacugacauccucgcucucaaggagccggcgaggacacgggauuucccgacugaaaagccucaguguucgccuguccccgcacagccucucccccuccguggaggccuggguccggcagcccgggggcgcccugcaucaccgcucugugcgcgggcggggccgcgcuccccggccuggagauggauggcgugcccgagccagcccaucugcggccgcggcugguccgggaggaagccguccccggggaugaauggggcuuuguucgcugccagccgcgcuccccucgcggcccggcccggcacaacggaggcaguaugcgacaggcauggaaaugagccgcgggcucuccccucgcagcgcccaggaaugcuggccagccggaaaggagcccucgcuggggacccgcucccgcgccucugaaaccccauugagaagggcucuuugaagcaauuaaagcgcguuucacggcggcccgggagggggcccuggccguccagcuucucuuuuuaccccucuucucuguccgaucguguuugugcaccuugguguggcggguuaccuagaaaccaggccagaacccgcucccucucuugcagagauucuguaaccucacaaaaguguccccauaaacagauugcuugucaccagggggcgggggugugugcgggcuagaacccaguuuggacuugcuccaagcugaccugcagagccuggguuccugcuuucaaaggcuucuuugcugggcucugcacccaccugcccugcagucagguuuaggcagacagaaauugccucuagaugaaaaaguccugaggcugcggcucagcauuuuccauuuucucagugguggggugggccgcguucaggucuagaagugaugucacaaccagcccuguaaagugauguaaccugcacuuguugaaggacuaggaccgggcuauuuugagacucuugaguuucuuccuuccccccuggagaaaagugggugacugggcaacucacaaagccgcucuggguacagcgguucucauuuguuaccggggaaaaucuuaaggcucaggaacugauuccgugaagaaggauggaauuccuucuaaauuggaggugggcaccuuauauauauacccauggggcaagugugugaacugaaggcccaguaacacccauauaaaaagauuucauugaguucucuaguugauuuuauagugcuuucuuuccucuaggaguuaagucugucucuuccccagcaggugcuuccuagagaacaggauucuuuuguuguagcuuugcuuuguuuguuguguuucugagacuugguucuugaauuucccucuguggccaagaauggugguauauuccggaucggccugccucuaccucccaagugcuggaguucaggcgugugcugccuugagcaucaugaucucuuuggggggggggggguuguuuguuuguuuuguuuuguuuagaaguaugggaaagguucuguguucagagcagguccuuaacaauacuuaugcuaggcaaauacauucaaugaaggagcgaaugaaguccgauccucuguuuuguuuguuuuguauaauuccaaacgagaaguagaaguagugagcacaaggugguuccugggcaaggaagacguugagaaguuugaagggaagguucgggaacauuuuugagagcacaaacaugccucaaauguuuccugaaaugacccagaggagagcaggcacucaggugggggacucauucuuuccaaguuugggguugguugguucuggcuaacaugaaucauguuuuacgucagugaggaguguaccccguccaucauucacucuuuaagcaugccauggaaacaggauggucagucagagucaugguugugcgugguaagcaucauugcggcucaugugcuacuccagugucuccauggugauuguuaccuggggcuuggcuuauacuucuauuaggauauuuuuucuuuggggcuuggaauauaugauuuuuuuuuuuucugcacacaccacacacacacacacaccaucagucaggaagcaaaugaacacaagauggaagaggagaaugcccuaccugaagcauaaucccagcacaucucucucucucucucuccucucuucuuacacacacagaucaagcaauggguaguccacuucaagaauggugccccaguguuuccuuauuuacuagggcauagucugaccaccagcagguugcuguacacaauaacuuccuuucuuauccugggguuucaucugacggccauucuggucuccauuuugcuuuuguauagacagccucucugacagcugagauccucucagcuucauucauucucuuuagccuuguagacacgacuggccagcacagcaaaaagccccacagacgagguaccugggcuagagcacaggccacacacuagcagugccccucacacagagaccuggugagugcucuagaaaucaaguaauccuguuccuuucugccuuucagcuuggucaugagcaggcaguggucuuagcaaauauuaacaauccaaaugucaaaugcuguguggugguacacaccaacaaucuuagcacuugggaaaguggguugagaguucaaggguuauucuuagcuacgcaaugaguuugaggccagcccagggacacucagaaacucugucucaauuacucuaaaaggguuaaauaacaaacauaaauaugaccacuaaucagaauuaagauuguuucuuccgucucugucccugaaaauccuucaggcaucugggguucuaaagccagggcagccucaagugaagugagcagacugaauagagagacaaacacaaagugcccuuuucaaucugauaagcucacagaaguucugucacacauugccauuuuuuuuuuccaggaaugaauuauuggguuuuuuuuuuuuuuugagccuuguaauuuguccauuaaguagaaaaaugcccagaagaccucgcuuuuauuuaccagcugacccgcgaccuuaaugaggcuucgcuaaaggguaggauggagaguuuuauuugucuuugucuuguguuugggguuaaaaaaaagaagaagaagaaagaaagaaaaagaaaaagaaaaaaaggagaagcugccucauucaacagucuuuuggucccuaaaauaaaccccacucccccuagcagugcuauuuacucaaucuccgggcuacuaaguguaggggugguccuuguugacuuaaaugagucccugcagcuagguggggcucucuggaguccuuagucaugugagguugccaggguaacuuaacgucuccagcgcuggaaugcuuuaagacguacaaagaggagacuacagagcgcauuacaacuuacagucauguguucaauaacaugucaucuuuucguaauggggcuuuuauuuuuacuuuauuuugugggauugaaagaucagaagccggaaauuagcugg

SEQ ID NO: 996 - RNA, 61346 nt, Mus musculus
cuccggcuugcagccgcgccccacguccgcccagccgcacccgcgcgagccccggcggcccagaagucgcgagggacuacuucgccugccucucccgcgggcgcccccgguucgagcggcggaaggagcgggcggcgugagcgcuuccgccgccccccucgcggcuccccucucgcgggcgugaggagcgggccgccgagcagcgcugaucucggcccucgucgccgccgcucggcacugugcccucgggcuccgacgcucgccucgcgcccugccugcggccccucagcuggagcgcguccgaggcagccccugagggccgaccaggcgcgccgcgcgggcagccggcggccaggcgggagauggugcgcggcaccucggcgggaccgcgccgccucccgcagccagcgcucggcugccccccgccggcucccgccgcccgcccgucgccgcgccccugagagcagcaccgccucagccaccggccgcgucccccucagcgcccgcagucgcccgcgccgucucggcuucgcacucgaccucggcgcggcaaaccgcuggggucgccacggccgcgcuugcugccgccgccccccugcggggguggccgggcugcccggcucgcggggcaccgcuccgagugaggcauccaccauggugaggcccccgagccgcugcccgcgcgccccgccggccgucgucgcccgccgccccucggugccgccgcugccgcugcuucccugccugcuguugcuccuccaucuccugaucggaucacggugagggaaagaugagcgaggagacggcgacuucugacaacgaguaagcgagcccuggccugguugagcccggggggcagcccccuccccccagcccgucccgcccgggaggugauagaugcccgaugugucgggccauuuucuuuaauggcagcaccccuuuucauucgugcauuuucgccucucugcuuggggaaggguaucgagugcagugcagaggcggcguagcagucggacgucuccgagacagaguaauaauguggguagcucaaaguggaguagaaacuacccuuugccugcccuucacuccggcgucaaacccgcccccccuccccaaacaccuugaacauccagccacccugccucuacagcuauuucgcucggaaacuaaugugugggagcaccuccagccgcaaacugcucuugaauccuaauucgaugacucagugacuccuaaauaccgauuaagccuucgccccccgccccacuuuuuaaacuuaugaccuauacuauucuaguaaaaagauaggguuagggaaacauuuuaagaauuaaauaggauuaaggacaccuggagugugggcgauguugagcuauuguguuuuuuuauuauuauuuuuuuaaccuucgagaguauugaacccgucuuaaucaagaacagaguaauuaaaaauuuugaaugcuaggguuuggcuuccgucugugauaaaguacgguuuacauugccgaacgcguuggugacuucaucagagcuugauccauaaguuuuugcuuuuuuggacuguccuuagguuuuccaaaugaaucaccgugccuuuuaaauauuuugcuuuaauguagcagccucuugaaggaauaauggggcuguaagaguuuccuguugagaguuaauuuggggccgaauuuuggugucuguuuuuucuguaauugaauucaauuuuuguuuguauuuggagggcuaugaagaguuaaaugaagucuaguccuuaggaugcauuccuuuaaauaaagugcauuccucaagucagaucuuuucgagaaggcuuuaaaggcccguuuaccauaaaauagcagaaaaaugccgagcaacgcccccccccuuugaaaagcacgcauugaggagcggguguggaaggagguggauugcugcagucagugcagucuagaagcagaaguggccgccauguucucucuuuuugugaaucgcccucauuugcauagcacacuucauucauaaaaaaaauaauuaaacauccaucaccuuggacaacuugaaaggcuuuccuaagaaaaccacucgaagcuuguuuguccuuguguagauuuuuggguucaggaagugaggagaauuugaaguuuuagauuaaaauuuggaacauacgcgcacacacaaacaacuaccccaguucucagaauguugacacaguuaugugggaaauaucaguucggggaggugcugggaucacgugaucgccuccauucauaaaauaccuggcuguccauucacagugcaguacacugucacugccuuccgcagacuagaucuauuuugagccagaucaagaacccugucucaaugcugggcugagaaaaacugcggaaaugcugaagggaaugacgggaacuuuuauuaguaucuugcaauaaagcagcugggauaaaaaucuuaugaucuauuuuagagauggggaaagaugucuuaccauuuuaauaguuuagaaaguaguauugccuuacuucggccaaagaacaaaugauggguguagauuaaagcaaauguagaauauauuguuucaaaacaggccuuuuuuuuuuuuuuuuuuuuugguacuauaguaaauugaaagugcaaguaaguguaugaaagagaucucaguggauagaaccguuguugaacuaaaaugaaaaaauauuaaugauuguuuuaauucucaagauacugaugcuuucaaacagcccccaccccaccuccaaauguacuuaugggcaacugggaaauuauucauucagauuuuuaaaauuguuuucacaaagauauacugccauauuaauacauuguccugaggagccuuguaacuguuaguuuggguaguaaaagggugaucuauuuuagcauguauuguccucugagagcuuuuucauggggcaaaaaugggugguggugguuaaugaacgugaggaaaugauuauguucaucugcuaauaguggcugcuagaccugacacuguuuacuugaaccuuggcucugccacaaaguggauuucuuggaaugucccguuuaaucuggucauuguagagcucaucuuuaacauaggaggugaaguuuugaaaugaaaauucauuauuuguaaucacacauuaggaaaaaacgagagauucaguagagcccucgugggcuuagguuugguuuaaaauggccuuguuuuaauuuuguucuuuucucucuuuucuuaaacuauccuucauagggauuugauuacaguagaaauuauuccuaacacuuuauugcuucaucuuuuucuuuguuucuagccuuuuaaagaagaugacuauaaucaauuucucggaagaucguguuaacuucuaaaaauugacagccacuaugcuaaaauguaguagggccuuuuagagcccucauuuugaaaaaccguuauuugaauuuagauuuuguguguguguguguguguguguauaaauagguaacugagguacuuacauaucuaaucaggaauuaguggaagauguauuauauaaaaauguaaaaggcaucuugacagugauaagucaaaugagggaaaaaugaaugaggauaggaugaagccuuagauaaucguuucaaauucauguuuaaaaauaagauuuuuuaggcaggucagauggcucagcugguacaggcacuuuauaccuugcaaccucaugaccugaguuucauuucaaggacuuacaugguggaaccuguucccacaaguuguacucugaccuccauguaccucuacauucaaaacaaucacacaaauaaauguacuaaaacauuuuuaauuagauuuuucaaaagacaguaagcauacuuuagaaguagacugcuuuaugccacaaauaaaggaacgagcaauauaauuuuauuuuugagguuaauacuuuauuuucugaugcuccaaauauuuccaguaaagauguaccuuauauauaauggauuagccuuuuaaauacaaauuugaacuccuaaguauauauuauggaaugcauagggccuugguaauuuguuguugacugcguauaacacugcauggccuuugccagucugaccacaguacugggaggagucaaguaacuguaaaaccaagcauuuuguuuacugugugcacaucagucagaaccgccugcugugccagaacuaggcuuuuuaauagcaagcuagaauuuacaguaauuuuagacuuuuaauuaaaauuggaucacuugagauaaauuuguuguaguauaaucuauguuagaaccauuuuuccugucaaaaguaaauuuugugguuauaucauauaguacuucuuuaaaaauguaccucgcagugucauuaugugaguauauauauuuaauuccauuugucuuauauauguauaugauuaugcauacauuauacauauaguuagaaaguauucuagagcugaauagaaggaaacauugggaagcuguguaacaauuauucagguaauuauguuuauguggguaucauggauacauaauguaaaauuuguuuagaagucaguggagcucaauccuuguucaccuucacuucuccuuucugauagaaagcuuuugguuuugaauuguauguuuuaaacuaugcuaaccuaacaugcucaaaaaacaaaacaaaacaaaacaaaaaacuuguagaaauaauuuucccccagaagacucauuuaugccgugaucuccaacacugucguccuguaucauuguguacuugauccguacuuauagugagauuucaaaaaucauauucauuuauacauuuuuaugucuguuauugcuucuucuuucauaaugcuuguuauacacuugugugugugugugacuuuuuacauuagggaucauuuagcuuuguuagaaaauaggcucaaaauuacgggaaaauaaauuauauuaucuuuuaaagaagauuuacccuuuuauuuccuaaggccaaaauuggcuucauuuuugacauguuauauuuucucaaguuuuagaaauaauaguugagaccuaaaacuauucuggauacuccuggauaaucacugugcugggcucugagcuaugcacuguaucaacaaaaagguacucauuuaucugauugauuuaaaagauuugaaaguuccuuucuuuuacagcuucuccauggugccaacuauaauaaacuguuaggaauaaagaagccuguuguuggggaaaggguaaacaguauaggcuuccucacuguaugcuguugcugguggagggggaagacucugggggaaagagggacugacaaccuagcucugauuaggguaagguggcuaauaggucucacugaguguuggguaggcugauacucagaggucuacauuucuucucuaaccuucaaaacugccaauaugaaaaauaguuuacccacuugagcaagaaaacuaguucagagacaacuuauuuguugugcuaccaugggauagcaaggacuaacauuuguuauguaauuguguccuuuacauaugacaaaacaugauauucauauuuuggauuuuuucacaucguuccaagcacugugugaaaagcuuuauuuaagaauuacauaguuaauauuuauacacacacaaauacaacacacccucacccuuuuucugaguggaauuucauagugaaugauacgguagauuaauauaugugaauauuucugcuauguuugaguuaucauucuagaauguuacuuuuaguuguuauuauauauccaaagaaugguauacauuaauguuuacucaucuaauauuguuggaauuuguucugguuuuuuuggaacaguauggagauugaccuuuaauuuuuuuuuaaaucuguaucuguuguuuuauccuugagauugucuaggaaggucacuuuuuuuuuauuaaauuauauacaaaagaaaaaauagucuaugagaauacuuaggcuuugaaaugucuguucaguucucugaaaauuauaauaccaauuauaauaccaguuuuauagagaaugaaauuuuauucagauuuaaaaugugcugggugguaaaguagaaaugauuuguuuagaaaaaauguuuuaggguagcuagaauuuuugaaauacugcauuauauuuaggauuaaagugaucauucagaggucaugugcguauguauuuaauuuuuaacuguuuugugcccugagagaugcuuuucuucuaacuaauucugugaucgagggugaaugaagcuggcuuauuuguaguggaaggaguuugaacuaagcauuauggguucuucuaaugugcuaauagugcaugacuuguuuuaaaguuaucagugggaaauacacucucuugauuuugcuaauuauauuauuuuugacauauuuaagcaaaugcugccugauaccauggcaacacaaacacacggauuuugauuaaaaaggaauaaauuuuucaaacaaccgauagguacauucagaaacaaguugggauugcuaaccguuuuguugucauuaggagaagaaauccuccuaucuaccuauuccagcuucuucucagacuuguuugauuuaaauaaucucuauacccuccaguuagguggggacuauaaggaggcuaauccuaccccaucagcauggauuagugaacagaaagcuacugaacuugaaugcuaacuucaggagcuccauaaggaaccuguuaacaucaugccagucucuagagcuuuacuuacugaccaggaacaccaguaagucauucuuacuuggucacuuaccaaaacccuguuaaucuaacacauuuaguuucagaaguuaacacagaauacagguaaggugguguauuauucuccagcauuuagauauuguucuaugacagguuugguauccuaacuguacccuaacagucgagaacuagagccauuagaucuaugaaauuugugucugugauacuuggaaugaggacauuguuuaucuucuuucgagagaggcaguaucucauuauguagcccuggcuggccucaaauucacagagcucugccugccucucucccuuuuaucuaacaaacaaaauaaugcuaguauacugugaaauuuugcuuucauguuuugaguaaagacuggaaagaguaggcagauacagaacauguacugggaagacuauagagauaaaggucuaguucuguauuguuuugcuucauuaaacaaaacaagcggaggcguggugguacaucccuuugauccuaggccucuggaggcagaggcaggugggucucuggguuugaggccaguucuggucuacagaggaacaggacagcccagacuauacagagaaacacugucuggaaaaaccaaaaacccaaccaaccaaccaaccaaaaaccuaaaacaaaccaccuaucuauaaaaagcaccccccccucccccgagccucuuaaagcuuuggauuuggaucucuucucuucucuucccucccucccuccuucccccuuccucucucucucuuuuccucuuuuucuuucucuccuuccuucuucccucccucccuccuuuccuuccuucgaggcaagguuucucuguauagugcuggaacucgcucuguagaccagucuggccuggaacucagagauuuuugucuucucccacagauuagaggcaugugccaccacuuccugccuagggucuauuaaaauggucuuaaugccuuucugagcucauuguggaugcuguucccucauuuuagguggaaaaggacauguuuuguacaguuucaacucaagagcauuuaaauaucacagaauaggggucaaaaguugacuuccuugggagaaauggugcuuuucaguuucaguuauuucaggagguaaacaguucauguucuuguaaacugugauccagugaagaucuuuuacugggaagaaagauuugugagccaggucacuguucuugguuuaaucuguuaaaauuuuauuuuuaauugggccuaccaaaagucugucaacuuauauguaagcugccauuuuugguuauaaacaacuguagcaaaaaauuaauauauauuaucauuaguuccugauauuuagccugcuauucugagauaauuaauuuguuaacuuaagaauaacuuucuuagauauguaaacucuaugcuugguuuaggaguuaauuggaaguuuauugauaaauuaggcgaauguacauacuuugaggccuguuugacuaaaaaauacuagguagaaguugagaacauguagcaaauaaccuuaauaaaugcaucgaaccagaguauaguuuaacuuuguguuagagagagagagagagagagagagggagggagggagagaauaugaaugaaacaguaaccuuuagccacccuuuguuuuccuuggcagcuuuucuucugagucugauauuucacaagggagcaaacagcuuuagugaccaaaaagcuuacugaucagacauacagacuggauugcuuugagucuaaaucuguagagugugugcuguuucuccucuaguacagaucaaaggaaaaggauaguuugucuuguaauuacugauuaacuucagcucaucccauuauugcaucuaucccgccuuagauacauuuaguugauugggaaguauagggaagacaguucuagcaagaugcagacuugcugguggaucucugaguuugaggccagccuggucuacauauuuguuacucugucuccaaaaaagcaaaauagauauuuuuaaaugacuuugaggacaagagcaauuaaaguggagaaaaaucuacuaaaaaaaaguaacuauaaaaccucuacaggccuuucauauacauaaacuuuauuugaauauagucuucuuuuuaaauguaaauauaaaguuauuaacguuagauuuuaauaggucaaaaagcaauagagcuauuuauuaauuccuacuugauacauuuaauauaaagacuguuucuuucuuugguuugguuugguuuuccagagacaggguuucucuguguggccauggcuguguugaaacucacuccuuagaccaggcuggccuccaacucagagaucugccugccucugccuucugagugcuaggauuaaaggcacacccccccccccccagcuaucuguauauuuuuaauaguccucacuaauacuguaauauuucgucauaguguacaagaggcugacauauccauuuucuccuuagugaaugcuagguuuccagcucuuuaauauuacaaauagcaucauauaguugguguacagcugggaugcuagaauuuagaaggcugaggcaagacaauuuuaaguugacaauugcaaauuucaggauagcuuuugcugauaguaaauuccaggacagcauguuucugucucuuugucucuggcgacccccaccccgcacccucccccaugugucuguuugugugugugugugugugugugugugugugugugugugucuagaccagagaaggauguguaguguucugcuccagcauucuccaucuuauuuccucauugacccuggaccugggcugucaggcagcaagcucugaggauccuucucucucucugccuuccacaguguugggguuauagauaauguggcuagacagacuuuaugcaaaugcuagggauuugaacucagaucuucaugcuuugcacagcaagcacucuuauucacagagccaucaccccaguacuuuaauuuuuuuugagagcuugugaaaggguguuaauuuccaaagaauacaaauuucuuuuaaugauaauucaaagccuuagauccauuuuguauuuuuauugccuauugauucaaaaccgaggcuugggaaaguuaagaaacaguaaaacuucugaguuguuaguacuaaaggugcgcaccaccacugccuaauucuucugaggaaaauaaaaagcaguccccccaccccugaaauaacucuuaagugguguuuaccauuaguccuccuuaaaaaauaaggaaauugagcagggugaggagguaguguauccuuuguaguucuagccaguaaggagccugagcagaaagaucacaaacuugaugcuagacugcuuucuacucuguccuuaaguaucuuuguuuguuuguuuguuuguuuguuuuuugagacaggguuucucuguauaguccuggcuguccuggaacucacuguguagaccaggcuggccuccaacucagaaauccgccugccucugccucccgagugcugggauuaaaggcgugugccaccacugcccggcuccuaaguaaguauauaggagcuggagagaugguucagcagcuaagugcaccuguugcucuugcagaggacgcaagcacuguucauaguaugucacaaccaucccuuacuccaugggaaacgguucagucuucugacguccaucagugcuagcacuuaaguauaccuguagauaaaaugcucauauauuuuaacaucccacaguaugcuuaaguagggcuucauugcuuugugaucucuauuaaaggaauauauuuacuuauguguugaucauagauuuguaaaaaaauauuuuuaaagauuuauuuauuuguuuguuuauguguaugaauaugcugucuucaugcacacuagaagagggcauuggaucccauuacagaugguuaugagccaucaggugcuugcuggaaauugaacucuggaagagcagucaguguucucuuagcccccauagaccuugauuuuuuuuuuuuuuuuuuuuuuuuuuuuuuuuuuuuuugguuuuuugagacaggguuucucuguguagcccuggcuguccuggaacucacuauguagaccaggcuggccuccaacucagaaaucugccugccucugcuucccaagugcuaggauuaaaggcgugcgcuaccaugccuggcugaccuugacuuuuaaaaaacucccaauaguauauuauuauauauacuacaguauauauaugauaucuauuuuauaaacaucuuaugaagguauuagauuuucuagacuaugagucagacaguuguggguacugggaagagaacucuguaacagcacugcacacuuaaccacugagccaucucuguagcugcauacuuaaguauuuuuaacaugcauuuaaaauuccuugguguucuuauguaacacuucuuuuguuaccacacuguauuuuguuucccaagauuauuugaauuauuuccaaguauuugcugucaugaauguacuuguuugugcuccuggcacauaugugcuaaguguucucuuaggauauauguaggaacauagguuguuaagauagugugaauuuugaagucuaugaagcaguguuccccucccccaaaagaacagcaaaacgaauguguaugcccaaggauucaauuuauacuuaagagugguccuuaaacauugcugucauuauaauugguaucuugaguaucagauaaugaauuuugauaaaauuuccuaagaguauuuuuccagguacugaacugagcaaauuaauuuauguaaucaaugaacucauuuaauacaggaacccuaugguguagguacggcaaacucauuguauggaugagggaaaaaagccugguaaaucauaguuaggacuuagauuugauuagguuacacaguaaacucgggcuuccauccugugaugguuuuucuuuguccaaauuacugauauuuauauuuccuaaucucucugucuuuucaucugcuuuuacucaucucuuggccuguauguguucaugguagaacauugucugaugcauaaucgucuuuugaaaagaauuuuuagaauuuguuuccucaguguuagaauggguaaggugacugugaagauuucuagaacguuguuuccaauuacuuuauaauuugguaaucuccuauucauugcaucauuaauuucaagauauuauuuguuuuauuuugccuuuuuuaaauuauaaaaauguaaaacaguugagaaagacuuauuauauaaaucuguuuacaguuaauuacuuuuauggauuaaccauuuagguuauuuaaaaaccugcagugauugacacacaugcauugcuuuauauuagguuaaaaacuaaccuggacuugacauguauuaacuccaaguaagcauuuuguacaccgggagcugggcugcuucuuuagccuucuuggugguuuucuugagguaguccuuuaugaagccagucaucuguauggucuucuggguggucaguuaauaauggugaauuguguuuuauuguuguuugugugcucucucucucucucucucucucucucucucucucuccaauuuaauuucaucuuuauuuguaugccuguguaugggugcccacucaggccagaagaaggcaucggcucuccuggagcugaaguaacaggauugauugugagcugucuguugacaugggugcuagugaucaaacaccaaccuccucccagaacaagugcucugcaucacagagccauuucuccagcaccaaauuuuuguuuacuaguuuuuaaaaguaauuauuucaaaagugauaaugcuaacguuggaagaauuuaacaaauuuuagcaaaaugcuagaacccaguaacaaauggcaaucccuaugcuaugugugauaaucuaaaugucaguagcauuuacauucgagucaugugaaaaaaaguuuaugucuguuucaggaaugaaaugucguaagcucuccauaucuuagaagucacuaaauguugcagugcagaagaccugaagagcuuacucauuuguggcauuggaaugacagacugguaguagcagccagacagauggaaaugaggaugcugcuguguuuauuagucaaauacaguucaucucccacaguuuguauugcucuaggcuuggcacacuaguuagcauugacacugaaugagguaacaaacaagcauuuguugagcauuuaugaaauccuggaggaaggaagggaguuauuacuuuugaggcauuaacauaauaagcacugggcauguagauaaauagaacagggucauucucaagcaguucuccucagguuuagaaguaauuguuaguucuuuguaaugcaugguuuggagauaaugauuuaacuaugaggagcaguacaaguucccuccaaaauuagaaaaaaaaucauuuauaagagaaauuuuuuuucaugugcacucacuuucacaguucuaagucuuaugauuuaauguagcuccaaucuuugcugacugaaauaucuugaaguucacauggcaggauaauuguuaucucuuaauuaguaaagguuaaaggguuaguuuguuacggcuuaaaauaaaggagcaaaugaauacuguggaaguagccuuuguaccuuuauauuuuauauguggaugaaauuuugugaguauaucuuggguauuauuuacauuuauauacugccuggugcuccuucacuggaaagagcuuugacgugaaagauugauaauuguuaacuguuaaugcaaggcaguuagcccaguugggccaccauuggagguaauaaguagcacgaugaggugcugcucuaaaagucaugcuccaaaaagcuguguuuucuggucagaagacaaagaugaagaacaggguuugaguuguggacuucucaucauuggccgugagcagauugaacuguauuuucuuuccccuuuccauuuaguuauccugaaacugaagacuuuagggauaaagaugagguagaaacagugaagaaacaggcaguuuuguucauuugucauuacuucucgucagcucacacauucuaaggcugaguuuuauuuuagaaaagagagcuauugguaauuacaacuacucauauugcugucuuccuucaaaaaaguuguauacuugauauacuugaguaucuuacauucaguggugaauuuaauuauuuuugaaaaauuauuuuccucuuuuaaguagagauccaaauauucuuugcccuuagcuuagacccagaauucuacaguugacaguucaguucuuccuguagacuugguguauuugagugacaggaaagagcaagugucugcuucuugcagcaccaaaauccaacaagugaugggagcugcuaacacuuucccagaaucucaaagcaaaucugugggguugaggaaauacucucuugggaaagauauuagaccucaaaagguagggaucaacuuacaaagacacgcauccucagucaguauccuaaaauguuaguaaauugcauagccaaaugcaacaguuaacacauagauaauauugucuaugaacagugugauuaucuacuaauauuauugaaguuucacaaguugcccuaauucaggauguauuucaugauuguauguugcaauagguugucauguauugacaaauuagucuccuguaaucugaaacaucucuuuaauuuuuuuuuuuauaaucuugacccuugccugaaaaguacuaggcagauauuugcagaauauuccuaaauucaagguauccauuuuuggcaacaauaccauguuacaagugguaguguauucaaucaggagguuggugaaaugaacugaacauuuugcuaagauucuggccauguuucuuaacugguuaaguucuuuuuguaauaagcagcuuaugagggaguuuuccgaggccugaaaaacacuguuaucuggcauauauuuaccauuuuucucauuuauugauaauucuuaucuacaacaauuuacugugaagcgugccaaauuauuuuucuguaaccaugguuucucucacuuuuaauaauuugguaugugguggaagggcucucucuucucauacuuacguacaucuuuaguaugacuuguagcgcagugucagcguaguuccccuggagccauugggaagcaccagcguguugcuuuucuaugucccucugaccagcauucgugaggcucaggaagugcuuugcuuguccuagcuuuggaaucauuauuucuuuaaggagcacugguuguuuuguuguuguuguuguuuaauuggagauuuguauuuaaaaccuuucuagcugugcucauuggcuuuuggaguaagguucaugguaguauuuaguuuacacuacagauggagaaagcuaaacugaaguuaaagguauuuacucauaauauccagaugaaguuguaggaagaguuggaauaugagcuuagacuucaccuauccaaagguggaguuugauauuccuuccuuuuauuugaccuacuuuacuuuuuuuuuuuuugaaauagggucucuuuauauuauauagcccuggcuguucuggaacucacugucuagaauaggcuggucucaaacucaggaacucagagagaucuguuugccuuugccucccaagugcuaagaauaaaggugugugucaccacucucugcuucacauuuacuuuaauaauaauuuugccuuuugcuuuucuuggacacaauauaguuaaaguauauuagaauguguuugcuaauaguauagcuuuuuugaagcggaaaacagucauugcaguccuaaaaaauauucacacauuugcucugaguaaggcugugugcuagauccuggcaguucuggauugcgcaugugcaugcuggagacacugcugaggggguuuugucuacuguuuuuuaaguaaagguagguggugugaugauggugauuacuucaacuucgugaacuuagguggcuuaggaucugcauguaauauguagaaaauauaacacacaaacacauaauaguagauuuacuuucgcuuuuguguuuaccuugccuccauuuggugucuugucauuucauaggugauacaauauaaccuugcuaaacauuuguaagcauuuuauauuuguugcuuaauucucacuaucuaaaugcuguuuuagcacauagauuucagugauuugucaaagaugagacaguuugguaaaugaaggcgcauuuaaauguuuuuacacugucuacugugaaauacugguuuuguuguuagacuugcuaacuauuccuucuuagguugaaacuuucuauuuaaauauacaugcaugcaugcauacauacauacauacguauauuuugacuugcacuuuugauuuuaucuuaucucaacuuuuacgugauucauaaaauaguauuguuuaucguuaaguagucucucagaauaacuuuuuaugaagcuuuucucugggcagcgauuacaaaaagacauuacuuuuuguagcaguagacugaugcuuguuugcugagcauuucugagcauagcaguuguuauauuuuguaagucucucugcacacauacaaaaaguaugcauaaagcuuaaucguuaguaauaacgaaaacagaucugaagacaaaaaaguucacuuuuguuaauaaagaacucucuaggaaucuuguucacaguuagacuagcauguaaauauauguaccaucuauuuggcuuuuuccacugucuuagugaauguuaauaagcuaagucuccugaggucuuccuggggauggucauagcuguugugacucaaaagugcaauaaaaugaaguccagcccaaaagaaccagucacacagcauguaucuucacaguagcaagcaguaaauguuuguugaaauuauuaccgguaguaguuaagccaccacaaguaaaugcaagcgaguucuuacuguagaauaaccucuaagcagcacaugcuaaauaucuauggaaaccauggagggcaauuuacagaucuuugcugcuucacaaaaacaugaagaaauuugaaaugggaagggauuuguauuaaauaggacugucagaguuucuauugaugaaacaccaugaccauaaacaacuuggggagaaaaggguuuaguuugaucacauuuccauuucauggucugucauuaaaggaagucagagcaggaacucaagguagagcaaggaaccuggaggcaggagcugcugcagagguguugcuuuuguucuucaugccuugcucaucuugcuuuauuauagcauccagaacccuaugccaaugggugacgucacacacaaugagcugggcccucacaaaucaaucaucaagaaacugcagacuugccuacaggccaauuguauagaggcauuuuuucaguuuagaucuuuucuucccagaugacccuagcuggugucaagcugacauaaagcuagccaauucaaggaccuuacuugaauaaauaacaauacuaaagccugggauuauaagauuuguagcucagacuuuuauaauucuauugugucugccuugguggaaauuuugucuucauuauugucauuucaguguuguccccacugaaaaauguuaccccugucuuacccucccuauaaaauuggucacuuuucuggggggaggggugucuuuuuuuuuucuuuuaggucuaaacugccuagccaaauucuaccuucuguaacuucccauuccaaauagacucauuauccaugauaacacaaaugucuauacuggaaaauaauuuauuugggguaacaucaucucuuguuuuuagggcuggaucagagauaacaguaguuagaccuggauaccaccuuuucuuaaagguauauauagcuucuagucagaauuucugcuaaucccugccauagggccaugauaaaaacuguaagagcacuauuuaggcacucccaguagcuaggcaaguucucggugagaaguugaguacucagucauuuggucaggugcuuauguauuuuauagaaaaaaaauuuuuuuaaagacaagaaugcagagauaauaagacaucuauauucuuauuauccagugaaucacuguuaccgucuuccucccagcuuuuuaucuaaauaucuuacuguuuuuaugauagugguuacaacggaguugggcugucaaaucugucuuuucuagaaacauggaaaugaugaaacuacaugauuucuacuuuggguuaucgaagauuggugguuagcaauuugucuaccaaguuagugagucuguguguggaccugcaaauuccauuuucuugcacaauccaaaauaauuauuggcagaaccaaaugauuuagaauaacccagugcuaacuuagugucuuacaaguaaaggaugcacuuggauugugaauguguuccggaagcagugguuucccugguggugaagcuccgcggggaagaagaggaguggagagagcuuauucuggcaaccaggaggccacugggacucggaacagacagcagucucaaguuggcauacucaaaaaucuaugaugagaacauccuugggcagagaauguaguaguaaaaggaguaguuuaucucuagcuuuacuuaaaaggguggaacugugcccguuucuuccuagguuaccuugacauuuuucugacagggucuugucuugugaaaaaagcaaauaaaaaccauuuugaagugaauuuacagucauuuauggaucugaagcuuuuuuuuuuuuuuuuuuuuuucggcacaguuaaaugaugaucuuggaaaguacaggccauggcuucuaacaggcucuauugccuuuaauuuagggaguauaauagacauagaaaggaugaugucccaaagagaaugugauggaucauuuguaaguaugugugccuagccuaaccuacuaccuuuaacucaguuacuaguuauuccuucuaaacacacacacacacacacacacacacacacacacacacacacacucuguugugaugaaucuaaucugccaguuugauaauuagagaguagguuaaaugaagacaaacaaguuguaggaccuacaacuggucaaauggagcuuugagaaaacuugaucagugaacuagcucuaaauaaugggaaucucgugauuuuuuuuuucuuuuucacaugguaagaauaagucauauucuguuccugagaauaaaaguagaaugaacagauggaaguuuuaggaaagauagcagacuuuuguucuauguauagagacaaaacuaaguuccuaaugcaguuugucugaugguagaauagauugucuuggggagucggaaaucauaguuuccaagugagagagaagauugaucaucugaauuuuuuacaaaaucaagugcuagguuuuaguuaaguuggucuagaucuucuagaguuccguguacuuguuuaggguccaugcuuuuauuguuuguuuuuguuuuuuguuuuugagauggguucuucuguuuagcccugacuguccuggaauuugcuuuguagaucagacugaccuugaacucacugagucccaccugucucugccucucaagugcugggaucaaaggacugugccacuacugcccaccauacuuaauaugcuucucuguuuguucagguuugcacccccacaaaguaaauguuuguauaaaaaugaaacagugcaacaaugcuuaucuuuagagaaaugcucuacaguuugagauuuauaaauagagaaaaaaauugaccuucaguaguuguuuuugacaaagaaagcaacaugcacauuugguuugugcaacagaaauuucgagcaauuucuucuuucccuuccucccuucuuucuuccuggcauuuguuugcaugccugccagagguugaagugcccacugucuuccuuggucacucuccacuuuauuuucugagacaggaucuuuuacuaaacccuaaauuuaccaaucaucuagucagguuagccuaucuagccaguuuguuucagggauccugucaccaccucugaaguguugugauacaugugugcccugacauuuauaugggugucagggauccaaauuccauucgucuuguuugugggcuugugcaguaagcauuuauucauugaugaggcaacaaguauuaguucuuuguuuagcucagugccuggagaaaaagauccuguguuuagcaaacaugggccuggguucaauccccacugcaauuuuuuuaucagcauauuuuucuuauguagacuuguuuucuggauugucauaaucggguaggcaucagcauugcugcauucauauugucccacaaugucaucuacaugaucugcagauacaacuaaggaaugcguuagaaauucccuauucugauguacaaaccaugauugguaucuuugguucauuccaauuuuguuugacauaaaagcugcugaccuaaauggauaagcaauacuagaaugauuugaauuugugggucuuggaaacacuuggaauguguuaucugugucucuugauucguagcuauggaaaaauguguucuguaugccuauaguguaaucuuugacucauuaaaacuucagaaaugaaagguucauauacuuaaauguuuauuucuaguaguggcuguuuuuauuuuauuaugcuauacucugaaacccuucugaguaauaacuguggugguauauaaguacuucgcugucaagccuuuuuguuuuuaaaccacauuucucuugcugcucugcaugggaauuaugaggcuguuuugaagucaguauugauccuaguuacaaagcuuguagcaucuaguguauuccaggaaauuguuggugggugaacacuaagggguuaaugagaauuucagggcaacugaaugguaaacaaggugaaugcucuugcggaguacaguguuuugagguugugaugguugggggccugauuauggaauugaaauuuuuuucuguagaugcuacuaugaucuuauacuaauaaaauugcaacuaauagagaauauguaccccagccaaagauuacucucacauaaaugagaccuccuuucuagucacuuuaauucaaagcacagagcagaacaaggacacaaaagacagcggggauuuaaauccucacuuaggcucuuaaacaagauguagucuugucagugggcauuauugucagaauuaaacaugucuugaaccuaguuucucaggcauaauaggcuacugaagucuucagcgcugaacgaauaguuuaauacucuuagagauaaaauuauuuuguuucauuguuuuugcuauuauaaaagaagaaaacaaaaguaaccucucuguuuucugaccauggugacauguugugacucuuccuuaggagcgauuauccuuguagaaagucucucaaacugagauccugcuguuucgaagucaucguccuuguacuuacuuugccaguuuguauauaguuugcuucacaauacuuaguuauagauuuacuuuuagccccuuucuuaugggccucuaaguuccuuccuuucuuuauuaaagcuuuaugcaugcagucuugaguauaccuccauuuuucuggaauugauuucuagauguaaaauguguggauagccugaguuacagucuuuuucauaggcuucugauuuauuuacagaaccucugucaaauacauagaauaacccaucagaauaaagcaccuuagaaauuugauggcaauuuauaaaauaguaaaagaauuuauuauucuccuuacauauuaaaauuaguuauugugaauacuuugauaggaacuauauauuauuauguugggaacuugauaauaauguauuuuguguggauauaugcauagauacauagacuagaagucaauauccagugaucaguuuuuauuuuauauuuuugagacagucuuagagaacuuggaacucuauaacucagcuggauugguuagccaccaagccucaguaaucuuccugcuucugcuuccccagugcugggaucacagguacacacuccugugcccacccagugcugggaucacagguacauacuccugugcccacccagugcugggaucacagguacacacuccugugcccacccagugcugggaucacagguacacacuccugugcccacccagugcugggaucacagguacacacuccugugcccacccagugcugggaucacagguacacacuccugugcccacccagugcugggaucacagguacauacuccugugcccacccagugcugggaucacagguacacacuccugugcccacccagugcugggaucacagguacacacuccugugcccacccagugcugggaucacagguacauacuccugugcccacccagugcuggguugguuacuggggauccaaacucaggaauguggcaagcacuuuaccaaaccagcuuuaaaguaccauuuuauuuuuaaaaauccaaugaauuugauuucccaauugaaaacaaacguacaugucauaugauuggcuuggucacucaggcugucugucaccuuuggacauuauuagcacaagugucacucaucuuucuguugcugcuuggcuuuguuguuuugggccuguggugagaggggcaugucaugaaacaaagcugcucacuucuugggaggaggaguguaggauaugagaggguuuccaccauuucccaguagcaccccagccuggugaccacguccuguaguacauggccuuuaguagacagcggugauccaagccauaauaccaugccgaaagcuuauucuggguuaauagcuucucuguaccuucugaucucaguccuuacagguuuguagucuuggagaucaucugauuccuguagguuuugccucacccuuugucucuuaaugcuuauucuccaugaguuuuguuaaaaagaauagaucuagaauucuacuuucuauaaagacacugcuguauucccagguuucaaaauuaaaauaguaucagaauucacaaagcaucuucuuagcugccuuucuaucuuugcuuucuucugguuauuccaagcuuucuugauuccauuuuuuaguguauuuauucuuagauuuucaucauauucuucagcauagaagccuagaauaauuuuauuuuuuaauauauaaggccaucuaccaguaaauucccagguugaacguaauuuucuuguuguuuauacucuuccagcucaugcuuggauaguauauauguauuuuaaaucuugcaccauauuuguaauuaagucucugcccauguuauugcaguguccauuuauagucuuagucugucagugcgucuugacucuuaccuguugagaccuccuaacuucuccucaagguuucaucccaucuucacucuuaggucuucucauucauuaugugaagguguguuugguucaggauuagcaaauaaacuaagacagacaagauaauuauacuguggaacucaguuccaagauuuuugaauacuucaaaaaugagaaacuuaguugguacucuaaggauuucaugaaccuuaugagguggaggucaguaaaggacucuuagagccaaguuuaaaaugaagcucaguuuauuuuaaagauaagaagccccuuugcuuuuaagccuuuuugcuacacuuacgacuaccuuguucucugcuuuuagacccaggauacauauuugcuauuauuucagagucuucuaucacaaucuccuuuuccuccucuuauuuuuaccucuaccagggacuuauuuuuuugaaacuagguuacauuuagauugugcugugacuuggcuagguggucagaggugaccuugaauuucugauccucaaguacuggcauuauagguguguguuacacaugcacauagccagccuucauugauugugaagaauaucuucuuaguuaaaaguaacaaugauuaauaagucaccaugaggaaaauaggcuggcaagaugguucagucaguacagacaguuguugcuguaccuggggacaucauuugaucccugaaccuacauguagaagaaagaagugacuccagcaggguguccugaccuccaggcauguaugugguacaggaacucccauacauauguacacacaaaauaaaugaauacaucuuaacgaauauuaaaauaaaaucuaugauaaaugacuauuuucuacuuauguuuauuuauguaucaugcaaggauaggauaucauuaaaauugauacuauauauaaucaggcaguguccauauucugaaaacugauauuaauaaaaugaacuacagugaggaaguacuuuucaaguauuuguaaggaaguaccuguuuauuugguggcuuuuuuguucuagauagcaguaaacaguuaagcaaaucaauuccuuguggaaaaugacuuugaguggauuuuaguucugggugucuggauauucagcuguguuauuaggugauauuuugucuguugaugaacagcauggggcugggaggacuggaugacuuaugcuugguggaaagccagaguuguuuucuucccuuguuaugacuugaagaagcugucuguaggaguauaaaagauauuuuggguccucuguagaacucagcuuuuaccugcuuacgcaucugcuuacauggacucauuuuauuaaacuaauuuaauaacuaaaagugccauaaauaaauaaauaaauaaauaaauagauagauaaauaaauaaagcaagcaagcagcuggcuuuucuuuccuucccucccuuucucucucucucucucccucucucucuuucuguucagacuccagaucaggucgaugguuuuugauuauuuaguuuagcugaaaacaguccauuaaaagugaauaaauaacaugaggaguuauaaaaauguuaagaugcagauguuaaaugccuaagaguucauaaaucaagccaagaucuaagauucuauguaaguuuguauauaaaagaaaugaacauucuacuagaggaaauaaaaaggcaauauugauucacuuauuuaugaguacaucaguuucuaaaaguguuagaaugccuucuuucucuguaauguccuuucacauuuaaagauuuuuuuuuuaauuuuaguuuaugugugucucacccaucucuccagccccuccccuuacaguuuaaaagaaacuuccaguauuguaccuauuaauuuacuuacauguaauuacagagcagccaucaaaauugacauaggcuacuugaacuuaguaaugcagaccaggauaaccuugaugaugauagcuuuuuucucucucucuuuccuugacuuggaguuuacuugaucacugcacccaugugauucuaacaaaauugauucuggguacauuuuacucaaucuguugguguuuauacuugaaguaacauaccauauucagugcugcccucuuuaguuacauaguuugacucuguuuuuuauuggacagcacugcuguaggacagugaaaauuaaaucgauuuauauugcauuuaggcggaaaggguauuuaaacauucaaagauuccacagucuugcaguuucuauuuucugauuaguguagucucuuaagaggaaguuugcaaacugccuucuguggaugaaauguuaggauuauguaaccauguaaauaccacuaaagaguucugaauucugacugaauucucauuuggcuguuuaagucaccuuguagggcccacacaccaaagucacuauggaagguaaagaaguuuuagcuacuuuuaaugucuccuuuaucuguuuuuguuacucuuaccuucaccuauuuagguauuuauugaauacuuggagguaccuccaagacuuucauauguugaccguguuuagaacacccagucgguggauuuuaauacucagugugaguuuacucuuaacuuuuccuccuuguuauuugaugagucugggucccugccacugacuccaugucuuuccuguauccccaauuugauugcauuacccuuaaggcuggccucuuacagcuuacuccaccuaccugcauuaagugccaagauguuauguggacucucagcaugcauauagcuaaauauugccccuacaugaauuugguaaaguaagugcuuuucaucuuuguuaaaugaagucaugugcacagaaccuuggagggguucacaguaacuucagaaggucuagaaguucagcguagcaaguuuugcugacucugcaaaagccacccuccaacguugaaaguaaaaggacuucccuucuuaggaugagccccaaauuuccuugaauggugaucuguuacuaaaugcucuugcuacugccccauagagccaggaagcauaguaaaguuggauacuacuuuauccuacguauauauaaacccacaauugccauuaaagucugcuaacauagauaauacaaguaaugauggcugagcaaaaaaaaaaauuuuuuuuuaacuaacaacacagaaaugagaauagacuuguaccuucuuccuagcuggcaaaaaggaauuucucagauagauuaaguuaggaagauggagcagugccuacuuuugcuuuaaguauuauuauuauaaucacacuagccauuaaccauuaaauguucauuauccgagucuuggauuuacacccuacuugauggaaacauuuacaaaauaauuuccucuccugccugugucuuccuagcuccucucucaggaggugucuuuacaguuuuuucacaacccacaggagaacaucagccuuucuuuaggcacgaccuugcuugaguugccuauuuaguuuccacagaacagcuacugagucucaugagauaugcccaaccucuuuggaaggagcacauguugguuguucuaaaaaggacugugggaacgucugcaauaucagcuuuuguuggagcaaguuaaugaaacauggggcauuauaaguaguaaaguaucaguucuuucaaguugguagaggauacgugcauuauguaggaaguaguagguuuggacaccauggaagaaagagagcaacuagauuugcugagucaaagaauguucauauuuuaaauuuugauggauauuuauagacuaccuuaaaaccuauuuacuagcuuauauuuccauauuuucuaucuucugagcuaguaaaugcauuguuggcauuugauaaucucuaauuugcaucauuuuuauuauaacuaagauucuuuauuguuuaagaggaguaccuuuguuuguuuguuugcauguauuauuuguggcaaagagaauagauaauguauucaacacgucucccgccaaaggcucuuaacccuaaacucuggaacucauaaauaugcuagcaaccuugaaaguuugacuccauugcaauggagagcuugucuuggauuaccucagugggcccagucuaaucccauagguuucuaaaagcaguguuuuuccaacuguggaacuaugaucagagagaauaaauuucagaaagauucauacaaaaguaacccaaacccaaggggcugaggaauguuaauggugucuaggagcuuuuucucuccuagccucuugaaaggaaugcagcauugccaauaccuuuauuuuugcuaagugaaacugaacuuucaagucauagagcuguauaaauuuguuuauaaacuacucagcuggcaauuuuuggauugugccaggcuuuuuacaugggagcucacaugagacuuacuuccucacgcuuacauggcaagugcucuggacucaucugucucccauggcucucuuacgguuuuuuugaagacaggaucucauuacgagauuugagauuauggaaaucacaugccagcugucgaaguuuuagguauguacucuggcauguugaugauauugucaauaagagcuuugaauguucauucagcaccuauucauccuucagauuaaaaaacaaaauucugcuucuuucucuuugaggauuuuccagauaucugacuugguuagauguguuuccauucuguaaacaauuggugacagacuuagaaaauugauuauugauucuuagcuaugacuaauaaucuuuacucaagguuuugaaugggccuugcuuccacaaaaccauaguaaauacaaagcaagacauuuccagaauaugcauaguaacauuagaaaguuaauuuaaucagaucauuauuagccaccugugucugaguagacucagugcuaagcaugucauaguaugucuuuguuuacuucuuacaacacuuugguaauaggcauuacuuuacucuauaggccaggaaaauggaauagggaaagccuaagguuaucucacuuuuaauuggugggauugccuuaaaacuuuaaacagguuuuuuaauugcaaaauacaauuuuaaaaauuagaauguggaaacaauaaaaaaaucagaugucugggacuaaauuagauuccauuggacaacaaagaagccagaaauauaaacuggauaaaagaaagcaucaacaaaugguacuggucaaacugcauggcugugugaagaauauaaauagaucuguauuuguuacccugcaaaaaaacucaaguugaaaugcaggauaaggccaagauacccugaaucugauagaagaaaaauaggaaauaguuacccaggaaaaggguaccucaauugucccauaaaauuggccugugggcaugcuguggggcauuuucucagaauugagguugaagggccaagcucacagaggguggugccaucccugggcagauaguccuggguuguauaagaagcagcuuccuuccauggucucugcuuuauuccugcucccauguuccugucuugaguuuuaccuugccuucccuugaugacagauuauaaccuauaagcccaauaaauaagccuuuucauaccccagguuguuuccagucaguguuuuaucauagcaacauaagccauauuagagcacacagacaugauguguacacagauacaugcauauaaacaucauuugguacuuuggauugaugguuacuaccugggaaauguuucuuuuaccuuuaaacuuacuaguguagaagaguaauuagacuuaaaacuuccuaauuguauucaguccuuaauuuucuuauucaagugagaaaauaacuaccucaagauuaguacaacaaaguucugagaaagaucucugaaaagcacagaccagucucccaugcuuacugcacuuugcauucuuuuaucucaguaaugaguaauaaucuuacuuaaagugugcaaggcuuaauuauugacuuguaagccaaaugugaugaugcuugccuaucaccccagcacccaggaucugaggcaggucucaaguuugagggaaaccugggcuacauccugaaauccugucucuugccauccuccaaaugaaggggaucugagcgaucucuuuguuaugucuuuaccugagaggugcaaagccucuacaggaaagggaacauaguuucucuauuuuguguaugugugugacuuaaaaaaaauagugcucaccaguuaauugacuagaugacugaguuguaaugugcugguuuucucaguguuuaccuuaacacuuugaaugguaaggguguuccugaaauaggccauaaugaauacuguaaaaauaauaauuaagaaauguugcaguaaaccuccaaccuaaaaaagcccaggcaaagaaaucacaacucaguugauaugaauaaaagcuacgcaccagauuccccaucuaugagaccccuuauaacuugcaguuucuccacaccaugugcuucugcuccguuguccgucaguccguccguccuuccuucccucccucccucccuuccucccucccucccucccuccuuccuuccuccucuuccaucgcccucucuucccuugucucucccuucccccccaaacuuuucagcuccaccuucccuucugcugcccaaucaccagcucuagccuuuaguuuacaaguuaagguggggagaagguucacaagaagucaccuguauaugugauucacuccuugucugcagcccuucccaggaaagcagaaauagcaucaaaauacaaggcuagggcuagccgcaacaaaaaaauauuuugucauuguaagcauacaggaggugggggcauggacaguuaauuuguguacugaacacaccuuaugggguucuaguuuucaauuuguggagaggaggagcaguuaauuauuuuuuaugguuagaagaugguaguuuuccucuccuguguauagacaacuuccauaucaucaagacuuuuccucaugcuuuucuauucauuuccuguugcugcuggaacaaauuaccacagccccaguaucuuuaaggcaauagaaauuauuauauuguaacuugggagccagaaauuuuaauaaacuauuuaguuaaguucacauugagaugugugucaguugguauauuauagaagaggauagaggcagaggagaggcaaaauuaggaaaauaauuuauuuuacaaauguuaaggauagucagacaaagcauaaaauacaaacaggugauugcaaauacuuaggaacaccugagaguagccauagcagaacaagaaauucuguuuuauguagcuaagguugaaaauacauuaauugaaaauuuugugguuaaaacuaugugcuaucucuauaaaagaaacauauaucugauuaaagagcaguacaggaguguguguugcgggcagguguuaagcugaagagaugacucagugacuaacagucuuucuacucuuucaaaggaccagcuucaggagaucugauucccuuuucuggccucuguagacgcugugcugaguguguguguguguguguguguguguguguguguguguguguguguguguguguguguacgagugugcacgggcacauaugcccccucacugaugugcacauauacauaguauuuuuaaaaaguacaaagaaacagaauuuugggaauucauagucccuucuaaguuauacaaaugggacauuaagguuuuuuggucuaaagagcaaauuucuuaauagauaauauucaagcuccaucauuaggauaauaguucuucacuacuuaacuaagcuuacagcauucuuuuuaaaauagucuaugucuuuuggugaggaaguucuuugcuauggcauggaguggaggucauaggaaaacuugaguauguuuucaucuucuaucacauggguccuggggaugaacucgguuguucagcuuaaugguaaacguuuuuacccauugaaaaagcucucugacuucaagaagugguagguaauagaauccaacuugauacguguaagagccaugugcauuuuuuuaaacaauugggucaucucuucacccacuuuagcaucuuaaguaaaccguaaucuuacuacacuugcagggaagcaaaaccgcaguaauguuccagaaagaaaaaucaaacugaugccagccagucacaguucugugagucagucuugugccacugugcuugguuacuacuuuuuccagucgcuuaguuaacagaauaaauaucagcugauaauaacaagauaaaauacagcacuuuaacaugaacaguaaacugugcuggucaucuucccauuguugugaaaaauacaugaggaaaacagcuuuaaaggaaguaaucuuauuuuggcuuagaguuucagagaucucaguaggugaugacuuggcucaggcacuuugggucugugguagggucaauaguaugcuagggaauucacacccucaaacagcugcuuaaucccuacugggaaaggaagcaaaaaggggaauggaacaagggccuuauauguucucugagggcaugcuccuaugacaacaugaaagauuuccacagauaaguuugauugaugaauaagcaagauauuuaccccucuauuauuuauuaaaaugguauaggcuucucacugguagaagaaaauuugaaaugugggcuucuaaguuuauaauauauuccagaacaguuggaaacuuagaagcaauuaauaaauauagcaacaauuuguucuugucuuaacguugaaccaaauguguacacacauaggguaggugacaauuuuucugugggauccaugaucacauguucaggguggaccagauaugcucucucuaccaaaaugaauugaaagaggaguccuauagucuuauuguaggcugaaucuucaaaauaaagaauaaucuguagugugugaguuuccccuuaaaguuaggguuuuuccccauauauuauuauggcuguaaguaauauacacagcaguuacuacauaguaauuaauacugucuuuggcuuuucaaacaagaccaacagauugacuuucuuguuguuauggaagagcuaaugucucaucuuugugucuguuuuaguaauaguuaugcacgagugcgagcuguggugaugaccagagaugacucaagugguggauggcuaccacucggagggagcggacugagcagcgucacugucuucagagucccucaucaggaagagaauggcugugcggacuuuuuuauccguggagagagacucagagacaaaaugguaauguuuaauauagcugucacuguaauuuuaugguacuuucugaaaaaaugaauuaucuguuuaaaauucucacugauacauuauuuacgagagaauuaauuuuaccugugacucagugacuauuucuugggaauugcuuuuauauuuauguuaaagaugugacuguuucuaacugggucugagaguaaugacaauauauugcaaggggcugccacuuuacuguuuaguuuaacuaggaauguucacagagagcucucuacccucccucacuuucuccuuguuccuuaggccaaaggucagcaaaucccagucugaagggcagauucaggcaugccaccuggucuuuuuauugguuuuuauucagaccacaagcuaaugaauuuugggggaugcaggggguuauuuauuuuaaacauuuucaaugaguugaugccuguaaccucaacgguuaggaauccaaagcagaaggauuuugauuugaggucagccuggaaugcauaguucuaggcuacccugaucugaccuacacagugagacccuaucucaaaaaacaagggcugguaaagucaaagaaccauaauuuugugacucauaaaauuaggugaaaucaaacuuugggguccauaaauaaauaguuuuuaauuaaaaaaucaauuuauauguauauagauguuuugcuuacauauuugucuguuuacuccacccauaccuagugccuuaggaagccagaagaggguauuggauuccuuggaacuagaguuacagaugauuaugagaggcuguuugaauucugggaaugaaaccccggguccucuggaagagcagucuguguuucuaaauguuguugugccaucucuucagucccaugccaauuguuuuuugaguuuagcugaagucauucauuuauauuuauuacuguuuucaugcuauaaagacaagacaguaguagcaacagaggccuuaaguguaugguucucugcggagaaaccgcuuauuccugccccuuagacuuuuggaggucucaggucucuuaguuccccauaaaucuuuuuagccacauaagguaauaaccagucugauuacuagauucacuggccaaucugauucuuaacacaauuauuuuauaccuuuguuuauguuuuuuuuauauaaaaauauuuuaaauggcaguuuacuguuugauuuuaauugucauuuuuaauugguguggaaggcuuauucucauuuuaucugagagcccaaagcuacuaaguauccgaaguugaguagcauuaaugucauuccuguaucaaggaaauagcauauacauagaagcaaaauagaaauuguguugaaaauuccuaaguuccuuuaaaguaacuagaaacccuuuaaauauauuuguagaugaguuaguuuuaugagaaauauuuuagauuuaaaucauuuuuuuuaaugcaugaacauuuugaaugcaacugggauuuggauuucauaacguuuuucacugaaucauuucaauagcauagaaaguugguaaacuaaauuuuggccaaauuucucccaugguuagaauuauccuaagugaucuugaaauacuccauuguuuugugggcuuauaauuauuuccuaauguuacacauggcacagugaaccacaguuaacuagaauauauucaguuuugugaaaaacuccaguugaaaucagaggauaauagaauaaacuuauaaaguuuauaaaggugauucuguacccacacagaauggugucugcacauuugaugcuguuugaagcuuggagacacuaaguagccaccauguuguaaguagucucugauuugauaaccagguuuguuaaaaaauaaguuguagauuaaaauaguuuuuaaaaacuagucaaauauggaauuuaaaauuggagaaauguuuucuaguaaaaaccauuuuaauguuaauuauggaacccaaacaguauaauuugaagugaggcuacucugagguaccucucguugauggagacagugaguguucaguauguagcuuaacaauacaaugcagaaagugaaccugggauucagaagaacgaucuuauuguaaugaugggacaagagagagagugaggggauagggaagcacauccgcaagcacagugccugcuccuggggcaggaccguccguaaugcuagugggaaggagagaggguuucugguagucgugcugaccagguuucaccuaaccguaggcugcaaggaaauaagcagagcaaacgugaccucaaggagacuucacuuccaguuggaagguugcugugcuuguucaagagauacacuguaaugaaguauuuuugguuauggaggcuuagggacaaagguauaggcaauaacucaggaguguauaacuuggaaauagcaaaguaugcagucucaagucaaaggagacagaagcauugaaaucaagagauaauauuuaaggauggcagugucuuucugugacuuguuuuguugaguuguuuuauucuaguucuuccuccccccaccccccggggucuaguuauuguuuuuucaagguuuucugacuacaaauauggaaauucuuaaaguucuuuccaaauuaauaauugcuuucuuuuaaagauuuuccuacuaaauaaacauuauauuuuaacaguuuuccaugugguaauuaauuuauuugcuagacaauauccuguaucuguuucugggcugcaucuucaauguuuaguuccuuagauggaugauagaagugaaacucuugcucuucaggcuccugaaugaacuguagccuuuaagaaaauaaauacuaggaagagguacauaaggccacugcugacuaagacacauacugggcaagacuaaaggaugcuuauaaggccccagaagaaagaaguuuguuguuuguuuguuucugguuucccccuaugauuugguacccuuuuucugaccuugugcaucaggcaugcacaaaguacauagaccuguuuacaugcacauaaaucuuuaaaaguuuaauuaacaaaaaaucuggcaggaaggagacgguaaauagaugcucacauguucccaaguaaugguagagagcagaucuccauucuguugccacaaaccaaaaacaggauugggugagauagaguacuuugagaaaaucaguuuugcuguuaauaauuggaauugaaacaaaugccagcaguguucauccaguccacaguuaaccugugcauuucagagucuagccacagauacagaaauaaguuaugcucuuaguaucuuucugaauagguguaagugagcuuuguggcuuuguuucagcaguaguguuacagcaguuaauucguuaacacagcugauauuccuugaagaggaaaaacccugcugguuaccauuacuguuugcggucuucugaacuccugugguaccuggugcaugaaaguuaggauugggaguuaccaguuacccugccagcugucagacagcuucgccuuuccuacuguaaccucuuuugagcccaugccucccauuucuuaagauucaguuguguguuuuaaaugcuauugcacugauuuaugcugauaugguguguuacacuuauguugauguuaucuuucucguuguugccuaauccugguauuuuccuacuaguucuccuguccuguccuguccuguucuguucuguucuguucuguucaccuuugaacuauaggcuguuucuucuuucacuuucuuggugcuggggauugaauuuaagaccuuauauuuauuaggcaaaaauuguaccacugaccuacacuucuguccagacuacuaaauguuuauaccguccuaacuacugaauuaagucuaaucuccaacugaaauuauuggcggaauuauuagcgguacauacuagcuuucuccacuacuuuuauuagaugcuaaauaauaaccugaccaucuacacuuuuaguuggcugguuaauuaauguuaauccugucuguauuuaaucacuuacgguuagagccuuucuaugugcugggcuuccugcuuagucugccauaauacauuauugauggaugcaaaaauguuugucuuuguaguucuggaugucauagagucggagaucaaugcaaugguguuaccugcuuaguuuuugacgagggcaccuccuagauggcauucaccgaguccucuggucucgagagaagagugcuguuaucucuuucauuacaagggcacuugcuucauaauaacuuaggcuuugucuguauggccucauuugacauuuuccacuuuuucacaggcccugucuucaaagaaagccacauuggaggaauuugcagggacuaaguucaguuucaguggcuuccugcuuaacucuugguugguagauuuuuaggcaaacauacuuuacuauguuauuauaacuguuuauagaggauuuagaucuugcuggcaguaguuguccucguugucuauuacuuucuuuuuuuuuaauuuaauuuuauuuuuaauuuuuuuuacacuccauaucccauuccccccaccgucccccccauccuccuacuguuccacaucccacaccuccuccccacuccaucuccauguggaugccccccaucccaccugaccucuaaacucccuggggccuccagugucuugaggguuaggugcaucaucucugaaugaacacagacccggaaguccucuacuguguguguguugggggccucauauugguguaugcugccuguuuggugguccaguguuugagagaucucugggauccagauuaauugagacugcuggaccuccuacaugaucgcccuucucagcuucuuucugccuucccuaauucagcaacaggggucagcugcuucuguccauugguugggugcaaacaucugcaucugacucuugucaggcugcuuguugggucuuucggagugauagaucccuuuuugugagugcuccauagccucaguaguagugucaggccuugggacauccccuugggccuguugcuggaccuucuuuuccucaggcuccuccucuccauuuccaucccugugggguggcaaccccaucccucauuugaugcccugucuucugcuggaggugggcucuauaaguucccucucccuacuguugggcauuucaucuaaggucccucccuuugaguacugggagucucucaccucccaggucucugaugcauucuaggcagucccccccccccaacuccccauuuccugagguugccuguuuacauucuuucugcuauuguuccucaguccuuuucccucacccaauaccagaucagguuccccucuccccaccacccuguuacuuucuuguaaaguauguuuuuccucacucuuugagaacuguaaaugguuuaucuuuaagacauacaaauguauuuauucaauccuuuuuacacauccguaaauauuaccaucuucuuaaaguucuucuugcaaucuuuuucccuuagguaccaaguagaacuuucugaauaauauuuggcacuacugaugauuaaaaaucccuuuuucuuugugaauuuauaguuguucugguguacauagaaauauaauauugacugcuaccuggagacuguuacuuuauuguagucauaacacuuuuguauuucuuaccugccaccagaauuugauaacuaauuuuaaugaaguucgauuuagaaugugucucauagauauucaguuauacugaaauaaauauaaguuauuaaccuuacaaaauaaugugaaggaaucuucuguauauccucuucccaauuuucccagcgaugauaacauuuucuaagacuauauuaucauauuauucuagaauauucauacaaucacccagacauuucuguuuuauccuuagucauuuauuaauguauuuagaacuguagaguuuaaucacguauguuagcauuaauaggcugaugcaaagcagaucaaugacuccuuccuguugauauuuuauagccauauacauaucccucuuagccugacaagcacugcuuuguucucugauucuaugauuucugucauuuccaaaauguuauaaaagugaaauuguaaguauucacucuuucaggauugucuguuuuucauucagcauaacucauuuuaagaguuggguuuuuuguuuuuuuuuuuuuuuaauauuuuauaaucuguaauaguuuuguuuuacucauguuuguuuuucuuagucauugacuuauaaaggugagauuucuggguccuuuccagauugaaccauuucauagauaaggccaccaugaacauuuguauguauacauuuuacugugucuuuguggacauaauguuacuuuuucuaggauauaugaucaaaacuuaauuugcuagauuaugugauguucauuuuuuaaugguauaagaaguugccaaauuuuuuuugaaaguagucaugcuguauuaaauuugcucauuggguaccuaaauguucccagcaugucauggacucacuuguuaauuauggcaguuggauaucuagugaaaagucauaguaggguucauuuguguuucugucguaguugaucauaucacaaccuuuacccauuuccuuacuagacugcucuuuucugucagugcucagucuguguucuagaugcuagccagcucuuccugggaauauguaacuaugcacgugcuuucucccagccuuuuuuuuuuuuuuuuuaauuuaacagacuuguagagcuuuacauuuugauaaaguucaauagaucuguuuucuuuaauagacugugguugugaugucagauccaugaacucuucucuaacugugguuucugagucuauaucccggaauuuguucuaugaggguuauaguuuuguaguuuauauuuaaacucacgguccauuuuagacuaauuuuuaguuaaugugguacuuaaaucaagauucucuguuuuggggcaggauguuaagacugugguuguuguuuuucucuguagcgugucuuuaagagguuguccuucccccuugagucacccucucucucauucuccugcucauccagucuuucugcagaugcuguaucccaugcugcuguccugugcaucagcacaaagaccuaggagagggagcccucucacuguugucuucucuucucaggauugucacagccuuuuccuucuguguaaauucuaaagccuuacugggaccuucacagauauucuuaaugaugaagcaucuaaaaucuguuuagaucucuaaauucuuaaaauuuaaagaaaggcauauuuauuuuguacauuagauauuaaguucuuuugguuuuugguuuucuuuuuuuuuucaguuuuuuuuuuauuagauauuuucuuuauuuacauuucaaauacuaucccaaaaguucccuauacccucacccagguuuuugguuuucuuaucugcuaaaauuuuuaugcuccaaacucauuuuaaaaauucagccaugguugccccagauaggcuccacaucccuccuccacccuuaugucccuuaucauucuuagaguugucugauuuucaugcucauucaauaggcacuuagaaguaguuguauauuucacuaaggagguuauuuucuagagaguacagucugugugauuccuuuuuaaaaauuacuuacuuauuuuauguaucugaguacacuguaguugucuucagacucaccagaagagggcauaggauccaauugcacauguaguucaugggaauugaacucaggaccucuggaaggacaguccguaguacucuuaacacugagcuaucuauccagcccugugugauucuuugccaagauauauuuuauguugucaguaaauucauuuaaauguuauacaucuuaaagaccaucuuacaugcauuuguuugcauguguguggcagaugaaacuuuaaucuuguucaaaucgacuuuaccuuuccuacuuggaaucuauuuucuaggucuccacuuacuuucuccauuuuauaugauccaagaucuugcucagggcauggcccuguccacaguugggacagaucuucacucaauuaauguaaucaagauaguuccccacaagugugcuuggggccugucuccaugugaauuuuagauucuauaaaguugagaauuaagacuaacuaauucaguaacacugaauacuuuguguguuaccucaguuauucaaaguaagcuggacaguaaguagagauagaaucguauccaacuggucuugggugcaaggcccacagacuuaacaaguuauuguaucaaauuucuuuuucaucaucuuucuucuugcuuuggaaguguggauauuauauuauauuucuguguauuauguuuuucauaacucaauauuguuauuuuggacacuucacuaaaaaguauuaaugcucauuaacuuuaugugaugaauauaccugaguggauuuggagucaccgaggaaacccuuccgggucucugagaguguuuccacagaaguuuaauuaagaaggaggaaaaauaaacccagaaugugggcuacacuauccugugggcuagggaccucggcugaagacaaaaggaccaaguagcuccagucuccaucuucauguccuuccugacuguggacucugugugaccagcugccucaugccacugcuacuuuuccugcuggaaugggccuuacuccucagacugagucagaacaacccguucuuucucaguuaucuuucucaggcguugugagaagaagcuaacauaccaccuccccacuuucuuuucauuuguaacugcauaacagcacagaggccugguuuuuucucuuuuucuuuaauacugaauuuuaacaaauuaaugguaguaguaggauauuuuucauucuagaguuuaguauaguuuuuauaauuaacaucuauuuacucuuuuuuuuuaucuauuuacucuuaacagaagaauagggauaauacauuuuuacuuuccaacauauguauacuuauuaauaaucaagauuucaaaaagauacuaauuacuuuuuaauuuguucuuugcuaaccagccacauucuaaauggaucagucacacaucauuuagggguuauucuugacaaaggcugagaguaucucccauauuaaagacuucauauaauaugugauucuagaaccuuauauuagaaauuuuaaaaauguuaucagacaugauuagaauauagacugagguaaaugacauaauuagaauuaaaacagauaaaauguuuccauguuaaauuuaauugcuguguugcauauaacaaacagcauugucuuaagaaacacuuccacguauugaagagcaaugggacaucaaauuauagccuccauacuacaguucagauaacauaaacagaaguguuuggugagguguguacaucuguggcagacuacucacauagccugugaggccauaaaugcaguuccggcacugcaaaaguagacaaacagaugaagugaauguauagagagaauguuaaagauaaaaaguaaaaggaagaaaggaauuuaccuguuguuacuuacuugaaaccauuucagaaaaacaaaacaaaacaaaaaccccccaaaaaccaaagauacaaagcuguguuguccugcaaaugacaugaaacuauuacucacucauuauaggaucuauucaauacuauuguauuuuuaaaaugaguauuuucaaaacgaggaaccagagcuuugaaaaguuauauagccagagccaggcaugguggcucauaacuuuaaucccagcacuuaggaggcaaagucugagagcuugaggccauccuggucuaccuaagaaguuucagaccagucagaaccuucucagggaaaccuugucucaaaggagaaaaaaaaguuuauaacccagcuauuauaaugacaaauaagugaucugcuucuguaguggaucucuuaagaaauuuagagaaggaauggcuggaagauauaauuaaugggaaacacuugucuagcaugcacaaggcccguugguuagaucaccagaaccacgggaagaaagguagggugaucuuugaaauuuucuccugucuguuccccagauucucucaaaauauuucuaagucuauucuucuaagaguuuuguaugcagcacuggguuuuuucuuuuaaauuacgguauaaauauacauucuguuuacaaccuguauggucuuuuugaucccaucuuaauuucuuuaucaaguugacuuggugaagauuauaaucaaggccucaguuuauuuaaaaugguuccuuuuauuuauaguccucaguguuuacuaagagcuacauuagauacauuuuguauguucauuaaccuuggcaccugauuuugcaggugguuuuggaauguaugcuuaagaaagaccucaucuauaauaaggucacucccacauuucaccacuggaagaucgaugacaagaaguuuggccuuaccuuucagaguccugcugaugccagggcuuuugaucgaggcauucgaagagcuauagaggauauaucucuagguagguuucauuauucuuaucugaauauuauuuauaaguaguagauauucuuuuuuugaacuuugaccuaaaguaguugcuguccuuuaaaagguguuuaauaauagaaaaaaaaauguuccaagaauaacagucaguuugugguacgacucaguggucaaacaugccuguuagcacagugcuuagggacugaggcaggggaauugagaaugugagaucuucuugguuuggguuauuuaguaagccuguauuuuaaaaaagcaaggagacagagaguaggggaguacaaggugcuguuuucugaaaauuugaagaaauauaaacuacuuaugaggaaacuagauaugagcauggaaauacuuaaugcuaaguguguuuugauacugugugaagcugguuaguuuuggcauauuuuuuaaagcucucaguugauuauauuuuuagguaaguuuuauaaaacaaauauuuuaaagagaaaauuauuauucauagcuguuaaaaugaaagugauacauuucaaauuuggguugacuuucaagcccauauuuaugcccuuguaagagaacacuucuuuuucuaagauggaguaagcuggguacacagugcugagccaguuuucuguuuaaggaggaauugcacauacaccuaaccaagauaguauugcaaugucuuuaucaacaguguucucuuucaacagauuuacuaaauuucugucacuuaguuuuuuaucccccaaaauaaacuagacuacuuuuuacaaaggucucauuccuuaucucaugccugcuucaugauagccaugcuuagagcauaaaugcagaauauucugcuaccauacaucauuuugcauucacuuguuauaacuaauggcacucuuuaacaccauacaagcuuauacagacaugugcaugcaccgcgucagucagcugggccuugacugcccauaguaaauuaagacugacuucauuuuuuaacuugagcagcugaaauucugauucugaacacauauguuuccugggucagacaauuuagaaaaaauugaauuagucacauuuugacaucacuaaacaaccagagaaauauaacacagcuagaagcuuagccgugaaagaaaguaaguggaaacuugccaagagcugauggagacagucacuuuuuauucuaacagaggaggaaauacaagaaucugcuauuugaauguugccaggcaauacagaagucagucagucagucauauauauaaaugcuaugcuuaauuaacuuuggccucuuuucuuagggugcccagcgucaaaaacugaggcugaaggaggagaugaugauuuacaaguaagugguuuggcuugaaaggaauuuuaaaacauuuucuguaggaaaucauuagaauucauaaguaaauuucaaagaaccuguauuuaccuuggucuuccagguaaacggaaccaugucacagaaaaguuuguuuuguaaggaguuuuacagguugcaaguaugaaauccuuaaaguaggcagguugacauucuggaagcuagacgaacccaugcugcaugacugagcugaauuuccagaccccucgggacaucaucuguguugagggaagucuccuuacguacugaacugguugguuuugugucaacuugacacaaacuggaguuuucacugagaaaggagcuucaguugaggaaaugccuccaugagauccagcuguaaggcauuuucuuaauuagugaucaagggggaaaggccccuugugggugggaccaucccugggcugguagucuugguucuauaagagagcaggcugagcaagccaggggaaacaagccaguaaggaacaucccuccauggccucugcaucagcuccugcuuccugaccugcuugaguuccaguccugacuuccuuggugaugaacagcaguauggaaguguaagcugaauaaacccuuuccuccccaacuugcuucuuggucaugauguuugugcaggaauagaaacccugacuaagacacauacuguagggcuggcgagauggcucaguggguaagagcacugacugcucuuccaaaggucuugaguucaaauuccagcaaccacaugguggcucacaaccacccauaaugagaucugacacccucuucuggugugucugaagacaguuacaguguacuuacauauaauaaauaaaaaaucuuuaaaaaaaaaaagacacauacuguauauugauuacauguagucauguccaaagcauaauguguggcaaaguuuagauuaguguuuagccaaacaacuacauaccauauaugauuuggcaagccaacaaaauuaacaauacacaccuguucacuacuuuccacuuaagaaaguuuauagaaaaaggaauugcaaauuguuaguagcauauagucaggaagauggcagccauaucuccauaucaaaauguccacaaccguggcuuauacaacagaagaacauuucaaugggaaguugauuuggcuuaaugguauuuuuaaguuuguacaucuuuacuuuuguacaucuauguuguccccaaauuucugacuuaauuuaugacauggaagcucuuuuaagcuguuuuuuuguuuguuuguuuguuuuguuuuguuuugggagacaucuuauauagugaagucaaaccuuccuuaaaaugaguagaaagggaggccuuacuuauauuuuaugugugugaguguuugccugcaugugucugcaccauauacauauagugccugaggaggacagaagagagaaucugcccuuggaacugaagucacagacagucaugagccuccauguaggugcuuggaauagauacccucacaccaggaucucuggagcauggcagacagugggcuaucuuuucagccccaagauagcacuauuuuaagaguccauguccaggauugaaacugcaaaagagaauucuuaaauucacuguaacacuguacaguuuaucuagugguaugccagaguuucagagaaugaaugagugggggagaggugcauguguguaauagggauugugcacccaguacacauguagaagucaguucuuccaccguguggguucuagggguugaauguuugucaucaggguugguggcaaguucuuuuauccaccgagucaucucauuggcccaugguuacuuaauuuacuacaaguuguuuucugaccaucauuuguaaaaacaauuaggauauagaauauaguuuaaaaguauaacauaaccuguuacgcaguuuuucagcuuaguagaagauucaaauuuaaaugaauauuuugaguaaagauuaucaaauuuaaaugaauauuuugaaaggauuaaaugucaaaguagaaaucuccauuuugaguauucauuaacuucuucaacagauauuaaaaucugucauaauuauuagauacaggguuguuuggcacaacaucuuucuguucugaacaguuuacugucuuguaguugccaggaagcgcugcgaagaacuuucuuuuucaguuaccuuugaaugaucucagaacugguccaugguuuggguuuaaaguccuaucuuguuuguauuuuacuccuagugucaacuacaguccugauuauaagcauaguuguuacuuaaaaacauuuuaaagaaagaugcuaaauuuaaaguuaggacuuaaacaaaaaacaaaaaccagcugucauguucuuguuuucuuagacuuuucugguaaaacaauuaaaguuuuguuugcuuuuguuucuuaauucugguuuguguuuguuucaaugucauuuguaauacuuuuccauccagauaagacagaauauuggcaguuuuaauuaagacaaccuuaauugcgauaaacacaaaauguaccuuguaacaggauugagauugcacaaagaacagaucuuaggugcugugcuucugggcagaaagaagacccagcugucagaaguuaaaaggcuuaguuuguuuaacuauugagaagcaaucagcuuuaaucuuauuuuuuuuuuuaauuagaugccauaacugacuaaaugacuaaaaagucucucauuuauauuaauugauuaaaauaaucuucacacugugggacaugaauuguuggugugccgauuuagaaagguguuuaguacaguucuguuucagaguugaacaccugccuggcuggccuuuaguccguggaaagugcauguauuacacacagccaucaucucuuagaccaucacauagcuuuaaaaguuuccaaagcuuguuagguugcacuuuauuauccauacgucacauacacuuuuauucaaaguuuuucuuaagguuuauuucuuuuuauucuaaguauauugguguuuugcuugcauguaugucugugagggugucagaucaacuagaacuggaguuacaauggugagcugccauggaggugccaggaauugaacccagguccucugaaagaguaccagugcuuuuaaccacugggcuaucucuccagcccuuuauucaaguuaaaguaaaguguaaucuugggcuagaaucuuagaaauaaauaggguugucaaaaaggguuauaugaagauuuauguagauagcaagaacuauauaacuauugcuuauuaucuaaaaaauagaucuaggaacaguaaacaaucucugcaaacuuaaaaguaccuuuaugccaaauuaacuuuacauuggaauauuuuguuaauguaagccaggacauggacugacuuuucuguaguguuauuuuucaacagauauuaugucuugacauuuuauuuucccuccuuacuguuucaucauaauugcuauauuaagguugcuuaaguagaauaaucuaugcuagugguguuucuagauaaaauucuugagggaaacauggcagcacauacucuuaaucucaggccuacauacugacagaucuccaugacagccuagaugacauggugaguuccagaauaccagggcuacauauuuaguuagacccuggagugcacgugcggaaucuacuuuauuucuaaucauaaaaagcaccugaggagaucuguuaaacagaguaggaguugauuguggccauaucuaaacugaaugggcacuaggaacaugggaaugugugugauuacguuaaguugaaaaaauuaggaauuuuuuuuguacuuuauacaguuuuugacuacuauaguuuauauauauuuauguauacuuauaauuaaaguuuugccuuauuggauaucaucuagccacguauuuaaaaaauugauuugugauaacuucaaggaugaaauucuugagcagugcuuuuaagauaaaguugaacguugugaacaguuguuucuuucccagugcgucccuaggagcccgcaguuacuuaaccuuagcaaagcgucugggguucugauucuuacccuccccacuuagugugugccagucucuuacagccuuggcacuugggacuuuacguagagcauugagauaaaacccagucuuuaugagaaaugauggacaaagucugaaagaagaucagcuugaauccacauuaaagucuaauaggcaggaaggauacaggagauggggagggguguggggggugcuuucagucacacggugaguaaugagaagaggaaguagacuggaaaguaguggcuggaaaggcucacuguuuagaaagucauuuuauguacauaaagacuuaaucuuacucaauugggaacaucagaccaggguguauaaaaaaagauauauuauuuaaaauaacagugacuaguucacugguagaguauauuuaacauuaugauuauaugccagaacuaagggggaaaagcauaaucuuaauaauuuaugaaagaaauuaacaaaaauuaucaaacuggcucaucugguucaacauuguauaaaauguuaguuugacuuuuuauaauauauaaguaauacauacuuuguuauacauuguaugcauagcacuuucaaacacuuguugggucauuucucauauccaaaugagacuuuggguuuuuaaugucugagacccauuuagguauauacuuacaaauuauugcucaacuucacagaacagaaauacagaauucuacccaggucaucauagcaagcuuagacaauauaacugaucuguguuuguuugcauauaaaauuuacauaagacuuaacuguuuuggaagaaacauuuuguugcuuccuuacggugcuggggauagaacccaggacauugccuggcuauacaagggcuaguacccaacauuaauuuagaauucuuaauugacuucucaauuaggcuguacuucaguaaaagacaaccuaaucaaaaaacuugauaucacuaaagauaaaguuaucauauaauuacuauugcugcuccaacucaugguuaagaauuuauaaguaucccaucuagcucuaaggcugauauuauaaccaguuuauaguaaaaaguuggucauauuaauuuuauauccuauuuuuaaaaagugaaucaaaaccuccaagguccuuucucuuaaccguuugguuuuuacauugucuuauauuucguuuguaugggguagguaguuuuaaaaauucuuaaacaaauaagcaaguuucuguuucuccuccccuccccuccccuccccuccucuccucuccucuccuuuuucucuuuccaguuuuuaaaauguguacugaguaacaguauuuagccaacuuccuuucaaugauuuaacauuaguugucauucuggggcaacuguuaggaaagaggucacaauauaagauagcugguuuugacauaauuggcuuuacuuggcaguagauccuauauauuuuaaacuuuaauugcuugauuccuggugugaugacuacuuuucacuuaaauguuacaguuauuuucuaacuuuaaaaagugaguucuggagaaauuaauggcuggagacaauuguuacagagcaaaaaguaaauuuaaaagauccuaguuaguuuauguaauucacuuguuuacuuuagaaguagcauuaacaaacucuuuaaaacuuauuuaagaaauuaaauauaucagccaccgaacucauacacuauugcacaaugccagaaagauuuugcugaagggacccuguuauagcugucucguaugaggcuaugccagugccuggcaaauacagaaguggaugcucacagucaucuauaagaugaaacacagggcccccaguggaggagcuagagaaaguacucaaggagcugaaggggucugcaacccuauagguagaacaacaauaugaacuaaucaguacccccagagcuugugucucuagcugcauauguagcagaagguggccuaguaggccaucauugggaagagaggccccuugguauugcagacuuuauaugccccaguacaggggaaugccaggaccaagaagugggaguggguggguagggagcagggcagagggaggguauagggaacuuucgggauagcauuugaaauguauauaaagaaaauaucuaauaaaaaauaaaugaaaaaaaagaaaugaaauauacauuuugaaccuuuacuagcacuauaaagguuauucuauuuuagaauaguuuggguaauaauuuaagccagugaaaguacucauccauuucuacuugacugucaaauuuucuucucaagugauugcacauuaauggagauaauggcaaacaguauaaucuacacugaaaagaaaugggaaaaccuaggauuuguuuuaaagugugcuacauuacacuuauguaacauuuuauagucauuuuuguuugugacauuuuggaauugugucuccaaugacugauguuaauuaauugaguauauucuccuaagugugaugguauaagugucuauacgccaucagcaaauucaggcucacauuuaacuuaacauaaucauggaccacuguuguuuguguaucaguauaguuuguguauuuucuguuuuuaauuuguaaauuguuuauauauguguguguguguguauuuguauuucccuccuaaugucuucaucuuccaugucuuuguauuacucucaguauaauuagauaaguuaucauuagauuucuauagaacagaagucuucauuucuuuaaaguuguuacuaauaaagucuauuuuguucacaaaguuuguguucuaaauuucuucucaucauguaccuugaguucagggaauugccuuucauagugauggcaauggcuuagacuuacuaauugugcugaaguaucuuucuuuguugauguuguucccaucagacgacugaagaagacacuucccguucccuagugaaagaucacuuuuuccagcaagagacaguuguuaccagugaaccuuacagaagcucagacauaagaccguuacccuuugaagaucugaaugccagaagagucuacuugcaaagccaagucagccaggugagaagacgaauacuguuuccaugcauagcuuauauagaaaagcugggugugcuacagaacaccaaggcccuccgcucuuuuccauguuacgaaacgauauaaugguuacauggagggagccuagaacuuccacaguugauuucaggaagauacaugcaguguuuauuacagagagcaccaugagcaaaggugucugugauuugguaaaaaaaucacacagauuaaaaacaaaggaaaagaugcugagaaccggcacuaggucauugaauguucauaguguggaaaacaccuuggaauuuuaucuaguguguuuuucauaaaauugaguacauaguuuucuacggcguuguacaagaaaccaaagacaacacugaacauuuuauacauuguuaguuguagucagaaacaauuugaaauaaccuugccaucugcauucccacaggcaguugacauuuccuagaacacuuauauuauccuuccucuuuucuuuuacccugaaguaaucaguaguggaaauaaauaguauuuuguucugacuuuaaguuucacuuuucugaugacuaguguguuagcaaaccaauacugaguugucuggucuucucuuacugauuugcaaggauauucuugcauuuuggaacuaaauccuuuguuagguaaaugccuuacaaccucuucauuguuuaauguucuggucuguaaguuauguaauaccagaauuuaccuccaaaaguuaugaaauaaugguaauaaaauaugguauguaaagcacuuuggaaaaguauuuuauuaaauaaagaaaacaguauuauuccuagucuuauaauugaaauguguccugaucuccaagauuguagacagaauaagacagguaauggucucaauuaauaggaguuaaauuugauggguuaguuucccuuaacacuauauauuugucaaagguuaauguacaaaacuauggguuugauaaugauguuuuuauauuugccgagagugaaacaacauccacacuucuguaguggagcgucauugucuuuauucccuacauagaacugauuuguuagagccuccccuacuggugcagagugcccugugucacauaccaaguuucccuguuugccuggaucugcuucuaguguuucugaugugauguguugcccucuugucucugcgccuggaccauucucaucuuuacuuuagaaucccagcucuguaagaaauggggauaugcagcaagugucguaacuuagcagcuugaugacuuuaaguuuaaguuuuuuguguguuuuauauuugaguuguuuugaaucugugcauuagcuuagggagacuuuggugucacucaugaaaguaauauauccuucuacuuaguucuuccucuguuucuuauaacauuuucuucaagaaaagagucuguaugucagauuuacuccuuuauauuuauuugccauuaugaguggaauccuuuuaaaagcucucuuaucacuaacuuugaaaaagcgcuuucucugguuuuucaacugauaaauuauccuaaagauuauagaaauaguauguaauuuccaguguuuucaaaaaaaguaccacuuaauugagguguaucuuuuaacaucauuguuaaaagaguauaaaagcaacauuguccauuugucuuuucacuuaaacauugcaugagagaacaguauccaucagucuggauaguugcagagugugaauguguuuauaugggugugugugugugugugugugugugugugugugugugugugugagagagagagagagagagagagagagagagacagagagagagagagagagagagagauuuuugagauaguaaaaauagggguaguaagugaaaauggacauuuuuacuuuuaaaagaauauuccuacaaaaaaaaauguacaggaaacuuugggauuuuguuuucuuguagcacuguggauugaaaccagggcugugcacaugcuucgcccagagcuguauccccagccaguaaggaugugugcuuaguauuuaacuugaggucacuauacucaggccaaaaaaguuuuucucuuaauuccuuuucuguaaggcucuucuauuuacuguuguuuuaguuuuaguuucauuuucauuuucaaauuauacuuuuauuaaauguggcaagguuuggagucagaauauuucagugcaaaaaauaaaaagaaaacaaugacugaaacacugaugauaaugaugauugauaugggaauucuaaaaguaauucugauaaaauucuaauaaaauuuuaaccauaaucuguuucuauucuuaaauguucuuuacaacucaagcuaagcaaucuaucaggacauugacugcccuucugauauuuuuuuuacaaaacauaauucauacaccagaaaauuauucuuuuuaugguaguuaacauucgauguuuugauauauuuacaagauugugcaacggccacuacucaauuccagagcauuccugucacucgggauaacccaucagggauguugucucgucccccacuucuucgccccuagcugcacuguugugacacaugcugaugcugaagaauacuccccacacagaggucuuccccuggcaugguguguuacuuauguucagucagcaguuggcagauaauugucacucugacagguuuuacuuuguaguccagacuagacuaguacucccauucuguaggccagguuguccuucgugauccucccucagaagccuccaaagcgcugggguuacaggcauggcugccauaccuacuuucugccuuguuuguugcaggauguuacuugcuaaauugaauuuuuaaaugcauuuuuuuuuacaacaauucuguucaaaaguaaaaugggggaaaugguucugcuuuucuuuuuuuaagacuucuuuauuuuguguguaugaauauuuugcguacauguauguuguacaucacacagguuuggugccuguggaggucagaaaagagcuuggaucccuagaacucagugacagauggcugugagccaccaugugagugcugggaaccaaauccaggugcucuuaacuguggcgcuaucccuccagccccuuaccuguucugcuguuuauuaaaagagggcuggggggcggggcguguugggccugggggcuuguuagacaugacuuuauaguuuugaaauguauauuggacuugguuuuguugaaaguaggaaauuuauacugcugucacuuaauuuagaaauuauuggaauuuuagauaccauucagucagcaaggccuagacauucagagccgaaguauggaauauguacagcggcaaauaucuaaggaaugugggagccuaaagucccaaacuaggguaaguaauguucauuuaucuccuggucugaaaugccgcaguuuagcauccaagaguguaucugccgcaucuguaugucuacacuccauucaaccugaguggcuuuugaauugcaucaucagauaggacaaacaggaacuggaauauuguuaauuuagcguaugcaucccuuccccuccauacaguagcaugcaccugcauccaagagucccaaagguuuauacugcuccagcggcuacucuucuccuuuaaguccuagcuaagucuuaagcugucaucccaccaaagugugggugacccuugggaaaugauugaucuugagacaaaauuucucuccagcugugaaccuguggaaccagauagaagauagcuucuagaguacaauguuagaaaagcauaggguagaaauagucccaucacaaaagugagaggcugaaaugaaggugccacagcucacccucaggaaggcaaaaccauaauaagcauuucacuccauuuuagcacuuggaauuaaucaucuuuggguuuggguuuguccuauuuugcucuugauuugguaguccuccacacuucugccucaccccaugucucaucgcugccaucagggucuuagaauaccaaagcaugcauggucuacugaaguaggagacuagccugcccucuuaaacugcagaagauaucucagccuucaaauucaggcuucuuuaccugagagcucgggcaugccuggagccacacagugcucuuggcauguugugaagggauccagagauugaaccuuccugucuucacccuguccuggcugcuuucguccauguuggcagcauuuugcuuuauccagcucugccugguauccucuccaguuccccaguguuuuuaauaaaguuucacuggagauuauccaauugcuuagcaaguccuucaguuuguccuugcgugugugcgcaagacacacacacacacacacacacacacacacucacacacaggauauuauaagcaacaugaagaaaacugcacagcauuucugaauaucuuuccacccaaguuuuaucuuccaaguguaccaaacaugauugauuuugccacuuccauuuucuuucucccuguguccaguaguaugguguuuuuuuuuucagaguccucaccaggaggaccuuauaggccauauucuuccuguacuuucucuaccauaaaacacuuuuaguuaaaaauuauuauccguuucuccauuuuuaaagcuguauuacaguggcucccagcuucuuggcacuauaaaucuguaagacagaaccaggggugagcggauggagcuccuguuggaagggauuggcucauccagaaaugggauacaaagccaaaaguuaguccaggucucguggcgcagaccuacagggccagguacuccaggcuguggcaagaggaaugagagcacaggagcagcuuugauagccucgugagaccuuaccuuaaaauacaaagggcaaagagagauagccgauggagcucgaugguagacugcauaucuagcaggcauaagacucuuaaguuuaaucuucaguacuagaaagaaagaaagaaaagugaaugcaggagaagccauuagcauggaaugagggaaaaacuggagcuugugugcaaaggcacccugcuggcagaacuuccucuugcucuacagggagguagucuuuguuucagguguugucugauuggcugugguccagcagccgaaguguugaucucaguuaaaacuuggucacagagcuccuugaaugaaucccuaggugggggucauccuaccacacugacauaaaaucaaccaccaucguccuuacugcaauuuuuaucuugucuaggucccuuugaagucaaucagacaugucagcuuucaagaugaggaugagauuguuagaauaaauccucgagauaucuuaauacgucgauaugcagacuacagacauccggacauguggaaaaaugacuuggagagagaugauacugacuccaguguuccauuuucuaaacaagacaguaaaaagucagacuaucucuaccacuguggggaugagacuaaguuaaguucucugaaagacucugugguauuuaagacacagccucccucguuaaaauuuaagucaaaacgaagaaaagaggauggggaacguucucgcugcguauacugccaggaaagguuuaaucaugaagaaaacgccagggggaaaugccaggacgcuccagauccuguuaaaagaugcauauaucaaguuagcugcaugcucugugcugagagcaugcuauaucauuguaugucagacucagagggagacuuuucugauccuuguucgugugacacuagcgaugacaaguucugccuaaggugguuagcccugguagcucugucuuucauuguaccauguaugugcugcuacgucccuuugagaaugugccaucgcuguggugaggcaugcgggugcuguggugggaaacauaaggcugcugggugaagcaguccagggccggcaugagcuuaaaccuucaucuccaggaauuagcuaacuuggauuuguggaagcuguuggcaagcaauauggaaucuugccgguaucauuggggccaugcguggaggaagcagaacucaucaguucuugugauuuacagaugcuagccgugccuguuucccugagugcauggcauguucugggacagaucacagagcauuuucagaaggcagucauuucugguuauugauuacaaaaggucaacauagaauaggauccaacuaaaagggauuaauuuuggcauuuucauauuuaugcacuaggugaugggacuuuuuaaagauuugaauucuuuaggacauuaacuaaaaagugcacuaagggacagugauuucaguacagaaaaguuaguacuugggaaauuaagagauaagacaagugcaacuaaaucauugguuguuuuuugaaagcaguuuuauguauaaauaacaaauguuuauauuuaacuaaauguaagguacgaacuaugacauauuaaacuuuucuugcccuuccuaguucugagguagaugugcacauaucugccaccacauuccauauguguugaguaguuaacucaucuaguuaauaacguuuguguccaugugagagauucggugaguucauccucagcucucuugggcugcaguuuauauugagucauaucuguacauucuggagaucuaaaaucuuuaaaauacucuaauagccuugagugaccaaccuuuuuuuuuaaagcacagauguaauugucuaauguucugauggaaauguaacacuuauuuuuauauaaagagauugaguaaacagaagaaauugaggguuccuuuaguuguuuuguuucugugguauucagccagcaaguuguuuucuuucagaguuuccuccuucagagaacuuaacugcauuuauaaacguuuuacaaggcagaagcauuaacuggauaguuagugugaaacaguuuccgcuugagaucuccauuucucacucugcugagccagaacucgcacagcuguuucacugauuuucugugcuuauuacucacauaacaaugguaauuaauaccuuucaguugcauuuuauuauauuucaggagcaaaguuacuuugcaguaacacauaugcagaauucucccaggaaaguauucaauccaccauugugaauggaaaucuuauacaccacauuccugucgcagagcauuuguauuaugggauguuugauuuacaaaguagugugauaugcuccagcaaacagguuaaaaauacuuugaggucaaauugucuugguuuuguuuuuuuaaaguguuacuauuaaaacucuugugagggauuguugcaaaauacucccucaggaaagaaagcagugugccuuuuuugccuuuuuuuuuuaauggauuaaaguuucugaagugauaaaaaugaaaaucacacuaccauuugaaguccauucuccagguuuucagugucauuucugugcagucaguuuuaugugucacacuucggcuuguguuggcuuucuucuuuugccccagauuaaacugaacaauguauauauauauaacacuaucugucuguaaaauacuuuuuuuaagaaagcauuuauauuuauaugacagcuugaacugacaacauuauguauauagaucaucuugaaguauuauuucacauugaaaagaagaaaaauauauugauaacuauagauguuaugaagaagaggcuauuucuaguuuuguacuaaaaaucaauuggaugaacuaaauccaaaaccagacacugucgcagcaauuuucagucuuauuuuuacuguuucuacauuggaggcugcugcacagauagaugaucuucguccuugcuguuuucagaggagcuugguuuccuagagcagacuguuaccuuucaggauuccuuuuucuugcugaaguagaguccugguuuuccuuaugagugauuauccauauuuguaaguucuggguuuguaauucagguuggagcaaggugugaauaacuaaagaaaauaacuugcuggcaauauaggaaaugccauggaaauaaacuguguauauacuucugagaagaacaaaauuaaucauuuuuuuuuucuguuaagcacuagucacuauagugcaucuccugguucuguacuguauuuuauacgcaacguacaugcuuuaauauuuuaauguuugugcauuaauauuuucaguuuguuuaaccacuuugcugcuaagauuuugccaucccguucccauuuuuuccuuuacaauuuuaaacauuucucuucauuaaaaacuaugauaaugaaauuguuuuuuuuuuaaccuuggauuuuuguaauuagcacacaugaauucaagccaguccagaaaagaaacugaugauauaauguuaaugagucucuuugugaauuagauggacaguuuaauccaauucccaacauguacguguagguggauucaagaaugauuucuuguucacuguacagauugggcgcugccauugggcauuuucuuuaaaacuucucuuuugucuagaauguaagcagauagcucaacaaaacuggugaaguaaaaguaaauauugaaaaugaaaucaucugaauagcgugacccaaaaauucuccagcuggggggccuguuugcuccugaucuguaguucucagaggaugcuugcagccuguggggaagccuuagauuuccugagcagugcuugcggagcugcagugccaccugcuggauggcuuuagaccagcgcugaaagauggaaauggugucuccaguaaaggagggcugugggcuguucaggguggccagugcccaccagagaaaucgggggugaggaaaagcgcuaaggaguguaaguaagucuuuccccaaaugcauaugguugcuggaagaauugaagcacuuuuuccuuacacauccuguuuuaaaauauuuauugaaacuuggaacuggcaaucaaacuuauguauguacugaagcauuuauacaaccaguuucuucaacucagaagccauuaccaaaaugguauuccuauuuucuucccaguaccagucagggagaauuaaaaaaaaaauaaacauaauuaccuguauuuuaucaugacaacuccagagaguguguauguuucugaguagauguugaugaggcaggacuuaaaauuuaaagagaaaaacuugaaacuaccuauuuucauugguuauucagcagugccuaaaaugagcuucugaacuauuacaaaugcacuuuggauucauguguacagugccaucugguucucugggucaaacuugcuucuccucucccucuuucuucucccguaacuaaguggcacacaggcauuucuuaguguucgugucggucuucaaagugcagagaacgugguggagagaauuuuauggaucuuuuuuuucuguuaaaauugaaugucugauuauauuugcaacauguaacuuggauuaauguguuuuaaaguaauuuuaauuguaguccagcagcacauugagcaaguguagcuuuucugaaaaguaacuuggagaacuucaguuaaccgauaaaaccaacucaucacuaaaugucgcugcucuuccucuugauuugaucuagaucccacuucugcgucuuacagggaacaccaaaaaguugcuaguaaaugauaguagagaaauagagggagucaaacagaaaauauuaaaaauaugcgcacacagacaaacagaggugauuuauacaaaccagaaugaagguggggagggaaggaaaauuacagggggcuuuaaaagguaccaguuaccuagcagcugggcaauuagaaaccuuucaguugcuuugguacacugucauccauuguucccaaaagcuaaauuugcaaaagcaauuaguuuuauuucauuuuuucaagaauuuccuagucgaaagccuuuguauuaaagaugcacagguuuuugugugaacagguuuuuuugugaacaaguauguuguacauuuuugcuguuaucuugaccucagaagugccucacuuguauauuacccaccccacccccacccccacuaggagccugccugcaucuuucuaauaagcaauggaagcccgcuuaacuccuguccuaaugcaucuucucacauagagcugacuggcugagaguugugaguauaucauguaaauacgcacauaggaguuuguaacugcuuuuguucugucauaucauguaauuggacguaucagaugguagacucuuuguuucagugauuucuccuccccuggaauuaccugauuaaaccaaauugugaaauuuaaaag

SEQ ID NO: 997 - RNA, 17115 nt, Mus musculus
agggaaguugguggcuuuacacaaggagagaagcucuugucugugggccgcugacauucaccucugugguacaaaacucaugaggaaagagggucucaagaccagcccucccagggcagucccaaagguuccugcaggaagaauuagugcugagcaggauauuuaaagcaaucgccuuccacaaagcaaagaggaccugcggaaggaacuggaagcgaagagcaagccugccugaugaucccgaaucuucagauucaguggcugagucagggccugugacuucaagggcaggaaucuaacuugacuaaucaaccaguagaaacuuuuacugcuggcucugaguaucugaagucuaauaaacaaacacaucuugggaacguacuuaucuacaagaggcacuggcuguguagcuguguacccggaguaacuaggaaacacucuguaagccccuccuugcguguacgcacacauaccacgcacacucacacaccuugucaccgaacacucccucccacacaaggaaagugaaauugcugugugaugagcauaaaguccuggguguuuccaagguuugggaguccagccagguguaacugauaaggggagggagccccagcugucccucagccggccccgcccugauucugccaagauccuuauuuggugaugcuuuuaccuggaucccuggacucagagccaagccugcucacgcagggccacagcuggagaagcaucgccgccgcugacgucccuucccaaagagaugaauggaauuccaggcagcuggagucaucuuggcuccggaccgauggcauugagaccagacuucagagacaaaggaucaggcagcagucuacugauggaaaaguguauacccacagaaauguaaaccacaccucgguuuugggagccgaaaaaaugaaaaaaaaacuguuuagggagaaagaugggaaauaaaauaauagguagagaguaauuuauaacucuacggguccguucuguaaauaguguaagauccuggagccagaugguucagcaaauucuccuaucgggagucacguuaagaaacacgagugggcacaaaauuguuuuucaagacacaauuucaauuuugccuugagggagcgggauauaaauucgcuuccuuaaaaugccgcuaaaaacucuccgaaaggauccccuaaaucagaauacauauaccgcccccaagcggccaucugaggaagcaaaguagaacuggggaaaaaacucucgacuuggacagugagucggaaggcgaccuccgugcacgguccugcuggcccugugcaacaccgugcugacacccuuagugagucagacggaaggcaggcgugcgggacaggagugaagcgcaaaguauagaugacaugggaucccccacccaccaggauugacucaggaggcagcuuccuuuaagggguccaaccuuuugcccucuuuuauuuuuaaaccagacugucucgauccccaagcgucucugucauggaauuauucaaggagaugugcuuuaaugaaagccucccuaaagggucuuaggugguccccaaagaagcaucgcgucuggggacucucaugcagaacgucuccaguucacauggcgcaagauccuaagcgcuaaaggcugaguacgccaaggcugcgugggcggagaccuauuuuucugacaaguuccagggcuccugugcgggaucggagucucccccuucacuuucagcccgagagcugugcgccaagcagcagggggcggagaaaugaacccguccguccccgucccccgcccccgcccccgagaacccuccccccucccugcuuccugccucuuuaaaagguccugggcuccucagucaagccagccacugccuggagucagccagccucaucggacuucugcaggcaaucgcgaagcugcuauccaguucugccacggucucucccggcgcaccggcagucucagcgucuucaccggacucagcguccuuguccuucacuucaccuuugccaccucuccggguuacugagccccggugcacacagguaaaccucccgccucugcggagcaccuggccggccaccucaaagccccaggcugcagaugaucagcgcuacuccucaucuccuacucuuccccuucugguuuuccuaacuccuuuauccugccccgucuauccccuggaaagaacuuuccggagcugguucucuucagccuucggguucacaaacuauaccuccaagacaccccaagauuuucuccccaguagucuccagguuaccccugacugucgccauccaaaauacauucuguaaucuugucuaaaggggcgggggggaggggacggacccaagucacuuuauacccuuuauccuggaacuccaacaaucccccugccucuggcgcucuuuuuauacuggauaccguuuggaaaguaaacccuucuuuuucagcacauauggggcaaaagaagaaacacacacacacacacacacacacacacacacacacacacacacacaccucugcccuuccaccuugcuuccuggucucugacucuggccuccugugcuucuugcuacaggcuccguguugggcacaaaggcuccaccauggagcuccugcggggacuagguguccuguuccuguugcauauguguggaagcaaccgcauuccaggugaguuugugauauauucauuuuccucccccuucuccucucucucucucucucucucucucucucucucucucucucucucucucgauagcuccuguguuuccuuggaguccuuaucuccugauaaggaugcagcuucccucgcucagcuuuccauaauugccauuauugucacgaguucccaccuuggcuccucacagccagaacuuuacccccuuauaccuagccuagaaagccgauugucuucucucuccuuacagagucugggggagauaacgguguguuugacaucuuugaacucauuggaggugcacgaaggggccccggucgccgacuggugaagggccaagaucuauccagccccgccuuccgcauugagaaugccaaccugauccccgcugugccggaugacaaguuccaagaccuacuggacgcugugugggccgacaaaggcuucaucuuccuggcuuccuugaggcagaugaagaagacccggggcacacuccuggcuguggaacggaaagacaacacuggccagaucuucaguguggucuccaacggcaaagcuggcacccuggaccugagccugagccugccagggaagcaacaaguggugucaguggaggaagcucuccuggccacuggccaguggaagagcaucacgcuguuuguucaagaggaccgggcucaacucuacauagacugugauaagauggagagcgcggagcuggauguacccauccagagcaucuucaccagggaucuggccagcguugccaggcuccgaguugcaaagggagaugucaaugacaauuuucagguaaaucuucuuaccugucacaagggcuauguggaauuaauaucgguagacuaaaaaugauucucaaauguaaagaggaacagacacccccagaagguugguuaaaucauauuacagaugacccaaaacuccaggguuucagauuugauagggacccgagaaauuuuguuccuaauaagaaauaaguuguaauggugccaggaccugggacccaugcuuucaaagcuaucaggagagauaagaaaugguuuuccuauuacacucagccuguuucagaaugggguacucccugugcccuuaggaaaguaacuuguaucaaauguaccuagcaguuuuaauagggcaugaaaaggauacuuugucaguauuugagucccugggcaggguguucugggugcuuucaguauggaucuaaggcaagacaugaauaacaguccagucaugugccucugggacuccuuacuugccuuaacuuucagauauuuuuuuuucuuacaagcguggcuuugaacgcccacauuaacucuuugucacuggagaguaucauguccuccagacuugggaucaaauuccauuuccuguguaccccaagcagccugaaaacuggauucuuuguaaaaugcuccaguuggcagaagacacaauuaagauuuugaaguuguucggcaauuuaugucucugugauaguuuggcaggaugaucuuaaguucuuuuaaacuuucugagcguucaccacaagcaaacucagacuggccgccccacccccacgcccagcauuaaaccacgucuguccucugcccacagggggugcugcagaaugugagguuugucuuuggaaccaccccagaagacauucucaggaacaaaggcugcuccagcugugaguaccccuguguuuuuuaagauuuggagaauucuggggaaguccaccgaaagcacccugauuaauguaagcaguagggugcauacacaauaucucagggggagcagaguuggcucgcacccacucugucauuccaaaggaaaugucuuuuauaacccagaacccgaaggguaggcuggugggaucagcuguugaaaccuugaaucagcuaucgaauacguuacaucuuauuucuuagcagcuaccaacguccuucuuacccuugacaacaacguggugaacgguuccagcccugcuauccgcaccaacuacaucggccacaaaacaaaggaccuccaagcuaucuguggccucuccugugaugaacuauccagcaugguccuggaacugaagggccugcgcaccaucgugaccacucugcaggacagcauccgaaaaguggucaguggcuuccccucccauuugccagcucuuggaaaucaccacagguggucccaugggagccuggacacucaugagccuucuccccuuucagacggaagagaacagagagcuggucagugagcugaagcggccuccccucugcuuucacaauggaguccaguacaagaacaacgaggaguggacuguagacaguugcacagagugucacugccagguaagagacacucacagacugcaauaagacuuggagacauaugucucgggagauacguaaaugacuacacacauuuuuaaaugugcucuggccugcuaccaaagugauuuuuuuuucuuuaauauguaaugacaucugcaaauuccucuuuaaaucucagaagguuuaucuuaauaauaccccaggcugagcagcuaagagaacaaaucuaucuaaacguuggaaugacuuaccugcuuuaguucaaagaccaaguauugagugucagauacauaaaacccgcuuaaagcauucgguuuuggccagcccuaauuuguauucagcucuggcagacagauucuucuaacacuguucggaucucuggcucaccgggaaaaguuuaaaugcaaaucacugguuacugaauuugagacacaacuucaauuaaguucccgccucccucuaauaugugauaaaaacccuuaucuaccuuugagaugcuuacugauaccugcaacguccguugcuuucccuuaugcaaauguguuguucuguaacuuccaccccugacugaguagcaguuaaaaagaacuuucccaaagaauggagugagaauuagcccuggaacuguauaccucuggggacuacagauccagcagagacaucccuccuauaaaagccaccccuccuguguccuggcuuauaauggcaaugucacagaaagcuccucucugcaauacgcuugguaacaucguucccucuccuucucuugccuugcagaacucgguuaccaucugcaaaaagguguccugucccaucaugcccugcuccaacgccacaguuccugauggugaaugcugcccacggugcuggcguaaguuccuaaaaugguguagccaucccucaguggcuagcucagucugggggcauccugacagcugggcacaacaccagagcccagccccucccagcuccaucagacguuccagucagaucuggguuauggcauaggcaauggaugaucuuacagagcuuauggauucugguuuuaugcuauaaggagagagauggauacagcaguagacuuaagcugguugcuuuuagcaauugaucuuuguugaaaaaaaugaucuacuggagaacggacagaaacuguguaagcauugggcugaggcuugaaaagccaccuguuuuaucugcagugagaggaggccuaagggcuuagcaucuguucaauuuccagggcaguaaaagaaaucagccacuauacugcuguguaacacucugccucaggggccuguugccaguauaaucacuuugcuaaggagauauuuuaugcagaaggcacaagucauaaaagugacucaccaugccucacaaagaaaucagggauacugaauugcccuucacucacacacacagagcugcacacaugagccacgacucagaaucacccaucccaugguagcaauuuuggcauaauaauguuuuucuguauauccacuucuguccaaccucuaucugagggugaguuacagggaacaaagccugccgagagcuagcggagcucugaguuugagcuagggguuguuagaaauauguucauggauggcaaaaacaaaaacaaguuccguguccccugauagacaggcgugauugucgucacggugucugagcagauagcaaacaaacaccuucuccucuugagaaaguguguacaaaaacaccagaggccagcacgaggaaaacaaacugauccaccucgugacugaggcagaggcagagccccaggcaaacugccucccaacauggaccagggcuucacugauagucagaagugaugcagagaagcugccuaacacacuggcauccuugggcaccagccuggaaacaucuaagacauccuaagucaggaaaggggaacuugcuugaggugcacauggaagaauccauaaugggugaacaggagagugcacacugugagcuggcucagcugugaggaccaggcagagugggccaucagcccaguccuuugcauaugaugaccugggaugaacuccuggaccacuggcccaagacuugugcuacucaggccagggagaucucaugcaggacacacuggcacuguaguugcuuaggauuugcuugugccugugaaaggagagaugugugaauuggcuccauuaucauuaucaguucccaagacucuuggauagccaagcgucuggagaguacauaaauguacacaaucucuaguuguuaaucaugcuuccauuaaacuaagaguaugaaaaaagaaggcuuuuuuuaaaaaaagaaaccuauugcuuuaccaccucuggcuauaaagggccauaagcauauaaguaaauaaacugccuaagaacaguuuaucuuagacaugagaugcuaacgaccucauuucuccccacagccagcgacucugcugacgauggcuggucucccuggucugaguggaccuccugcucugccacauguggcaauggaauucagcaacguggucguuccugugacagccucaacaacagaugcgagggcucuucgguacagacaaggaccugccacauucaggagugugacaaaagauguaagcaucauggcugccaaggguggcaaucucccuugcccagugcuucccucacaaagagcagcuccggagcgagcggggagccugagaaugcagguucugagccugcgggcucucagucucaaucacaccucuaaccuuugcacuccugggcuugaccuuccuucccugaggcuccuccucaucuguaacgagagaacaauaaccauuccugauaaaguuacuuuagccauuuucucuagauaauucauaugaaacaaucagaauggaucugggcuccugaccagcaaccuauaaauauuagguuguugacagcaacucacacacacagacaaauaccaucuucccuauaguuucuccacugaaguguggcaguagccaguuucuacaauacacuaguugaagcugcuuuuggugggcugcuggaaugauugccugcugagacuugcuguguggcccccuccaaggcagcacccauuggugacaaucaacuuugcccuucaguuaaacaggaugguggcuggagucacuggucuccauggucguccuguucugugaccuguggugacggugugaucacaaggauccggcucugcaacucccccagcccccagaugaacgggaagcccugugaaggugaagcccgggagaccaaagccugcaagaaagacgccugcccaaguaagugugggccugaccuggggauacaugggaggcagcucuacccagcugguggccugcucucugcagcuaaguagaccauggagcaugggagcucacucucuagagaaacaaacagaaaccaaguccugccugcucagcagcuucuuuuaaugaaaaacagaaagcaaaccauuucaaccucccuaauucccaaagauucuucucaugggccagguuagagggcauuugaaaccggcucaggacaggauucugggacagauaaggcacccgaaaacugaauuuuuacaugugacucauuugcuuacaguuaauggaggcuggggucccuggucaccaugggacaucugcucugucaccuguggaggaggagugcagagacgcagccgacucuguaacaaccccacaccccaguuuggaggcaaagacuguguuggcgaugugacagaaaaucaaguuugcaacaagcaggacugcccaauugguaagcugcgaggccagggacaccaccacccugggagcuuucucuuuuaugaaugucauagucaguauucacugggugcggggagggggagggugccauauuuaauuggcccuagugguuugauuacaguaagaugcaaggcaaccauuuccaguaacagagacccuucagugucuuauucucuuuuaaguaguacauggcagugacagcaacuuagacccaagcacuuacccaccugucucuuaccucuccucagauggaugccuguccaaucccugcuuugcuggugccaaguguacuagcuacccugaugguagcuggaaauguggugcguguccuccuggcuacaguggaaauggcauccagugcaaagacgucgaugagguaggcagccaauggcuccaaguuaucagaaugaagaaagcagcuaacccaguccaggguccuuccuuaaaacaacauuugccaaguguuaagcaaacucucauuuccuccauagugcaaagaagugccugaugcuugcuucaaucacaacggagaacaucggugcaagaacacagauccuggcuacaacugccugcccugcccaccacgauucacuggcucacagcccuucggccgaggugucgaacaugccauggccaacaaacagguauaguagacaaguaggccagaguagaagagagcugccuuuggucaaacaaugaacagacagagagggcacugguugcauagucucagaugugugaauauucugggcugaaagaagcugugaucagauaggcuugugccagaugagcagcuccaagaaaauccaguguaaaucagcauuugccaauagcugggauauccucaaauagaauggagagacagaagaaacccaucuuucucccaaauggggcugcuaucuguuucaggaugggaggaaucuggaccuuugguggcuugggacuuuuagacauucugugauagcaucgggauacuguacccucaggugugcaaaccgcgaaaccccugcacggacgggacgcaugacugcaacaagaacgcuaagugcaacuaccugggucacuacagugaccccauguaccgcugugagugcaagcccggcuaugcaggcaauggcaucaucugcggagaggacacagaccuggacggcuggccuaaugaaaaccugguguguguggccaacgcaaccuaccacugcaaaaagguacagcauauaugaagcccagagcauuuguacaaacugcacauaaguaaccucccaaaauagcuuccauggcuucaccuucccauuaaaaucaugucuacaccugagcauccuagcaggcuaucccacuguggcccccagugugcgccaaacaagcgaaugcuaacugugucgccuucuuuuuaggacaacugccccaaccuucccaacucggggcaggaagacuaugacaaggacgggauuggcgaugccugcgaugaugacgaugacaacgacaagauccccgaugacaggguagggaaaauaugcucuccauuccuccuucauccucguggugugaugacaaccugaaacacuaggauucaagggaucacagagugauagcaaaaacauagaccaaacucauauagaggauacuuagaaacuugucacuaugucucagugauuugaggacacagauguugcuagaauuauuagagugaguuucauuuuucaucacagacuaccccaguuugcacaugugguauucuguuccacagauacaaugucuagaugaguauauuuuuauaaugaaaacagggguggugugauuauauacuggauuauauacuauccagucuucauccauagugucuuccuggcugggaauuucacuuaugcugaauacucagucaguauauggaccaaguacuagauaacugcaguagaucuuugagggcuuuuaauacugugaaugggguugaaggcaucagcugauuuccuaggcagcaccauagagaguccauuuucccucuuugcaggacaacuguccauuccauuacaacccagcccaguaugacuaugacagagaugaugugggagaccgcugugacaacugccccuacaaccacaacccugaccaagcagacacagacaaaaacggggagggcgaugccugugcuguggacaucgauggagaugguaaggccccuggacuggcaggcugaagggacagagacagcacagcuuacugaguggcuauuaacgugugacugaguuaaaauauauggggcuguaggacucauguacaccuccuccauaggaauccucaaugaacgagacaacugccaguacguuuacaacguggaccagagggacacggacauggaugggguuggagaucagugugacaacugcccccuggaacacaauccagaccagguaggugaacuucuuucagaaucucuuggugagguauugugucucccuuucuaagccuuuaagauagugaauucaauagacuccaagcccucccauuacugggguaccccagagccauuugcaaugugugccuguacagagucugccugauauaagccucuggcaaacacucucagagacuauuauggaaaucuugggaccucaguuuuguuugcaaccaccauuaagacaaauuacacaaaacagagagcugaagcugauaguucuauaguuguauccgaugcauguaaaacugagaggagagcagagugcagaagcaaaacaaacaccugugugauggcugggaacagagucuaguaaacaauuaggaagcuaaaauacucagagcuggagagaauucugguuucuccuauuccccccaacggacccagcuucauuuucuucucagccugagcugcaaacagcuauuaauagccaggcuucugguaccagagagcuucccucuguguuguugugcagcauuguuuucuaggaauaaaguaaaucaauuucucuuuugucuaaaacgaugguucugagugacuuaguguucagaaauuuggauagauuguuuuucuaaggaugagagaaaugagaauucaaguuacuccuaauacuuacccuuauggagucguaccaugcuaaaagcaauuugacuucaagccacugucacagggaaccaugagggcuagucaguauuagcuucaggucacacaguacugagaucuucugcuuuggguuugggucauuagacauuagacauuagacauuagacaucuucgauagcauuugaccucacagaaugaguuuggauuccucagauuagaauaacuuuuauaagcaaauuucaauagcauacaaaaucuccaaagcaaagagcauaaaugcuggaaagaaaacauucaaauuuuagauaaaccgucccaaagcaucucacacgcacugaaugcuaagcccucugggaaaaucuauuuugaaaaaauucuaguuugacuuuaucugagccaaaagauaaaaucuuuaugggauaaauguagaaagcuaaauacuuuuuaaaaaaaugucucuuacacauuaugcagccagucgcacugaccacugccaggauucgaggccuggaguagaaguugaccuguauuugauucacccacuguugaugucucucuuccagcuggacucugacucagaccucauaggggacacuugugacaacaaucaggacaucgaugaggauggccaucagaacaaucuggacaacugucccuaugugccuaaugccaaccaggccgaccaugauaaagauggcaaaggagaugccugugaccaugacgaugacaaugacggcaucccugaugacagagacaacugcaggcuggugcccaauccugaccagaaggacucugauggugagucacuguggccacuccuagcuggcauaacugacaucuuggcugucuagaugaaaggaauaaaaacaggguauccaagaggucagaguaacaaaacacaaauuuuugacaagauguuaaauagugacccacucaucauagcaguucagaauuucacugaacacuugcuuucuuugaccuuugaccuuaggugauggccgaggugacgccugcaaagacgacuuugaccaugacaaugugccagauauugaugacaucuguccugagaauuuugacaucagugaaaccgauuuccgacaauuccagaugauuccucuagaucccaaaggaaccucccaaaaugacccuaacuggguuguccgccaucagggcaaagaacuuguccagacuguaaacugugacccuggacuugcuguagguaaguagugagcuccuuagauccagguggggacacacugaaagggagcaaauauaaaaucuguccauuggaccuguggccuuccgccacucgggacaucugggaacauuguagagaaugcuguaaaagccauagucuuuaaucugacccuggccuugccuuccagguuaugaugaguuuaaugcuguggacuucagcgguaccuucuucaucaacaccgagagagaugaugacuacgcuggcuuuguuuucggcuaccaguccagcagccgcuucuacguugugauguggaaacaagucacccaguccuacugggacaccaaccccacaagggcucagggauacucaggccugucuguaaagguugugaacuccaccaccggcccuggcgagcaccugcggaaugcacuguggcacacaggaaacaccccuggccagguaagaagccucgucuagaagggagaguugccaggcccuuggggaguacaggagacagcacuucgaccaagguuccacuagggaaucuuagcagucaaguucucugcaucaccaaccaugguacaaaaccauuauggugugcuagaggggagugggcucugacaagagcuguccuuuaagugcacaggcagcuucagucacuucaaacaaaucccuccuuuccuuucccucucugagggaugccuugggggaaacuccacacuggcccucugcagauauagcucagcucagagccuuuucagcaguuucucguggaaugaaauucgagucuucagaggaggcuguguuucaacuuuuccugcuccuuuuccuucaggugcgcacccuguggcaugacccucgccacaucggcuggaaagauuucacugcauacagauggcgucucagccacaggccaaagaccgguuauaucagguaagacugcaggaauucaauuucacuguagucacaccgaauaggcucgaaggauaagacugagaaguggcagucucaugagugagauuuuuuuucuucugugcagaguggugauguaugaaggaaagaaaaucauggcugacucgggacccaucuaugacaaaaccuacgccggcgguagacuaggccuguucgucuucucucaggaaaugguguucuucucagacaugaaauacgagugucgagguaggagagacacuguggugcacaguuaaggugucuacagauuuauaagguugacagugauaggagggucugauuuaaagguuggggaggggguuccgguuugguuuuuguuauuuuucuuuugaggauacaauaccaaacaagaaauccuguuuaugcaauccugaaucuguaccaggacaauuagcuugcccagcagucucugaacuccuccugccuuggucagagguggacaguaagcaaguagcuaugaacauuagcccucacggcaacaccuugaagcucuauucauuucucucuugcgcacuuggccugugguuuuauucauacaucacggcaccagcuguccuccuugagaccaagagcaguagcaagaguguuaauguucacuaacagccuuggcuuucuugccuccauuuucuucacgggauggcuuacacucugagaucggaccuaccgcagaguaacugcucaguacauauuuacugagucagaugucugcaagcacaaaggcauuggguauuaagaucagagacacagagaauagagucucaccaacacgguugccuaaacaugaccugaacaaaggugacauuaguagacuugcuaguguggauucgggggaggggagacaaagaggauuccugaucugucccugucagagacaguaaucccugagccgcuagccugaugauuacuucuagggugaccucaagcucgcugauucgauuucauuuaugugcaucuuuguuuauuuaacagauuccuaaucaucagcugccaaucauaaccagcgcuggcaaugcaccuucuaaaaacaagggcuagagaaaccccccaccccugccgggaucgccuuuccucgccuuccuugccucucuucuugcauaguguggacuuguaaagccugagaccugccucaagaaaaugcaguuuucaaacccagagucagcacucggccuuuaacgaaugagaaugcaucuuccaagaccaugaagaguuccuuggguuugcuuuugggaaagccaaagcgccuauuuacuucccacuaggaaggugcccgcuccacucugccuuacucacagagccagaacuucuucgaggccaccucugagcagcacacacagaagcauuuucaggcaugucaaagaaaggaaaaaaugacucacuagaacucaccgccaaacaaccucugacauagguccugagauguggggaggcaggagccaaagcucuagggagggcauguacccaagagaugacuguaugaaaauguggaggagcuguucgguacuaaaucauuuucaggggacagacagacuugcugcauuucugcaugcugcuggugagagcugauugacccaaucuuccacacaggcacuugagcaagcagggaagggagggagaucauagcuucuggacuuucucccuuugggcacuucucaccugcaguggccaggguaggggucagaagugugggccaugcuggcugcccuugacuggucacgcugaaacuguuagcuuauucugcauguacaacaugcauauguauaaggacagcuagagaaccuuaccgucucagugagcucuagcugccuccgcaggaggggcagugcgccuuuacuuuaugguuagaaaggcacaaaauuucuaucaaccuaacuaaaacauuccuuuucuuucuuucuuucuuucuuucuuucuuccuuuuucucucaguuaccauggauuuuuccaaaucucuuuugguuuuuguuuaacaaaugcuuuaacaauguaauauauuuauuuuguuccccuauucuggaggguucgucggaaggauuguuacugaaacaggaagcgugggacuaucugaaucaucuucguagugagucuuuaugacuguaagauuguaaauacagauuauuuauuaacccuguucuaccuggaauuagacugcauauagcaaauguuugcaagcagguagcugaggcggaucagcaaaucucuccaaaaccaguguguggaaaggcagcagaggcagcugcuuuucaucuggggcucacagugaaugauuuggacuccuuuggcuuccccuuuguuuucucuguaguuucaaguggaauuagguggcggccgcuugcauucacuccuccuuguaauggaagccaggaguacucuaaggcccacaccaccccuugugccuauuuccagggagaagaaagaaaacacaaucaccuuuucuuuauuucauuuuuuccccaaaagagacaaagguggaacuucuauacaaauauuaccucauuuguugugugacugaguaaagaauuuuggauuaagaagaaagaguuuaagugucaauaaacuuaaaacuacuguugugucuaaaaagucgguguuguacauagcauaaaaauccuuugccgaggaugaucccaagaaagaaacagcuuuguaauguuaaguacaacuucucaaaguucugguuuuguucuaucaucuuuuacaccguugcuuuuauuuuuauaaauuauuuucucguugccauuggaauagagaucucagacuauguagauaugcuauuuaaauaauuuaucaggaaauacugccuguagaguuaguauuucugguuuuuauauguugcacacugaauugaagaaauguugguuuuucuuguuucguuuuaguuuguuucuuugguuuuguuuuuguuuuugcuuuuuacuucccaguuuugacucuuugccaauacccuuuuuccuaggaacgugcuuuuuuuuuuauuuuguacacauuuuuauccauuuuacauucuaaagcaguguaacuuguauauuacuguuucuuauguacaaggaacaacaauaaaucauauggaaguuuauauuuauacu

SEQ ID NO: 998 - RNA, 17115 nt, Mus musculus
aguauaaauauaaacuuccauaugauuuauuguuguuccuuguacauaagaaacaguaauauacaaguuacacugcuuuagaauguaaaauggauaaaaauguguacaaaauaaaaaaaaaagcacguuccuaggaaaaaggguauuggcaaagagucaaaacugggaaguaaaaagcaaaaacaaaaacaaaaccaaagaaacaaacuaaaacgaaacaagaaaaaccaacauuucuucaauucagugugcaacauauaaaaaccagaaauacuaacucuacaggcaguauuuccugauaaauuauuuaaauagcauaucuacauagucugagaucucuauuccaauggcaacgagaaaauaauuuauaaaaauaaaagcaacgguguaaaagaugauagaacaaaaccagaacuuugagaaguuguacuuaacauuacaaagcuguuucuuucuugggaucauccucggcaaaggauuuuuaugcuauguacaacaccgacuuuuuagacacaacaguaguuuuaaguuuauugacacuuaaacucuuucuucuuaauccaaaauucuuuacucagucacacaacaaaugagguaauauuuguauagaaguuccaccuuugucucuuuuggggaaaaaaugaaauaaagaaaaggugauuguguuuucuuucuucucccuggaaauaggcacaagggguggugugggccuuagaguacuccuggcuuccauuacaaggaggagugaaugcaagcggccgccaccuaauuccacuugaaacuacagagaaaacaaaggggaagccaaaggaguccaaaucauucacugugagccccagaugaaaagcagcugccucugcugccuuuccacacacugguuuuggagagauuugcugauccgccucagcuaccugcuugcaaacauuugcuauaugcagucuaauuccagguagaacaggguuaauaaauaaucuguauuuacaaucuuacagucauaaagacucacuacgaagaugauucagauagucccacgcuuccuguuucaguaacaauccuuccgacgaacccuccagaauaggggaacaaaauaaauauauuacauuguuaaagcauuuguuaaacaaaaaccaaaagagauuuggaaaaauccaugguaacugagagaaaaaggaagaaagaaagaaagaaagaaagaaagaaaaggaauguuuuaguuagguugauagaaauuuugugccuuucuaaccauaaaguaaaggcgcacugccccuccugcggaggcagcuagagcucacugagacgguaagguucucuagcuguccuuauacauaugcauguuguacaugcagaauaagcuaacaguuucagcgugaccagucaagggcagccagcauggcccacacuucugaccccuacccuggccacugcaggugagaagugcccaaagggagaaaguccagaagcuaugaucucccucccuucccugcuugcucaagugccuguguggaagauugggucaaucagcucucaccagcagcaugcagaaaugcagcaagucugucuguccccugaaaaugauuuaguaccgaacagcuccuccacauuuucauacagucaucucuuggguacaugcccucccuagagcuuuggcuccugccuccccacaucucaggaccuaugucagagguuguuuggcggugaguucuagugagucauuuuuuccuuucuuugacaugccugaaaaugcuucugugugugcugcucagagguggccucgaagaaguucuggcucugugaguaaggcagaguggagcgggcaccuuccuagugggaaguaaauaggcgcuuuggcuuucccaaaagcaaacccaaggaacucuucauggucuuggaagaugcauucucauucguuaaaggccgagugcugacucuggguuugaaaacugcauuuucuugaggcaggucucaggcuuuacaaguccacacuaugcaagaagagaggcaaggaaggcgaggaaaggcgaucccggcaggggugggggguuucucuagcccuuguuuuuagaaggugcauugccagcgcugguuaugauuggcagcugaugauuaggaaucuguuaaauaaacaaagaugcacauaaaugaaaucgaaucagcgagcuugaggucacccuagaaguaaucaucaggcuagcggcucagggauuacugucucugacagggacagaucaggaauccucuuugucuccccucccccgaauccacacuagcaagucuacuaaugucaccuuuguucaggucauguuuaggcaaccguguuggugagacucuauucucugugucucugaucuuaauacccaaugccuuugugcuugcagacaucugacucaguaaauauguacugagcaguuacucugcgguagguccgaucucagaguguaagccaucccgugaagaaaauggaggcaagaaagccaaggcuguuagugaacauuaacacucuugcuacugcucuuggucucaaggaggacagcuggugccgugauguaugaauaaaaccacaggccaagugcgcaagagagaaaugaauagagcuucaagguguugccgugagggcuaauguucauagcuacuugcuuacuguccaccucugaccaaggcaggaggaguucagagacugcugggcaagcuaauuguccugguacagauucaggauugcauaaacaggauuucuuguuugguauuguauccucaaaagaaaaauaacaaaaaccaaaccggaacccccuccccaaccuuuaaaucagacccuccuaucacugucaaccuuauaaaucuguagacaccuuaacugugcaccacagugucucuccuaccucgacacucguauuucaugucugagaagaacaccauuuccugagagaagacgaacaggccuagucuaccgccggcguagguuuugucauagaugggucccgagucagccaugauuuucuuuccuucauacaucaccacucugcacagaagaaaaaaaaucucacucaugagacugccacuucucagucuuauccuucgagccuauucggugugacuacagugaaauugaauuccugcagucuuaccugauauaaccggucuuuggccuguggcugagacgccaucuguaugcagugaaaucuuuccagccgauguggcgagggucaugccacagggugcgcaccugaaggaaaaggagcaggaaaaguugaaacacagccuccucugaagacucgaauuucauuccacgagaaacugcugaaaaggcucugagcugagcuauaucugcagagggccaguguggaguuucccccaaggcaucccucagagagggaaaggaaaggagggauuuguuugaagugacugaagcugccugugcacuuaaaggacagcucuugucagagcccacuccccucuagcacaccauaaugguuuuguaccaugguuggugaugcagagaacuugacugcuaagauucccuaguggaaccuuggucgaagugcugucuccuguacuccccaagggccuggcaacucucccuucuagacgaggcuucuuaccuggccagggguguuuccugugugccacagugcauuccgcaggugcucgccagggccggugguggaguucacaaccuuuacagacaggccugaguaucccugagcccuugugggguuggugucccaguaggacugggugacuuguuuccacaucacaacguagaagcggcugcuggacugguagccgaaaacaaagccagcguagucaucaucucucucgguguugaugaagaagguaccgcugaaguccacagcauuaaacucaucauaaccuggaaggcaaggccagggucagauuaaagacuauggcuuuuacagcauucucuacaauguucccagaugucccgaguggcggaaggccacagguccaauggacagauuuuauauuugcucccuuucaguguguccccaccuggaucuaaggagcucacuacuuaccuacagcaaguccagggucacaguuuacagucuggacaaguucuuugcccugauggcggacaacccaguuagggucauuuugggagguuccuuugggaucuagaggaaucaucuggaauugucggaaaucgguuucacugaugucaaaauucucaggacagaugucaucaauaucuggcacauugucauggucaaagucgucuuugcaggcgucaccucggccaucaccuaaggucaaaggucaaagaaagcaaguguucagugaaauucugaacugcuaugaugagugggucacuauuuaacaucuugucaaaaauuuguguuuuguuacucugaccucuuggauacccuguuuuuauuccuuucaucuagacagccaagaugucaguuaugccagcuaggaguggccacagugacucaccaucagaguccuucuggucaggauugggcaccagccugcaguugucucugucaucagggaugccgucauugucaucgucauggucacaggcaucuccuuugccaucuuuaucauggucggccugguuggcauuaggcacauagggacaguuguccagauuguucugauggccauccucaucgauguccugauuguugucacaaguguccccuaugaggucugagucagaguccagcuggaagagagacaucaacagugggugaaucaaauacaggucaacuucuacuccaggccucgaauccuggcaguggucagugcgacuggcugcauaauguguaagagacauuuuuuuaaaaaguauuuagcuuucuacauuuaucccauaaagauuuuaucuuuuggcucagauaaagucaaacuagaauuuuuucaaaauagauuuucccagagggcuuagcauucagugcgugugagaugcuuugggacgguuuaucuaaaauuugaauguuuucuuuccagcauuuaugcucuuugcuuuggagauuuuguaugcuauugaaauuugcuuauaaaaguuauucuaaucugaggaauccaaacucauucugugaggucaaaugcuaucgaagaugucuaaugucuaaugucuaaugucuaaugacccaaacccaaagcagaagaucucaguacugugugaccugaagcuaauacugacuagcccucaugguucccugugacaguggcuugaagucaaauugcuuuuagcaugguacgacuccauaaggguaaguauuaggaguaacuugaauucucauuucucucauccuuagaaaaacaaucuauccaaauuucugaacacuaagucacucagaaccaucguuuuagacaaaagagaaauugauuuacuuuauuccuagaaaacaaugcugcacaacaacacagagggaagcucucugguaccagaagccuggcuauuaauagcuguuugcagcucaggcugagaagaaaaugaagcuggguccguuggggggaauaggagaaaccagaauucucuccagcucugaguauuuuagcuuccuaauuguuuacuagacucuguucccagccaucacacagguguuuguuuugcuucugcacucugcucuccucucaguuuuacaugcaucggauacaacuauagaacuaucagcuucagcucucuguuuuguguaauuugucuuaauggugguugcaaacaaaacugaggucccaagauuuccauaauagucucugagaguguuugccagaggcuuauaucaggcagacucuguacaggcacacauugcaaauggcucugggguaccccaguaaugggagggcuuggagucuauugaauucacuaucuuaaaggcuuagaaagggagacacaauaccucaccaagagauucugaaagaaguucaccuaccuggucuggauuguguuccagggggcaguugucacacugaucuccaaccccauccauguccgugucccucugguccacguuguaaacguacuggcaguugucucguucauugaggauuccuauggaggagguguacaugaguccuacagccccauauauuuuaacucagucacacguuaauagccacucaguaagcugugcugucucugucccuucagccugccaguccaggggccuuaccaucuccaucgauguccacagcacaggcaucgcccuccccguuuuugucugugucugcuuggucaggguugugguuguaggggcaguugucacagcggucucccacaucaucucugucauagucauacugggcuggguuguaauggaauggacaguuguccugcaaagagggaaaauggacucucuauggugcugccuaggaaaucagcugaugccuucaaccccauucacaguauuaaaagcccucaaagaucuacugcaguuaucuaguacuugguccauauacugacugaguauucagcauaagugaaauucccagccaggaagacacuauggaugaagacuggauaguauauaauccaguauauaaucacaccaccccuguuuucauuauaaaaauauacucaucuagacauuguaucuguggaacagaauaccacaugugcaaacugggguagucugugaugaaaaaugaaacucacucuaauaauucuagcaacaucuguguccucaaaucacugagacauagugacaaguuucuaaguauccucuauaugaguuuggucuauguuuuugcuaucacucugugaucccuugaauccuaguguuucagguugucaucacaccacgaggaugaaggaggaauggagagcauauuuucccuacccugucaucggggaucuugucguugucaucgucaucaucgcaggcaucgccaaucccguccuugucauagucuuccugccccgaguugggaagguuggggcaguuguccuaaaaagaaggcgacacaguuagcauucgcuuguuuggcgcacacugggggccacagugggauagccugcuaggaugcucagguguagacaugauuuuaaugggaaggugaagccauggaagcuauuuugggagguuacuuaugugcaguuuguacaaaugcucugggcuucauauaugcuguaccuuuuugcagugguagguugcguuggccacacacaccagguuuucauuaggccagccguccaggucuguguccucuccgcagaugaugccauugccugcauagccgggcuugcacucacagcgguacauggggucacuguagugacccagguaguugcacuuagcguucuuguugcagucaugcgucccguccgugcagggguuucgcgguuugcacaccugaggguacaguaucccgaugcuaucacagaaugucuaaaagucccaagccaccaaagguccagauuccucccauccugaaacagauagcagccccauuugggagaaagauggguuucuucugucucuccauucuauuugaggauaucccagcuauuggcaaaugcugauuuacacuggauuuucuuggagcugcucaucuggcacaagccuaucugaucacagcuucuuucagcccagaauauucacacaucugagacuaugcaaccagugcccucucugucuguucauuguuugaccaaaggcagcucucuucuacucuggccuacuugucuacuauaccuguuuguuggccauggcauguucgacaccucggccgaagggcugugagccagugaaucguggugggcagggcaggcaguuguagccaggaucuguguucuugcaccgauguucuccguugugauugaagcaagcaucaggcacuucuuugcacuauggaggaaaugagaguuugcuuaacacuuggcaaauguuguuuuaaggaaggacccuggacuggguuagcugcuuucuucauucugauaacuuggagccauuggcugccuaccucaucgacgucuuugcacuggaugccauuuccacuguagccaggaggacacgcaccacauuuccagcuaccaucaggguagcuaguacacuuggcaccagcaaagcagggauuggacaggcauccaucugaggagagguaagagacagguggguaagugcuugggucuaaguugcugucacugccauguacuacuuaaaagagaauaagacacugaagggucucuguuacuggaaaugguugccuugcaucuuacuguaaucaaaccacuagggccaauuaaauauggcacccucccccuccccgcacccagugaauacugacuaugacauucauaaaagagaaagcucccagggugguggugucccuggccucgcagcuuaccaauugggcaguccugcuuguugcaaacuugauuuucugucacaucgccaacacagucuuugccuccaaacuggggugugggguuguuacagagucggcugcgucucugcacuccuccuccacaggugacagagcagaugucccauggugaccagggaccccagccuccauuaacuguaagcaaaugagucacauguaaaaauucaguuuucgggugccuuaucugucccagaauccuguccugagccgguuucaaaugcccucuaaccuggcccaugagaagaaucuuugggaauuagggagguugaaaugguuugcuuucuguuuuucauuaaaagaagcugcugagcaggcaggacuugguuucuguuuguuucucuagagagugagcucccaugcuccauggucuacuuagcugcagagagcaggccaccagcuggguagagcugccucccauguauccccaggucaggcccacacuuacuugggcaggcgucuuucuugcaggcuuuggucucccgggcuucaccuucacagggcuucccguucaucugggggcugggggaguugcagagccggauccuugugaucacaccgucaccacaggucacagaacaggacgaccauggagaccagugacuccagccaccauccuguuuaacugaagggcaaaguugauugucaccaaugggugcugccuuggagggggccacacagcaagucucagcaggcaaucauuccagcagcccaccaaaagcagcuucaacuaguguauuguagaaacuggcuacugccacacuucaguggagaaacuauagggaagaugguauuugucugugugugugaguugcugucaacaaccuaauauuuauagguugcuggucaggagcccagauccauucugauuguuucauaugaauuaucuagagaaaauggcuaaaguaacuuuaucaggaaugguuauuguucucucguuacagaugaggaggagccucagggaaggaaggucaagcccaggagugcaaagguuagaggugugauugagacugagagcccgcaggcucagaaccugcauucucaggcuccccgcucgcuccggagcugcucuuugugagggaagcacugggcaagggagauugccacccuuggcagccaugaugcuuacaucuuuugucacacuccugaauguggcagguccuugucuguaccgaagagcccucgcaucuguuguugaggcugucacaggaacgaccacguugcugaauuccauugccacauguggcagagcaggagguccacucagaccagggagaccagccaucgucagcagagucgcuggcuguggggagaaaugaggucguuagcaucucaugucuaagauaaacuguucuuaggcaguuuauuuacuuauaugcuuauggcccuuuauagccagaggugguaaagcaauagguuucuuuuuuuaaaaaaagccuucuuuuuucauacucuuaguuuaauggaagcaugauuaacaacuagagauuguguacauuuauguacucuccagacgcuuggcuauccaagagucuugggaacugauaaugauaauggagccaauucacacaucucuccuuucacaggcacaagcaaauccuaagcaacuacagugccaguguguccugcaugagaucucccuggccugaguagcacaagucuugggccagugguccaggaguucaucccaggucaucauaugcaaaggacugggcugauggcccacucugccugguccucacagcugagccagcucacagugugcacucuccuguucacccauuauggauucuuccaugugcaccucaagcaaguuccccuuuccugacuuaggaugucuuagauguuuccaggcuggugcccaaggaugccaguguguuaggcagcuucucugcaucacuucugacuaucagugaagcccugguccauguugggaggcaguuugccuggggcucugccucugccucagucacgagguggaucaguuuguuuuccucgugcuggccucugguguuuuuguacacacuuucucaagaggagaagguguuuguuugcuaucugcucagacaccgugacgacaaucacgccugucuaucaggggacacggaacuuguuuuuguuuuugccauccaugaacauauuucuaacaaccccuagcucaaacucagagcuccgcuagcucucggcaggcuuuguucccuguaacucacccucagauagagguuggacagaaguggauauacagaaaaacauuauuaugccaaaauugcuaccaugggaugggugauucugagucguggcucaugugugcagcucugugugugugagugaagggcaauucaguaucccugauuucuuugugaggcauggugagucacuuuuaugacuugugccuucugcauaaaauaucuccuuagcaaagugauuauacuggcaacaggccccugaggcagaguguuacacagcaguauaguggcugauuucuuuuacugcccuggaaauugaacagaugcuaagcccuuaggccuccucucacugcagauaaaacagguggcuuuucaagccucagcccaaugcuuacacaguuucuguccguucuccaguagaucauuuuuuucaacaaagaucaauugcuaaaagcaaccagcuuaagucuacugcuguauccaucucucuccuuauagcauaaaaccagaauccauaagcucuguaagaucauccauugccuaugccauaacccagaucugacuggaacgucugauggagcugggaggggcugggcucugguguugugcccagcugucaggaugcccccagacugagcuagccacugagggauggcuacaccauuuuaggaacuuacgccagcaccgugggcagcauucaccaucaggaacuguggcguuggagcagggcaugaugggacaggacaccuuuuugcagaugguaaccgaguucugcaaggcaagagaaggagagggaacgauguuaccaagcguauugcagagaggagcuuucugugacauugccauuauaagccaggacacaggagggguggcuuuuauaggagggaugucucugcuggaucuguaguccccagagguauacaguuccagggcuaauucucacuccauucuuugggaaaguucuuuuuaacugcuacucagucagggguggaaguuacagaacaacacauuugcauaagggaaagcaacggacguugcagguaucaguaagcaucucaaagguagauaaggguuuuuaucacauauuagagggaggcgggaacuuaauugaaguugugucucaaauucaguaaccagugauuugcauuuaaacuuuucccggugagccagagauccgaacaguguuagaagaaucugucugccagagcugaauacaaauuagggcuggccaaaaccgaaugcuuuaagcggguuuuauguaucugacacucaauacuuggucuuugaacuaaagcagguaagucauuccaacguuuagauagauuuguucucuuagcugcucagccugggguauuauuaagauaaaccuucugagauuuaaagaggaauuugcagaugucauuacauauuaaagaaaaaaaaaucacuuugguagcaggccagagcacauuuaaaaauguguguagucauuuacguaucucccgagacauaugucuccaagucuuauugcagucugugagugucucuuaccuggcagugacacucugugcaacugucuacaguccacuccucguuguucuuguacuggacuccauugugaaagcagaggggaggccgcuucagcucacugaccagcucucuguucucuuccgucugaaaggggagaaggcucaugaguguccaggcucccaugggaccaccuguggugauuuccaagagcuggcaaaugggaggggaagccacugaccacuuuucggaugcuguccugcagaguggucacgauggugcgcaggcccuucaguuccaggaccaugcuggauaguucaucacaggagaggccacagauagcuuggagguccuuuguuuuguggccgauguaguuggugcggauagcagggcuggaaccguucaccacguuguugucaaggguaagaaggacguugguagcugcuaagaaauaagauguaacguauucgauagcugauucaagguuucaacagcugaucccaccagccuacccuucggguucuggguuauaaaagacauuuccuuuggaaugacagagugggugcgagccaacucugcucccccugagauauuguguaugcacccuacugcuuacauuaaucagggugcuuucgguggacuuccccagaauucuccaaaucuuaaaaaacacagggguacucacagcuggagcagccuuuguuccugagaaugucuucuggggugguuccaaagacaaaccucacauucugcagcacccccugugggcagaggacagacgugguuuaaugcugggcguggggguggggcggccagucugaguuugcuuguggugaacgcucagaaaguuuaaaagaacuuaagaucauccugccaaacuaucacagagacauaaauugccgaacaacuucaaaaucuuaauugugucuucugccaacuggagcauuuuacaaagaauccaguuuucaggcugcuugggguacacaggaaauggaauuugaucccaagucuggaggacaugauacucuccagugacaaagaguuaaugugggcguucaaagccacgcuuguaagaaaaaaaaauaucugaaaguuaaggcaaguaaggagucccagaggcacaugacuggacuguuauucaugucuugccuuagauccauacugaaagcacccagaacacccugcccagggacucaaauacugacaaaguauccuuuucaugcccuauuaaaacugcuagguacauuugauacaaguuacuuuccuaagggcacagggaguaccccauucugaaacaggcugaguguaauaggaaaaccauuucuuaucucuccugauagcuuugaaagcaugggucccagguccuggcaccauuacaacuuauuucuuauuaggaacaaaauuucucgggucccuaucaaaucugaaacccuggaguuuugggucaucuguaauaugauuuaaccaaccuucugggggugucuguuccucuuuacauuugagaaucauuuuuagucuaccgauauuaauuccacauagcccuugugacagguaagaagauuuaccugaaaauugucauugacaucucccuuugcaacucggagccuggcaacgcuggccagaucccuggugaagaugcucuggauggguacauccagcuccgcgcucuccaucuuaucacagucuauguagaguugagcccgguccucuugaacaaacagcgugaugcucuuccacuggccaguggccaggagagcuuccuccacugacaccacuuguugcuucccuggcaggcucaggcucagguccagggugccagcuuugccguuggagaccacacugaagaucuggccaguguugucuuuccguuccacagccaggagugugccccgggucuucuucaucugccucaaggaagccaggaagaugaagccuuugucggcccacacagcguccaguaggucuuggaacuugucauccggcacagcggggaucagguuggcauucucaaugcggaaggcggggcuggauagaucuuggcccuucaccagucggcgaccggggccccuucgugcaccuccaaugaguucaaagaugucaaacacaccguuaucucccccagacucuguaaggagagagaagacaaucggcuuucuaggcuagguauaaggggguaaaguucuggcugugaggagccaaggugggaacucgugacaauaauggcaauuauggaaagcugagcgagggaagcugcauccuuaucaggagauaaggacuccaaggaaacacaggagcuaucgagagagagagagagagagagagagagagagagagagagagagagagaggagaagggggaggaaaaugaauauaucacaaacucaccuggaaugcgguugcuuccacacauaugcaacaggaacaggacaccuaguccccgcaggagcuccaugguggagccuuugugcccaacacggagccuguagcaagaagcacaggaggccagagucagagaccaggaagcaagguggaagggcagagguguguguguguguguguguguguguguguguguguguguguguguguuucuucuuuugccccauaugugcugaaaaagaaggguuuacuuuccaaacgguauccaguauaaaaagagcgccagaggcagggggauuguuggaguuccaggauaaaggguauaaagugacuuggguccguccccucccccccgccccuuuagacaagauuacagaauguauuuuggauggcgacagucagggguaaccuggagacuacuggggagaaaaucuuggggugucuuggagguauaguuugugaacccgaaggcugaagagaaccagcuccggaaaguucuuuccaggggauagacggggcaggauaaaggaguuaggaaaaccagaaggggaagaguaggagaugaggaguagcgcugaucaucugcagccuggggcuuugagguggccggccaggugcuccgcagaggcgggagguuuaccugugugcaccggggcucaguaacccggagagguggcaaaggugaagugaaggacaaggacgcugaguccggugaagacgcugagacugccggugcgccgggagagaccguggcagaacuggauagcagcuucgcgauugccugcagaaguccgaugaggcuggcugacuccaggcaguggcuggcuugacugaggagcccaggaccuuuuaaagaggcaggaagcagggaggggggaggguucucgggggcgggggcgggggacggggacggacggguucauuucuccgcccccugcugcuuggcgcacagcucucgggcugaaagugaagggggagacuccgaucccgcacaggagcccuggaacuugucagaaaaauaggucuccgcccacgcagccuuggcguacucagccuuuagcgcuuaggaucuugcgccaugugaacuggagacguucugcaugagaguccccagacgcgaugcuucuuuggggaccaccuaagacccuuuagggaggcuuucauuaaagcacaucuccuugaauaauuccaugacagagacgcuuggggaucgagacagucugguuuaaaaauaaaagagggcaaaagguuggaccccuuaaaggaagcugccuccugagucaauccuggugggugggggaucccaugucaucuauacuuugcgcuucacuccugucccgcacgccugccuuccgucugacucacuaagggugucagcacgguguugcacagggccagcaggaccgugcacggaggucgccuuccgacucacuguccaagucgagaguuuuuuccccaguucuacuuugcuuccucagauggccgcuugggggcgguauauguauucugauuuaggggauccuuucggagaguuuuuagcggcauuuuaaggaagcgaauuuauaucccgcucccucaaggcaaaauugaaauugugucuugaaaaacaauuuugugcccacucguguuucuuaacgugacucccgauaggagaauuugcugaaccaucuggcuccaggaucuuacacuauuuacagaacggacccguagaguuauaaauuacucucuaccuauuauuuuauuucccaucuuucucccuaaacaguuuuuuuuucauuuuuucggcucccaaaaccgaggugugguuuacauuucuguggguauacacuuuuccaucaguagacugcugccugauccuuugucucugaagucuggucucaaugccaucgguccggagccaagaugacuccagcugccuggaauuccauucaucucuuugggaagggacgucagcggcggcgaugcuucuccagcuguggcccugcgugagcaggcuuggcucugaguccagggauccagguaaaagcaucaccaaauaaggaucuuggcagaaucagggcggggccggcugagggacagcuggggcucccuccccuuaucaguuacaccuggcuggacucccaaaccuuggaaacacccaggacuuuaugcucaucacacagcaauuucacuuuccuugugugggagggaguguucggugacaaggugugugagugugcgugguaugugugcguacacgcaaggaggggcuuacagaguguuuccuaguuacuccggguacacagcuacacagccagugccucuuguagauaaguacguucccaagauguguuuguuuauuagacuucagauacucagagccagcaguaaaaguuucuacugguugauuagucaaguuagauuccugcccuugaagucacaggcccugacucagccacugaaucugaagauucgggaucaucaggcaggcuugcucuucgcuuccaguuccuuccgcagguccucuuugcuuuguggaaggcgauugcuuuaaauauccugcucagcacuaauucuuccugcaggaaccuuugggacugcccugggagggcuggucuugagacccucuuuccucaugaguuuuguaccacagaggugaaugucagcggcccacagacaagagcuucucuccuuguguaaagccaccaacuucccu

SEQ ID NO: 999 - RNA, 86620 nt, Mus musculus
cccucaguucggucacggcgcgggcuggagcuccccuacccaccccagaaucaccgcuaccucgccuaggccgcugcgccugccccggccgccauggcugggggccgcggggccucuggacgcggccgggcugagccacaggagagcuauucgcagcgacaggaccacgagcugcaggcccuggaggccauuuacggcucggacuuccaggaucugcggccggaugcgcgcggacggguaggaacgugguuggucuggcccgguguucuccagucuaggaacccagccagacgccuccagucuggggcgaccacuuagauccuaaaggcuuuucauauugcaguuccacuacccucacuuucugccucugcgccgccacuggucuugagaaggcagcaccuggccugaauucucuuuuuuccccggucgggcuccucucucugcugugcuucuuauucccacugacguccccuaaccacccuucguccuuccaaccauucuuccccacacugacucgccccaggccucgagguggguugugacugcacauucauagucacucauugcuacuuugugcuggggaugcuuagggggcguggguccaggucuugugcucucagcaaacaaacucccaggucacacuguguaaaucccguuuccuguguggaagaacuuuuuguaccuuccuccgagacuuuugaggaauagguauagaacauguuuauugucgcuguaaugcaguguuuaccgaguucuauuuaaaacaucacuuuccuuuuuuguguggaaguuaagcugagggcagugacagucucucccuauccuugaauaguguaucugccgaacuaaaauguuccugaaguuugaaaguacuucuuuccuccaucugccuuacuucuuuaacucacaaugucugucuuuucucuauaucuaguauuucuuuaggaaaaggcuuuacuuaagcugucagggccaagauucucccacuaaaccaauauacuuuuuaauuuaaugauuuagacgcuaggaacacagucauggguaaaacaugcacaaaaccccugcugccggcgggaagcuuacuuuuuuaggccuuauuuguaacuuuacauacaguuauacaugcuucuuguaaauaguaagauaaccuacaggucaucuggcaacuucucuguuuccagggaaccaggaaguagggccuaggccaccagaauaguguuacagaaugugcaggggacucagggagacccagcuggcuuuuuuuuuuuuuuuuuuuuuuuuuaguuuuuuuaguuuuauguucccaaggugcaggaaaauggaaggaaaaccaucagccacuuuuagguaaugauacugauaauccuaagaauuuacagcugaucccaguuagcccaggaauuuacagcucacgguggccuuuauaaccaagaagacuuaacccagagauaguguaaaaggcagguagaguuauucaguaguagacucuggcucuggaucacaagcaauaucaccaacacuuucuuucauaggccuuucaggcaaauaauugaugcucagucugaugagucagagguuacgcuuugaacaagcucucauuagcacccgcuacuugccuuucuucagggaaagguuauucggugccacuauccugaaucuagaacccuugaggccuaguaguuuucagaauacagaaguguucuuacacauaauccgggguguauguuccuccuccuuccaugccuguggggguguguucacaauguaaacgcaaugaaauaaauguaugaauaugcaaaugucagccugaacacagugaggacaaugaccucuucucauuucaggucaaguuuacugccaguaaacucagaucacuuuuuuuuaacuuuugggggauaugucauggauuaaaugucaguuuugaaacauuucauucauggauagucaaacaguucagaguguauaucaaaaauuaauuuacacauuuaaaaguuuggguaucaaucauuuaagauauaguuuacaauucaaggacauuuaaaaaauacuacuuauuuaucuugucuagcuuuccguaucagcagagggucugcuuccucccuugggaggcauugcaaacccucccuccuuccuucugucucuggguccacugguuguuuaugagugcacuuaucucuuuagccuuugucaacauugcaugcuccguccuuucauuuugacaguaaaugaaugaaagcugucccaucuaauuuguauuucauugguuagaaaccauguucaugguuuuucuuuuucucugaacuguuuuuuguuuguuuguuuguuuguuggguuuuuuguuuugguuugguuugguuuuuugguuuuucgagacagggcuucucuguauagcccuggcuguccuggaacucacucuguagaccaggcuggccucgaacucagaaauucgccugccucugccucccgagugcugggauuaaaggcaagcaucaccacugcccagcucugaacuguucuuauucauugauuuauuuuucucuucuaaggucuauuuucuuacucaaugguaaaaauguagauguauguuagggaaauuuuauuugugguaacaugaaacaaaaauuuucuccuaaauuaaucauagacauauuuauguaauuuaugcaguuaaaaauuuuuaacagaaucaaaaugaacuacuuguuuucugaaccacauggcuauuuuaucucccucuuccccaucuacaaagcacuuccccaucugagggcgggugcucgccuagcacauccuagguuugauuucucagcacuaagaaacaaaaguggggggaggaaagacccucccccuguucccguguuaccauaaaaaaaauagaaggaagaaagaaagaaaagaaagaggauaaaucgucagauguuuuguuuaguuauuuaaauuauuuaacuauuucaugacacacacgagcaccaccugacucuaacuacugaguguugggacuaaaggcgugugccaccacacccagagacuucauguuuuuaaagcuuccaucaaauaaauguagaaauaucuuuuucaagagggucuagaucauguucuccgggugcuguccauucucacagucugagaaacacgugaaguuuccacuucugcugccaaucugaagugcugccucuacacacacacacacacacacacacacacacacacacacacacacacacagguugcuaacccuuccauuucagugcuugguauaaagcuuuccaaaguugauauuagcaauucccaaauguauuugcaucuauuccuugccaccaucucuuuaauuuucaaugcuguuauaacauuguuuuaaacuauuauaaauucuuaacaguccucgguguuuaacauuguugccauucacuguaccgaauuuuccuguuucagugugaauguuuaaauggccuugccugauaccuucuucuuucacuuucugcugcuauaacaugcuacuacaaauuggaaacuuuauaaaccaaaaacaaagcacaauuuauuucuuacaguccuagagccuagaaagucuaaaaucaaggggcuauaccuugugaggaccuugcugaucauaaauagcagaaggcauggcaugccaaaggaggguauuccugugugcuuguguaucucuuugucaucuuauaaagucacugaucucaugauuauggccccucuucuaaauaucagacuauauuaggaucgauuaguuuucuaauacuuuugagggacacauugaaacuauaguaccugguccaauccuguucgaauuuuuauuaaaacaaauucugaauguugugauguuuguucaaaauggagcugaaggucauauuaaauuuuaaagaaucuaauguuuguuuguuuguuuguuuuaauuugaugagcaaauguuugagaaaagauaaacuuggucauuauaaacaaaguauucaguuuuagagauggaggaaugagggaaauaaauauuuaaggcauuucauauaaaucuagaggaauguuaucuaauuccauuuucugagcacuugccauuaguaucuuucuggcuauuacuguguucauuuuuuuuccugauaugaugugugugugugugcuuacacacgcacgugcaugcaugugugcacgugugcauacuuacaguguaccgcaauauguguugaguccagaaaaggauaucagguaucuuucucuguugcuuuccacuuguagucuuuuguuuguuuguuuguuuguuuguuuuguuuuguuuuuaaucgagacaggaucucucacuguaccuuaagcucaccauuugacuaggcugccuccacuuaucucugcccuccaaagcuuugauuauuggcacacauaggcauguggauacguauggguuuucuguggauccugggaauucacucagggcuuccugauaauacaggaggcccaccuagccauucuuccaguccauugucuccguuuuuugguucuguacagauuuacaagcaggcugcccagauuaucucccuucccccauggcucuacccuggucucaaguaggcugcuuccaucugaaugcuauuuccaucuggaagagaaaaaaaaagaagcuaugcugauuaaaguuuaccuucaaaugcaaggaggacagauagcaggaaacuagguaacaauucuagacagauaccucaaacugguuaaagugugugccuuuuuuccuuaacaauuaugauagcuacauauguauacacaguaacuacugacucguaaguguacucagcaauuauucacacuggguuugauggacauuuauauaacaaauuaauuucccaaaccucauccucacuuuggugccuguuuuauaacccagugaagucuaaugaugggacugucuuuccauaccuuugagucuuggaaccugaagauuuucagcuucaugaaguuaaaauauucagcuuuuaaggauauugacccuuuccucuaguauguauaacaagcaaguguuuaggagacaaaggcaccugagagaagcuuuguuaagcagcucuuuuaaaaaguaaaaagauugggucuggagagaugguucagugguuaagagcacugacugcucuuccagagguccugaguucaauucccagcaaccacaugauggcuuauaaccaucuguaaugggaucugauacucuucuucuggugggucugaagacagcaacaguguacucacauacauaaauaaauacaucuuuaaaaaaaugaaagaaagaagauuuagcucagcacaguuguaaagcuuuuuuuuuuuugucagccaccuuuugcuuuggggucuguauuguuagucaagguucucuagaguaacagaauuuguagaaugauuaucuaucuaucuaucuaucuaucuaucuaucuaucaucuaucuacugucuaucuacacacagagaagagggguauuagaaugacuuaaaaacugugguccagcuagucccacuauggcugccuaugaauauaaaguccaagaagcccgaaguuguucaguccacacggcuggaugucucagcuguucuucaguacaugcuggaauccugaagaaguaggcucuaaugcuaaugaaggaauagacuugcuagccagggcuagagcaagcaggcaaagaaaaagagcaaguuuucuucuuccaugcccuuuauauaggcugccagccaaaggugugguacaguuagagguggaucuucccaccucaaagaucugaaugacuucucacuucuaaugguuuaauuagaaaaauaaucccucauaggugugcccagucauguaggcuuuaguuaaucccagaugcugucaaguugacaaccaagaauagccaucagagagccuuugucaaggcaguggcccauugugagauauguauguagcagaggaccuuucacuucauggucguacagaggaagagaagggcuguauauauaugaacccuggaaagugggaagggcuucuucuuagggugaacuuucaguuguugagguuuaagguucuuuguguccugaacauaccuuacaaaaagccauuuccugucuucuugagugaaaccuaggaaauauucuggucuaaucucugaaagaacucuucauugaguuauuucauuauuugaguucuacauuauuguuuuugacauuuuucuuucaguaaguugguggugguuaguauuaaauuagcuacacaugaagagaaccuaacagugauauuuauuacauaaaagccuggggcucaggagcucuuccuucuugcuaaggaugcucuguccuugaugugcccuuguacucuaacacuguuaucugaacuccagccuucguagcuuuauuccaaccuguuugaaaaaaaaaaaaaaaaagguguaaagaaacugcauaugaaguugggcacaaugguacaaacacauaaugccaacccucagaagggugagacagaaggaucuugaguucagggcuagccugggcuauauaccaaaucccagacaacagcagaaacuguuguauccuuuucuuuuguuuuuguuguuguuguuuguuuguuuguuccauuaacuuauuuauucacuuaacauccugauugaagccccaccucaccucccaguaccccccucacccagccccuccaccauaccuacccuuuuccucugagaagggggaggucccccucuggguaccaaccuucccugacgcaucaagucacuguaggacuggguacauccucucccacuaaggccagacaaauuuucucuuaagauaauuuucucuaaauuucacaugaucauucuuuaaaaauaaacaaaaccccaaaaaagacuuguggugcaggggacuaaaaucaggggacuaaaaucaugugccaaacaacagcuccaucacuagcccagcauaugacagaucucgauucucuuaauuuuccagaaauuaauucauuggcuaaaccuagcugcaaaguagccugggagauguacccaacuaaacuguccaguucuauugcuacaaaaguaaaggagagauggauaaugaggauaacuaauaggcuuuucugagaaauaccccaaagucuguaaucuguaggggaaauacuacaggagccauuaaauucugucagccaaaauaaggaccuuaaacauagccagccuguugcuucuguggccuguucuuccuucuuugggucacccucacuuggaacucacacuguggcaaguuguuaggcuucaucucagcuugggucauuccuaaguggcuguggucuguucuuacaucugaaccaccaucacucggcucuugggcucuggaaguggaaagcuuuaugccaggugucuccucacuucaagucauguucuauccugguuucuaaacauugguuuugguguuagcuacccuggcccuuucaucccucgugguucugugguguugccgcacuguggaguuaucuagacugugaccuaccuggggcucuguggcugcuccauccaaggaauauuuacuggauauguuuuauucagcccagaauucuacagaccauuaccguuccaugauccccagugguccugggagcuggcucucagaagccucuccucuaguuuucgagcaguccuuacauggauucauuuguacuucauuaagugcaaucgugucuuaguguuguauaguucuccagugaacuacugccuccuuaaguuugcuuccugcuucagugacuccaagcauuuagccauggccugcaagacccuuucccaaggagguuaguuacauccagauagacucauuuucugugugauagagauuggucugagcagcuagagccaggcucacuccaggagaccugauggccccaguguucuagggaaaguucugaaugugcagugcucuucuccaucucaguggucucuaucagcuuugccuucacugucggccugguuccagcguagucauucugaggaacucagaaaggucagcaugacuuuucacaaagcagacaagacaauccuuggcuuggccaucaucaacaagagugcccuggcugggaugcucuagccaugcaggcaugugcacucaagggauguugugugaagcaccuucagcaccacacaguccaaaaaaccuaaacaauucaagugaaagcucuuugaaggugauuuuauaacuggaaaguucauuuuguaagacuuagaaaaaugcauucuuagaauuguucauagugugggaucuacaguguuaacuauagauguuuuuuuuccauggguaauccaguauagaugccaaacccuucuccuuccuacucaguaagaggaccaaccacagguaugcugucuguaucagcuaauaagcauugauucagcacuugucagaaaacugacaggaaggaauguugaucugcuuucagagauaacuuagucuguauaccaucuuccugcuucagcaucccagaaacuaggauuagagccgugagccaugguucuuggcucucccuuugguauuaaaauaucugcccucggaggauagcucaguggagaaagcauugggccucgaacuugaggaccagaacuuggacuccacaggcauggugguugccugugaacccaauacuugagagacagagacagggucccuggggcaagcugucugguuagucuagauggaauuggcaagcuuugaguucaagaaacccugcuucaauaaaucuagggugaucaagaaagauacccugacaucaaccucagcaucucuaugaaaaugcacacaauguguuuucacucccccuuacacacacacaugcacccauacauacacaugaacccauacacacacaugcacccauacauacacauguacccauacauacacgugcacccauacacacacacgcaccugcucaucucacacauacuaaaaaaauucuguauuguaaaguacuauauauuagaagaaauaauuuuuaagauuuauuuauuuaaaaaaaaagauuuauuuauuguauguauaugaguacacuguagcugucaucagacacaccagaagagggcaucagaucccauuacagaugguugugagccaccaugugguugcugggaauugaacucaggaccucuggaagaacagugagugcucuuaacugcugagccaucucuccagccuccaagaaauaauuucuuaacagaauguuaauuggugauuguaaugucuuuucaaaguuuauguucagugagauaauaguuuauaaagaugugucuugauguagaaagcacagguaaaauuuugacuagcuuucucuccaugugucuaucucuaaaauggagccgaauaaucuucuaacuuugccagacucuugucagaaaauaaauaauaauauagguaaagagugauugauaggacuuagaauaagcuaggcagguaagaggaguaaccucagcuaaaagauuggcuguaaauugguaauuguagaaacuguaugguggguacaagguucuauccuaucauuaucucuacuuaccuuugacauuuucccuaauuaaaaacuucaaaaagaaagagaggcuauuuggggcucagccaaaggaccugcacuucccagcccaggacugccuguaacuacagcuccaaggggguccaacaccuuccuuuggcuucuuuaguaccugcccacagguggcauacauucacauaaacacacacauaacacagcuaauuuuugaaguaaugaugagaacuccuugaaauguagcuguguaagaagaauggucacauauccucagaagcaucagauagccacuuucucccuaucaacaaaauaacuccugugccaauucucuuggcaucuuaagccacaaugcuguccugcugugguggagagugguucugccccacccucugggcuccucuaaggaaaccccagccucuccuccucacugucucuccuuuuugacucccuggaugcugaccuucccagcugccuugcuggauccaggauccgcacuacgccagacugcucuuccggcuguucccaccagcacccucaugggcuuuaguaucuuuccuaucuuuaaaaucaaaacaccaccaacaacaaaaucucucccuugaguucauaucauccccccucucucaaucacucccagcccacccaccucugccguguucccuguccccauucacauucagccuugaaggagcugucuggguuugcaguguccacuuguucaccuagcugucacuccucaacauacucucuuguguuugaugcccauaacacugauggucaagaucacuaccuguggccuccauggccccagccauaaaaucugcucucaucuuucacuaccugagggaucaacgggcacaagacccuuccucuccuuuguguccuucauugccugaucucucuuagcuugaucucaaauucauuuucucuucccccucccacacucccuccuucuguggauguccaacauuggcuuaaucguuauaaugauuuucuuguucguuugaaauuuacagugcugggaauauaacccagacccuuauacaugcaaggcaaacacucuaccacugagcuacauccccagcccuguucguuuuuauuucugccuucagucuuccccauucauuccuuauucaacagccagaguguuuuuuuuaaaaguguauauuguaucuuaucauugcccaucuuuaaauccugccgaguuuguugucuggcugaccuuucucaguacaccugcuuuccuugaucgcccuucacacauaugccccaggcccacuggccuccuuuuggccuuugggggcacccaucucugcucaggaucagcuuaucugccuaaaccuuccccagugaccacaucugagcauguucccucaugccucaaacacauuaaaugaucaaagugcucauguaagaguccuguagaggcaggagcuagcuucuuguaagaaguacuaacaaaaaauugcccauugagacaacuguaagccgcucauaaauauuuuuggugagaucaggcugggccaauucuguucagauuucaaucuaaauacaggaugaaaacauccaaugucuaaaauaugaauucuaaaguacuccccaaagaaaguuuuaaaaaucuacaacuauuucaaaaucuaaaaccucuacaauaugaaacacgccccaggcauuucaggcagguaugguugaccuguguccccugcucaugaggucuuuuuaccguaccuguucaggucacucagcccugcuuccuuugcggcucuccccguccuuugccucugaucaucugcccucuagucuguauguguuugauggggccaggucugucuagauucaccucccgccuccaggccagcaccuagcacauaguuaaccaguaacuucuaaggaguggaagcccaguggguguuuuucuucaauccuuugauaccuuugacaggaaaauguauuuuuuucugacauuuucacuuuuaaaccaugcuuuuggaaacaugacagaauacuucuguaaaccauaaguacuuucaaaacuugggaauagaacuuuucaacuaaggugaucauuaucauucucauuaagauuguuucuccaggggauagagaagguggugcagugcuugugagcacugucuuuucuuccagaggcucggaguuugauucgaagcucacagcugucuguaacuccaguuccaggggaucugaugccuucuucugccuccacaggcaccaagcacacauguagugcacagagauagaugaaggcagaacacccauacacauaaaauaauaauugguccuccaauuggcugggacggugucaagcagcuguaacuuaguguacagggacagguggggagaaggaaaaacccuacgagauguguucuuuuucucuuuuaggugagagagccuccugaaaucaacuuaguucuuuacccucagggccuagcuggugaagaaguauacgugcaaguggaacugaggguuaaaugcccaccuacauacccagaugugugaguaccuguauaagaagcuuccgugucauuucgcuuuucuguuuugacagcauaggaauauuacaguugggagcauuuccucuuuccuuccuuugucugccaauguaaaguuucauuucccaucaccuauaucucaguaacacuauauccgcccuagacuuuuugcaaagcagccuuuaagucugcauauagcuguagagugcucacuaccgaugcuaauauucacucauugaccggaugcuaguauuuacucauugaccaccuuuuugcuuuugcaacuuucaugcuuauuuaauucuuuguaaucuagagagaaggaaggucuauacauauaggauaaagauguggcgagcauuuaaagugcuuccuuuauagccauuggagaugagaugaccugaccugcccggccuuuuacugccuggaauaaagagaggaauggagcuacuguuuuucucaguggagcagcauaagucugaccaggugguacaggguuguccccugugcuccagggcuguccccagcccuucagaccuugaccauccgagccccuccccaccaauaccuugaguauucuccagugggagaggcaaccaaaacuacacauagauguaagcacucaagaagcugacaucaccacugggcaugaagcuagaacaaaagcaucuccaugaggacucagcgggcucuucuguaagcauccccaggaccuccgauuggcugggacagugucaggcaguucuagcuuaaugugcagggacaggugaggggucguggggaggguggcaaauggaaggaagugcuccuuuccucaguggguggggcaugaauggaggcuguggauuuaagaaaugucgaagaagaaucucaucgauucagucugagcuuccugaagucaguaacucccgugcuucuugagagagcgugcauagaugcuugugggagguugacucaugagaaauguaauuaaguuuaugaaauaaaauuaagccaguggcucucuggcuuuuguuuugugcuucauggugcgguauacauggugucuuugcugacacugcguuagugcagauggcuuaggucagggcucacuuucucaagaauguuauugcuuaaaugccagguacaagcccccaugcucucgacguauaaguugugguuguaaacaugagcauucucacaaccuccuuagauuagauaauuugcuagaaugacucacagaacucagaacaaguaauuuucugguuuguuguaaaggauuugaucuaaaauagcccaagaaggcugcauaggccagagcauaggaagggguauggaucugaguguccucuccaggccaccauccucagcucuuccacaugcuuggcagcucacaguacccuugagcccugcuguucagggggcugggcgagguuuugcucucuaggcaugacugagcaguaauuaaguccauguaauuaagcaguaauuaagaccaugggcgauugagcucagucucuagcaccuccuuccuccuuaggggacugggguaugguuggaauaucucaucccauggucaaggcuggagcuauccuagccaccuucauccucacacugugcuggcacccaagcaagcauuaacccuuccucauaaacucugcucuggcugaaaggguucgugaugaagaacauaauaugcucuccuaagcucugccacucaggaaauuccaagggcaguggggccuuugagccagaaacuguggccaaagaucacagguaacauauucuuuauugugccauagacucaagcacucaaauguuuguucuugaaaagucaacaugaaaagcccagauaugugcguacugaaauacuaauuauagcguaauuucugaaagcaaauagacuagagccaggcagcaggcccaugccuauagucccagaauuaagucagggagauugugagccugagaccacaaaggagagccuuugagcacaguuucuugccuuggagcuccuguuggguuaacaggagauguuuguuaguugagcucuucugugcaugauggaagguugagucacaauccugacuugccuguuaaaagcucguuccugggcugcgauaaccuagagucuguagaucuccauaaaugucaccugggaaacuaaaacuccccuggucgaaaagcuacuucaaagaacuaggcagacagauuauauguccauuugauacgaacauggaaugacuuggggcuggagagauggcucagugguuaagagcacugacugcucuuccgaaggucuugaguucaaaucccagcaaccacaugguggcucacaaccaucuguaacaaguccugaugcccucuucuggugugucugaagacuucuacaguguacuuacauauaauaaauaaauaaaucuuaaacauagaacaacauagaaaugcuuagaacuuagaaaguuuaaaaguaaucucaucaaccacacaaaacuaucaugucaaggacauaaaguauuaguaugauacaugacaaguuuguucuguuaauauugcuguauaguuuguuuguuuguuuguuuguuuuuugagacacgaucucguuguguagcccuggcuggccugaauucaauaugcugacuaccuagccucaaauucacagagauccacccaccucugccugagacugaagguguguaucaccacgccuggccaaagaggagaggcuggagaaaugucugaguaguuaaacacacuggcuguccuuccagaggacccacauucaaaucccagcacccacaaggugcucacaacugccagcagcuccaguccuaagcgaucugacacccucuucuggcuuccauagauacuguggcauacagacauaaaugucagcaaaacaaccauccauacacauagcauaagaauagaucauuuuuuaauuauguaagugcuggagggauaaaucagugcuugaauaagcacaagaaccugaguacuuguuuccagcacauaaauaaaaagcugaacaugcuggugugcaugguauucccaaugccuguguccccuggaagugcuggccagugcugggacucaccugaugagggagucccagguuccagcgauagagacugucuccaaaaucaagggggacagcuccuaggaagcaguaccugauguuggccucuguccucuacaggcacagacacacaugcacacauucaccuacacacauucaccugcacaaagacacacacagaaacaauuguguaaggcuugauucuagggacugcuccagucaguuuaaaauaaugugauauaggagaacacuuaugcacagugguccuugauuccucugugugagagaauccugggugugguaggccaucuguggacucgacauauuggcauuacuaagguuuuuuuaaaaaaauauagaaccugaguacuuguaucucccagauuuuaucuguucaggaagauccugacuguagcauccuguucuacagggggguaauaaagccuugagagagugcacacuaggugaauucgcaggaaggcuucaccaagguaaaaugcuaggaaccccuuagaaaugcuuaacaggaagugaugaaucaccuucucaucaggaaaaugacguaaauucuguuuaaucccagagagcuauuaauggauguuuauugguuaggaauaaaggaaacccggaggcugacuguguaauuuccuugaguuuaaaguguuuucuuagaugaacucugagggaugaagcagcaugcaaacugugggauaggcagguuucuaugaugcacucgacuaguguucaggaggcaugcacacgugagagcacacacacacagacacacagcagaauggagugacagguguggaccauugugagacuccagauggaucaugauggcugcacucaucaggcauucuugugcuuccugcuggagcccaaggaugugcagagaauuacaguacagaggagcacauagccaagucagcagucagacaaggagcagaaggagcaggacgcaugcuguggagggcaucggagucagcagcagcagggaauggugcuggggcaucuuaaccagaucguuaaaagacuaucaaagcagaugaguugggagcaagccuaguuaggggcaauggggcuuuguauauuugggccuucccacuucuccauaggguacaggguucuccaugccgagcacuguaucagcuggaauuguugggcguguaguugaaggccuucugagguuaaagagaugcauggcuggucacaggggaguuucagcuaggaggucuggauaccggauccucaggugcucaaacagggacccuagcagaccuuaaaacaagcugcagacuuccuucucaaguaacuucuuucugugugugucuguuuuuucagaguucccgaaauagacuuaaaaaaugcuaaaggccugucgaaugaaaguguuaauuuguuaaaaucacaccuggaagaacuggccaaaaagcaguguggagagguaaggguggccaagcuggagcuuuggaaacaaaacagaaagaucccacucaccucugcgcagccugccccaguaguaacacucacaacacugaguacaugaucacagccuccauccugacagugaugcuuggggucaaggugguggguaacuccauccccauaaagaucucaacgcuauguccuucuuggccucuucccaguucccuuacucucuccuucauaccuggcaaccacuaguccauccuccauuucuauaaucucauuugaagaucuuucauacaguauacaaccuuaggagagguugguaauuuuuucagguucucugaagaguuucccaagugguuaaauauaacaauaauuguuacauuucauaacugaauaguauuccaccuugauguuccuuuagccauuuacaagaugaaauacauugaguuuuccaguuuuuaguuauuauaaauaaaguugcuauaaauacucccacacauguucuucaagcuagagugauaaaccuguccugaguaaaaaggguguacucauccuacagaguagcacagccuagucacauggcugcuucccuuugugaucgcgcaccagccagggagcuacagcgucugcuccacccaguaucucagcugucagccacagguaguuaggccaggaggucaaagugcaauguaguguuguccagccuuacauaggaagggaauucugacauucaccacaacguagugcaaccuuaaagaaguuggaauaagugaaaugagcuggcuguaguaagacagguacuccaugacuauuccagauagucaaacucacaggacagagaggagaaugguagcugcuggggcugggagagcaaggaauggcaaauuuauucagugggaaugguuucaaguuggaaagccuuggaagugggggcagcgaugccugucagucacgguugccaggcagcauuucugcaugucucaguaguggacagagugcugugggagucugccccaaaaacuggaggaaaaaaagcuuacgggagccauccucaugggaagggguuggaggggcauaaagugugggacugugcugugcagguccagccuguuuaucaaaaguuugucuucauagcucugaaguccuggcaguuaaaaauacaauucuaaagaauucauuuauguuuucaaguaaaauggaguguaaugaaacguuagcauaagcuuagggacuggcugugguagggucuucccugaaggccgccuguuaaaguaccgaggcuucauucucuacacggaggagcaccaaaagcaaugauuaggaacauucaccuuugccccagugauguuuugggggaugaggggugcugggggacagagucucacuagauggcucugguggcccaaaucagaggugugugcccacaugcucaacacuccucugagugacuuuugaucuacauuaguagaucuugguugguugguuggguuuuuuugguggggguuggggaguggaggguuguuuguuuguuuguuuguuuguuuuugagacagagucucacuauguagcccuggagcucacauagaaaccaggcuggccucacagacaucugccugucucugccugucucugccuccugaggauuagucagggagugcacuacacaucuggcuguguguuagcaggccuuuauuagucguggaaagugauccaaaguguaccaaagauucuuuuuuuuuuuuuaacugauaaaaucaaacuccuggguuccucccugagucagucagaaguuauuuacugaacaucuuaugcuggggaacuaugguguucagacaauuuggccuccaugaggggcacagacaaagcauugucuaaaaccauggccgacuggagacuaaugcucuggagaaucaugaugagguguccagaguggaaagagggcaggagaagcccuugagcagcaucugaggccagcccuggauggacaggagagaagcacucaggaagacucacuuuggaauaugcuugcuuuuaugcaguccuacaaauuguaucagacuucacuugcucagaaagugcuaauaaguuaaaucaaugagaacaaaaccuugacaguuguggucuugccugguucugguuuagaaauggucucugggaguggugggaacaucuugcuuuacccaauguuauuuuagcccuugcuuagccucuagacugacauuacucaacccuaggucaagauauauuuaguaaacaccaccgcuucugguauaauaaaaaaguauaucaccucuaccgagcgaaggcugcacuuucuuagcacauacuucugggaaggccaacugugaacagacucacagcuucucgaggaaagcgucaucaaugcucaggccccuuagaagcagcaugaaagaguaagauguuuaaaugcucucugguaacugugggggaaagcgccucgguccacauucuucacugacagaagcagcuuggcuaugguacccugggcuggaugccagucaguguggucucagaaccccugaacuauugauugccacccuacuguggcuucuggcuuagcccagaggcuagaaaggugacuuucucuguuccccuauggauguuugagguugccuucccuuccuggcucugucuggcugauuccuuacauauugaccagccucuugcuuguucauugccagaagggagggaaggagaggucuauagacuugcuucugggccucugaucagugugcuaucuggacaagugacagcacugauugaugcucaugggaccguucuguccaaccgucaaguaaacaggcucucuacuuggcaagguagccacucccuuucuacaguuguacauaguuuucagcuuuauuuauacagaugauuagauguuaggaaaaugacaguauauuugaguagaucuuacccacacacacauacacacauacacaagaagagacacuuuuuauuuaucucagcagcgauguaucuugaucacagacucagugagcccucuaagcgcuuuuucuacugugacugugucauauaccuaauuccaaagaugucagagcaaagugacaaaaugcuggcacggcaggugagucuggcugccugcucaucguguugccggguggcagucccucuccaggcccugccccuugccaucaacugaucauuugugguuguuuuguuuacauguguaggugaugauauuugaacuggcacaccaugugcagucguuucucagcgagcauaacaagcccccaccaaagucuuuccaugaagaaaugcuggaaaggcaggcucaggagaagcagcagagguugcuggaggccaggcggaaggaggagcaggaggugagaaccagcuguuagugcuggccccagccuggaggccuccaugugucuauucccacucucacuaugaguaugucugugagucuuacucaucacuucauucaggaaaugugcauucaugugagagaaaucacuacaagucacugagcaacacuacccagcucucucccugcagccaucacuggcuuggagcccuucucuaaguggcucauaugacuggacuuccugugucgcuaagccugccaaccuguacaggaguucacugaaucuggaggcuuuuuccuccugacugacagauguggcugaugcccaguggguagaagagccaggaguuaaacuuacuuucauggucacuaaacagcucuauucuucuguuaacuucuccugagcaggaacugcuuccugacuuuuaaaaauccuuuaagauguuuuauacccuggguuuccuucuugauuuuuaacuuaaaauuguuuucuuuuuagccccuugaucaacuuaguaaguacuuaugugggugcagguuaaaaaagaaagaaagaaagaaagaaagaaagaaagaaagaaagaaaggaaggaaggaaggaaggaaggaaggaaggaaggaaggaaggaaggaaggaaggaaggaaggaagaaagaaagaaagaaagaaagaaagaaagaaagaaaagaaagagguguuucccuaacacauuccacagccauuccucauucagugaucuguaggauuccucuaaaacaguaguucucaaguuuccuaaugcuacaacccuucaauacauuccucauauuuuggugaccccccaucauuaaauuuuguugcuguuuuauaacuguaauuuugcagcuguuaugaaucaugauguggauaucugauuugcacacccaaguugagaaccacuguuuugaagugugucuuaauugcuuaccuaugcuagaaucuauggggaaauuuaaguucauuuucuugaguauucacaugcucugauuuuuuuuaaucuuugcauguuuuuaauauuucacaggccaaccuacccuuccccgcccccucaucuuccauuauuuuuucuuccauucuguugcucuucauuuucuuccccagcuuccucuccucucccucucuuaccuugguucuuuuucccgaggcagggucuuacuguguaucccaguguggguaucacagacaugugccauguaccaagugucacaggugaacuauggaauugucccuucagauucuacaaaacggauaagccuccugagauuuuugacugauuagagcaaauuugcauauucuuuggggaagaauugguaucuuauccauacuaaacucccaucuaggacuggguuuauguuuauuucuugguaugaaagucugguuuucuuucuugcuauagauauuacuacucauacuucaagacuuggauuuucucccacuuucuuuaaugguaauaugucuccuaguggcauuuuaugcauacacaugacauacuuugaucacauucaccaugcugcuauccuuucucgucccucuccuucuccauccucuggcaccuuuccucuuuccaaauagccccuuccugcuuuuaggugcuuacgucugguucuuguuucugccucauuuuguccacccuaugcuauacuaacauccucuguguguuuucuauagcauguuguuguucuugacagggcaaacauucuccaucccucauauuccauugagauggaucuuacccauauugcuuggcuccuauuaaaccaugucaaguccccaguuagagugcauaguugcucaguauuagauguuagugggccuuuaacucacagucuuuuuugguauacugcuguaacuaccuguaaauuuagauuauguuuuuuugcauuuuauugcuauuuacauuucugaugacuuaauacucuugauaaaauuuacaguuguagggaacuaagaacaauugacgaagaucaaaauaacuuaauacucaaaaggaugaugugagaaggcauauuaaggucauggugggcugaugugauaccugggccuuugccacccuaggcccaggcucugagaacguccaacuccaccacaccuguauaaguucauggaagacaacagccccugcacccagccucugcacaugggcagauguugaagcuagaagagugaaaaggaagacaaacccaguaccucacagggaagccugcugcucagagacacuggcagcagacaugagcguggcuacuccaaguuuucauguguagaucucaggaaaugagggcccuggcauggaaauugaaaagcuaugugaguccagaauggaccugcugggugccuucuuauauagauuggugucugaccuggucugauuuauuucagcaacgugaaauccuccacgagauucagagaaggaaagaggagaucaaggaagagaagaaaaggaaggaaauggcuaagcaggugccguccauucuguaccaaaggaucuacguguccucuuguaaaagcccuaauguccacaggagacaucuuucccucucaugugcuaaagcuaaagcuccggccuuucauuuauuacguuuggggucuguuucuuuuguuuucugauuugugguaaaaggggcuugagacagggucucacuauguauccuuugcuugcuuugaauucauaauaugacauaagcuaaccgucugcucuuggaaguucugccuuagccucccucgcucucagagcgcgaacauaaagaagcacugggcucugcuuaucaaguauuuuuagauuuccaaaacaggugacaaaauccagcguugucuauugucuguaaauaacuuugguuuauauaauuacaguaauuuaucaaaugaguccaaaggcaggagauugaaauuuuaauuaaccuggaauagaacuuuuauuaaacaaacaaaacaguuuguucuuacugaagagcgaaugggaaccuuacauaccuuccuaaaacucgauuuggugauagaaagaaugauucgccaucaaauuaaagaacaaacuggaugugcuggggacauuccucauucuuuucuggacauugcuggcagggucccacgugguacaaccagaaacaacacccaagcaaagcuuucauguuucugcuguccugcuguagccuuagaggugacacucuucuguggcugucuuuccgaauaucaaaacaaagggacuguagugccagucugcccuggguaaagcugaauccaaaucugacauuucuguugccuccacccucccaucuuaccucugcacugccuccugucagccgcucuucucuccucaaccacccagucucuaaucaucuccaguccugucuuuuuaacuuuccaagcagauucuaagcucucgcacauaaaaaucucaugcucuuaaagcugugauguggacuucacuuguugaccuagaguuggcuuggguugaugcacucuauuggauguguacacugccuucacgcacacagguggaggcugaggucgacugccucaaugguuugccacuguuucuaucuguaauuuguagugugugguuuucaugcuugcacauccaugugccacaagugugcaauaccugaggaggccagaagaggccaucagauccccugggauuagaguuagagacaguugugaguugccaaguggcucugggaaucuaacccagguccucugaaagagcagccagugcucuuaaccccugagccccuuccacuuuauuuuuuugagauagggucucuuacugugcagggucuagacuggcuggccagugagccuccaggaccauccugccuccuuggugacacacacaccaccacaucuuuuuuuuuuuuuuuuuuuggaauguaggggaucaaaauucagcuccugugcugcucguucagcuauccccuggugcacauugcaccuuuuaaguugagucugguuguuacacuguaagcugugauagcuguuauugucaaccugacacaacccugaaucacugggaagaaacucuuaugagagauuguuuacauuagguuuggugugugguguaucuauaagagagaguccugauugccagauaacaugggaaggcccggcccacugugggcagcaucaaucccuaguuuggggcccaggacuguguaagaggaggaaucauagcugguaugaggcaugcucaccuccacuucucugcuccugacuguagguucgugcucuccuccacuguggccuaaccaccuuggugggcuguggacuucuccccuaagcugcuucuugauccaguauuuuuucacaucaucagaaaugacacuaaaaccucccgaucaaauuaaacauuuauucuguacugagagggugauuccagcugagcgugucauccgcuuguaugagcagcuaauguggauuucauucucccuuuccuaggaacguuuggaaaucacuagcuugacaaaccaggacuaugccucuaagagagacccagcagggcacagggcagcugccauccuccauggaggcucuccugacuuuguaggaaaugguaaagcccggacauacuccucaggaagguccaggugagucccucagccuucucgcaugcaggguggaagauggggaaggauaaaauggccugcggcgagcggcaggaaugcucagauagaaccuucaccaacggcucagcacgucuaucuccaucuguuagcuaacuguaugaaaccaagucuuuauuuaacgcuuucuaaguaccgucacauauuugcuguguggugcugguguuugaacccagggccucacacaugcuagcuaagcuccaccucagagcuacagcccagcucucuguuucacuuuauuuugaggcaaaaaucuuacagcccagacugaccucgaaccugugaugcccuuggucuuagccucccacagggauagauuaacaggcaugcaucgucaugcuugccucccaguaccucaggaagccagucauaaaccacagaacagccuacaacacugcacacucucaccuucaguacaauuugauuugauucaaugauuuaaauuuuuuauccaucugaaucaucacuaucaauucaaauuucacuuuucauacuguguguguaacuucuuuuugugcagugguggugggucugagaaacaggguuuuagauaauguagacugacuucaaacuugcucugcagccaaauuugcccugcaguuccccuaccucuaccauguaagugcugggauuacaccuggccugguuuacuggguucugggaauuaaauggagggcuuucuguauucugggcaagcacuccaucaacugagcugcacggccugcuauaguuagguacaaacauagacagaggugugggauuucccaaaguggauucaguauaaaauacccauuccuagaggagagagucacacccucugagguaggcuccuagguccucugucaccagagggcacuggaagaacacuccuuccuccauauucuuacuacuuagagauugucucuauccaugugaauuugagugcagaagccaugaauggagagguuauuaaauauuauagguucuucagcucauuuuuaauuaaaguuuuauuuauuauugggaauguguguguguguguguguguguguguguguguguguguguguguguguguguguguguguguguucugugcacagugggacauguggaagucagaggaccacuucucaagugucauuacuguccugcuaccagucccacggccccauuuuauuuagggcuccagugagucagcacaugacaguggaaauguacagcacagcagccugcucaccucacagccaggccacaggaggagggauggaggggcugagggcccucuaggcccugccuuagaaaccaccagugcccaguagcacagagugaggaagccuuuagcacaugggacuucucgugcauccugguuuaaaacuaguggccgcucucagccuuggugguggcagaucuuggacagccgugagcaccaauuauuuuuuuauuagauauuuucuuuauuuacauuucaaauguuauccccuuuccuaguuuucccucugaaaacccccuauccccacaccccuuccccugcuccccaacccacucacuuccauucccaguccuggccuuccucuauacuggggcauagaaccuucacaggaccuagggccucuccucccauugaugacugacuaggccauccucagccacauauacagcuagagccgcauguccccccauguguuuucuuugauuggugguuuauuuccaaggagcucuggggguacugguuaguucauauugauguuccuccuauggggcuucagaccccuucagcuccuuggguucuugucucuagcuccuccauuggggaagucuuuccaccgucucuucuacaguggucuaggggagaggagaaugugauauagauguccauuuagggcugagcauuguggucacugaugcuuugugccuuugucaguuguggcucucugugcuaauuagcaucuauugcaaagagaaguuucugucaugaugguugagauauguacuaaucuggguauagcccuguugauaggaauugauuuacuauuauguccauuuagcaaaaucuugauccaacaguggugccagguaugggugucaucuuguggaguaggacuuaaauauagucaaaguaguugguuacucccugauguugaugccacuauuacaccaacauguguaucuuggcagggcugaccuuauuguagcucacagaguuuagaugugggcaagaucaauggugacuuuuuucucugguagcaugcacagcuucuccuagcacucugaaagcuagccagguuagugccaacuuaauaccucuguguucugugacucaaguguguggugaugaauauucuaaaauaccuucaaaccuguccucuccaggacauugggauggguuggacuaagaggacugaguagcaccauuugcuggcuagggcagagcucauaccaagggcugcuagauucuucaugugagucuagcauaugguuuugaaucuuugcuuguauucuuuucuccaaaaaucucauuguguucuuauuuauacaagaagcuuaaacagaacuauaauguaaugauuaugccccagcauuuagaauaugugggacauguggguggcauaagagacccacgagggaaaagguugaggaaggcuagaagucucgggauuggaagcagagacacugggcuaugacugagcagugucuguauguaggagaaaguugaagguguccaaaguugaaggcuccucuggauggggagcuagugaggagaugugggguggagguaggguauauaggacucauaaaacacaguaggugaucaugccaccaacuaaauucaaagaaccacaagaaaauaaaacugaaguugacaguggaggaggaagguauugguuuauuuucgcugcagugguagagacaugaaugauagaggcuggacugaaaacacagggcucuaguuugaauaugaagacccagaguaaguguguagagagugcagccugcaguguggggaugcaaggaacagauugaacauugaggauggaaggacuagccggugggccaguaucuggccagcaggucuguaggggauggaacugaggcauugccuacaguccgucuucaguguugacuuaaagacugcugccagcaccagacaccuauggguaagacuguagggacugggaacuuccuucccucugugcuccuuguuuucaguaaaagaacgggucucuucuccuagagaccaugcagaucuccugcagcaagcuucaucagagccuuuccaaggaacguucaagcauaaugagcucuguccuucacugcucacuguaugcugucccccaacuuguucauugcuuuugcaaucuaguuucccagcgugugcuccccauccauggcaggggaaagagaggagaggagagaggaaggcagggaagggagaacagaaaggagaaacaaaaauauagagagguuaaguguuuagggacagucacagggagugucugucagagacagugagagaaugaaugggcacucccuggcugaggcccaugcugggacagugaggacucugagccccugccucugaguguucugcaaaugcaccugugccugggaagugagaagcuauggggucagugaggggugaauguaaacugccacggccagcugagcuugcuacugugauggacagccaguagaacuugcugcagugauggacggcugagcuuccuauguagaugaaaugcugugucucugcuguuggugugugauuguuuggaggucagcuauguaaagucagcuuuuuccuuccauguuccagggaucaaacucaggucgucuugcuuuuaagacagcacuuuuagcggcugagccuucuugccugaccaggaucugaauuuuaauuucaguguaaauaggagugguuggugcauaccacucugaauggaguuuauggcauucauauguaaaagggagcaaugagagugggcaggaauucauuuucccauuagcaccuucaacuccaucccccauagagacuggacucaaugggcuaauaauuaggaggggugagaauuuccugugucaaacuguaaguuaaaggaaaaaacauuguccacauuuauuuuucaggcgagaacgucaguauucuguguguaguggugaacccucuccuggcucgugugacauccuccauuucucuguggguagcccugaucagcucauggugcacaaagggagauguguuggugaguaaacuagccaaggccauuaaguugguuuagugacaaacguuaacccugauguaccagaauggacuacagguugacaucucagccaacacagugugaagaggacccucauccuagcaggaagcuguaauucugggcccuagggugaaaagcuacucagcuccuguaauguaauauggaaauacaacugugcucuuggaaauauauuagcggacagauaguucuaaguauugcgucaugugcaucugguuacugagaaaguguguauaaacaaaaugagcccugauacuugugaucuuugauaaccaaaucucugcuuuuuccuuccugguacuuacuagggauugaaccaagauccuugugcauaccaagcaaguacugaaccacugaguccuaucccagcccccaaaucuccuuaaguuaccuacuguccgucugcuuggcguuauccuacaaggcacauugugccuggccggaaaaaacaccuuauuuucucuacaucuuaauuuggcaguugucucugguggcuccuugaaaugaaccguucucugcaauuugggauuuuaauuauuuauugaaaaaucuaguuuucuaaauugacuuucuuagccaucuagaugagcugcuagggcuugcugcuauguagugaauugaacaguuaacuucuauuuucaauccuauaauugccagaauuaauggauaguauaucggaggucaagcucacuugcuuucagcuuuuuuccuccuuuuuuaaggugguacaaauaaaccagagagcagcuaaggagagggcagcagauaaaaggggcagaaagcaaacaucugaagagccucuggucuggacacucaaccugggacugugucuagcggccuagacagacuaggauucacagacaaagggcugacauaggccccagcagaggugguuggccuuggacuugagauuguccuugauucagacauuccgaauuugugagcuggcaacaugaaacucccgcuucaauaaccugggaaaucagaaagacaguaccucaggcuuagucucacugugugcuuaucaguuagaugcaccuuuuuaacuaaauuauuuauuuucucauuggaaaauaaaauuuccaauuggucuggcguuggaaauagacccuaauuucuaugaaguaucuggguuuuuuuuaaacuauuaacuaauuaauuuuuuaauauccaauaagacauuuccauuuugagaagcaauauauaauguuuguuuuucaguugaaaguuguaguuuagagacuagaggauguuucuggcuguaggugaggugcugacagcugucuggauaaguaacuguugcuggcucagcacagcuucagucuguguccuguucacacuucuucagccucagcauacuugcucucuggguugccuccaccaagaaaagggugauaugaagguagcaaaaugaauuuauaauguaaaagccccagcaauuauaaaaugucaagcuguuugcacacagugccgucgagguagcuuaguggauaggggcacucaccuagcaaccugagugacacccagaagcuccaugguagaaggacaggaucaacucucaaaaguggucuugugacccacacacagaugcuguggcauacacccguaggugcacacacauauuacaugaauguuucauguaaguauaaguguuauacauacaugaaugaaugccagugcacugggaucacacauaugcagugagacuucaugugagccauguucuucuucguccaucccauaaauucuuggugucaccaucuccagugagcuacucaacacaugauccuaaaguugcuucccuuagcugacaaguuuucaaacguaaggucuuaaccgcuuaggcuaagacuuuuauaagucauuaugacuagcagauaacuagguuguuuucauuaaaaucucuaaauugccagcauuucccugaaguaaaaacugccugacaaaugcaaugucuaggugagcaaauucagccauaauucuccaaaguacuuuugcuaaaacugucuuauauaugcagguuauuuuuguucugauuuuucaaauggaaaauguaauuaucaacagcucuuaaauuauuugucucauuaggaaagugaagcaauaucaugaaaaacuagacuuuuuguacuaaaaggguacagcugcggagauagcucagugcuugugagaaggcgugacuccaaccccagaacccacaguuaaaauaacagaaagcaaagcuugauggcaugcgcucggaauauaagugcugggaagguggggcagauucuuggagcucacuggcuagacagcacugugaggcaggaagagauccuaccugaacagcagcugggaaccagcacccaagccauccugugcacacccauacacacccaugcacacacacaucauaugcacacacacacacacacucacacacacacacaucauaugcacacauagggcuagaucacuauauuauuagugguuccaagcuggagaugagucaguagccuggcaucauuuggugauaccugaagacuacuuguuuuccaugcuggggacugaaccccacaccuagcacacacuuauccaguacucuacuacugagcgcacccagucuacaggcguguuugacaguugaugcugugguaggggugcuacugacaucuaacuuguugacagcgggacacaaaguguccccuacaacuaaggucuguguggccugggcacuucaaugcuacgaugagacaaauuaagaagaaaaaagcauggaggaaggaaaacaaaguaaaauacaagcgaugcuuucuucuuuugcuauuauaaucuuuaauggcaacagagaauuuuguacagcgggguuuaauguuauagcaguucugauccccaaggagaaaacgugccugauaguuaacuaagugcacugcuuucagccuuagcucucauucugguucuuucccucuaaaacacagggcagugggcuuugcugagcauauacagaguuugugccucugaugaagccacuuuucaaauuagacuaagcuguugugcugugcacacuaaucuauguuagugggaugacagggcagcugugguccccaagggugggcugcagaggagaacgacacuggagguccaguaagaugcucuucucucucucucacccggugauaaaucucaucaucgguucugaacuuucuacaauaauuaagauuugaaggcuuggguuauguugauaauuguuaaaaagugcuuacaaauggacagguauugcaguaaauguuucuuuucauaguuagcauguaguacacacacaguuuacaagcucuggugaucuuuucugucugucugcaggcagugaugagcagcugggaaaggugguauacaaugcuuuggaaacagccacgggcagcuuugucuugcugcaugaguggguccuucaauggcagaagaugggcccuugccuuaccagucaagagaaagagaagauugacaagugcaaaaggcagguagguaagccugcgugguggaacacagagugggaagaccagaucaaggccagccuaagcuacauggcaagcuugaggccagccugggcugcagaagccccugucuuagauucaaaacugaaagaaaaaugucaguaaguguuugucauggcuguccaaaggcccaaucucaaacuguagauaaugaagcaaaaagccugcccccauuggcucccacagagugugaggaccaugugacccucaccuuccccaggccuccacucugcucccacuucuguacccugccccagccucguacgcacccuccugucucggccccugugauuucugccuuacugguauuaguuaccgcuucagagcugggcuguuugcaauuauuuauaucuuuucugcucuuuuaaaauguugcuuuauaaugacuuuugagggaucagagggauuuuuuuucucuuuuguuuaugugcagugcuguuaaugagaaaagaauuuuauaugaauuaauaaugcuggacuugggaacacuuaacauucuauuuauuuauucuuugcuuaauaaagaaguuagaaaacagccaagcaagagaacuuuaaagcacaccaaaaucaguaguuaguuuuggauggugaucauauaauaagucuaaggauuuuuuuccuuuguauuauauuauauuuaaauuuauauuuuucagugcugggaauuaaaccuaaggucucuugccugcuggauagaugcucuaccauugaacuacacauccauuguuuuuacaauaauuuuuaguagaagauucuauuuugaauauguuucuuuuuuuuucugcuaaccauaucacacacauaccccaaaauuuugauuuuuaaaagacacagcgauuuuaugguauuuggauacccuguuuuggcauugaaguugauaauuagcuaaacuuucuugcauuuuuauguacugucagguugauuuaucaguuuaggggaaaaaaaucaagacauaguauccuauuuucccaucuuugaaaguguauugucuaucucacaccuuacuuuuggagugaaacaccagcuaaugucauuugccuaauauccuacucagauucaaggagcagaaacagaauucagcucccuagugaaacugagccauccaaauaucguccgcuacuuugcgaugaacuccagagaggaggaggacuccauugugaucgacauucuggcagagcacgucaguggcaucucucuggcuacacaccugagccacucgggcccaguccccgcccaccagcugcgcaaguacacagcccagcuccuggcaggccuggauuaccuacacagcaacuccguggugcacaagguucugagcgcguccagugucuugguagaugccgagggcacugucaagauaacagacuacagcaucucuaagcgucuggcagacauuugcaaggaggauguauuugagcaagcucgaguucguuuuagugacagugcccugccuuauaaaacaggaaagaaaggggauguguggcggcucggccuccugcuguugucucucagccaaggacaggaguguggggaguauccggugaccauccccagugaccugccagcugacuuccaagacuuccugaagaagugagugacagggaucguuccguccugcuuuccuccuguacagcugaggagcggggaggcugagaugugaggaagggagucagggcgaauuccugcccaggcucauguguucuccuuccuuaguacagccuuccaccuucuccugaacccacuugaguuuaauaauugauucucaaacuacuuuugggaggcugccuggaauacucuagaauuuuuuucccauuccuaucuaccccagaaucguuggcagugguaagaaguggccuaggugugguagacuuccucuguuacuuugcugcuaaguccuaggagaccaaagagaaggccucaggaaaccagucaagaagugugguucugcccucucucuuccugacucguccuccaaugaccaggucagaggaccaauccaccaccuguuucuagacagaggauuuuucacuugugaaucacaagugcauaaucguuacaaagccagcuuuuaaaaaguaaguguguguguguguguguguguguguguguguguguguguguguguccaugucugugagagcaagaacccauugacguuugugucaaucaaaccgaggagagggaacagcuuucuggagucuucucuccuuccacagugagcucuagggacucacucagguuguugggucaucaggcuuguggggcagccuccuucucccuuuucaucucucugacucacagccaggcucucuccaguuugaggaguccuuaauaaugagauuuuucuugggccuaaacuauuuguccaggacuuuccccucaguauuuucuaccuucacccugaauguucucagucuaagccagcacuaccccucagucucuaauaagaagaggucugagcauucaguuguuucuggcaccccucuggagcagccuccugcaggccugcccugugcugcugcugcugcugcuacugcugcugccucugcugcugcugcugcugcugcugcugcugcugcugcugcuucuucuucuucuucuucuucuucuucuucuucuucuucuucuucuucuucuucuucuucuccuucuucuucuucuucuucuucuucuucuucuucuucuucuucuucuccuccuccuccuccuccuccuccuccuccuccuccuccuccuucuucuucuucuucuucuucuuccucccccucucucucucucucucucucucucucuuucucuccucaccuucguuucccuagucacucaccaagucucuucaucuucucucuugccuucacauuucuguuugccugugaccugaccauagcgauccccgucacccacuaguucgcuggucacucauauggcagucucugaaucugagcagucccucugccacacaucagaguuucacuggugauggacuacgcagaugauggcagccacguaagacuggcugugauauuggagcugaguuaauuuaugcagcgcauacuguaaugaagauucauucuugcgcugugccccugucuuuaagcaacauagagcauuuaaaugaggcuauugguguguugcagaaaguagccaugauacuuuccucauuugaggaaaugggucaacauugagucugugcaacauucucuccuuaaaguauauaaacuuuuaaguucuuucuaaaagucacuuaugauuucuuuuaaaugaaauagaacuuuucuuaaguuuuuucuuuauuuauuuuauguuaguacacuguugaugucuucagacacaccagaaaagggcaucagaucuuauuacagaugguugugagccaccaugugguugcugggaauugaacucaggaccucuagaagaauagucagugcucuuaacugcugagccaucucuccaucccccaaaauagaacucuuuaaaaaaauggauuuaaaugcacccuacaaugaggguggcugaggugacagaugggcugaugaguuacuaugaaaagucucauuuccauccuucccaugcccccuugaacucuccccgcuccucacuucagcagccgggcaguggcccaaucagcagccgggcaguggcccagucagaggccugagacuuuccugguuguuccuuagaggagcagcuccccucugucgcuucugaaggugacucuguuaacauagcugucaucugggauaauguguauaugccucucuucugggguggggccucugauggccggcuuaguuggggugggugacauuugguuuagguuguuagccuugcuguccaccccaguuagcagaagaagcaaacaauucacaaaagcagaguggauuccuccugugauccccaucguacuuaguugacacccuugggaagucaucugggagguggcuaagaguucagguguuggagccagauggcagauccuggacuaacaagguccugguagcuauaacuaucugaaaacacaagucauucucaguaggugcuagcguuuucugauccacaucuguugucacagcagucacauuaaugucacagcugagccagaauugauagugcucuucagaaucuagcacagcaugugugaggugugugugugugucugugugugugucugucugugugucugugucugugugucuuugugucugugugugugucugucugucucuguguaugugucugugucuguguguaugugugugacugaggaacaaucccaacaguaagagaaugcauuguaaauaaauucuggcaguucccugacucuuccaaggguugagugaguuccaccucuccggcgcuggcugccccuagccccuguugcacccagacugcagcucucagcgcccucagcaguaagagcuguggaaaguuccgggccugcuaucccuucuggucucaaagcugaggcuaacauggccucugcugcuggucgccacucuacugccaaaaugauggggucugaaaauguaaucuuaacaagcaagagcuccucaaagcugcaguuuaacucucggcaggcuuuaaaccuguuucgauccagaucuguugugucagucacaguaaugcacggugguagacuuagaguggauagugcacuuuagaacuuaacacaguguguguauguggucagugcaguggguauguaggacuggaaauaacccaggagaaccagagaauauacuaggaaaucccaauggguccaagcugauguaggaguuuaaaaggaucuuuacugacauaauugucuuuauugacauaaaauguaaagacauggcugaaaggccacuugcuaaaggcaaauaaacucaauauccucaauaaccuauuaugacuggguuguuguacacuuguagauggaagcaaaaaaggaagggucuguagcgaugcacauuaagagauuaagagauggccagacgaugggaagcagaggcagauggauuucugugaguucaaagccagccuggucuauagaacaaguucuaggacagccagagcuacacagagaaacccuguuucaaagaaaacaaacaaagggaaggaggaagggcaagagagaacuucuauuauuuauguauucauucauuuuugagacagucucacuuuguaguucuagcuggccuaguguguagagcaggcuggccuugguccugugacuuuuuagcugugcugcucagugcuaccauuguguuucuggauccccagcaucugauuguuaucuuuggaaagcuugauuuaggucugguccuccgcaggcuuaguucagcagggcacguuacuaagcugugaauggaaguggcaauccaaaccugauuuauauggccugaguguauuucagaucauuuuaugccucuauaguuaacaaaauguuguugguuuuucuuuucucuuuucaacuugagcccagucuacugugggauaugcaaaccaugaaaugguguuuauucauuuaaauucacuuuuaaguauauuuucuuccaaaaguaacaugaauuugccaauguguguuuaaaaagaaaagcaggccgauagauaagcuggguaaugaacuagaaaggcauuuacacugugcacacugagauucuucuccugcucugaggugugucugccuggacgacaaggaaagauggagcccucagcagcugcugaaacacagcuuuauaaacccucaaccaaagcugccuuugguggagcagaguccugaaggugaguuaucgccugccugccugccugccugccugccugccugccugccugccugccugccugccugccugccugccugccugccugcugucugccugccugccugccugccugccgccugccugccugccugccugccugccugccugccugccugccugccugccugcugucugccugccugccugccugccugccugccugccugccugcccgccugccgccugcccgcccgcccgcccgccugccgccugccugccugccugccugccugccugccugccugccugccugccugccugccugccugccugccugccugccuuuucuuguuuuuucuucuuuucuuuuuuugcuagggucccacuguguaacccaggcuagaccucuugguccuccagacucugcuuccuaagggcuacgauugcaggcauugcaggcaugcccuacuacacuugacuacuucuaugaugaugauaaaaacacagagccugaaacugagaacgucugccugaaauuuuuuuccuuaccuaggccgggccucacuuaauccacuuaugugcaggccuuguguuuaugagacugcuuugugacccuaguucuuccagccucuauagauggaguggguagggcauccccuuccugcuguguuacccacaucgccauguuaucuuagaagagcuuggcguggacuaggaaaacugaguuuggguucuagcugccuaguucagucacauucucuccaucccuguuacccucaccuguaaaaugggccaacuguauauuccugccuguuuuaaagaugaccaggugagaaaagaugucaaaggauuugaagugcuuuucagaccacuaguuggggcaccuuccucucauacuuagguuguuggcuccugugagcugucugcuuuuuuuuuauuauuauucucauuuauguguguauguguguguccauguggguaugugcacauguggauacaguguccagagaguccagaagaggccauuagguucccuagagcuguaguuacagguagcuguaagcugcucagugugggugcuggggaccaaacugcagucgucugcaaagacagugugagcccuccaccaucgagccaucucccagcccaguccucaugccucugcucucucuuagacucugggggacaagacuacauugagaccgucauucccagcaaccagcugcccagcgcugcguucuucagugagacacagaaacaguucucccgguacuucauugaguuugaagaacuacaacuccuagggaaaggagcuuuuggagcugucaucaagguacgacaggguuguccccaauccccuuuaagcuuucucuuuccuuuccauggccucacaggcuugguuuccauuuugggaguggaaagggaaguaaauaaaauaagacucuucgaagcugggagcacuuucaccucccggaguuaaaggcuuucuuuaaggccacccuggacucauuaagaauacauuguuccuguguccuugguuggcucagaacaaugacaugaagaaaaaaaaaaaaaaaaaaacauuacuuacaagcauccuugagcggccaggaucucugcgugaagaccauuucccugugcuuggaucaggaggggaguugaccucuucaccuaccccaguguugucagggagaaaaggauuccaaaguuagaacagaaauggcauucaagcugggagaccgucuugaugccucauuuucuagccuaggaagauggaagauuacaagcacgucuuagggacuggcacucuuaggccucugcucacucggccuggguaaguguuauuacguaauguaggaagaggcuucugcuguucuuauauaacuuaaauguuuucuaacccacuagagaugcaggugagaugcagguuagaaagugugaagaacagcugaggugcgugccaugguuuacguaugaaugugaccucuauccaugaggcauguauguguuugggauucugaguguauagagaagcaggcagcacuccuguguuggaugauuuuuguguguuuuggaggguuguuuuguuggguuuugguuuuguuuguuuguuucuuuugaaacaagguuucauggcgccugagcugccuggaaaacacaauguagcagagauggcccugaacccugguccuucuccugacagcugagugcugggacuucaggccgguguucccaugccugcuugauacuguucuggggaucaagcccagaguuuguguguacuuggcaaguacucugcuaugugagcuauaucccuggcagguuuuugagaauuauauagcccaggcuguccucaaacucaguguggcugaggaugaccguaagccucuugccuccaucucccuguguuaguguuucauagcccucuuagaagugucucucuuacugcacaggccucucagccaaagcgacaauucauccaucuucccacaguaaaagagagccaggcuugagcaaggcagguaucugacaagaaaacucaucguucuaggaggaguuacaauucagugucauuuuuauuaacuauaugucuuuuuuugauucuugaauuuaucuuaucaaacuuuguuucuuucuugucuuuuuuuuuuuuuuaaauuggacaggccccuugcaaccuuccuuauuuacacgaucuuaaagauggcuagugagcugccguaccaagggcaucuucaucuuccaggcccuccuuucuccucuugagaugcccuggcucucgcccccucugcagacuuccagcugaauugagcagccuguuucaccgccccagcuucuuuaguacuugcccuucaccacuugagcacuuccucauuuggacgaaugaacugcuaggcguuuuuagugcauugacucuuacggaaaugugaaggaaaaccugggacaguuuauucugucaaaccaggggagccuucagggagggguggugugugagcacacuggccguggagauguguuucuguuguuucgucauguuccuauuuuuauugcuugauguuauaucaucaauuuugaaucuuaguuuggugacaaaaaucaaugggcagcaugcguguugauggugacugcugcuguugguugggcacaccucccuggagcugggggagucuucuuucuccauaugcucucauguauuccuuauuguccccacucagacuagcaaugaaaauggauaaaugccauguagguaagaaaacugagucucaaggaaaucgaauaucucccccccaguugacuuggccuuagaaauucuucguaaaauaaauuuucauuaaaaaaauuauuuuagauuuguuaaaauuucuggaguuucaucauccaucauuagugacuucaaauauuaagaaaauaaaaucagcagauggaaacuuauacuggcuuuagaaaauuaauuuugcuuuaaaacuaaaauguauuuugauacguauuuagccuauauaacaacagaaaaugggaaguaauugucaugaaauuaauaaaacuuauggcucaauauguuaaccuaauuuuaaagaaaauguuacacuuauuaauaaauaaaugauuaagacaagcauggugguccaugccugcaaucccagcacucaaaagauggaggcggacgauugcagaguccaagguuagcuuuaucuccauagggaguuugaggucauccugggcuguaagagacccugccuaaaaacaagagaaaauguguguuccgguaauccaggucugaaguagaaggaugucaaguuccagaccuggcuacauagugagauauuuccccaaaaagagagaggagaaaaaggagggaggggugagggaaaagggaaagaaacacggaggcagagaugaaacucaugcccuccccagugucucccagcggaauccgcacaucggaauuucuugaacauuucccuaguuugggggcauccgaagcuuuccuuggcuugaauucaaacuuuguggcucuuagcuauuauuauggguucucagacuacaaguucuguuggggcggaaaugggccauucgguguaaaugccagggugcaagguucugggcuacaaaucugaccagguccuguccccuacuggcccacaggugcaaaacaagcuugauggcugcugcuaugcugugaagcgcaucccuaucaacccugcaagcagacacuuccgccggaucaagggcgaggugacacugcuaucgcgccugcaccaugagaacauugugcgcuacuacaacgccuggaucgagcggcaugagcgcccagcggugccagggacaccgcccccagacugcacaccccaggcccaggacagcccagccaccugcgggaaaacaucaggcgacacugaagaacugggcagcguggaggcugcagcaccgccacccauccucagcagcucgguggaguggagcacaucugcagagcguucuaccagcacccgcuucccagucacgggccaggauuccagcagcgaugaggaggacgaggacgagcgcgauggcgucuucucccaguccuuucuguaaguguuuggggagagggccccuggucccuaacccaacgggccacaccagggguacucagagucccaguguguggacccuguuaagagagaagcaaacugauggaaacuucuccuucagggaguagccaaaugcaacccagaggaauuuuaaagauuccccauauccaaggcuggaagaaagaagcaggcgugauuuccaauacuuuaucuugauacauuuaagagaauuugucacagggcacugcuuuaaaucacagcuuccaacucuguggaccacuuaagagucuggauaacuaacuggccuugagacugaaaauuaugacccaagggcaauugucuuagcaauuuacuucauuguacucaguuggauagaauuuauuacaauucuuagccauuaauuacuuuguggauaauggagcucguucuuaaagaggucucuguuggaggcuggagagagggcucagugguugagagaguuuuuuacucuuucagaggaauugaauuugauacccagcaccuccaugacugcuagccauauguaacuucaaucacacgcccccuucuggccuccacaggcgcagcauacguauggagcacagacaaugcuggccaaacacccaugcauauaaaauaaagacuuaaauaacuaaacaaaaguucuguauuuagguaacagaaaagaaaaugcaacagcccaaucuguauugguguuguagaguaguggugugucuuaguuacugugcuauugauguaaagagacgucaaagccuaucucaaagaugcaacucuuccaacaagccacaccuccuaguccaccaacuggaggcaaaguauucaguauaugaaggagcuguagaggccauucucucucagaccaccccauguagagugcucgagcuucuuggauuuucuggugaacuaaaaagaaugucagcuuuuugcuagguuuguuuguuuaauauaucuuuauuucucuuuuuaaagaccugcuucagauucugacagugacaucaucuuugacaaugaagaugaaaacaguaaaagucaaaaucagguaaauauguaaguagaaguucccuagcuucccucagcgugcuauguaaggaaaugacaucaucgaauguuauaaacacaggcagaaugucagagccuuagucugguagguggauaucaguuuaaaaauacacccagucauuuaaaauacauccuauuuguguuuugggcuuuuauucacaccauaaauucauacugacauauagaagaaguaaauuggcaugccguacuuuuucacaugguggaaaguuucccggaggggcuagagagucggcuuagcaguuaagagcucuuacggcucuugcaggccugagcuuggcucccaucccccacaugauaacucacaacaccuguaaaccgagucccggggauccaguggccucugccuccacgggcaucugugagauaaaccaucuucuagaacaguguuuuaaccagguagugugagccuguaaugucuggugaguaaacauaaaggaccaccgcgccuuguuuuauuucugauguugugaacaagaggagagaaugccagaaugcaccuuacuuuuaguaaacguaaguuuuguugcuagagcuuguccuuugcaggggcuggaaagauggcuggaggggguggggggguuacgagcaugcacuguccuugaaaaggagcugagcccaguucccaggucaggcaggcaggucgcagcuccuguaacuccagugccagaugcuuacuagauguguacuaggugugaugugaagcaugcuucuccauauggcucauggcuuuaaaaacuugacaaauauucuggacccucagaucccauguagcccugcuuccuucucuggucaggaugcagagccacaggcuggugccucaaguaggaacggugagcugacaauugugacuaaauguggucuguaauagcuauguuacuuggaauaacaggauaaucccuggcauuuaugagcucacucacaggguguaaacauguagacacuguuugaagauuugaaugaauuagccaguaugguuuuaauaaguauuguuaauuaaaagccacuuaugccccuuugcuuucauuuuuuaauauaaaguuagcuacaauaauagcauaaguaaucuaaacugcuaaagcaaaaguuauauuugcuuuaguguucguugugcauuuaauuaucaggggcaucaaauuuaugcuuccaguuugguucaauuaaagacgacaucccaugagcauuguaauugauggguagaaaccucaagggcuuaauaaucuccacagacgcuucacaaagaguguaaguaauuuaguacuugaauccaguuauuuccaaaguagaacuuuuuaauuuucuuugaaaagggaaaauauugaaaaauguucuuccucauaaaaacuguagucaggggaccagagagcaguuaagaacaugagguguucuucagagcacugauuccaagcagugucugcuggcucacagcugccugggucucaggaaacccuguguccuccuguagccuccacaggcacuggcccucacacauacacacccacacacaggcaugcacauagaggcagaacuagauaagaugaaaccagaagaaaggcuuuaaaaccuaguacaaugcaucuguauaugcugcuguuugagguuaugcauaccauaugcacugccccauggaggcucuaguugcccuggggaggcuagagggcgcuggauccccugaaauguagaguuaggugguugugagcggccugaugugagugcugggaauggagcccagguccucugcaagagcaguaagcacucuaaaaccacugagcccuuaccauuuucugggcucuccagcccuagaaaagacuuuuuaaaagauauuagagagaaaauuaccuaugggagacaagcaaauuggccuugugaggaaggaggcugcuuaucacgugcuaugugaguggcagguaagauguguucaggguguagcucagaggacacugaaccuucugacagugugaagacaucuguuaacacaggcucacccuguauucauuccauccuucuuaucaguagaucucaaaguaaggccugagcaggagucuguguauugcacaucuuaccuaucuccuauggcucccaggguuguguguaagcucugcagaaucugcucacaccagacuuucccuuuaaguacuccaagcuccuaaaggguggugguuguacucugcucugcugauguccccuaaagcgauggaggccauugcacaggagacuggggccuuagacacaaguucuugaaggugaugaugcucuuguuuaauuucagcccucaguuugaguucuguguuccucuuggcuuaggaugaagacugcaaucaaaaggacgguagccaugagauugagccuucagugacagcugaggcugugcacuaccuuuauauccaggugagacgcugguggacagcuccgggauggagugccucucacugcuuguggcaguuauguuuuuaugauggacuguaagguuauggacaaaagagggcugauuggcauugcuaaagaguaauuggcaccaggcaaugauagcacaagccuuuaaucccagcacuugagaggcagaggcaggcggauuucugaguucgaggccagccuggucuacagagugaguuccaggacagccagggcuacacagagaaacccugucucgaagagaaaaaaaaaaaaaaaagagcaauuggccagggaagcuguaacauggaagccuuucccccagccuugaaccuguucuuuuugcaguguuuucaggaggcaccauggggcagcccuggacuuaggcugggcaagugcacauccuagaucuaccugucgucacugugugagcucagaugaagugccucaguuucccacagauuaacuaacuauugauacuucucaaccgugucugagucccgggaaugcaggagugggcaggccuuaacucucuguaugugcccuuucucuaaauagcccugugacgugggugggacucuugggaguugggcccugagugagaccuggaaggugacucagaaugggcuggggauucugaggaugaggaugaaggcugagguguaaaacagagcagcacuucugccugaggaauuucccacucuggcccuggcugggacccuaagcuaguuucacacauugaccuuagacuuaaaugaugcuacaguguuuucucucuuaauacaccaagaaagggugagacagagccccuacucgaauguguccaugcuuguaauguuuuucucuagauucaaaaagcauuuguuauucguguacaaauaaauccgaggacaucauuaggcuaauuagcuauucuuggaaauuugagauuggaaacaaucuuguaacauaauaacaucuuauugcaaucucuguuuucauguuugugacaaggguuuuaaacaaaaaaaaggauuuuaaaaacaagcagccagcauagcaugcaagugguccuggcucaaucccaccgcgggggacuggggagaguguuauagugccugcuaauauuauguauaucugcccuaauauauucuucaguauucuugguuauuaauauuauuauuaaacacauauaugcuucuauagguuuuaggggguguuugggugcuggggauggugcuucgugcaugcuuguaaugugcucuaucauugagccaauucauaugcaagauggguuuuuucauacugucauuuguuuuauuuuuuuagcauuaaaaaaaagguagcucuuuccaagacuuuuuaaaaucccuguuauaaguuuuaccaugagugauuguauugaccacagcuccccuccuuuauccugagccuucgcugugaucggcucgaccugguuuguucuucucuguagauggaguacugcgagaagagcacgcugcgggacaccauugaccaggggcuguuccgagacaccagccggcucuggaggcuuuuccgagagauucuggauggauuagcuuauauccaugagaaaguaaacuuuauaacgucucaugucucauaccucucuucacauaaauuguucauuuauguugcaugauuugugcauguguugugggaauuagggauacacuccccauguacuuguggauguagguggguuggaugagaacagccccacaggcucauauuugaauccuuagucuccaguugguggaacuguuugggaaggauuaggauguagggacuuguuggaggaagugugucacuuugagguuucagaauguaagcucucagcuacuguugcagcgucaugccugccugccugccugcugccguauucuguacucccagccuugaugggcauagacuuuaaguccaguuuaacucuuuuuuucuguaaguugccuuuaucaaaagaaaaguaaugaaaacaggugucuucuuuuguugcucuuuguuuuguuuuguuuuguuuuguuuugagacaaggucucuugcugcacacaagcuugccacuugagcuaagcuggcugcacagccagcccucagggucuguuugucugccaaucucugugcccagcuuuuauguggaugucgaguaucugaauucagguccucaagcuuuuauagcaaauacucuaccuacugaaccaucuucuggcuuacagaaauuauacaaacguaauaaacuuauauuaaaaaucaaacagaaaauggagaauaagcacacaaaacaaaacaagggaggaaacuauggauaugaucaaauagucuuuuacaauuauuuguauauuuguauauacgugugugauccagugaaugccacugugcacauguggaggucagaggacaauuuucuuuccuuuuaccaugugaauuauaugaauuaaacucagguuaucaggcuuugugacaaggaccuuugccugcugagccaccuugcuggucauggugucugucuuaucaucacauagccuaagagcaccaaaauauucgcucacugacccuuuacaagacguccacucuguaaggaaggcauuuggauguacaaaguguugaggaugauuggaguggugaauuaguuaacugcuuuggcuccugccgcacugguggcacacgcccugccccugcccaagagcucucuggauuccugaaugacagacacacacacaccgacuaauuuuguuaugccuugacuagcucaauggugggcacuucuaaaccucccugcagccagcacauucccccugcggcauuccugacuuaacaccucuucaaucuauguuuuaucuuguuacccuggcuccuucugggugcccucauuaucuuugcugcccaagacgccucugggcagcccuucugaggccacuuuccucgugccuacauuuccuccauugcucccucuguuccuucucugccugguccauccuauucccuucuucuggccgagagccuuucuuucuucuccugggaacauagaagucccaccucucucucucucucucucucucucucucucucucucucucugcccagccauuggccguuggcucuuuauugaucaaucgaaaaccaauuggggccagggcccuucagcauuuggacacgcagauucccgguuugggcgcauuagaacuaauccccagcagaugauccuuucgacguuccguguagggugagaaugugguucauacauacagaucugguucccggugaccuaaugcugugcuuccugggaaccuggaggaacuagggaucugccuagcagagaguaguggggcucaguaacuuagcucagcuguguguaggaauggcauuuuaaggcuagaaguuggcuguucaaggugaaggcucucaggccuggcuccgaggucagacagugcucaugucuuaaacauguaauuaucuaauguuggggcuuuuucuccucugccucaauuuuuuggaacuucaaaauguuuauacugugccuuguuaauauugagaagccauggaaucuacauggcauaauuugcaagguggaaaauaaaagggaauucuagugggcaucauugggccucucucugugcaucaccuacauacacagaggcacaaacaugcagcaaaccugugcuugagagggacgcuuguucucagagccagaggaguauauaccauaugguauaugccuuuguaccauacaaaagaccagagaagcguuuuuauuacauuuagcaucuucugcauagaacaguaagcaugcugagcccuuccgaggaggagaaagcaggauuccugugaugucaucauugagcuccugagagcugguggcauagaccugaacuguuagaacagugugccaggcucaugaaagaggcaaaacagggagaugucggugcagcuggaaugagaggacaaguccaggaguguggcaggcagaaguagugcaaaggaaaacggcagaggaaggagaguagggccugagcagagcacagggaaagccagcaggagucucuggggagccagggagcagagccuggggguugccccugcucaggaccaccagcagagaggucagaggucacaggacggacauuccagagaccaggaaguccaugggagaagacucauccaguggucaucacaacccucuuccuuuaaagucgggaaacagagugcugaguucugugugggaagaagcaguggauggacucuucauugucuuccaacagggaaugauucaucgcgacuugaagccugucaauauuuuuuuggauucugaugaccaugugaaaauaggugacuuuggccuggcaacagaccaucuggccuucacugugaguuguuuguuuguuuguuuguuuguuuguuuuauuuuaaauuaggcuaugccuguaaaugacuuggguaccuuaauaacccuggaaacacagagaugggauaaugaucuccuguucuccuuccaugucuuccucuacugugaggcaagccugaagggacagucugcaagugugucuuagguucugaaucuuagggauguaaaguuauugguuuaugaacaauguuuagguaaaaggcauaugaugcuuuaugaaauaauuuggcaguugggucuccuuacugggcauuugacaagcucuugcaucugaggaacuuuccacuggcuugcaaaaguaagucucaguccuggacaaacacuggcucugacacuacugauuaguuuagcauacagagcuaauuaaugugagggguaagaaacagugagaugagaguaaggagaggaggagauguguggccauguggaacaggaaacauuguagacccagugcuguagcacuggugaaguauuuaaucaguuaaacccagguguucaagaccaaccugggccacauaaugagacccccaucacccaaaggaaaauaaagacugcauacaacaguggcacuccagauggacccuagaaggucagugggaguguagcaggccaaaauccagggcagggcacaguaaaaccaggacaagaaucaccagcaugagcuaacagccaaggugagcagacucggcuaugugaacaucccauguucugacuggcugaaacugugaaguguagaaaagcugauguauaaagaggaagucuuuggaaauugggcagcuuugagggccagggcccuauuuaauuaucauaagcuagcuuuuaggucccaugaucuguaguaaguguagcucauuccaagacuggucagaaaaagaaaauggaauuuagauggugacaagauggaccgccagggcuaauuucgcagaugaaguuaggagcggagagugaggagguagaaaaaagcuggaagugaaaguaggugccuguccucccaggacucagaaggcagaggcaggaggaccacaacaaguucaagaccagcuuagguugcauagcaaguucuaggccagucagagcugcagagugagacccugacacccaccacagcaaagaaauagaagaggagcaauaaggacuggguccugagcagagcagauaaaguguauugagaagugcugaaaccaagcccggaugacauggugagauguuguccccaacuaaagagcucagugagguguugggaguagaggagaggcucuacagucucagcaagcugcacacagccuuaucccugcccuuugcccaggccuugucagaacucaugcgucggcuauaaaaugugugcauuugggaccugcagcaaaggagaacaaaaggcaagcgacagcacccggaacauguccuccugcaagaccacaucuccuaggccucccccaaauagucagcaacuagagaccaaguauucaaaugcccaagacuuaugaaggauaucccauucaaaccucuagacuugguuuagggugugaccauuagagcugugugaaagagggcaaagcaguccagugugugcuucagcaagggacaauggggccaaguuagugaccaaccuuuagggaaaaaaauagcaaaacugacauggaagaggcuguaguacuaggaaagguagagcaauguuugucacuguuuuuaauucucuugugcuuccugauaaacagccucuauuccuggaguuugugggaugaacauaaguugguuucucuaagagucuggguauuucaguccugaagagagcuguccacugaauucauucuccucuugcuuucucuggguuuccguugagcccugcaugaauggguuaacuaaauauaaaaaauaaguaaauguguuaagucaaaaaaccagguaauaauuauucuguggucccuguuagcuuuucagucuucacuuagaaacaggugagccauugccaugaacugcuggaaggcuuuaauccauccucgcuuguguuuaaucuguaugcacuugugauuaauccaucuucacuguguucuaggcugaagguaaacaggacgaccaggcaggugacggagugauuaagucagacccuucagguaagccuuuauuucauccauguguuuaaaaggagaccauaaaacuucucaaccugaaaucugccuuuuacuuauaaagacuuuauucugaagcaaauugaaauuauccuuuaaauagucuuuauggaaguuuaagguuuuuuuccuuucgcuauguuaauuauucuuaagaagcauaagcucugucauuaguagaacaacggugaugaugguccccugggggcccaaaguguuggugcuguaagguuaccucaaacccagccuuccuggggcuuuauccaguccuagccuuccuguguaagcagaggccuguaugugaggccguguggacagucuaggguguacaaaaucauccguacaguguucacuuuccuccuggggguagggggauggcagauaacagauccagcccagccucacuuuuauaaagaagcucuuuuguucugggccagcgagacagcucagcaaguaaaguugcuugccacugagccugaugaccugaggucagccucuugagcccacagaguggaaggagacaaugaacucccacaaguuguccucugacucccacauacaugccacagcguccacacauccacacaaauaaauaaauauaacuaggaguuaggaggaagcccuuugguuuuaaguuuacucuaucuggagcuagggguguagcucacugccccucaccggcaugcacaaggcccuggguucaguacugagcacugugaaacagcaacaccaggaauaacuuagucccuggcugaaaugcuucccuccuuuccuccauaggccauuugacuggcaugguugguacugcucuguauguaagcccugagguccaaggaagcaccaagucugcauacaaccagguacagugugugugugugugugugugugugugugugugugugugugugguggggucucagaguaagugacaagugugaccaucaggacuguaccauguaggguuuagugaccagcugaaguaggaacagucauucuaggcagagcaugcagcagugccccagggcagcaacggaagcuggcaucguugcugcagaaguuggcaguuccucuauccauuaggacuaugggagcuagccucuaugcuguuccccucccccgucagguacauagggaacaaggcagccaccggaguaacagcuguguacaggaggucagagagcugacccagugauggcgaaacccauguugagcaggaagcaauggaagagaaaugcccuaaauuaggaugaggccugugaagaauggaacugaguagcaaggcaguaguggggccuggcaggcauucagaauugcuuucuucugcucugggcauucaacucuaagggccuugcacauucuaggcgguacuccaccaucaagcuacguccugaaacucauacaaggaugccauuuagaauaaauaauggacaaagauaagugagggcuagggauguggcucagucgguagagcacuugccuggaaagugacaggcuugguccuaucaguagcacugacaagcauggauagagccugccaaagaggggaaaggcugaaacaguggaauagcaagcaucaaaaaagggucgugguaaggugaaugcauucuguacaauaaguuuaaacagcgcaagagacuagaucucaaauguuauuaccagagagagggagaggaggugggagggauggcagcugugcuagcagauagacauguuagcuucacugugaucgucauuucucagugaaaauuuuggaugauuugcuuuuaaaauuauaggucuaaaaacuuguuucagaacagaucuucguauuucucaacuaaacccccaagcuccuggaaaugccauuuugauaucagaacucucuaaaggcaauuucuguuuuccccacagaaaguggaucucuucagccugggaauuaucuucuuugagaugucuuaucacccgauggugacugccucagaaagaauuuucguucucaaccaacuucgagaugugggugucagauauauuugaugaauacauuuccaguauccucagugucguauggagaucagaacucaaggacuuuuuccugauauuuauaaaauagaagaggcuaucaauuguugauuuaaaaaacaaaacggucuuagccaguagcccaggcuagccugaaacaugagauuccccucucuuauccuucugaaugcugggauugcagugcacggccccaagccuggcugccuccucuaauuucaaugacucauuguccaauucaugauaagcugaucaugcugucguuuucaguaaaaugucuuugggacaaggagugucaccucauuuaaguugccagcauagugguuuuaguaacuaaauuugucagccuauguuguccugugcucuaguaagagaaaucacaccccugucaacaugcccagugaugaggaacaguuugguuuauuugaggcgagccagccuaggcuacaugacauuccagaccuuaucuucucacccccuccaaacauaaagguuuauauuggauggaucugguuuuguaaagcaaaucugaaugaccagaaguuaaaguggaucugaagucuggagccaggucucugugguagagacuuugcuaacccuggcacacacacauguggcucucagcagucacuugagcuguuuuucccagugaaauucccacucauguuuuugagauaaacccuuccucaguugcuguuugugcucauaggggugaguguuacagggagcccggacaagggugcccaugacaauggggcauuaagaaaguagaaaguaaagucugggcaauuuggacuguuacucaugaaacaggucuggagagccuuucucauccuuagggagcaaaggcaagccuaaguauuuguuaaguuaaaucacauagaacaagccaggcauggaggggcaugccuacagucccagcauguaagagagacagagcaugaguucaaggcuagucuggacuacacaugagcaagacccuguccacauggcacuaauagaccacagcagacaagugaguuagugaacacacugagguugcuccugagucagcaguguacacacugaggauguuccuaugagucagcagugaacacacugagguuucuccugagucagcagugcacacacugaggauguuccuaugagucagcagugaacacacugaguauauuccugagucagcagugcacacacugaggauguuccuaugagucagcagugaacacacugaguauauuccugagucagcagugcacacacugaguauauuccugagucagcagugcacacacugaggauguuccuaugagucagcagugcacacacugaggauguuccuaugagucagcagugaacacacugagguuucuccugagucagcagugaacacacugaggauguuccuaugagucagcagugaacacacugagguuucuccugagucagcagugcacacacugaggauguuccuaugagucagcagugcacacacugaggauguuccuaugagucagcagugcacacacugaguauauuccugagucagcagugcacacacugaggauguuccuaugaguuagcagugcacacacugaggauguuccuaugagucagcagugcacacacugaagauguuccugagucagcagugcacacacugaggauguuccugagucagcagugcacacacugaggauguuccuaugagucagcagugcacacacugaggauguuccuaugagucagcagugcacacacugaggauguuccuaugagucagcagugcacacacugaagauguuccugagucagcagugcacacacugaggauguuccugagucagcagugcacacacugaggauguuccuaugagucagcagugcacacacugaggauguuccuaugagucagcagugcacacacugaagauguuccugagucagcagugcacacacugaggauguuccugagucagcagugcacacacugaggauguuccuaugagucagcagugcacacacugaggauguuccuaugagucagcagugcacacacugagaauguuccuaugagucagcagugcacacacugaagauguuccugagucagcagugcacacacugaggauguuccuaugagucagcagugcacacacugaggauguuccuaugagucagcagugcacacacugaagauguuccugagucagcagugcacacacugaggaugcucuguggacacuuuggggagcaaucuguauuuuggaaagcaguguguggguagcaguugcuaaggcauagauggaccgaggguguuucugcaugcaccuuagcugggauggaccuagauguccuugaggaagccccuuucuguaaucugaaauugcuuuuucaauucaggaauauguaaacuaucgguuacucuuguagcugagguccugcucaucagaaaagcagggacucagaggaauuggaagugggauuuggaguuggugcuaacugaauuugcccguugcuuuuggcuuguuuguuucuaagucaggccuuaugcagcagcagcuggccucugacuuggcugugucugaagccaccugugacccacccaccuccgccucuaccucccaccuccucuuagguugaugauuuccuggaaucuugccuuucuucaccauguguuucacuaaacugcuuuguguuucugugcaacccuuacacuuaauuuauuccuuaugcugacuuuuauugacaauuacagucauggcaaaaaucucuuauuuaaauuaucuuuuauuuaaacuuaaaggaggugauuugcauaacggaggccaucauuuggguaacguccacauuaauagacuguguacugaagagugagcacagggcguggagaaggugucauguuagcaaauuuuaauuugcucuuugguuaucuuacugugcugaauaaaagcuuugccucuggcagccugccaagcgcuugcugauuugaauauaauacucuuuuagcccacaucgcccaaguuuccagacgacuucgaugauggagaacauacaaagcagguaauuugcugaggcuuuaauugcuggucugcagccuuggguuuuaauuacuguuucucuugguuuucaauuagaaaucuucugccacucguucucuuguguucacggaacaccguggggaaaauagcaaaagauggaggagcucuuaagauguuacuaggcuugaaaugcacuauaaaaaggccagggucugaaagcaaauuaacccacuccagagcucuuuguguauucaauugugccuucaaguguuacuuggaccgcuggcuuagcugggaagaaaugcuuuuacagcaaauugcuuuagauaaaacuuaggacauacaggcaaaaaauuauaaucucuguuuuaugggugaaguaacucagguuguacagaaaggacuacacuuuccaaguggucugcuguuagaaggucuugggauuauuugguuuuauagcacgggggaaucaaaccuagguccuccacaugcuaggcaaguauuccaccacugagcaguagcuguuacaguauuucaagcauggacauuucucacguacaccauagcuaucggggacaggggggcagggagaugguucauccuacgcuaacacuagcacccaaauaacaugagagacccuaagugagcuguguaccauucucugguauuccuuucuucuuucugauaguuguuugcuguggugaaaccuucacucguuaauacucaggucauagggaaauuucuuccuuacacugacuguuauugacagugauagucagggcaaaaguaucuucuuuaaacuaucagcauugagaacaggaacauaaacagagcaugucaacauuugcaacuucuuauuggcugcaugucugcauggccauuccacugcacaucuauaagaguuagggacuguuagugucuuuuuauuucuguuugaguaagucucuauacuucuaugguguuuaguaugacacuguuaaaggcuaacagggcucauuuggccaccucuauuuaauuaguaaagaaguauuagaaaacaggcuguuaccuguucuauuuaucuuguuagcugcuaucuuccauuugaauuagucauucgcugaauuuuugagugucauaacuauaaauacucacuucauagauagggucucucuacauaccccuaguugucccagaacucacuauguagaccaggcuggccuugaacucauagagacccaccucuguuuccaccacacccaccagaaggguauuuuaaagauacauuagagauaucuuaugaaauccaucuaaaaauugaaaauuucuguucucaaauauucugccaauuuuuuuauaaauucuuuuucuaagcuacagaguuaagaaucaugaaggaacaggugugauggcacguaucuuuaaucccagcauucaggagacagagguagauggaucucuuugaguucaaagcauggucuauauauuuauuuacugaguagacuguuuaaaaagaaaaagguuuaggguaccuuuuaaaggcuugugcugcuucagagggcucuccacuauggaggcauaacaaacaguguaaagcaagaggauuccagggaauagacucaguaaagaaaaggagggagagcgaggaccagugugcugugcgguagaggugcugcugugugcuuauguaaguacuaacauuaggcaugggcucuaugguaaugucuagauaucuccuuuuuauacaguccuuuguagucauaagacuaagcucagcuuucgugugcuuuguuaaggauauguuugaucguuggugacaaagggaccuuucccuuucaagaaugcuccaguuacauucaugcccaagucacagggucaugggucacuaaauggcauaaucagagaucucggaagugccagcuaagcauaaaaagugcccugaaugaccgccuaucugaguuucaucugcugucuccuuaccaacuaugugccugucacguugcagaaaucugucaucuccuggcuguugaaccaugauccagcuaaacggcccacggccauggaacugcucaagagugagcugcuccccccgccgcagauggaggaguccgagcugcaugaagugcugcaccacacgcuggccaacauagaugggaaggccuaccgcaccaugaugagucagaucuucugccagcacaucucccccgcuauagacuacaccuacgacagugacauccugaagguggcugagucacacauagcgggcacuucucuuuacucuuugauaguuuuuauguaugucuaugauacauucugaucaaacucaucccucugcccuuucuuaucuuccucccacuccuaauacccuuucuccuacuaaaugcuuaucuaaccuccaugucuuacauuuuuauagguuuuuuaaaauaacauuuuauguaagggggugggacaugcacaugucaugguacacguauugcggucaaaggacaacuuguaggaauuauuaguucuuucuucccaccaugugugccucagggauugaacccaagcugccaggcuaggcagcgagugccuuuaccugcuaagccaucccauguucguaucucuuuauuuuguucggguuuuaccuugugauauuccgggucuaaccagcuaucccugcgcuguaaguucuuggcuuaaaucccccaaagccccaaaagcacaaagcaugcacaaagcaugcacaaagcaugcacaaagcaugacugcuuaguucagggaagagccaugcuaguaaucacuuauugauuuugacccuucccacuccaugcccuuccaagagacugagagacagagcccauuucagauuuccaaccugggacacccaaggggucagcucuguauguggaaacaauggcucccagcaccggccaaggcccaggaagcccagaugcagggugcccuggcuccucagaugcaggaugcccuggcuccccagaugcagggugcccuggcuccccagaugcaggaugcccuggcuccccagaugcaggaugcccuggcuccucagaugcagggugcccuggcuccucagcagcucugcggccucagcugggaagcaucuugagucucuaaaagcuuccagaugguuucugaagaguugucaaggugccagucuugguaaccuuuauuauuucauuucuaaaaguuaaaacaaaaccaaaaacacagaagcaccugaaauaauuuagagaaauguuuuguuuuucuuuucuuuuauuggauauuuuauuuguuuacauuucaaauguuauccccuuucccgguuuccccucuggaaacccccuaucccaucuccucucccccugcuucuaugaaggugcuccaccuacccacccacccacuccugccucccugcccuggcauuccccuacacuggggcauugagccuucacaggacaagggccuuccgccucccauugaugccugacaauauaugcggcuggagccaugggucgcuccauguguacuccuugguugguaguuaaagaguugagugaguagguaaccaaggcuggccauccaugcugucuacuucuauauaguuaagcugugguauaaucuuagaagauggaauuuagagaaacuguagauuuuaaguguauaugaucaugcacaccuguggccuugcaaagacugaagaggauuguggccaggcuagccugggcaauacaaugagacccugucucagaaauaagagcagaguuugacugucuaauaagaaucagaucuguuuguaagacuacagguaacuuuauuuugucuuuuugcuuauuuuuuauuucuaaaauuacuauaauaaaauggaaugaaaaggaaacaccuuaagcaaauauccaugucucucuaaauguguucaaagagacaguugcucaagaccucugcugagauccugacccugggcagggcagcacccagcacaacugcagacgagcauuuuagaggaacucuugaguuaggcuuugcugaugacauuuaaucggucucauuguagggcaacuucuugauucguacagccaagauccagcagcuuguaugugaaaccaucguccgcgucuuuaaaaggcaugguauguccuucucugaaaagcacuccucuggcaguuuucuaaaagucauuagaaaguagagugcuugcacacaagcacagcaaccugagcucaguccuuagcacccacugaaaaccccgccaugccagcacacaucuguaagcccagaacugggacagggccacagagacaggaagauccccaagcucgguggcgacagccaacucaggaagcucaggcucagugagagcaacugagacaccuggcaucaaccuguagcacaagugcaugcauacgugagcaagcccaugcacaugugcacauaccaacacaaaauuauaccacguggguauacacacacagaagaaagaaagaaagaaagaaagagagagagagagagagagagagagagagagagagagagagagagagagagggagagagagagagagaagaaagaaaagaagaaagaaagaaagaaagaaagaaagaaagaaagaaagaaagaaagaaagaaaagaaagaaagaaagaaagaaagaaagaaagaaagaaagaaagaaagaaagaaagaaagaaagaaagaaaagaaagaaagaaagaaagaaagaaaggaaggccagguaugcuguacaagccuguaauuucagcacucaggaggcuaaggcaagggguuugaagccagcugaggcaauauagugagaccagucucaaugaaagaaaaaaauugcuauugguggauuuugguaugacuauauauuaaaauccauugauaagcaguuggcccagcuuguugaggagaaacuguuugauuaucccaaccuugcuacuaaauacgguugacucauggaguccaaagucugacuaaaucaacagacuuagcccaggucagcuuuccauguaucuauccaucuggaacauuauuagccaauauugggagccaauguuggcucucagugccccagcggcagcucacucaccugugugcuugugugcguuuuggguuaagaaccugaggcucagcggcucucucuguauuuugguauaggcgcuguccagcugugcaccccacugcugcuuccccgaaacaggcaaauauaugagcacaacgaagcggcuuuguucauggaucacagcggcaugcuggugaugcuuccguucgaccugcgggugagcugggaugcugcuccguuaaagacucgccccucccagacacccccacuucagccuuauccuggggagccacauguaggaaauaccuaaucagaguaaaggcaguauuagaguucagcaagugucugaccccauauugcagugcugagguccacagagcacccuacagcaagucaaccucaacucagacagaggaaugucguucacucgccagcuagcucuucaguaaaaccccaaaugucgcugucuagagaaagcaauguuaaaacagcuaauggcuaugcugaguuuuguccauguucucuuucuugugauccccaaagcuuucuuagccagcaacaacuuuagucuuucacagccuuaacugcuagcaagcccacccaccauuuuccucuagaccugaggaaaacgugcagugaguaugagagucgggguucugucccuaaugcacagaaggcacuugcaaccaaacucgaggagagagcauguacuuagcaugugcagugcccugggugcaauccucagcaccaaaacaucuuuaaagguacaaauggaggcauaaaggaagcauacggccaggcgguacauagacaggaaaugaguaacuguuugagguuauggcaagauauaugugcugugcauacauguuuaacuuuacuuggaagguacaaaaauguuuauauuauucagagaugaccagggcuguugagacuacuaauggcuaacuuuuuagaaaaguaauaaaagaaugaaaugaaugaaaauuuacaaauuuauuuuuuuaaaaaaaugucucuauguguaucuauguaagugugugcuacaugugugcacaugccuaccgaagcagaggagggcauuagaucccuggagcuggaacugucagcauuguggaucaucccucaugagugcuaagaacagaacucaggcccucggaaaagcaagaagccucuuaaccacuaagccuugaaauuuuucaaaauuugauucucauuccauaguccaugaaaugacaguuccaccuuuaggguuuuuuuuuuuuuaaguaauacaguauaugaaucuuaaaaggauguuuauguaauuguaucaaaaaaugaaacccaucauguuuaucuauaggagaaugaguaacuauaugucaugauauuaaggaauauuaagaagcuauuaaaaauguagcugggcauaguggccuacaccuguaaucucaacaguuggaaguucaagcaggagaaucacaagcuugaggcaaggccacauuauguacugagacccauuuuagacaaauaggggagcuggggagaugacucaguaguuaagagcacuuaaugcucuugcugagaaccuugauucaguuccuagaauccacacagaguaguucacaacugccuauaacuccaguucugggguaucugacacccuuuucugacuuccguggacuugcacucugggacacacacauacauguaaaguaaauuuaucaaaagacuacagcuaaacuugucuguauaucaaauauucauauauguaagggugaauacucacaccuauuaguauaucuuaucuguaaacauguccauaauauauugauagcuuaagaaaaauaaguucugaaggaacucuaaaaucccacuuuuuuuguaaagaaagguuucuagaacugagagaaacuugggcgugaaugaguugcuguauguguugcacgcacuugguauaugugaucaaugaacucacucuuacucaugggugagccaccaugcacaucagccugucuuggcaucuccaaaaaguagggugucagggaguaucucaaaguccuaggaggaagaauacaaucaaggcauuugccuuuuugcuuuucuuuucuuuuuacuuuuuauggcuuguugcaaaacaacuuuugcuuuuaagauguaagagaauuuuuuuccaaauaauuaugugcaugugugagagaaauguggggggagaggaagcaagggagagagaggaagggagaggggaggagggaggggcacuacucaugggugaggggugcucggaguggagcgcaggaccucauuuauaggaaagcaaggauucugcuggugagcaccacucccagccucugcuggugagcaccacucccagccuuccuucuguauuuuuggcuucuguuuuucuuuuaaauaagcaaaguagcuuggaauuauugcuugacagaggugaauaaacagccuaucaccauugggcuguugggaaaagaguagcaguccggaggacacguagcugcacugauuacuagaggguacuaggggcggggcguuaaacaugagcucccuuuccauaacagaauuccuugggccggagagauggcucagcagcugggagcacugacugcuccucuagaggacccaaguucaauucccagcgccuacguggcagcucacagcugucuguaaugauaguucuaggggauaugcauaugcaugcagacaaaaauaaccauacauaaaauaaauaauuuccucuaagagaccgauauggaacucaggaacuuaauucaccauaagagaaagcacucacucauuuugacuguuauuauaaaugagaauuuuuaaaaauguacuaaaguguaugugagagaacgaaaaagaauuguguagaaaugugcauauggaagccaggaaacagcuuugcccggcuggcacaccagagaccagcccaggaaggagaacauuauccacgauaggcuaggccucuccugaaucaaacaucaaucaagaaaauggcugaaccuguguccacugaaaacuagccagcaugcaugacaagucuuacuacccucuaagccaucucucuaauccauaaacuacaucuuaaaaaucacaauaaaccaauaaccuaugcauauuucaaaugagcaugauaaaauaugaccauguuuucaacaaaaaaggaagaagaauguuucgcagcccucagaaaugcagugagcagagucugcaguagagccuacugcagcugaagcacacacgagcaccccagugugcgugcucucaggguacggucacgugcugcuuaauggcuaggguauacuuuuuaaagaaaugcaucggcagcuauuucaucauugugcugacaucauagggugugcuggcugggcaguugguucugaccucacuauuaagugggugccugaccuuaaagugauguguggguucuagcccagcagagcuguuuuaaaaucgaaaagaauguaguacuuugcaccucaugaugugggucuuuaaaacuuucuucuuucaggucccuuuugcaagauauguggcaagaaauaacauacugaauuuaaaacgguaagguguauugugcacccugcauuugguagaugugggaaugaaaucagacaaaggugggugggagguuuuguuuuuuucuucugaaacuuucauacaggaaagaauucugggguugaaguguugagcagcaugugucagggagcccagccccagggcucccuuguccucagaugacuagaaugucauaagacaucuuuagaagaaaugaagcaaucaugucuccugacaggccugcuguauauucugugcuuucuacauggccccaggcaacauaacuaaugaugcuuucaaauaguuacuuggggagggaggaucuggcuguuuuugaucucaaauggcugcuuuuaagguuuaauuggagggacaaauggccaguggucucugugaacuccuuaugcagguaacuaaaugaaaguuccuuguaaagaauggggugauccagcaagaacagccagugccgagaccuuggcacuuggcaacaaggguagguucagauacugcaggggucagacucucagaucgucaucaauuacaaccaaaaugcugucaguggggcacaccaugucacauuucucucucuaugcucuaugaggccacaauuaccagucaguccuaaagcauggacaguucuguguagaaagccaucacuuaaugucauuugguguaauuucuuuuucucuaucagacauauguaaaaaaaaaaaaaaauuaacaguacaaggcuggaaccugggguauagauuaugaggcaaaauugguuggguucaaaccugacuuugaacugucaaagcacaacacagauuuuuuuuuuaacuucauuucuuugcccaacaauucuucauacguauuuauuuccaauaagcagcgaucuaagaaagcugguuccuuccuccagauacugcauagagcggguguucagaccucggaaguuagaccgauuucaucccaaagaacuccuggaaugugcauuugauaucgucacuucuaccaccaacagcucucugcccacugccgaaaccaucuacaccaucuaugaaauaauccaggaguuuccugcacuucagguuccuucccgcucugucacguguugccuuguccugcuagcggaggcggagggacccauacccacugcugccucuugcugagugcuggagcagaucauggcuuuucugaagcaacugcagaguuugagggugacgcuuugagcuucaucuuggacucgggcuucuacccugacagaauugguuuguuggggggggggggugggccaaguuguucucuacccauccuuacaacguucaggaaugaggcugcuuccuaccaugcccuuggcgcacuccugcccuggugaggaccucggugcucccccucaucucacugucaacuccucagugucccuucccaccagcucuuccucuccagcucuaauggggacugcuugccgcucuccucacaggccugccauccccgcugcuggucacggauguuuacauucuagaaagucuucucucauccagccaugggucagaccuucucccgggaagccuccaggguuggcuggcuggucacacuuuagucuccacccucacagcucuugacaugaggcagcuaugugaucauuaauuuuuuuuuucuccaagcacagugugcucauucaagguagagccccugggccacuccucccuguagacagcugucccagcacaccugugagcacucaguaacucacugcuguggccaaagggaaugaugaccguuaacaaccuucugcuugccagucgguuaccacugaucugacuccuuguuucuccaucugugugcacucuuuuaggcucuuuaacuuaguugaagaccaacccguguauuuuuaugaauauuauaaaaguauuacauucuucaacuguaacauugaacauaauggauaugaaagauaagccagacuguagugacaauugacuuuaaucccaguacucagaaagcagaggcagauggaucuuggugaauucgaggccguccuggucuacaaagcaagcuccaggacagccagggauacacagagaaacccugucucaguagauagaugaauaaauggccaggaaagaaagaaaaaugaaccaggaaagaggaugcuauacuuuagcucuccuguggugguaggaaaauaaauuaauuaccagauuucauuuggccacauacuuguagugcuuuuauaaugaaaauaauaguauuuuucucucuauucuaggaaaggaauuacagcauuuacuugaaccauacgaugcuucugaaggcaauacuccuacacugugggaucccagaggacaagcucagccaagucuacgucauucuguaugaugcuguggugagcacuuaauuucuuugacucgauguugaaggguaauaauaauacuagcccaugacuauucucaagcaaccauaaaacuacauggagaauuucaucucucuucaucuuugcucuacugugacacaagcaauuguguuuaagauuuauuuuuauuguuccuaauuaugugacugugggggagguaacucuguggacggucugugguuaaugcagagugaauugggacuuucauuauuguuauuuuuuuuaauacagggaagccuugccuaguuuucauucagauuggcuucgaggguuccgacuuuacuggcuguuuucuagggguuuguuucuuccucacaaagugcugcugcuguugggccgugcuggguucaacagaaugcagauggggcacuggcagaauacagggacugggagggaaggcuggaggucacguguauugcuuuuguuuccaggagggcuucuggguuuugagacagggucucacuauguuuaccaggcuggccuugaacucacagaggccugccuuggccucccaagaacuaggcaucacucauguucccuuucucuucuccaucagacagagaagcugacuaggagagaaguggaagcuaaauucuguaaccuguccuugucuucuaauagcguaaguaccuucugauggcgugcuugccacugucucuaccauuuuacgaugucagaaaaugucacgacguuucuguagcagugcgguagcaagcaacacacaucugcugcucacagaugcagcuucucccuugaguguuggugccauggcaaccacugggauuggaagagagagacuggugcugugaucagaguguguccuucuguguguccuccacaugcggagucccgcucuuccuugauuacuggguucuuucuuucacaucccuuguaaagccugugcuugauacagccuccugcagagcaggcucagcucuacgaugccucuuccaaaacaagucauguggaaccaggguauagauuucugcaaauccuucuaaacagccuaagcucacccaaggucuucuacuguucagaacagaauuguggcucuuaccuuccuagaaaauuuccuaccucuaaaaucuucuugguaaacaggccaacuguguucucucuacugaugucauuuaauccaaaucuuuggcacaauggcccacacuuaacagaauggcuaaacagcagaagaaaacagaauuuuguguauuuucuccauauuuuuuuagguauuuucuucauuuacauuuccaaugcuaucccaaaaguccccccaugcccucccccccaacccccuacccacccacucccacuucuuggcccuggcguuccccuguacugaggcauauaaaguuugcaaaaccaaugggccucucuuuccaaugauggccgacuaggucaucuucugauacauaugcagcuagagacacgagcucugggggguacugguuaguucauauuguuguucugccuauaggguugcagauccauuuagcuccuuggguacuuucucuagcuccuccauuaggggcccugugauccauccaauagcugacugugagcaucuacuucuguguuugcuaggcccaggcauaaccucacaagagguagcuauaucaggguccuuucagcaaaaucuugcuaguguaugcaauggugucagcguuuggaggcugauuaugggauggauccccagguugguuuuaauuuucuuuuuuucuuuuuuuguuuuuuguuuuuuguuuuguuuuguuuuuguuugguugguugguuuuucaagacaggguuucucuguguagcccuggcuguccuggaacucacucuauagaccaagcuggccucgaacucagaaaucagccugccucugccucccaagugcgccacgacugcccagcuugguuuucauuuucuuuugugguguuaaaaauucaaccuagagucucgcauacuaagcaauuacauucuucacuaaacccagccccaagaaaaaaauguuuuuauguuucaaacuuuuccagaagcaacugggcauggugauuuaugccuuuaaucccaguacuuaggagacaaagaccuuaguuugaggcuagccuggucgacagagcaaguuccaggauaaccagugguacacagaaaaacugucuccaaaaauuaaaaaaaaaaaaaaguaaguuuaaaaaauuuaaguagcugugcagugguggcgcacgccuuuaaucccagcacuugggaggcagaagcagguggaucucugaguucaaggccagccuggccuacagagugagucccaggacagccagggcuacagagaaacccugucuuggaaaacuaacuaacuaacuaacuaacuaacuaacuuucccagaagcuuuacagcccuuccuugaucucaaacuucaucccaugaucuuuggugguaacaaaauucacagguucaauaaacuaaaauaugauuguggacagggcaaguagagucgcuuacucccuagacaguuacuguauggcuggcacggugccuggacauagaagaauaagaaaggaucuucacaaauaucugcccucaacucuuugaaacaacuuucacagggcucacauagaccaugguuggaagaaacacccacauucauuuagggaagauguucuacuugucguucuguuuugagaugaccaccaugaccaaaagcaacuuggagaggaaaggguugacuuggcuuacacuuccaugaagucagggcaggaacugaagcagagacaugacgggaacccugcuuacgagcucgauccccauggcuugcuuagccugagagaggcaguuccuugauuggggaucccuugcccugggaacucuaguuugugccaagaaucugguugaagcuguccagaucagugacucuauacccagaaguuucuuugaauuaacgccauauuugaaaaugucucauagauaccgugcuaagauacuguacugcugcuaagauaucgacaucucuuugugaugcugaacaagaaguguauuugacuaguuuuaaaagaaaaaaaugggaucuaaugacauuugaaucuucauuauuuuaaaauggugccccaaguauacuagggaaaugggggaugaggggcaggaagguucguguccagccccgucuuaguucacagugacaucuugaaacccaggaggcacugaguuucauccaguuauguggauacaaaagcucccucauugcuccugccagguauuagccagguaacuucauggaaaagcuauugggaaaaaauguucucuuauuuugaacuaacuaaccuccucacuuccuuuguacuaggaaucaaacccagagcuccaacuaccugccacagagcuacacugccagcucuaggaaggaaaaauuaagucgaaagucaaaaacaugauuuuguauuuaaaccuuuuuaucuuuaacuuaguuagaagauuacaaaacagccacuuugcaguacacaguggcacacaccuuuaaucccagcacucgugggacagagucaagagucaaacagauuuuugugagugaggccaggucuacuuaaggacuucuagggcuacauagcgagaaccugucucaaaaauaaagaguaaaauuaaaagggagagaaacuaacucuuugggauuuaaagugcaaaugacuuaugguuaacugauuacguuaagcugagacuucacucagcuccuagguuuuguguaccaaccuauaggugggccagauacugccuacauacaguguggcauagcuggaauuuuggucugaucuccagcuuggcuccugguaguuuucucuugggcacuguguccauaguuacuccuccuuccuccugcugcaugcuggggacuggggucagccagaguuugccguccccagcacugcuuuucucaggagcagacauggcagacacagagugacugagggaauaggggcuccagagguggugcagggggaggcagcccugggcuccucguggggauuacucgggcaaggggagagaagaguucccggcuaauucugugaauaucugaacaagucuggcguggccugccccucucauuugugcaccugcaguaaugaaaaugaggguguggauggaggaggggaucacgguuuacaguggggacaacgcacagcagaggcucagccaguguccaguccacugccaguacuuaccacuaaguacaugucugucugucucaaacauucugugagcugcuucagagcagaauuuggggggaaaggauacuguguaggacuagcaaaggcuaggauuaccugugaccacccaaugcccguucuuggggcuacacagcgcccugcaggccccgcagcaugcggaagcacugugcaugcugucccugucccaucucggagcagcagcugugcaugcugucccugucccauccuggagcagcagcuaacugugccucuuugcuuuccagcuguguagacucuacaaguucauugagcagaagggggauuugcaagacuuaacgccaaccaucaacucacuaauaaaacagaaaacaggcguugcucaguuggugaaguauagcuuaaaagaccucgaggacgucgucgggcugcugaagaaacuuggcgugaaguuacagguuugacagcuguucugugcuggcaguuugggccugcagugauaacagcggccccaggggauggggcuuauuucccuaauguuaguauuguauuucuccagagcucaggauuucuuugcaagcggcacuguuucuaucacacacacccacucuguggugcgugccucagagaggguguuacugucagagcuuggaggguuucuguaaacaguucuugcccgaucuuacugaaggguuuuguuuauggagaauaauugagacagaguuguaguccacauuccacagcugaggcugcugccccauauguguggcgauucccuccacaggucuccaucaaccugggcuuggucuacaaggugcagcagcacacuggcaucaucuuccaguuccuggcauucagcaaacgcaggcaaaggguugugccugagauccuugccgccgguggcagauacgaccugcugguaagggcaagccccguguguugacuugcuuuggccuacugcuaguuccucuaauuccucagcucauuccccugccaugaugcaaaaaguuaacccaguaaauccuaugggaucccuguagcauuuaucuaggaauauaaauguaucuucuugccucugcucccaagugcugagauuacaggcauguaccacgccaggcuugugaggccuugcuuuuuuuuuuuuuuuuuuuuuuuuuuaacuguugcuuuccccagaauauauuucuuuccuguuucauaaccuggccuccggucuauccacagauucccaaguucagaggcccacagacuguggggccaguccccacugcugucggugucagcauagccauagacaagauauuugcugcuguccucaacauggaagagccuguaaguccugaugcuugcuggcacgcuuuggggcauccccacuccucauguuacuuaccuaccuuuggagcacagccugccaaguuauauacucacucccacacuccaaguaaggaccagcacggcagcagccacccuccugaagacaauggcagaaccacagguugagagcucaguccccaagucggccccuccacuuucaaugccagguagaagcccuuuuucuuagagcaggacacagaacucagagaaacccugugucgaccuggcuuaauauaaccgacauuaacaugaagaggugaggacaugaagagcuuaggcgcuucaggaaugaacaccgagcccuguguggugcaccaucugcugggagccuccuuccaaagcacucugaaccuugcccuuugcuguuugguggaugcuucauuauauagcaggauugacaaugucaccagugauccacuuagccccuuccccucccagaacuggggcugugucugaaagcuccaacccuuuauccugacuuagucugcccaagggccaggucccucucccccaacuccgucucaguuauuaacauagaaagaccaucacuuugaagagucuaggauuuuaauaaucgggaacaaagggcacauagcugcuuugaagacuuaaaagcugcagcacaaguguuuuaaaaugaccuuuccugugaucaagccgaagaguugucucuuccuugcuucucagcccgugcccucugcucucuggcugcugccgauucaggcaucucuccuacuuaacucuccacaucuauaguacacuauauaaagauaaaauauucugcuuguuaacacacuuuugucaauucucuugcacaaaaacccagcuagucuacaaagcuuaaaaaaaaauggcuuuucccauuuuaggcaagaucuguuuucccugggugagggggugggaguggaaauguaucuuccuaauggcacaggacagcugaaauuaugucuguaaagaucuuuuuaaaauugucuuguuuucuguuguuucgcgaugucauuuuaaaccaaagccaucuguacugugugacuguucccaauuucaggggcacucgucagcccugggaugcugcucucaccccacagcugcaguguuccccacccccacccuguguaacuauguuuccuaucagguuacagugagcuccugugaccuccugguugucaguguuggccagauguccauguccagggccaucaaccuaacccagaaacuguggacagcgggcaucacugcagaaaucauguaugacuggucccagguaagggacagaaagcugugaaugacaugcagaugguuaugugaucaggauagaucagccuuucacaggcauggccaccugaggccaccugaagccauagggcccaaccauaacccuacgcuuauuuaaaacgcugagauuucuguugguuuugcuuacuuuuuguaacucaaugguaagucucucaaggugagcuuuguagaugauaaugguguacuguguaggggccuugguucacuuucucugacagaaaaaaucucaagcacagcagggaaaaugucagacacagcaaggcacagagagggagaagagagacccuuaccggaguggaggccucuggagccucacgucuggucuccuugaggaugggcguuuuaauggucuuugagcacucugugcccccuaauuuaggguuggucagguuaaucaaucaaagacagggaagcuguuugguccaaaacauuggguauuuguauggucuggccuugaacuuguuagaccaguuuacuggcaguggugcccuacugguagaagaagccugacaagccuuuaagccuuugucucaguucaggagugugagaaagaagcuggaaguuugccaucuuuccuauccguuuacccucugccugccauauguguccgccucucaggggucuguguaacuccacucccuguagcaaugucagaagguuggacagaggggcuagagagaugcuuaggugcccucgaugcucuuccaguggaccuaaguucuguucccagccccccaugucagguggcuuacaucagcaaguaacuccagcuccagggaguuacuucuagccccugcagguacauacacauauguggguaugcaccgaaagagacauacacacacacacacacacacauauauauauauauauauauauauauauauaauguaaaaacauuuuuaaaaaauuggaugggccugccagucuacaccagagucugucaaauaggguuuaucucuguggguggaguuaccucuugcguuagcaucugauggcuacuacaacagauggccacaaggccaguguguuaacaguucuguucuaagauccuggaagucagaagucaggguuaagaugacuggcagggcuugucucuccagaggcccgaggcaugggucuguuccuagagaccuccugcacuggcugggcccuuccuccuuuaaacucagcaguguggaauuuucuucccugaggaggcuucuucuucuuuguccucagugagacuucuguccuuaccuucucucuaccucuggcuaccucagccccugugauggcccagggccaccauugacagguuccagggacuaaaaugaggacaugcuguggccagcuugccacacugagggcacucugagcuugugugucuguggaucuguaagucaucagcgcuccuccugugcagaccugcuaucugcucuagcugugaggugaggaaagugucacccuggacaccugccugcccuucacaauuggaguugggagcuuuagauacccaaugucuguguuaucaggcaugggggaugcuuguacauuagcuacacuaauggcaccccagggcucugcaaugacuggaacccacaggccaacucucccaccaugagcuuucugcagcucuguguguucauauaaaaacuguugucaaguuuuuaaucauguaacuaaaaaggcaucaauuugcuugcuucauauguucuuagagaaguguucggguguucaguuuccggguguucaguuucuguuuugugagacaggaucucacuguagcccauccuccugccuuagccuccuccugggugcuaggauuauaggcaagaaccaaauacacagcuuaauucugcuuuguucuagcugauguuuuuuuauuccuuugcuuuccuaaaaugcuguguguguguguguguguguguguguguguguguguguguguguguguguguguguguguguguguguguuacagaacuuggcacauuuuguuaaggcuugaagccauugaaaaccucuuccugucacggcugcauuacuuguuugccauccuucaacacaaucaugaaaguagugaaagcacaagagaauuccuuccuggaauucugugcuccucucaauagcauuccuacccccugaagucagcguauuuaguaucucaccuugggaauacaauuagcagcaguuuuuucauuguccuuaaugacuugaaggggcuccaggcacacaguguccauuggucucacuguuuguuucagucccaggaagaguuacaagaguacugcagacaccaugaaaucaccuauguggcucuggucuccgauaaagaaggaagccaugucaagguaaagagggaaggggagggcuggagauggagcucugugguugagcacuuaucuagcaugggugaguuucuugauucagucccugcuaaaacuauacacacaggcacacacacacacacacauucaagaccauugggaaaucaauuagcauuuuccacaaacuguugccuguggaaccucuagugugcuucagcaugcuguuuucucuuuucucuucucucuucucuucucuucucuucucuucucuucucuucucuucuccccuccuccuacccccucaccccugcuguacuguuucuauguauagguguuuugccucaaucugugaaccaugugugugcagugccuacagaggccagaagagggaaucugacgcccucuucaagagcuggaguugcagaugguaguaagcugccacaaggaaugaagcccagguccugugagagcagccagugcucuuagccacugagccaucuuucccagccccaggcucuugucuuaggagagcugugccugccaacagcuugcuuucuggagucuuccuaaacaauuuuacucuguuguaccuaacuaaaauuguacauaaaccuaccacuucaugaccuuuucaaauauuguuuugaaagaaaaaauuguccuuuaucucucauucuccuuauuuucuccuauaaugcugucaggaugaguuggacauguguuuuaagaguuuguaugcaauaaggauugcaccucaaaugugugcauauccucaucauaaaaucacauggcccggcuagagguggcuugggggguaaaagcauguacugccuuccagagacccugugaguccucccagcacccgccucaggacucaacucccuguaaagccagcuccagaagaaugcaaccccuccagccuccucaggcaucugcacuagcgugcucauagcuauagacacauacauacacauaaauaaaaaaaacaaacaaggcccacacaggccuacauacccagcuguccaaccaccucuuucaggauaagcagggaacuguguaauaugagagccauuuuuuuuuaauucugucaucucuaacuauuccugaacaguccauguaucucagcaacaguuucaauguuuggagauuugguucaucauugcuguauccuugaccuuguaauaguguaugucaagauguuggagcacacuccacagcugugacaucuaaaaucaucucagagccugagucaaggccuuuaccaccaagccugaugaccuaaguccacucccaggacucccauaguaacauaguaaaaggaaaggcuccacuccugccaacugauccucugaucucagacagcaugcaugcagccaaacacaucacaaaacuaauaaaauaaaguuuugggcuuuuuuuugguuuguuguuguuguuguuguuguuuugguuuuucgagacaggguuucuucucuguguagcccuggcuguccuggaacucacucuguagaccaggcuggccucgaacucggaaauccgccugccucugccucccaaaugcugggauuaauuaaagugcuacuuuaaaaaacaaaagacugcuaaaugucuuccagaaagcagaauccuccccaauuaagacccacugacuccaaacuguugacccaauugcuucacucgggcacacugagcuaccauuuugguuucagaaacuuccaaaugauaaauuauuucauucuuuccaaggucaaguccuuugagaaggagaggcaaacagaaaagcguguauuggaaucggaucuuguggaucacguuaugcagaaacuaagaaccaaaguuggugacgaaagaaauuucagguaaauuuauaaagaaaacaaaguaauuuagcugacaauuugugaagccaaaacugagcagccccacccacuuauuuccuggugaaggccccuuugugugcaccauaacaagacagaagaaggaaaguaaacaccacaggcagaagaaacagauccauggaguggccugggcuugugagaacuuacucccuaggacaggauuaaucuccugcaguguccugcagcugaaguaggaauagugacacaugucugugaucucaccacuuaggggacugagauuagaagaucacaaguucaaggccagccugggcugccaagugaagucaagccagccuguacuacauagucacacccuaauaccaaucucaauuuuuucaaaaucuauuagacauugacacuuaaacauuuaaaaaauacuuauccauuuuaagugaaaguaauaaccaagucauguuaaccuagauaauauaucuuaguagaauaaaaacuuuauuuuaaaaauaauaaggaggcuggagagauggcucagugguuaagagcacugacugcucuuccacagguccugaguucaauucccagcaaccacaugguggcucacaaccauguguaaugggauccaauccucucuucuggugugucugaagacagugacaauaguacuuuuuaaaauaauaauaguaauuucaguuucaaaaguguuguauucagaagucuccaagguguugcacuuuguuuauaaucucuacagggcuuuaguggaagaauguccgccauggaauagagaguauuaugggauagagaguauuauggcaaaauaugcaacuuacauauagaaaacaucuggaggacuguacaagauguuugacuguaguuacuucugggagacuauaaaagggcaguggggugagaaaaggucuuacaucuucacaacucauacaugcucauaucaaaacaaacagaucuagguauuauaauccugacaaauaccuacaaucccagcacuugggaugucaguucaaggucagccccugcuacauaguaaguucaaguccugcaugggauccaugaagcccugucucaaaaacaaccagaagacagaaaacacuuaaauuuaaggagaugucaguaauucucaacaaguagcaguuuuguucccacugggacaucugacaguguuuggagacaggcuguugucacacuggggugcagguguaauagaggccugagugcugcugggacaugacagagcacgggacugauagaugcaccuccagcaaagaacaucugacaccaaggaccaugacugccaggacugaggcgucucagcuuagagaauacaaggcuugcuuugccaccugugcccccagucacccccucccccaacacacacuuuccaugaccacuuaguuuccaugaauucacuggcaggcuuuuuucaaggaaugugcuauucuugaagucaccagucaaaucacagacagacguucagaaaaugaaagagaaagagcacuaccaugucucuuaaagguuauaaauuaaugugcaggcuugaaagagcaucuguguacagcuuuugaaacuucuccugugguggucaccaaggcuccuggcugagugcugguggggccugcuacugcuguuucuuuguauuguaagggagcgaaaagaacacccauuacauuucauuaaaucagcugacucuguggagccuggauuucagacccaguuggaugaaucaggauguugucuuagucuuuuaaccugaaucauguccuuauuuuuuuuuuuacuugcucaugagaaaaagcaucacuaggagcauuuucuguuuuguuuuuuccuccaauuaauaacuaagaggaucgugguuuuguauucaguaggaagguagcaugcucuaagggcacccuuaucuggguugcuuuuugccucauugacauuugcuaacuguuuguuugcuuguuuuuagagacgcuucugauaaucuugccguacaaacucugaaggggucguuuucuaaugcuucagguauaaguacuaauugaaauccuagccuuaagaaugcugugucgucuuagggcuaaggcugauggauaccuucucacaccgaaaauaccuuuuaaaggaaagugucaaccaagcuguacaugagauguguuccaacguccuggaagcacuaaggcagcuugggcucaguccaacccucuaauccuagucugucucaguguuguauucacacaugugauuuaaccuucguuuuacucaguucacuauauacaugcaaugcggauauuucccucauacaacagacuaaagaaaagcagcucaagccaaauuugguggcacaugccuguaauccuagcacucaggagacuaaggcagaaggaugcagugugaagccaaccuggucuauaaauauauauaacuagacuccaccucaaagagacaaaaagaaggccgacaugagucacagccagguguacacuaauagacaguucuuuauggaguguucuagaaacuggucccagguaaagacuuuaacaugaaacucugugucucagguuuguuugaaauccauggaacuacaguaguccccaacgugauuguucuagcaccagaaaagcugucagccagcaccaggaggcgacaugagauucagguauagcacauccaccuuuuuuucuuugcuugcuugcuugcuugcuuacuugcuuuuauuuuacgugugcggguguuuugccugaauguaugucugugcaccauauaucuuagagaccugaagagggcauuagauccccuggaauuugacuugcaguuugacuaugcaggagcuggaaacugaaccuggguccacuaagccauuucuccagcagcuuguccuuggcuuuaaauauaaagauccuuucccuucuaaccugguggcuucugaagaucucauuaacaaaacuucucaggugccauaauucagcccaacuguucuccagagauguuaguaagcagcagcugucaacagaugauccguuuaaucugccuacauaagagcauuuuagaccagccacaagaguaguucucaugguuucagugucugcuguaugccuguacuaaggccaugugugcaaccuuagagcacgugcaguaugcaguuaaaaaagcaagagaaguaacagaauguguugaauguggcaagagugugccaugauccuaaugagagaugauguuaagagcauuugauuuauugcuguugugauuuuuguuugguuuuccuuugguuuuucaagauaggguuuugcuguccugggcucuguagucacucuguagaccaggcuggucuuaauaguugggcuggucaccaccgcccaacuauuaagagcauuuguguggugguguacacuguaaucucaggugcuuggaaagaucuaaaguuugaggccaaccugggcaacauaacaagacucaaaaucaguuuccccucagccuccagcucucuccaagcuauaucaggaacaaagcuuuauguucuguuuggagcccuuucuaagcucuggcuuugucaugcuguuguuuucuagaaugagaaaaaacauuaacaugcucugaacuccauuuucuuauuaggugcaaacccgacuucagacuacacuugccaacuuacaucagaaaagcagugaaauugaaauuuuggcuguaagucauaugcucuuuaacaauuugaagauagcaucugucugcauugucuaguguggucucagaauucagggcuauuuuugcugucagcuguauaugguaucaaccuggcuguuccucaugugaauuacaggcagucuaacgcuagaaaaagcuggggagaaaagauggucauuuguguguuucucuuuuucucuucuuuuuuuuuccuaaggccacacucauggugaagccuuaguaagugcacauggcagcauugcaccuuugaggugucgauaugaucugaacuccagccuccagugcuuguuagcucacauaguccaguuaaagucugcuuuaggagcugggaagauaacuacaugguuuuaggcacgugcggacuaaaguucagguccccagaacccacaauaaaugccuaugauuccaaccucagcugaaggaagacaccagcaaguuggcacaaauuaggcaucaauuagcucuggguuucacucagacucugccucaaagaauaagauggaagagcagcuaagaauauuuccaauaucaaccucaggucuucacacacaugcacgcaugugugcacugaaaaaaaauuuauagcagcccuguucuucuccacagccccagccagggugagcugccuguacuucauacaugauaugcuuucuguguauuaacagguggaccuacccaaggaaacaaucuuacaguuucuaucauuagagguaagcaacggcaacauccgcacugugacuuuuacagucuugucaaagggaaacuaguaaaaggucuuaaacuucuuuaguaauuauguuugucuggcagcaucaggaacugagcuaguaacguugguccuucuuuuccuguguguuaugggcacuccugaaucagaaucauacagccacagaggcucagggccaggacuugagccuagcagauagcauaaucuaguuucuuacccauaguaccauguguuucccaagcaaaucuucaucccaguuagggaagcacaauuacacagaacauucuguuguaaaagacccaaaggauuguuuacagguuuauacuuucauacauuuuuuuucaguuuuuaaaauuuucaagugucccaugguaguaaaauaaucauagcuacaggugacuucuauauuuaugugaggaagaauguuaccagguagccuguccuaguuugcuuuuuguagcucuaauaaaacacugaccaaaaacaacuagaaagggaagguuaucaccucuuauuacagacuagagucccuugcugagggaagccaagguugaacuccaaggcaagaauguuucuacuaacugacuagcugacuggcaagcuugcuuuauagaccaggccugccuguccaggauagcaccacccacaguaagcuaggccuuccugcaugaaucccuaaucaagaaaaaugccccaggggccaacugcuggaaccaguucuucuauuacuggucccucuuuccagccuaguuuguguaauuaacaaaaacuaaccagaauauagcccaagcuggccuugaacugcgguaauccucuugccucaggcuccuaggaauggagaugacaggcuacagguuaauuuuuaaagcauuucauaacaaauaacuuuuuuuugucuauccauacuguucagucauagauuuaaaauaaacugaauuaagauuggaauuggaagcaagagggucuucaguugagggccagacaacaguacagacuaagacccugucuccucauuacuguuaaucaaacaagcacacaagacucucuggcaguuuacugacuuuugauccaguucagugaguacacaugaaaggcaacaguguccacuauacacaggaaauguccaagaaaagcaauguacagucacauucgaauacccuggcuauggcaaggcagagcaggcucuaacuagauaccuguagucucaaaagaaaauugaagcuucaaaggaagagccacagacuccccaucaccaacacugcugacccacaaagucaggcaguaacccugcugcucugcucugucacaucuggucucaucuuuccuagugggaugcugaugaacaggcauuuaacacaacugugaagcagcugcugucacgccugccaaagcaaagauaccucaaacucgucugcgaugaaauuuauaacaucaaaguugaaaagaaguaaguuauagcagguuucaugugguuaaaauuuagggaagggucugacugagugucaaggguuaacagucaacaaauucuagacugugaaucacugugaggaucuugucaguagcacugugagccugagcguagcaucgggauaucgugugugugacauguggagacaugggguucaugccacuuuccucgucaccauuucuuuuugggacagggucucucucugagccugaagcucaccaaugagcuaggcugacuggcaucacugacuucagggacacacauaucucuacccuguccaaggccacacugucaggaaccacucugcccagcuuuuaacacugcuucuagggauccaaacucagugcuugcuuggcaugcacuuuaccaacugggccaucucucaagccucagaaaacauuuacacaacuaagucagggaugauggcauacaacuauaauccuagaacuugggauguagagacagaucaggcauccaaggucauguuuagccuuauaagcaaguuugaaggcaguccggguuccaugaaacucagucacaaaaaaagcaaaugacauuaaaaaacaaaacaaaaaaugacuaccuuugcuguguaugucaaaaugccagucauuuaugucacuguuuaacuaaaggacaucaaggaaguugguggugaauggcaguuucuucaucagaacuuaauugcaaacugucaaucacagcuccaagaaaguuuaugcagucuuucuagugaucaaucucccaucauauuuuuaauuaaaacaaagcuaugaaauuauuuuaucccacuaagucugccaucggugugcuuguccuuuucucuugcagggugucagugcuguuccuguacagcuacagagaugacuacuacagaauccuauuuugacccuaaagaacugcugcuguauuguucaaauggacagggacuuauacugaaauaauggaauguugugcauucauuuuaacuuuaaauucuaauaagcuguccuacaaagcugagcuuugucggguuuucauguauaaauuuaccuuuuugauauaauaaauguuuucauagauau

SEQ ID NO: 1000 - RNA, 3988 nt, Mus musculus
gucgcccucuggccuccacacacaucucacagugcaugcacacaugucuuuacaugcacauuagaauuuuuuuuuuaauguuuuaggauggagggggaggguggucagaggcuuaagauggcuggucgguggauuaagguccuugccguacaagcguugcugucugaauuugaucccuggaagggaaaggugaaugaaaagaucccacuccagaguugucccaugagcucuaccuaugugccaugcaauaauaaaaucauuuuuaaagguagaaagcaaagaagauaucugauguugaucucugaacuccacaagaauuuauaacugcauguaugugugcauaugccacagauguacaaacacacacacacacacacauacagggcaggggguggaggugagagagaaauccauauaauagaaaucuggggcuaugacucaggaguauagugcuuaccuaguaugccugacaucuaagguugacugccagcacuucacacacaccacgcaugcauguguguguacacacaaaaacuuuugaugggcagagcuuguauagagagugugauuucccucuucugcacuucaccaaauguuuucccuauuccauugcugagaacuccauaaugccaagccuguuugaauucauaguuuccuuuugguucuuucccuaaagaaagauagauuauuugaggcauaacggcuccccaacuugucucaucucguccccaaggaagaucgguuaucacggugccagccaagagagccacuucuggcuugcuucugaguuugcugugacuuggcuccugaggucugugcaguacagagcacacuguaaguuugauaccucaaggaaugagccuguaguaagaaagcaagcuucuugggacuggacuacugagacugccgggauaaaggauggguuauuggauuagauguagggaaucucacugcucuagauaaaggagucuauggcaaaagaaacaguuccuaagagcagugcccauucauucagaccaucuggcucuccaguggucuggggucagugcuccagauaagucaugaacgaaaaggaugauagccaccaucuaauucaugucugucugucugucugucugucugucugucugucugucuguguuuaucuaaucuaugugucugucucucugugucucuuucugugucucugugugcgcaugugccugcacacacauuccccauccccccucuccucucuuaccucucuuacuuuugaaauagggucucacuacauagucuccaccaucuuggagcacacuaaguaggccaagcugccuuugaacucagagaucuccaucugucucugccucccaaguguugggacuaaggcuuaugccaccacacccagcucaacucuguauauauucuuuacucuuagcugcugcucgaaacuuugaaagacgaacugaagguuuucaaugaaaccgccaagaagcagauggaggagcuacagguaagggcugacgcacccacggcagcaccugccguuucaccacagcguagggauucggggaaaucauucuuucuauucuucccuuuuaggguaugcuuugccuaagugugcacacguacagacugcgacaguguccacggagguuagagcuggguuacaggcaguugugagcugccguguuaggcacugcaaacugaaccugggucagcuuugcaggagcagccacugaacugcugagccaccucucugguuuauccuuccuuccucuuuucuuuuucucugucccagagauccagccccaggaugauccucuucauggagauuauagacgugagccaccaugcuuggcuugcuuuuuaguuacuuauuuuuuuaacauuuauuuuuacuucugugucucugugaauguaugucacguaugcgcagguacccaugggagacauaagauggcuucagaccccuuagagcuagaguuauagacauugguaagguaccugccauggguacuaaaaacugagcuuuagucgucggaaggagcaagggauagucaacugcaaagagaucuccaguuccccugcuuuccuauuacaguucagugugaauguaugugggugcauagugcguccaugccccagugcauggggcucacacuccgguuauuaggcuugguggcaggcaccuuuacccuugaagcgauuucaccugcccccaucccccccauccuugcuuggaucauguuuggcuuugugugugugugugugugugugugugugugugugugugugugugugugugugagagagagagacugccccugccuccgagaacugcagagcugagagccaacccacucccuaccgugguugcagcucugggaauacaaacccccaagucaguuguaccuccugagggcugggcuucuggagaguugccaggaguggcccucacccuguuauggcuuugcuccuuggggggaaagggacggcuccuacaguccugaguuggggacaaagauggagaagggggggacaucaaauggccagggcucccugccccgguagggcugacucaggucagcagccacggagcaacaaggaucaacucucuagggauauaacaaauaacacacuccuaaaucagacuaggucaaggcucaacucccuccuuccauucuggaggaguccaagacagagacuacacuccagucugggcucccugcaagcagcccaucagagcucgccacgauugacgucccaaucgauggacccauucacauagcugggcaaaaaggauggaaggcaagggucugccuaggguugaggucagggugggaacagggccggggcgcccagcagggacaacaacagcugguacgacuugggguaagguggguaagucccacaugugccauagaaggcagcccauagcaccaggcccaguauacuuguuuguuuuuaaugaacuauuuugaaauaauuuuagauuuauagaagaguuacauaucuaauauagaaaauucaguuucccuaggauaauaccucaugcuguccucacuggcaugccauugguaacuaaagucccagacuuaguacugaauccauuuuuuuuuuuaagaugcuuuucuuccacaaauucuuucuguguucccgaggacccuagaaagguuccuggggauaaaaccauugcaaggcccaggggagcaaagucuccacaccucccaugggccacaccgcaguaugcucagagagcugagacugaaauccaugcuaaaaagcucuucucaggagaccugggugaacuguccagauuguagggcuagaggguugagagugcuugcugcuccugcaaaggucccaaguucuacacucugcagcucaugccuucauaacuccagcucuagggaucugaugcccuuuuguuucucuccucuccauggauauccaaggguauacacacacacacacacgcacacacacacacacacacacacacacacacacacacacacacacaauuaccaagaaaagaaaauguaagagccaggcacgguagcacacaccuucuauuacagaggcagcaggggucuucguacguuugaagccugguccacauggugagauucuuggacgccuuccgauugccagacaaaugguggggcaggagacacaaacgguuucauuguuccaguuuaaauacagaguagggaaauuccccgagccagcacagauaaauuuuaaggugggaaauaagaugcugucugguacuggggucgccccccucuauguagcacggguauaacggucugguccgggugcugucuuuguuguaagaguuguguuauggguuucccucugggaugauuucccuuucaggccuugaaggugaaguugaagcugaaagaagaggagaguguccaguuccuggaacagcagaccuuauguaaggacgaagccagugacuucacaauaauccuagaggaaauggagcagcucuuag

SEQ ID NO: 1001 - RNA, 3988 nt, Mus musculus
cuaagagcugcuccauuuccucuaggauuauugugaagucacuggcuucguccuuacauaaggucugcuguuccaggaacuggacacucuccucuucuuucagcuucaacuucaccuucaaggccugaaagggaaaucaucccagagggaaacccauaacacaacucuuacaacaaagacagcacccggaccagaccguuauacccgugcuacauagaggggggcgaccccaguaccagacagcaucuuauuucccaccuuaaaauuuaucugugcuggcucggggaauuucccuacucuguauuuaaacuggaacaaugaaaccguuugugucuccugccccaccauuugucuggcaaucggaaggcguccaagaaucucaccauguggaccaggcuucaaacguacgaagaccccugcugccucuguaauagaaggugugugcuaccgugccuggcucuuacauuuucuuuucuugguaauugugugugugugugugugugugugugugugugugugugugugugugcguguguguguguguguauacccuuggauauccauggagaggagagaaacaaaagggcaucagaucccuagagcuggaguuaugaaggcaugagcugcagaguguagaacuugggaccuuugcaggagcagcaagcacucucaacccucuagcccuacaaucuggacaguucacccaggucuccugagaagagcuuuuuagcauggauuucagucucagcucucugagcauacugcgguguggcccaugggagguguggagacuuugcuccccugggccuugcaaugguuuuauccccaggaaccuuucuaggguccucgggaacacagaaagaauuuguggaagaaaagcaucuuaaaaaaaaaaauggauucaguacuaagucugggacuuuaguuaccaauggcaugccagugaggacagcaugagguauuauccuagggaaacugaauuuucuauauuagauauguaacucuucuauaaaucuaaaauuauuucaaaauaguucauuaaaaacaaacaaguauacugggccuggugcuaugggcugccuucuauggcacaugugggacuuacccaccuuaccccaagucguaccagcuguuguugucccugcugggcgccccggcccuguucccacccugaccucaacccuaggcagacccuugccuuccauccuuuuugcccagcuaugugaauggguccaucgauugggacgucaaucguggcgagcucugaugggcugcuugcagggagcccagacuggaguguagucucugucuuggacuccuccagaauggaaggagggaguugagccuugaccuagucugauuuaggaguguguuauuuguuauaucccuagagaguugauccuuguugcuccguggcugcugaccugagucagcccuaccggggcagggagcccuggccauuugaugucccccccuucuccaucuuuguccccaacucaggacuguaggagccgucccuuuccccccaaggagcaaagccauaacagggugagggccacuccuggcaacucuccagaagcccagcccucaggagguacaacugacuuggggguuuguauucccagagcugcaaccacgguagggaguggguuggcucucagcucugcaguucucggaggcaggggcagucucucucucucacacacacacacacacacacacacacacacacacacacacacacacacacaaagccaaacaugauccaagcaaggaugggggggaugggggcaggugaaaucgcuucaaggguaaaggugccugccaccaagccuaauaaccggagugugagccccaugcacuggggcauggacgcacuaugcacccacauacauucacacugaacuguaauaggaaagcaggggaacuggagaucucuuugcaguugacuaucccuugcuccuuccgacgacuaaagcucaguuuuuaguacccauggcagguaccuuaccaaugucuauaacucuagcucuaaggggucugaagccaucuuaugucucccauggguaccugcgcauacgugacauacauucacagagacacagaaguaaaaauaaauguuaaaaaaauaaguaacuaaaaagcaagccaagcaugguggcucacgucuauaaucuccaugaagaggaucauccuggggcuggaucucugggacagagaaaaagaaaagaggaaggaaggauaaaccagagagguggcucagcaguucaguggcugcuccugcaaagcugacccagguucaguuugcagugccuaacacggcagcucacaacugccuguaacccagcucuaaccuccguggacacugucgcagucuguacgugugcacacuuaggcaaagcauacccuaaaagggaagaauagaaagaaugauuuccccgaaucccuacgcuguggugaaacggcaggugcugccgugggugcgucagcccuuaccuguagcuccuccaucugcuucuuggcgguuucauugaaaaccuucaguucgucuuucaaaguuucgagcagcagcuaagaguaaagaauauauacagaguugagcugggugugguggcauaagccuuagucccaacacuugggaggcagagacagauggagaucucugaguucaaaggcagcuuggccuacuuagugugcuccaagaugguggagacuauguagugagacccuauuucaaaaguaagagagguaagagaggagaggggggauggggaaugugugugcaggcacaugcgcacacagagacacagaaagagacacagagagacagacacauagauuagauaaacacagacagacagacagacagacagacagacagacagacagacaugaauuagaugguggcuaucauccuuuucguucaugacuuaucuggagcacugaccccagaccacuggagagccagauggucugaaugaaugggcacugcucuuaggaacuguuucuuuugccauagacuccuuuaucuagagcagugagauucccuacaucuaauccaauaacccauccuuuaucccggcagucucaguaguccagucccaagaagcuugcuuucuuacuacaggcucauuccuugagguaucaaacuuacagugugcucuguacugcacagaccucaggagccaagucacagcaaacucagaagcaagccagaaguggcucucuuggcuggcaccgugauaaccgaucuuccuuggggacgagaugagacaaguuggggagccguuaugccucaaauaaucuaucuuucuuuagggaaagaaccaaaaggaaacuaugaauucaaacaggcuuggcauuauggaguucucagcaauggaauagggaaaacauuuggugaagugcagaagagggaaaucacacucucuauacaagcucugcccaucaaaaguuuuuguguguacacacacaugcaugcguggugugugugaagugcuggcagucaaccuuagaugucaggcauacuagguaagcacuauacuccugagucauagccccagauuucuauuauauggauuucucucucaccuccacccccugcccuguauguguguguguguguguguuuguacaucuguggcauaugcacacauacaugcaguuauaaauucuuguggaguucagagaucaacaucagauaucuucuuugcuuucuaccuuuaaaaaugauuuuauuauugcauggcacauagguagagcucaugggacaacucuggagugggaucuuuucauucaccuuucccuuccagggaucaaauucagacagcaacgcuuguacggcaaggaccuuaauccaccgaccagccaucuuaagccucugaccacccucccccuccauccuaaaacauuaaaaaaaaaauucuaaugugcauguaaagacaugugugcaugcacugugagauguguguggaggccagagggcgac

SEQ ID NO: 1002 - RNA, 532 nt, Mus musculus
auucauuuuuuuugcaaguuugcagaucaguuuauuaagaugaagucacugcuaguuacacagaagagaagcuacugccaaagucagugagguucucgagaacucgcuacaucagacacagacguccagaaccacaaggaacuguuccugauucccagugacaaggcugaggaggacaaaucugcacauuuacuucaaguuuuuaaagagcuugugggccacacaguggucccgugagugcaagaagccaaagagcuccucuguacaauccucuccugucugugaucgggaagacacggauuaucacacaacucuggucauucccgggccuuuacacacuucuccagcgguucacagugcucucucacuguuguuagggggcccacuaauucuuccucuucuuccucguuggggucuccggauccagugagcaucuuucguucauccucuagucccaugucgggagccgguuugggauucaacaagcgcgaccaggguagcuacuccacuucagguuuaagaagcaauaaau

SEQ ID NO: 1003 - RNA, 7414 nt, Mus musculus
auuucaucuuuugaaggcuguugauuuuaauggugcaaaaaggauacagguuaaacugagucagcgucagcccaaugcugauaucagcuagagguugacaguggaaaauggggcuggaaaauucuaaacaaacauuugucuguagucaagaacuguauccgaugaaaggaguagggcuuaaaauaaaauaaauaagauaaaauaaaaagaauaaaaaacaaaaacaacaaaagggagaugcuagauauacaaaugacaugagagagaucaagugaaggaaaauggauuucagagcucucccagggacagaaggaaaucgggagacuucuugcuuccucucuggccccuacaguaggcauccuuaguucugguuacaucaaguuccuuccuucucugcauugucuguccuuggugcaccagucugaccaugugucaguuuguguguuuuuguuuugucugaaugacugucguucuauguuucauguugaagaaaaacugguuaaaacuuuauccaauggauauccaucucugauucagucucaguuugcacagcagaagcugugcaacuuuucauuaguuagaucacugaagaaaauggcauccaaucucccagcaaccauuaacugccaguagccccucccucacccauguuuaaaugacaguggacucagaauugcgccuggcuugcagagguaacuacugcugcacgggugcaacaacccagccacuccccacagacuuuuuaaggcaccccuccuuauccucuggcucuucccuucuuucccagucuucucccauauguucugagccuggcaggugugaugcagguauccaguuucaagaggcucacuccugaaccucuugcugccaugccuuuguaagucaggguguuuaguucuuacucucacaugaaauuaccgugaggcuuguuaugagaauaccaggguuuucucuccugaugauuuccugauucauaacuaccaguacuuggcucccauuuucuaagggagugaaaauaaucaacaauaccacuuuauuuuaaagaacgggagggggaaauuacuugaauuaguaacagaaagggaagagacugauaaaagagugagaggcgccaucuacuggaucaguggcuacuuccagcuuugggugagaaggagguuucauguuuuuacccuuuaaauccugcucaaagcacucaaaucaacagcaagguuacuucacacuauccugaacuauuacaggauauuccaaccccgagucccuggaagaccaugagaaaagauugauacaaaaauaccuaauuaagacuaacagcauuuacugcuuaagugcuaaaaaaugggucuuaauccucuagauucagcuucaggaagacucauucccucuguugauuaugaacuuaucagggaagaauugucagcuggugaugcgccacaguccuggaugguuauacaucaacaacucuuuuaagacguagcgcugaaagaauugcaauggaugguuguauguuuguuugcuuauagucuauguuuuauuauacacaagaaaucuucaaaauccugaguggcagugcauguguuuaauucuaccauuugggauuuaaaaacaaaaacaaaaacuucaaggcaagcuuguacauggcugucuauaacucaagcaauuggaaagcuuaagaaaguagaaacugagugugaggccagcugggauacuuagugauucugaggcuauccuggcuacauaacaagacccucucaagaaaaacagagagagagagcaggaaagauggaggaggagaggaguuaccccagauucaaggcuuacaaaaaugucuguguguguuauuuucuuuguuugacacagggucucaguacacuccccucucccacuccaccccccccccccgccccacauacacacagaggcagcuuuagcaauagacagacauuuuccaauuauuuugauguggcuaauggcugauaaaaugugguuuugaaaauaagaaugcgcuucacaugagagaagagcucauuuggaguggaaagacagccgugaucacgcacagugcuuaccuguggaaggcaaggcaucauaacagagucagugcucuggugguaacaguccugacuccaggaaaucugccauucuaaaacauguuaguuuuguuaacugcacugcuuccgucuuuguuauuuugagacaugagucucacuauguagcccuggcagaggccagaagaggggaaggguccccuaaugcuggggugucaggugguugugagccacucaaagagcaaugagugcucuuaaccagaccguguguguguguguguguguguguguguguguaugugugugugugugugagagagagagaaagagagagagagagagagagagagagagagagagagagagaaccagaaucauuuuuggauauuuuguaauugggcuguuaauucuuuuguuaagauuuuauguccagaauaaauaauaaacaacacaacaaaaagaguauauuccacugugagaaauuauaucacaugcacuaggagagagaugaucaguagaacaaacagaaaagaauaaguguuggguagcuuggggggcguggcacacuccuugaaucccagcacucagaaggcagaugcagguggaucuuugugaguucaagaccagcuuggucuacagagcaagauccaggacagccagggcuauaccaaaaccaugucucagaaaacaaacauacaacaacaaagaacaaaagaaaaaagaaaaagacacagauugucugaguccaugccuguggaauaaagaauaaacuguuuaccaggaguugagagagagaaaaagggaagaaugugcuguacaguuuccuguaggaaugagaaauauguuuugaaaucuugagauaagguugcucuaguuugugaauauaguaaaugccaacaguguuuaucuuaaagcgguuaauuuuaugcuaugugaauuuuaucucaauuaaaaaaaaaaaaaaaaaaaaaaagcaaggcaugguguuucauaccuguauucccgcucuggaggcaauguaggaggauucaggguucaagaucugccugagcuagagaaacucagaaauacuaaggggcuuggaggucaguuguagagcacuugccuucuaauggaucuagauucuauccuaagcacuggggggaagagggaagggaucguaagaaaccaguaaaaauggacauacaagguguuagaaaaaaaugaucuauguacagaucugaaagccccaacaagccagaaggaaggagguagcagcagguacaagcaagguuccuuacugugaaaccuugcucuucuccaaaccugaguaucaaccaaugggagcagucccugucucaaggcccauccuugcuccaauccaagaagccauuuuuccaauggucacauuccucagucuucuugccagucaucccgugcccaggcugggaugggugagacguacucaaagucuggcccuuuauagcggagggcaugcaggaacauuacgagauccuggggcaagggauccugucgcaacacucggcacucggcacagagcgggucuguuucuugagucacaucugcuuuagcugccuucucugguguguccagaugcugaggggcugccucagcuauuccaucuaucuucugggcugcuguagccaacccuuccaggcugucuuuagccaacucugaagagggagcugucgagucuaugagcccuggcgucaggucacucucacagagaucuagcauacucaggcuuucuuuggccugauguucugcaaccaggucucggagcaguuccucgucugucuuuggaauguggccacccuggccucgagaaggaccccaggcaguugaauuguagauggggucauugagaaucggguggcccaggaauuggagguggacucggaucuggugagugcgaccuguaaguggucggcacuguaccacacuggagcggccauuguagcucagccucuggaacacagucucacaaggcuugccccggggauccacacggcacacuccuaccuuguaagacaccacuaagauggguuccuuacaaauuaccuccuugucagggaacuccccugcaacccggcauacauacuccuucuccagcugcacaggaggaaaggggaaaaagucaguccaaagugaauacagagucuaaauccucucuucagguacaccaguguaucugagagaggaagauucaaauucuaacaccagcguugucaguuucaccaccuggguaaguuacuuaaacucuauacaucccauaucucaucuagaaaguaugaagucagggcaauggcuccacaguuaggaucaccugcugcucucccagaggaccuggguucaguuccuagcaucuacaugguggcucacaaccaucccuaacuccaguuccaggagagcuguucucauucuaaccucugcaggggcaugugugcacgcgcgugcgcaaacgaacacacacacauacacauacacaugcagaacacucauauaaacuaaaaugaauacauaauagaaauucuuuuaaaaagaaaauaugaacugagaaaacauuuaccucacggggcuaccauaagcguuucauaaauuggguucuaauguguuggggauuaagucuggcgugugcucaaugagcgaauuaugauccagaugcagagcauaaucaccaccaguaagaaucuuacuugcaccucuuucaacuuuauccuacuaagugagcucucuucaaaaucuuaacaauguuuaauguuuccagaacagcaaacuaccagggccaucuccaaagcccuucugaagcauacaggauagcugucuuuggaacuucaggugcugagccuccucaaaagaggaagguuguagaugccccucaaucuacuuuaugauuccucuguguuccaguguacagcaggcaaaagccugacucaccugccgaucccgaaccugcucauggaucuucuccgagacugcagcugucuucgcaaacaugagcacuccugaggugaggcgguccagccgaugcaguggguguagcucuuucaguuggugcuccuugccuaggaugaagaugaccguguugugucggaagcggccacaggggugcacaggaauggaggacggcuugucuauaacaaccacaucguuguucucagcuagcagguggauaggcucugcugugacugguggcucaugucugugcacuguguuccgcaagaaaucauuguccugucaaaaacauacgcaacaucagccugggaccagcaaccuauagauagucagucaccccagcuccucaguuccuuacugacacagaggaacggucacaguaaagccuucaauagaaaaagaaguggguguaguaagaucucauuuuguaaaaauauacacaggcauacagcuaguuuugaaaaauauacaaaguugauugaauuucuugguggugagaaugaguauuuuugcuucuuuauauacucuuuacaauaaaguuguauuuuaagauuuuucauuacauucauuuauguguguacaugcauaacagcggcacacgcagagacaagagguugugagucuuaguggcaaggaccuuuaccuacugaacaucucaccauccugacagaaauauauuugaaaguaaaugucuuuuaaauagagagacaaccucuacuaguuacgaacaaacaacacaaguucagagcucuaggcucuacacacagauuugauacaagcucacuacauacucuugggcaagucauuuuaacgccucuaggacuugguuuaaaaaccuaugguuuucaaaaucuguauggggaagguuauuuccaaauccugaaauucuccuuuucuccuuacaaucucugugagccaguguuaaugauaguagucucacugaauuuaaaaaaaaaaaaaaaaggcuggagagauggcucggugguuaagagcacugacuguucuuccagagguccugaguucaauucccagcaaccacacgguggcucccaacuaucugaaaugggaucugaugcccucuucuggugugucugaagacagcugcaguguacuaaaauaaaauaaauaaaucaaaacaaaacaccugccuaguaucuaucccugacuuccuaauucuauacacaugggaaacgaguuucaguguuaauaugagcgcacacuuugggaaucguacuguugccuuacuuugagguucaguuuggucacaaaggggagaagaagcaaugcaaacuccccaaaguugccacuugaguuuaauguuagagugcacaaaacgcuuaacuuuguuccugauacaguuaagaacacauaaaugaggucucuauuauuauuuguacagagauauaucaugcaggguagaaaguaggcagugcccuugccacaaggcagauauuaaaggaacaugagaauuuccauuuuguuuguuggaaacaaacagccuugcuggcaaggaugaucagguuaaguucuggagcgugggaaggcuaucuaaccuacuuggggcugugggaagcggggacuaaaagagcaccaagagaaaaugagauuguuucugaauuaccaucacuuuacucccauacuuauaaggugugucugagaaaacaaacaaacaaaaaaaaucccaaaaccuucccuccuuuucucaaagcuaguuccaucagacaccaccuugagcacgaugcugagguccuggacugguuccucguugagaugcaggcguccugcccggacagcggccucguaguaagacaguggcugggaucggaacucggugcugaagacgugcaacaagcugcggcccacccagcgaccuuuacaguaggucuggaagucaaaguaauagggccgcaccuugcgcaggccgcccucgaaguaguagguagucucugcgaagugcucaucgcuaaagcucaccccggugcgccguuucuucggaggcggcacgacccguuccccaguggcgccccuccgcuuuuuccucuugccugagucggcgacuggagcuggggucugcucuccguugcucgggagcugcccuucgccucccugggccugguccccgcucuccgggaccugcuucccuaccgccgccggcuccaggcgcuccaggagcggcucuccgcucguguugcuaccagcaucuccauuuggcugaaccaaagccuucagcccgcccgcugccucggcuugcgcagacagugccucagucaucgccuucccacagcuaccccaaguccggacaaagcugugggaccagagcgccaccugccacugcacaaugucccguaggcagcccgggacaccccgccacaugacagcacggcuagccgcuucagggucgcaaucugaug

SEQ ID NO: 1004 - RNA, 59520 nt, Mus musculus
cacugagcaugcgcaucacuagggcgguuagauuugaauacuucagggacguugagaggugacguccgacuccaaggagcgcgaggaccccagacaagucaagcagguggucgguggcgggucagaaugcuccuuuccguucugggcuccugagagggcucggguucuguuugagugcugaagggcgggcgcggguugcugaggucgcucggucgucggggcgaucucggaaaggcccugcagccgaccggaccgcgcgagcgccaacggcccgcucuccuucuccuggagcgccgcguuucgcuucuccuuucccaaagccgcuccauucccggggucgugucgucugcgcggugcgccgugggccuccggguucgccccgcccaucaucuuuggucagggcuccgggauccggucccaccgucucucgccaacuccuugugguauguguuucugaccgacguucccugcuuccguggucugaaggcgacgagugaacuuuaaauuguaggcuccguccgagcacaauaauagaguuucggguuucugcagguccaacauuaguaaagacaaaucgguguguuagauuacauaaauuuccuuucccauccaaaagacuuuggauucccuuugggaagaaaaauauugccuacugcaauuuuuaaaauguacuagacguuguaguuugauuuaugcucauauauuugaaugccgagucaacugagaguggcacuguuugaaaggauuaggaggagggguggccuuguuggaggagauguguuaaugagggaugagcuuugagguuuccaaaacucugccugcuguuuguggacguucuuggcuacuccuucagcauuguguuugcucgcagguuccccaugaugacugcuauauaagucucugaaacuguaagcaagacccccaauuaacugcuuccugcuauaagaguuguggccauggugucucuucacagcaauaaaacugugacuaagacagaaguuaacagagauaaagcauguggcuaaaacccaaagcagcaguuuauucuagacaccaagguugaccguuaguuuucauuucaguuaaauugguuccguugagucccuuguaugucucauagguucauugucuugugcuaaaguagacuucauggggauggcauuucauuggucagauuguuggagagaugauuuauaaauauggaaggaaauauaucguaagguauuuggucauuaaagguuagguucaagcaguguacuucuugacuaugugaauggcuggaaaccuuuacaaguugauagauguaaauggaguaaaauguuugggauggugauauaaaugauguguuugaugcugagaauacgagaagguacugauucuagauacuggaucgaacaagcguuuccaauagaauuuucugugauaauaauauucuauaucugcacuguccaacaugguaucuauuagcagucauuuuuggcgcacuuaaaauaugguuaucaaagaaauguaguaugauuaccaaaaacuugaguuuuaauuuguuucaucuuaauuucauuguauauaaucauucaauuugacagcacaggucuagagucuguaucaguggagucugaaucagugaaaauguuuguauauuuugguuguauaaauucaggaauggacaaagagccagauaguauuuaggcucugcuugcugugggucaguaugauggucucugcuacaugauguuuugguggugauguuuauuuucuucaguuaaaagaaaguucucaaagguugcuuuggcccacuguuggucugcagaccccuggauuauuuagacugguggcucaaacuuuuugguucaaacaguccaaaagaaauacuuaauauccucauuuuuauauagcuugguucaauaaauuuaaugaguauguccuaacaacuugguagccauuugguaaguguaaguugaaggaaaagauaauaaacuuuuuucuuaaguaaucaaguuacuaauuaaguccacuagcuuuuauucauaccaguugccaaagcucuuacuucacaaugauacgguauuauugaugguaauguagauagauaauauuuugaauuaguucaugcagugccugauagauuucaagaauggcuguuaaaaaaacuaguaguauccaaaaaccuguaaguauauaaguaaaaaccuguaacuauaugcuauaaguauaccccuaaaugccaaauguaguuuucuagacaaucaauaauuaguaugaaugugaucaaaagcauuuuauaaguacgguuuauuacagugguuuaggggcuugaccuguuuuguuaaagguguaacacauggguuauauaauaaaauacacauuuaaugaaauuagagacuuccagaaaguuuugaaucucauugguuaagugguaacuaguucacaaguuggagaggaaugguucucaaagacuuugaaacaacaaugguuuagguuaccuuggguuaauaguuccuaguaguuaccuguuuugaguacagaacuuaaaacuauuccuguaaaagauaagcugaacuugaaaugauuucuauagagcagugguucuucagccuugcuaaugcuguaaccuguuaauacaauuccucagguugucgugacccucgaacauaaaacuauuuuguugcagcugggugugguuggcacacaccuuuaaucccaggauuugguaggcagaggcaaguucuaggccagccugggcuauagaacuagcuccaagacagucaaggcuacacagggaagcccugugcugaaaaacaaaaacaaacaaaaguuuguugcuacuuuauaacuaauuuugcuacuguuaugaguuguaauauaaauauguaauaugcaggguaucugauaugggaccuuugugaaagggguuuuugguucccaaagaggucacaauccacagguugagaaucacuucuauagaagagacaaauguacuaguuaauaguuguaagugcugcauguuuacuugugaaggggacucauucagaaaauagccauugagcuccuaccauuuaaaaguacugcuagaccauaacaggaaacucaagacacaccacuuuauuuucauaacuuucugcugugguaaagguauuugagcgaagugauagaaacacccguuaauauauaacaaguuauauaacaagauuuuaaaguacaguuguaaugcuaccaagaagacuuugucuuucuugccaagagagaauagcacuuuauuaguacacuaauuuguggaagaacucuguauaggacuagaacagcgaguguggcuacuaaaaucaggaaguagucaggaguaaugaagucugagagacagccagagaccgucucuucuaagccuuauaggucccagugaagaaggucaauacaguagcaagcaauugcuuuaaauacauacauuuaugagcugaagagauaguucacuaauuaagagcacuggcugaucuugagaggaagaaccuugauucaguuucuuuuuuuuguuuuuuuuuuuguuuuuagguuuuuauggauucuuugaguuucauauuauguacccccaucauguucugcuccucuccccguccccucauaucagccuuuugcucuugcauccuccuccaaaauaaaacacacacacacacagacaacaacaaguccaaaacaaagcauagaaaacaguagagacgguaguaguauguuauagugugacccacaguacaucccucugaccacacauuucacuugaaauguucauugcgaucagucauuggucugguucaagaucucuggcuucugugacaccaucaguauuggauccucuuugggacuccucccaguuauucuguuguuguccuguaucauggagauccugcagcuuuggauucuggggugggccaucucagagcccuggaucugggucuaagugguaacagcugaucagcucauuaguucucccuuaauuacaccaccggugcaagcuuucuaccacugcucuggcuaggccggccaauaccaccaucagcaggaggcagggucagcucuccugcucucaugcucuugggacuaacucaccugugccccuuccaccagagccagcuccacugugcugcccagucaaggcauagggcccacucucccaagugcugcagccuaugaggggcugggaccgcucuccugcucucacacccuuggggcuggcucaucugagccccuuccaucagggccaacuucacugugcugcccaggugcccuguucuucugagcgcuagccagugagggacagggcuagcucuucugcucuuaugcccgcagggccaacucuaccaauuacagcaaguggcaaggaggaggacaucaccccacacucacacacacaccaccucacaacauaggcgugggcccaacucucccgugaucucguccuuguccccucaacuaggaccagaagacucuguggcccagaagugcagggacugcucuuccucuugcagcagucugcaaggaacaggaccugcuuacccacucuuaugaccccagggccagcuauucugacugccaaagguggggagggaugagagcauccacaccaccucauaguagaugagugaguggcagggccaacacucccuggaucucacccucaaggcuggugguucaccugugcuccaccaccggggucagcucugugugcuguccaggugggguucagggcccauucuccugaugcugcagcuggugaggggaggggcagagcuauaucucugggaaacuuuccuuccugcuggaggggguugcaaagagugccaccccauggcagaugaguggcagggucagcucucuuacacuuaugcccuuggggccugcucacccauaccuccaccgucaggaucagcuuuauucugcugcccugacaaggcucagggcccacuccacugagugcugccagcugugagagauggagccggcucucuagaguacugcagccaccucacagcauagacgugggcccaauucucccacaauuucguccuuaggacuggcucauccuuguccccucaacuaggaccagcucuacucuggggugggccaucucagugaggggcagggccaguuuggcacagccccuggacauccaagugguccccgguggcugcucugaccaaggacuuccucauguucuguaguggaaauaugagccacagacaaggacaccgaccccugcuacaugaccccugccacugaguaggcacaaagucagaaauagcaccaguggcagggcuggucacucacaacagguuacuucuuucuucccccgaaugucuaguuccaucuuucuucuugauguucaagcuguuccacuucucuuucucucccaucugaccaccaaaugcuuauacauuaugguggcuccagcugcaggcuggccacauggcuggcaggucccugggugacauccuccaucuauacugcauggccugucuacaagcagaugucuauguccccccugugccuugcacuggagggcaggucuauggaugucaugaugguccacaggucucugucuuccuucuuccucccugcacugucugaauuugauuugauuuuuuuuaaagauuuauuuauuuuauuuaugugagugcacuguagcuauccucaagcacaccagaagagggcgucagaucccauuacagaugguugugagccaccaugugguugcugggaauugaacucaggaccuucagaagaggagucagugcucuuaaccacugagccaucucuccagcucccuugauuugauuuuucagcagauccuuuuuuuuuaaggauuuauuauuuauuauauguaaguacacuguagcuguccucagacacuccagaagagggagucggaucuccuuacggaugguugugagccaccaugugguugcugggauuugaacccagaaccuucagaagagcaguugggugcucuuaccagcugagccaucucaccagccccuugauuugauuuuuaugaguucuaggcauaaaacaacuuuugacuaucaagccagaaugaacaaaggguugccacuuacucugccgcugcuuaguauaaaaacaguaucaccaacaaggcgucucuuugccccuugucaggggguuugguucaauuuccagugcuuauguggcaucucacaacugucccuaacuccaguucuaggguauucaguuuccuuuucugaccuccacggacauacaugcaaacaaaacacucauguacauuuuguuuaaagcagucaagccaguuguggugauccuugcuuuaaaccucaacacucaggaggcaaaggcagaaagaucaucugugaguuugaggccaguauggucuguauauauugaauuccaggccagguggggcuacauagugagacuaucuuaagaaccaaaaacaggggcugcagagauggcucagugguuaagagcacugggugcucuuucagagguccuggguucaauucccagcaccuacagggcagcucauaauugucuguaauuauaguuccaggagaucugauacccucacaccaaugcacauaaaacuaaauaaauuuuuuaaaaaacaaauaacaacaaaaacucuaaacccaaauacuuauuucagacuuaaauucagacuuaugaaagucuguucccuaaauuuggcuuuuauuuuaugugaaaaauauuaucuuuuagguaucuuauuuuuccuuauuguuaaaaguaagaacauugauacagagaaacccugucuugaaaaaaaccaaaaaaaaaaaaaaaaaguaagaacauugacuguuaguagguauaugguauuaauuuaauguuaugauagaaauggcuaguaguaguugucaaacuuuauagcuauuauuuuuaaaccugagaugucuuuucuuaccugaaaauaagguucuaguuaaugcaugcagugagaaaaucuuguauguauuuauuuugugugaguuauacugcagaugugaaggucagaggcuaacuuaaugggagucuauucagguuuucuccuaccauguggauuccagugauugaccuuggguaguuaagccuagugacaagugccuuuaccugcugagcuaucuuaauugaguagauuuccauuuccaauuccacucaacacguauugaguaaaauuccaauuugaauacuugacuauaguauauaaaacaugaauauuguuggaucuaguuguacuuuccuguaaucaagguugcuuaggagacugagauaggagaauuaaaaguucaaggacagccuuguacagaaugaguucaaggcuacccgggcaacuuagagaauaugaauugugcuguugcacacuugggcuuucaagaaaaacugaaaaucuaauuauuuuauuuuauuuuuuuaaaagauuuuauuuauuauuuauuuuauauguaaguacacuguugcugucuuaagacacaccaggagagggagucagaugucauuaaggaugguuguaagccaccaugugguugcuggaauuugaacucagaaccuuuggaagagcagucagugcucuuaacagcugagccaucucuccagcccccuaauuauuuuaugaaaugaaaaaaaaaucuugagauuuuugcaauuugggcaauuaacuaaaaaauuaagaaucauugcuggggauggagacggggugaggggccagggggggaaggggugagcgggugucagcucuggcagguccucuuucuugugcuuauucuucuugaggcagcagcagagcgggaagagcauccuucgguggggguaagauuuggucuuacaagguauuuaggauugcuauaucauaauaaaacauuuccuaucuuaagucuaagucacuugccgcaguagcugaccugccuuugaacuccucugaggcuugaaacugguagcaccucauccuaaaacagcagagaguaaauaaagcagccuuugcucgagcucugcaggaacugugccgcucucacuuucagccugcugguugaagucacaggaagagaaagcgacacuuugaaaaguggcuuuagaguuuauuucuaaauuguaaaaaauuuccuaagaaagcucuuuaagaaaaaugggaauggggcuuguaaaaaaggggggauaagcgggacaaggagcacuaaaagaggggauaaggagaauaaugccaagaaaagugggacaaggagaagugcucuccucuuuguccucagcacuuauacaucuuucagcauacaugaucacgugauaaaagguucaucacaaaauacauagauucaaaucauauaaguuuacaauagagauguuuacaugcauauucauuagacuaucuggcuaaacauucaucaccugucacaacuccacaaguucauggagaguuaaaaccauaauuaaguuauuagugaaguuuuguauagauaaauccaguuaguauuuuaucuucuguccuagcaccuauaauaaauuguuaguucucuuuuuaugaccuuuggucaaugguuuuucaaccuuuuggacugugcucugaguaguagaaugccuacuuacuaucuccgaagccagauugacagaguucucauugcaguuuugauuaccagaaaggaccuaauaccaguccgacuauaagagagcuuaauaaauacugauauaauuuuaggaauucuuauaggauugucauuaagaauuaagucaucuauuugucuauauagcaucacuauauaagacuguauaucuuuguucuguaaagauuugcucaaaagggugggcuaauacguaguguuauauuauuauuuuuuuaauauaaauuauuauauuuaaguacauuguagcugucuucagacacuccagaagagagcaucagauuuuguuacggaugguugugagccaccaugugguuucugggguuugaacucaggaccuuuggaagagcagucggugcucuuaacugcugagccauuucaccagcccccauaaucuaggcagcuugcugaccuguacggggaacgaacccacgaacuuggcauuaucagcaccaugcucuaaccaacugagcuaacuggccagguuaauaacuauaucuauauaucuauagaugaagauauaccaggaaaagcauauuaauagcagcagucuuuccuaaaaugaauuucuccuuguccuugccuacuggagcaaacccaucauagauuuuuuuuuggggggggggucgagacaggguuucucuguguagcccuggcuguccuggaacucacucuguagaccaggcuggccucaaacucagaaauccaccugcuucugccucaggagugcugggauuaaagucuugcgccacaaugccuggcagauuauuauuauuuuuuuuuaauccaagauggaccaucucagaaagaucacuugcuaguuauuagcuuguuggcuucugacacaccauguauauguuaaaacuuagggacagguaugguggcacaugccuuuaauccuaguacuuguagcaauucuccuugccucuuaccuccugaguucugggauuauaguuauguucuaucauacccagcauaauucaauuuuccuaagauauauccacuauuuuagguauccgauugacuuccauuuagagguugaauuauuauguaauccaaguauuauauuaucgaauuaucaugcaaauuaggccagauuuuuauuggaaaguccaugccaucgugcucagaguuagucuacaaauuuuaucuugauuugggggggaggggguagggauggaggacaagagggauggcuucccucuugauacagcccaggcugacuuggaacuugauauguaacugagacuagcuuugaacucuuucuucuccugccuccaccucccaagugcuaggauuguaaggaugaccacaauaccuggcuucgauuuuuacuuugaguauuaauauuccaguauuaaguauaacaugguacuuacuguccuacauuucucauguuuuagagcucacaauguagucuuugcuucuuauuuuuagucuucuaaagucauauccaugcuccuaaucuaccauagguuauauuuuucaucuuuuuuuacuuguuaauacuaugugccuuuuuuuuuuuuuuaacagaaaaaaguuuucaaaaauggaugggguauauucagaagcuaaugaagagaaguaaguugauucggugcugcugaaauguuauuuucuauuacagaaaggccacuucaaauuaguuaagaacuaucaguaaugucugaaguuguuuucuauuuuguuccaaguaaaagaagucaguauuacaaagcaauagcuuuucugccaugucuguauaaguucauuagaguaagaacuuaagacuugaaggacuuucauagagaccaccucccaucucauuaaggucuuaugagaugaauugauuucuccaaaauugguaccauaaacuagugauccguuugcagccuaaaaaacaauguuguuugagacagucuuacuaugaggcucuuggcuggcuuaaaacucauaaguagaccaggcuagccucaaacucagagaaucaccugacuccaccuucauuaaaggcaugugccaccacaucuguuccuaauuuuuaauauauaugacacuuaauuuuucagauaauuaccaaaauugaaaaaaucucaagauuucauacaauaauuagguuuucaguuuuucuugaaacaccauguuggcaacaaaucucauauucucccuuggaacagguaacuaguagaauguaauggcagugaucuuuagacuaggcaagaacuaacacuaaacuauacucucaacuucuucuaggcccaccucuuugguacuagaaauugaauuucagauuucauaccugcuaggugagcgcucuaccacugagccucaacccucagucuucuucuauguuuugguuugagacagggucucacuaaauugcaaagacuggucuugaacuuacuugguaucugaggcaggcccaaauuugugacccuucugcgucagccucuaaacagcugauuacaggcuguaccaccaggcuugaccacaaugugccuuuaaaacauuguauucuuaaaugcagaguuggaugucuuauaacacauaaaggaugaauugaugacagcuuugagaaauucaguuguuuaucugcauauacaauaauuuuuccucuuuuucuuuuagugacaauacacagagaccuguuagaagacagcauuccucaguaagaaauauuuuuauuuaaauuaauaguuguuacuuuuuacugaauauaauuacaggaauuuugauuguggcuuuaccuuggcaucccagcuacuuuuuguuuguuuguuuacuuuuugagacaggguuucucuguauagcccuggcuguccuggaacucacuuuguagaccaggcuggccuggaacucagaaauccaccucccucugccucucaaaugccgggauuaaaggcgugcgccaccaccgcccagcucccagcuaccuucuuacugcuuucuguguaaagacucaaauagucugguuauacauuucaaaacuguacuaaaauucauauuuuugcacuuuuuuguaauuuaauaaacuuuugguuagcauauuucuacagcauugugauauuuuaaguguuuauauaauaaauuaauuucaauauuauaagugcuuaaaauguauaaauuucuuucuuuuuaaaauauguauauuuaaccuggcauucaaacuauugcaagacaaaaguuuacccaaguugauucacauaguaaauucauguuauauuaugaaacugaaaaacagugguauaggaugcuguguguagaaguuacccauaagggauucugacauaacucugcuggaauuuucuuuccuuuuuuucuauuucaacugcuuuuggguagguuuugcuaacaggcauaauuuauguaauuauuucugauugcuaugauauaucuaguacuucuuauuucuacguuuaauuucuguguaaagaguuugauguauuuucucaagguaggaaaauaggacuuaguacugaauuguguuagugugauuauccuauuauaggacaugcccucauuauugaacugcacauuaugaaaaaacaaacugcagacuguuagauggucucauaccccugaguugguguggagcguuauccagaacacuuagaagauuuugugcaaaagaauuugggugagugggucaggagaaggcauaaaugucagacauuuaagucagaaacauaacagugaauaauaugacuuugaagaaucucagggauuuuaauugaaauguuagcucucuacucauauaacuuaaauugacuaguagcuacauuaacuuuucuugacuaauucgaauuauugccuuuagauuuugaaacccccaaggaguccucuucaggaccucaaauguggaaaucaaacaaaccagguaagucccgagugcaaaugcucugcaauuucagggacuuuauuuuggaggacuugguuugcugagauuugguuucacuuacauagacugagagacuuugaaccuguggcaguucuccaccugagcuucccaagagcuuggauuauagauuucugucaucaugccuggcuucagagaucaucacaaaguuuauuaguuaugugaagagauaauacuauaaauguuucccauuuaaauguauacaggagggggcuggugagauggcucagugguuaagagcaccgaaugcucuuccaaagguccugaguucaaaucccagcaaccacauggugguucacaaccaucuguaaugggaucugaugcccucuucugcugugucugaggacagcuacaguguacacacauauaauaaauaaauaaauaaaucuuuuuaaaaauguauacagguaaguaucgcauugcuuccauuuucuuguucaagagcuagagauauaacucaaugcuuaccuacugugcaugagguugugguuauugaauaaguuggcauuuauaauuuuaaaauuccauaggauuagaauagggaauaguauuuugacucuuuaaccuagaacaggaucuaguacaugcuuuuagcuaucuggccuccguguauaacuuuguacguggauguuagggauuggaaauucaguucucucacuuauguggcaagcacuuuaucuacucucugucaugccuacugugacugauuagaccuuugaccauauagacugcuuaauauagauagcauacuguucuugguucuuuuuaaguuguauuuuuaacuuauguguauaugugaaugccugcacauggguauguauucuauaagccuggagcccacagaagccagaagagauaaccagauccuuuggagauguaaauacagauaauuaugagcuucccaauuggggugcuggaaaccagaccugaguucucugcaagagcuguacauauuuuuaacuacugagccaucucuccagccccuucaaagagacacauagucuuagcagcauuaaucacaguagucaagagguaggaaaaaaaucaagugcccaucuauuuuguuuaaauaaacaaaauuugcuauuuauaaauaaugaaauucaguauuaaaaaucugacacacaauagcaugcaagugucuuaaagaaauaaaugaaaagaaaaagucucaaaaagacaaauucuacucauaccacugauaauaaccaaauaccaaaauagaaugcugguugccaaggauuuggaggaaggaucuaaauguguauuuuacuuauuuguuuuaauuuuguguaugugucauaugcacccucaugugaaagugcccauggaggucacaaaggcaucagauacccuucuggaccuggaguuggaggugguugugaaucuccuaacacgggaaaugaacuaugauacucuguaagaguuguaugugcucuuuacuacuaagccaucucuccaauggcucaauauguauaguuaucguuuguaagaugaagaucuugagagugguuacacaacaagaugcuuucaucacuauugaacuguauacuuuuaaagugcuaguaaagaugagggugcugagaugacucagugguuaagaacacuuuuugcccuugcagaggacacagauucgguugcagcuaaguagcucacagcuaccuguaacuguaguuccagaugaucugaugcccuuuucugacuuccauggcgccugcauguauauggaauacauaaacucacacaagcacacauaaacacauuuuuuuuuaaaugguaaagaugguaaauuuaacuuuauguaguuuuuaccacuaacuaagaaguguaaguacuugucaaggcagagugguuaagauguaaauuauguuauggcugggugugauggcacaggccuguaauuucagcacuaggaacaugaaauuucaaauucauccuugggcuuuauagcaaauuugaauauagccugaacuauggacuauaauaauuacaacaaucacaaaagauaguaacuuauguggauuuuacuauaaugaaaguuuuuuuagauggacaaguugcugcaugcuuuuaaucccagcacuagagagcagaggcaggcugaucucuaugaguucuaucuaaccuggucuacuuagaguuccaggcuagucauagcuacauaguaagacucuauguuacaaacaaacaaaaagcuguuuauuuguaauuguagaauacauuguaauaagaucaauacagcugaccacauagcuccuguuuugugcccagucuuucuuguuauauauuguuuguuaguaugcuuauuucuacuugauuuuagccaaaaggucaaaaaacaauaauauguuuauuuuaacucuuacugaaaaucaugcucuaggaguggugacacacaccuaaaauuccagcaaucagaaaccugaagugcaaggauuaugaauuugaggucaacaugggcuauguauuugaaaacaaaguaacaacaaaagaaaauacauauuuacaugaaccacggauucaauccugaguacuacagccauccaaagaguauuuggaaaaucauauucauguucauuaagugcuuuuauauugggcuguuuggaaaucuucuauuauuaauucaaaauaagaguugaucccugcuucuaauagucuggagaucuaguucaccaugauuuauauuaagaauuguauccuuuacuguuuucucuuaggaaccuaauccuccaagaaaaaggaaaagcucucgucgagucagcuuugcagauacuauaaaguaaguugaaaagaaaguacauuguuauagguuuuucccccuaucaaauacaugggugggaacuaaauuggauagucuguuugcuuaaauaaauauuagagugcaugugugcgugcguguguuccuguguaaguaucuuccucacucuccacuuuacuuuuugagacugggucucucuggucuggagaguccgcucagcaguuaagagcacuuccagagguucaauucuuagcaaccacaugguggcucacaaccaucuguaaugggaucuucuggugugucugaagacagcgacucacauacauacaauaaauaaauuuguuuguuuguuuguuuuuuguuuuguuuuuuuuauuuuuuuugagacaggguuucucuguauagcccuggcuguccuggaacucacuuuguagaccaggcuguccuugaacucagaaauccaccugccucugccucccgagugcugggauuaaaggcgugcgccaucaugcccggcauaaauaaaucuuaaaaaaaaaaaagagagagagagacauggucuuucuaucaacauggaacuuauugacgcagcuagacuggcuucuuuaugggacccagggggccuccagucucuauuucccagcacuggaugggagucuaaacucaggucuucauguuuacauagcaagcacuuuacugauggaguuauccucucacaaccagaguauugcuuuauuuugaaaaguacuuuuuacuuaaaauguauucgugugugcauguauccugcccuggcaugugucuggaggucaggggauagcuuuuggcaguuacuucucuccuucuacuuugggggauugaacucaggcuguugucuuucacaucaaguacuuuuauccacugagacaucuugcuggcauguuuuuguuguuguuguuguuguuguuuuucaagacaggguuucucuguauagcccuggcuguccuagaacucacucuuuagaccaggcuggccucgaacucagaaauccgccugccucugccucccaagugcugggauuaaaggcaugugccaccaucguccagcuauauauuuuuuuaauuccuuucaaaauauauauuuaugggacugaagacauggcucagcaguuaagagcacugguugcucuugagaggaccugaguuugauuccuagcucucacauggcagcucagaaccaucuaugacucgagcuccaggagacugggcucucucuuuuugccucugugggcauggcauacaugugguguacaaacaccaauauacauaaaauuaaaaauguaaauguauuucuuauuggugagagugcuguguaugagugugugugauuugugugugaguguggguacaaaauuguuuuucaaauguuauuauucgguauuaucuauauaagagaagcagaaugaguccugaaaggcaguaacaaaacaaagauaacuacuaauauugcuacuauuuaccauuguaguagagguuccagccagcaaaaguaaaggaagagauuuuaaaaauuagaaauacuauugagguacuuuaugccgucaauaauaaaacaauaggaaauuuuuuaaaaauaaaggcuuuucaguauucuuuuuuucucuucuagaguauuccagacagagucucacaugaaaacagagagaaauucagaaauuucagguaaauauauaauuucagucccugcuaaucuguuuucuuuacaacuuuucugugguuauguacucauaaccccccccucucucucucucucgugugugugugugugugugugugugugugugugugaagaaagcauacaucuuaagacauguagagucaagagaaaguugagauucucuuuucuuucuaccauguggucuucaagauugaguuuggguccuucuuggcaguaaaugccuuugccgccuaaguuauuuugcuagcucuaucauacuauuuaauauuuaaguauuuuaucuuaagggauagagaaguaguucuauugguaaggcgauugccauaccuacaugaggcccugaguuuggaucuccaguaccuauuuaaaagcccaguguaggcuaguuguggugaagugguggagggugacagaugaagcaguacauaccuuguauugguuacuuuucuguugcugugauaaagcaccaugaccaaggcaguuuauaaaagaaauagguuauaagagucuaucaugaagcugggcgugguggcgcacgccuaugauccagcacuugggaggcagaggcagguggauaucugaguuugaggccauccuggucuacagagugaguuccaggacauccagggcuacacaaagaaacccugucucaaaaaaacaaaaccaaaaagaaacccaaaaaacauguacacaaacaugugguauacaguuguaauccugucacccuggaggugaaugcaaaaggaucagaacuuuaaggucauccuugguuacauagcaaguuuaaguccaaccugcgauacaugagaugaaauauaaaaaauaaugccaggugugguggcacacaccuuuaauucuagcacuugaaaggcagagguaguuggaucucugaguuugaggucagucugaucuagauagugaguuccagauacauagacauugucucaaaaagcaaguagauaaauugcuagcacagauaagauuuauuuuuuuccaaaacagaucuaauaaucacuguuuucuaucauuagaaaaggcucucagggacugcaguauaacucaguaguagaaugguugcuugccaugucuuggguuugaucuucagcauuggaggaggaaaauaugagcucagaaucuauuuauuuauuuauuuauuuugguuuucugagacaggguuucucuuuguaucccuagcucuacuggaacucaaucuauaggccaggcuggccuugaacucagacaucuaccuaccuuugccaccugagugcuggauuaaaggcguaugccaccugccaaucuuaaagauauuuaauucauaaguccuuauaaagaccuuaauaacuauugucuuaguuauuauuuuuuuauuguucuguuaagcaccaugaccaaaaacaacuuggcaaggaaaggguuuauuuuuguuuauaguuguaguucauuuugaugggaagucaggucaggaacucaagacaggaacaacauggaggcaggaacugaaggaagagaccaaggaggaacacugcuuacugguuugcucaacauggcuugcccaucuugcuuucuuauacaaggcagguccaucugguaaggagugccacaaaccacaacaagcugggccuuuucacagcaaucauuagucuaggaaaggcacuacagacuugcauauucucaacugagguucuccuuuccagaugacucuagcugugucaaguucacagccaaacagccaggacacugguaaauacuucuaacugaugacaguccuaagaaagaaaaaaagacuuaugguaugauguuuuucuuacuguaaucuuuuucuuauuguucuauagguaugaacacuuugcuuugugcuccaauucagacucagaugcaacaaaaggagguaugaaaucaugcaaauaucuucauaaauuaaacucacauaguuaacaaaauuuuauuguagugguauaauuuugagauaacuuaccaaagugaauuaucauaaccuauuaaaacuuccuauauuuucaguuaauugagguaaauuaagucauugccaauuuaaauaauacaaagaccuuucaaacaucaaugaucacaugaaauaucucagaauuuuauuaaaauauagaggguuuuuuggggggauugaagauauagcucagugguauuuugccuagcauaugcaaaugucuauauucaauacccaguaucacacacauggaaaauauguauuguguguagguaggauagacagacagacaaguauauguccaguugaaaaggguaaacucuucagagauuguauauauuuuuuaaauauuuauuuuguuacagaauguaugaguguuccacuuuauguaugcaugcauugugugcgagaggauaccagaucccucugaacuggaguuagagacaguugcuagcugcuauguaggugcuaggaacugaaccuugguccucugaaaaaguagagaaugcucuuaacugcugaggcauuuuucuaugccucaagaaucuacauuucuaaccaucucuugaaugacacugacaugcaggugcacagacuguacuuugaauaacaagaaauuagagacuguaucuuugaaaacaagacucuccaaagaaaagaguguaauaugaacuagccaucauguaccuaugccuuucuaagauuuuacuuaggguugguaauucaauacagaugccuuucuaagauuuuuuauuuaggguugaagugacuauucaauacagaauuuucauuauaguuucauuucauacauucagugcuuuuuauuuuuuuagugcaggaggcauguaacuaacuuugaauuuaaauuuuuccuaaacuaaaaggaauuuauuuauagauuuuagcuuuuaaaaagaaauguuugaugccuagagagauggcucagugguuaagagcacuggcugcucuaucagggguccugaguucaauucccagcaaccacaugguagcucacaaucaucuguaaugggaucugauccccucuucugguguaucugaagacagcuaaaguguacucacauauauaagaauaaauaaaacauuuaaaaaaaauguuugagauaaguuuucaccccagucuggcuugaaacuuacuauguaacuaaggaugaauuugaacuuuuuuuguuguuugagacaaagucucacucuguugugcagccuuggcuaucuuggagaacacuguauaaacuugguuagccucaaaaucacagagaucuccuaccucagccucccagagugcugagaugaaaggcaugcaccacucugcccagcucccuugaacuguuugcugauccucuugccuccauuauagaugugaauuaacuuaucuggucuauguugugcuggggauugaucauagggcuuuauaauaacaugguaaguaagcauucuaccaaaugaauuauaucccuagaccuagggaaaaaaauguaauaagaaaguacauauaauaaacuauaccaaggaaagcaauauagcuuggaaccauuacuaauugugcuuacauaguacauguuaggggcuggagagauggcacagcaguuaagaacaccgucagcucuuccagaguuuaaucuccugcaaccacaugguggcucacaaucaucuauaaugggaucugaugcuuucuucuggcaugcagguguacaugcagauugagcccucauauuaauaaaauaaauaaaucuuuuaaaaauauauaauacauguuauaaaauccuuuuuucaaaauguauuuggagcuagagaauuggcuuaguugguaaauguuuuggaugcuuuuccagaggaccuggguuaacuccuacauugcaauuuguaaucaugugugacuauaguucuaggcaauucuggccuccacaggcaccaggcaggcaagugguucauaggcacacaugcagguagaacacccuuacacauaaaauaauaaaacaauaaauuauaaaaaauuauauuugaucuaauauuucuauuuuuucauuauaguucucaauuacagacugcaaccaugaaaggaaacaugcaaaugaucagacagucaucuuuucagaugaaaaccagauggaucugacagcaagucacacuguaaugauuaccaaaggucuuucagacuguaccaaaaaugaaaauucuacaaaaauagauaccacguccuuucuggagaauuuaaagcaucaugcugcaaauucaagaauuaaaaaggauuuagcauguuccacaguuuccuuaagucaaaacauuuucucagaaaagaucaauucugacaacuucauaaaaagauugaagacaggaaaacauauuucgucuucuacagagcuugauaaggaaaaugcugagauaccuguuuauuccaaagacucaaacagugccucuucaacauaucaaaugcaugcaucucuugguguagaugaaaauaguaguaauaggacuagaaucuuuagagaacaagaugaugguaugaauuugacccaaugucauacagccuguauuaagacuuggauuccuccauccacggaggccaaaauaggagaauucaaaggugauaaaacaauuuauggcaaugaguguauggaguugacaacuaacuauacgauacagguuuugucaucagaaaauaauuuaucugaaagagaaacucaaacucaaaaugguaugaauguuacaacaguugauggagcuacagcuccagcuccagagaagaaaacagcccuuaaggauaaacuaaaugcugcuuuucaaggcucuuucccaaacccugaaaauaaaauucauauuaucaaaugucauccuauagagucagaaacucauacagucacacagauuucuagucaaagugccagcacauuggcuguaacuucaaaaucuauauguucuaguccagcuauugagggguauaagacaauuuuucauucuaguagcaaugaugcaauggaacugacuaagugucuaucagcuauggaagaggaaaaaaaauugcugaaggcugaugauaaguauucuaaaauauguaccaauccagaugcuggcccacucagagagaaaacuauuuauuuagaagaggauagcauggacauuaccaaaagucacaccguugcaauagauaauaaaauauuuaaacaugaucaagaaaacauuaaaaaagaaauaauagccauaccaauauuugaaaaggaaauggugcuccgaaaucuuaugccuaugucaaaagaugagaaaagggauguaaauuauauuucaguuccucaaguaucuaaggaaagcuuacaacggagucagacaaacacuuuaucuguuucauugacugacaaaaagauggaauucuuggcagaugaagauauggaucugacuaaaagucacacaacuaaguuaagucaaguuauuccuacaacuuuugacuuagcaucaaagaaugucaccaaaucauacucucacagcaaaagcccuuuaaaugagugggaaagccuggauaaacaaguagugcuaggccagcauucuaaacuuccuuuaccacagaggaaagauagagaugauccugacuguucucaucauaagauaauguauucagaggaguuacaaacuauggaucuaaccaagagccacacuauuguaauuggcuuugguccuucugaaguacaagaacauaguaaaauuaauuuagaacacaaaaacagccaacuuacagcagaaagcauacaaacagcugugaacguuccugcagcaaacucuagaguaguaacaacuaaugauauggacauguuaaaggacagaaguacacauaagccagaauugcugaaggaaaagcaaaacaucaaaaucuauggaagaaaaaguauugguagacugaaaauugauaaaacuauauuauuuucagaggguaaugagggugauauggauaucaccaagaguugcacagucaaaauaaaucauagaucuuuauuagauaagcaugauucucauuuaguaucuuuggcaggaacuucuaaaaccauuuugcaugcacguggucagguugaaauggaaaucaauagaagucacacaacuccuuuagaauguaaaauuaucucgcccagugauauaacuccuggugaucuggauaagacuaugaugucuauagaugaucaugaggaacuagacaugaccaagucccauacuguuuucauugacuaccaagcagaggcaaaagguguacuuccagacagacuugacuuucaauuauccaaaaaggaaagccuacagaagccgaaagugacaucucuggcugaagagauuuacauuucaaaaaauagugaaagcaaccaucuaccagcaaaaggcagccagcuaacaauauuagaggaagggucuaauagcgggcuuggagaggaaacuaaugaugcacaaaagccuggauuucugaaugaacuucugucaggcaaaacucagagaagaaaaagccuuagccucaaaaacaagaguauuacauuuccagagaaugauaaaaguuauagagagaucccucagaguucugcaguagaaauaaauaaugaaacuaggcuggaagacagaaagggcuucaguuuugugccauuggcaggaacuuccaaaccaguuuugucugcauaugggcccgaggacauggagauuucuauaggucaaaccacugcuucagaauauaaaacugucccaccagaagaaauaacuacuauaccuauggauaaaacuguaauguuuguagauaauuucggugaucuggaugucaccagaucccauacgguuuucaucgauugucaagccaaagaaaagguacuugaugaauauacuaacuugggaauacagaaaacaaaaacuuugagugguucugaaggugauacccauauucaagaaaucacaaaaaacccagcagcucaacacaaacaccauaugacaacuguuauuccuucuaguacaguaguuagugaucaaaguucaaugaaaaucaaguuucacaaagcugauagagaugaggaggucaaaggaaaggaaguggaagccaauaugcugaaacaaacuaaaccugaaagcugucuguuaaauauaacagauggaaaaaauguggauuuuacaagcaguuauacagcugauguuuguagauccagugacaaguauuccucuuuaccaaauauuucuucuucugauaauucgggugguaauacuauguccuugugugauaaaaauaaggagaaagcuuauaauugccaagugccaaaugaauuuacuuaugcagcuaucuuaccaaguacauaucacauggauucuaaaaaacugucugucuuuccaccuuguccuucaaaagaagucacucaaacugaaagugccauagcgcugcuuaaagaugaagauccgguagaagagccucugggggagauggcuacauuuaacucaaagcauguaucucuuaaccuggcaaaggaucaaacagaggccuuuguugauguuaguguugcuucucagccucaucucucagcccaacaaaguccaucaacucaaaaagggcaggauguugcccguagagaugaaggaauauuagcuaaagcugggaagaaggcuuuaccuuuucuucuagaaaaugucgcugcauccacaugggaaaaugaguccaaaauacccacuaauguggaacacuuugcuguaaccuaugaaaaagaacugaguauaaguauucaaacagauaaauguaauacaaauguacagagcccuaguaacucggcccugacaacacaagucauucagacgcaugcaaaugcugaaggagcacuagacuuuuuaguuccaucuacuguuucauguuuuaguaguaccaaaccaagucugaguaauuugaauagaaaaacugaggaggucuuagacuuucagacuguuaauuuauuaccuccugccgaacaguuacuugaagaaggaagucaggcacauaguaugaguauaguacaagcuacagaaauauauagacuagguuccaggaaugauagagaugaagaaaguaaaacuuucuguaaugaggcugaaacuacaucuguaccacuaaaaacagcuguuaaagacaaaacaagaagauguucauuggggauauuuuuacccaaauuaccaagcaagagaaguuguaguaucacugguguugaugaccuggaacagauucuagcagaugcagcugacuuaacucaacuagaaacucagccagucuguaguaaagauccaggcauuggaucuguugcagccaaacugaauuugaguccaucucaguuuauaaaugaggaaaaucucccuguauauccuggugagauacuuucaucagauucuguuagccuggacauugaggaaaguguucugauugacacaucucagagagagaguuuaccgucugaaaacaaaaccgaaaacugcagggcccaaaaaagaacccggguugaagaaaaugauguuacaaaugagaaaaaaaucagaacacaugacagugcacaagaucaagagguaagcugucuugagccaaaaaauguucuugaauuuuaaguaucuaagcaauagaaacuauuucuacuuacuauagguuagugaaauauuccuguguagaauuauuagaggucaguugguaaaggauuuaccaugacacgauggccuauaccuguaaucccagcacucugaaggcuaaggaaaggggacugcugugacuuugaggcuagccaaggcuacguaacagaaucuuaucucaaaacaauaauuuguuguggcaaauacccacaaaaauggaauuaaaauuguauagauaccaaauauuauaauugugucuugugacuuguaucaggugccucauaauugcuuguaaccccaggggacccaguauccucuccuguacucuucagauaccugcaucacacacauauaccuccauacagguauaaacacuuguacauaauuaaaaaugaaaauaaguccuuagcaaaacaaucacauaaauagccaaauaugauagccuaauauuccaguacucaggaaauucaaguaggaggaucacaaguuugaagucagccugaguuauagguugaaguaaggcuuggugugugugugugugugugugugugugugugugugugugugugugugugugugugugaacaaaaacaauguaaguaaguacaaaaaaugauuucuguguugcuggaguuugcuuugaggugaggugaugagaaaauagccaaagcuuugagaaacuaauaauaguaauauaaugcuuaaaucugacuagauuuuaugaaaauuaguauuuuguugaaauauuauauaucugacuaaaucaaugguuguuaaccuuccuuaaugcugugaccucuguauuuauguauuuuguguaugaguguuuugucugcauguacauuuacauaacagagggcagcagauuccaugggacuacaguuauugaugguugggaauugagcuccggacuucugaaugagcaaccaguacucuuaaacccugagccauaccuccagcucccagcuuugacccucuaauagagaaguuccucaugaugugcugaccccaaccauagaauuauuugcaaugcuacuucauaacuaauuuugcuacugcuauuaaucacaauacaaguaccuguauuuucugauguugucaagcaaccucugugaaaggguucauccuaaacccccaaagggauguaguucaguuuuuaagacuuuuuaaaauauuuuuuaaaauuuauuuauuuauuauauguaaguacacuauaguugucuucagacacaccagaaaagggugucagaucuuguuacagaugguugugagccaccaugugguugcuggaauuugaacucgagaccuuuggaagagcagucaguguucuuaaccgcugagccaucucaccagccccuaaaauauuuuuuuaaagguuauuaaucuuuuaaagcuuaggccuuagcugagcagucucccagcaauucuaaaccuacuaauccugguucuacauccugccauguggcuacaucuaccucucugcucagcucuggucugucccuucaccucuguguacccuggcugagucucccaccucugauucuucucccagaguuccucuacccagaagaucugaccagcuaucaguuaucauaucuuuuuuuuuuuuuaauuugguuuuucaagacaggguuucucuguauagcccuggcuguccuggaacucacuuuguagaccaggcuggccucgaacucagaaaucugccugccucugccuccugaguccugggauuaaaggcaugugccaccaugcccggcuccuucauaucuuuauuaaagccaguuagaucuaauugaucuugauuaccuuaggcaggugagaaaggaacaaauauuuacaaaacaugagacuagugaugggucauagaaauaacaauacuaagauccggcuauuuaguucugugcaggugccaaauuaagaauugaauauauaagaggcaagaggauuucugaguucgaagccagacuugucuacaaagugaguuccuagacagccagggcuauacagagaaacagaaacccugucuugaaaaaaacaaaaaaacacaacaaaacaaaaaagaauugaauauauagagauauaccuucauacaguauaccccaacaaaaugaagcccuggcuaaucuagaauuugcuaucuagaccaagguagccuugaacucagagagucagaacugucugucuucugaauucugagaguaaaacacugauacuuucugugguggcucacaaauuuaaucccagcacuuuugaaaggcagaggcaggugaaucucugaguuggaggccagccuggucuacagaccuaguucuaggacagccaaggcuacacauagaaacccugucuugaaaaaccaaaauaaauaaauaaaauucuacucugcauuucuuuaguguauggugagagauacauuuuuguauggguauauuugcuuguuaguguguuugccuguguguauaggcaagaagucagugucaggugucucccuuuaucauucuccaccuuauucugaaaccaggacucucacuaaaccuggagcucaccaccaauucagcuaggcuggcuagacauugagcugaucuccacuucccuuccuucucugcccuccacuccugggaugacuggugcaugcccuguggacacuagggaucgaaacucaaguccucauuggaccaucucuuuagacccuaguuuccuauucugagguagcuccacuauuggugacuagcagcuaaauaauugcauaaauugacuuacgguaucuuucuauaacugagguacaacuaagaaauaauuuguuuguacuauauagcacauuaacuaccauuaaaagccuaaauugccugauauucuacuucuuucucucucucucuuuuuuuuucuuucuuuguuuuuuuguuuguuuguuuuuuugauacaggguuuuucuguguaauccugacuaucauggaacuugcuugcuuuguagaccaggcuggccucaaacucacaaagauccaccugccucugccuuccaaguggucccaagggcaugugucaccacugcccagugauauucuacuucuuucauaaguuauugcauaugaauuauguagguaaauuuuguuagaaacaguauuuuuggcuggguggugguguagugugccuuuaaucccagcacucaggagucagaggcagguggaucucugacuucaaggcuagccuguucuaggacauaaagaaaccucguuucagaagacaagcaaaaaaguuuuuacugguguucaagauuuagucacuaaguuccaagcucgucacuuuaugcugauauuuuuagauuauguacuguguaccugaggacacuuuugugcauauguaugauacggauggaggaacaugccacagcauguauguggaugucauggcaacaaaguugauaucuuaacuuuguggagucaauuaucuucuuuucccuucauguggguucugggaauggaacucaggccacuaagcuuacauagcaaguguguuuacuuuuaacuggcucuuacgcugauguuucuuugguaauuucagauuuuugauaaucauauggaagaggauaucaauaaaaaugucaacaguguauugcugaaaagccugagcaggacaccgucuaguugcagcagcucucuggauucaaucaagucugauggacucucucuggaugucagcaguaagauacuuaugaaggcuaaauaauaacaguuauuugaaucuaugauuaaugaguauauuucacuuaagaaguauuuggauguuauauaaauccuuucaguguugaguugauagguaauuucacuuuugauuuuuuaaaaauuuguagugaaaugacacguguuguauuacagagaacuaguugauuuccuccaaaagcuuauaauuagaagggaaacauugaauggaaccuuaaagcuauauuucagauauuuuguuuuaauaagugaaaagcuucccagaaacaugggaugcaucaggaucaugaacagcacacaaguuugaaagauaaucaaaauuaacuuuacauuuuaguguuuguucauuuguuuuugguacaaggucucaccaccuguaguuuuggcagccuagaacugugauguagaccagauuggccuuaaacccagaggucugccugcuucugcucagccaguguuggcacuaaaggugcgcaccaccauuucaagccugucaguuuagcuuuggcuugcuuaccguuuacauaaauuuugcuuuguuucuagcacagcguaauagccaaauggaaucacaguuucuuggugacacuaucucugaagagaguuugaaggagguauguuaauguauuucucauuuuaauuauuuuacauuuauuauuuauuuuguguguguguguuugagugcauguaugccauacuacacaugugacagucugaggacaaccuguagaaauugauccauccuuccagcuugugggucucagguauugaacuccggcugucaggccuggcuguugagugcccuugccuacugagccaugccaugggcugcgauuucucacugaaguuuuuauuuugcuuguuucuuuguguuaaaacagcaucuuccuuuguggcccuggcuagcuuggagcucaccauguaaauuaggcugaccucaaacucccugagaucugucuuuaucugccuccaaaguccugggauuaaagccauguguacuaccacaauggcuuaugucuugcuguuuuguuuuugucuuuuuguuuuguuuuguuuuuuaauuuuuuuuuuaauuuuuuuucuuccuagaauuucucuguguagcccugacuguccuagaacucagagaccgaccugccucucucugccucuuggagugcugaugucaaagucaugugccaccaccccucagcuuuauuucuuacuuuuaauacacuauuuuuaaaugucuuuuguugcuuuuuuuuuucuauuuauuuauuuacuuacuuauuuuuauguaugugaguacacugucacucucuuuagacaccagaagagggcauuggaucccauuacagaugguugugagccaccaucuaauugcugggaauugaacucaggaccucuggaagaaguuuggcuauuuccaaacuuaguagauaaagcuguuuagaaaugaaugauguuguuagagacaaagugaauucacuuugaguguucauauaaaguucuuuuuuuauuuuuagaaacucaaggauggacaaauuacaauaaaggaguucuucauacuucuucagguccacaucuuaauacagaaaccuaggcagagcacucucccagccaaaguaagugcaauuucuuggcaaacauucaucaaaauaucaccagcccacauuaauauaucauucuuuuuuuauugucauuguuguuguuaguuaaguuagguuguaccaaugcaaacauuuauuaaaagauaaaaucaugaacuagggauguagcucaguugguagaggccuaccugcuaugagugaagccucaagucugccaagucuaacaucgcaaauuuggaugcucuggugauguucccuuuccucacacugauguacuugcagucccagcugugaucucucuaaacauuccagugaugccuuuugaggcaagaucucagauccagcuugcagcucucccaguuugacauccgugaguguuuuuucuccaucagugguauaacuaacaauaucuugaugucaauagauccaagucauacucaagaagaaaagagacuugaaaagucauagauaucaaaagaaauggguauauguagaucaugggaaaugagguuuauagcuguggacaucaucugucccaagauuuggaugacuguaagucucuguagaguagaagugggaaacauguuuuuagugggauuggagauguugcuagccuucauagacaaugucuguagcucccuuauauuucuguguguuguaggagcucagcuggcugcacuaguagcgggugcuuuuauaguuauccuugauccuugcaucuuuauggagaaguucaagcuaaaauacuguaacccauaaaguauaauuaggucaaagaucuccuuggccugaaauacccaaguauuguuuauauauaaguuguacauuuaaucaaaaugaguaaaaauggcuuguacacauaaugucuaauucaagaugcaacaaauuaauuuaccaacugaguauaauaauaauuauccaauguguuccacagggcaugagucuuuuauccacuggcacuucugcuauuuuacuagacacauaauuguaugcuuuacuuuuuuuaaauuuauuuuccuuuuauguuuauugauguuuuauaugcaugcauguucuguggaucacauuugugcaaugccuaaggaggacagaagaggucauuagauccccugcuacugcaguucgcagauaguuguaagcuaccaugugguacuuggaccaaaucucuguccuguacaagagcaacaagugcucuuaacugacaagcaaacaaaaaagagauuggccuuguauugaauggugaugccauguaauauuuucauaacuuucuuuucuuguucuuuuacaaagaaucuugauuucauuuaguaucaaacaguguuagaaaacacaaucuacauuuuccuauugccauuucauuuugagucaguacauauaguuuugauuuuuaugccuuuaaaaauauuuuuuaagccgggcagugguggcgcaugccuuuaaucccagcacuugggaggcagaggcagguggauuucugaguucgaggccagccugguguacagagugaguuccaggacagccagggcuauacagagaaacccugucucaaaaaaacaaaaacaaaaacaaaaacaaacaaaaaauauuuuuuaagaacuggaggacuguaaccagguaucuucaacuccaacacuuagaggcaaagaagugcagaucucugugaguuuaaggucagccagggcuucacagugaaaccguuucuaaaacaagcaagaaggugauaaucgagccagugagaugacauaguggguaaaggugccguacacucagcugacuguguaaguuugauuccgcaggacccauaguggaagaaaacugacuuucacauucaugcugugacuugcaugccacauacauaauaaauaaauauaauauaaaauaaaaaaauaauuuuggcaguaugcugaaugugguggcccccaucuauaaucccaguuccuaauagauacaaccaggaggaucacagguucagucauucuugacuucauguauauuucaagggccaccaagugucugugagaccuugucugaaaauaaaugugggaggggcccaaggagauggcaccaugauuaaaagcagucucugcuguugcagaugauuuagguuucagucccaauacccauguggcuguucacaacuguauaacuccauucccaggagauuugacagccucuucugacuacccagggcaccaggcaugaaugauguacauaaauacaugcaaagaaaauauacacacccagguccuggggacuaaacacaguccucaugcuuauauaucuuccagcaacuuaauagauaaguccaaaguuuagaaauugaaauaacauauuaaccaggacagccagggcuacacagagaagcccugucucgaaaaaacaaaacaacaacaaacaaacaaacaaaaaagaaaucauauuaugugcuaugcugcuuguaaguaauggaugaagaguuauuugguuuuuuuguuuguuuuuuuuauaaguaaugaaauuuaaaaccuuguuuaguuuuuuuuuccucccaaaacgagauuaaaugcauuuauuugucuuuaaacuagaguugcaaaacauaacaaacuauucuuaaugagugaguggguggguggguugguugguugguugguugguugguugguugguugguugguugguugguugguugagauaaggucucuaguucaagggagccuggaauuuagcagaagauggcuuugaacucacaaaggcaaggccauuuugccucagucuccuaagugcugggaauggcaggcaugagccacuacugccuugauuucuuuuuuucuccuuucuaguuuaaguaaaguaguuccuacuaagcuuaauuuuuaaguauuguuuuuuuuaacuauacuuaucuauugcguguauguguauauauguacaugccuguauaugcuuugaggugaaaggacaauuuaugggagccaccuugcuaacccuugauuuucuuaaaacaauucauguuauuuuuaaacccuuucaauccuauaagucaauauucuuagcucacccgaucacccauggaagaguggacuuugaacccagaacaucauauuacucuauacugaacuacacacccagcccuguuuguuugacuuuaaaaauagacucucuaaaacuugaauuuguuauuguaucugguauuguccuuaaaaugccaguuuugagcuagguauaaucgugcaccucuguaauuccaguacuuggggagaucaggaggucagugugaucuucaguuacauaggaguuccagucuagccuggguuacaugagacccucucuuaaaaaaaggaaaagaacaaaaauccacaccugguucucccagacauggugucacagcguggcaagagguaagacaagaggauccuaaguuccaggccagccuaaacuacauaguaagguucuagcuuagguuuuaaaagaaaaagguaucaauucugauugauugauugauugauugauugauugauugauugauugauuacuguuuuuuuuaaguuuacuauaaacacauuaccuaccacagaagaucugauguugagacaauauguuuauggacccaggauacagauuuauaaagaagacugugagcuucuucgacaaaagauugacgaguaagaaaguuuuauuuccccugugauuguuuuucgaggguuauaauaaacaagugaucuguguaguauuuuaauuagaaaacugcaguaugggaaaaagaauggaauuaacaggcaguauuaugaauagaaacccaauucugggggcuggagagauggcuuagugguuaagagcacugacugcucuuccagagguccugaguucaguucccagaaaccacaugguggcucacaaccaucuguaaugggaucugaugcccucuucuggugaaucugaagagagugacaguguacucauacauaaaauaaguaaaucuuuaaaaaaaaagaaagaaagaaagaaaagaaacccaguucugucuacaauacuguauagccuuguauaagucauuugcuuuccuuuucuacuucauaaaguaguaaugacccagcacuugggaggcaguggcaggcggauuucugaguucgaggccagccuggucuacagagugaguuccaggacagccagggcuacacagagaaacccugucucgaaaauaaaauaaaauaaaauaaaguaguagugauaucuauucaauggauaccacgaggaauagcuacuauuugcacaaaacguuuuauaucaugaugaauaaaaggauaaacugaaauuauuauguuauguuauaaauuaguugaaacagaacaucuucaaaaggauauaauaugccaccccccccccacacacacacaccaauaagacaggguuucucuguguauccuuggcuguguuucccugguuaagagcacuugcuucaaagucauaaggauaagagcucugauuccaauauccacaucaugccuauuuggccuccaagcccaaagauguauuuacaugaauaaauaaauaagcccaagaaacaaaaaagccaggccauucuggucuacaugauaucuuuucuggggaaaaugauuguaucuauuacuugguaggauggcauaggccuucucauccuuguacuuaggaagcaaaggcagguagaucucugaauucaaggccacccaggguugcaaagugagaucuuaucucaaaauagaguaauaauaacaauuguauaguauucaaaaucaaaguuauuuugguauuucuaauuuuugcuauauuuuuucccuuaauuuacauacauaaaguauaguuuuacuuagaauauagcucaaugcuuggaucuuuguaaauauuacacccagauuuacaauuuauuuaugaaacuacuuuaccuagaauucaaaauaauguuuaugucaugcuauuuuaguacuuuccaguuacuuuugacccaaucuaacaaaaauaaauaauuuuuaaguguugggguuuuuuguuuuguuuucuuuuuuccuuugugugugugugugauacugagaauugacuuuagagcuuugagagugcuaggcauuuaauuucucugccaaugagcuuuauccuuagcuguacagagcagauagcuuugaaguuauuuauuuuauguguguggguguuuuguaugcaugugugucuagugccuguggaggccagaaagggcuucaaaucgccugaaauuggaaauacauggugagcugccauguggguagagcuguggauguggaacugguccucuggaagaacugucaguguucuuaaccacugggccaucucuccagccuuacuuagguaauuuuaaauuuaaaauuuaaaauaaaacuguuaaguauuucaucuggacauggggcauacacucauaaucuccauaguaaggaaaaaagaugguaaauucauagccauccugugauaacuauauuccaggucagcuugggcuauguaaucagacccuaucuacagaagaacaaacaaaugcaaugaggaccucuguuguaugguuaaacggaccugaggucaaaccucuagcaccaguguaaaagaugcuagcacaagcaucuucaaucucagagcuccuaccggaagaugggaggcagagacaagagacccuagcugcucaagggucaugugaccugcuauacacagcauuagaaaaacaaaaaagggauucgggccuuaaacaggugauaacaagauuguccucugaccuccacacacaugcccauagacacacacuaaugugcacauauacacauuguguacucaacaaacaaggggaaaagaaggaacaaacaaaaaaugaugguagaccaauugucugauucuucuuuguucauucaacauauuuauguagcaccugcuguuuaccagaaucuacauuaauuacuagggcucaucacugaauaagacagauaagauucuuaauauuguuuuagaaagugaaaugcaggugccuggacagguugcuagugaguaugaucauaagaagcucacuacugccugcaacuccagucaggagauugaugcccucuccuuaacucuuugguuucuuucauguacauaguguacauaaacuccuucaaguauacauaaaucaaucaaucaaucaaucaaucaaucuuuaaaaaaauggaaucuagccuuaaaaaguagaucuuguuuagauuuguuuuguugcuugauauauuuuauaauuuguuuuguuuuguuuuguuuuugguuuuuuuuuuuuugaggcaggguuucucuguguagcccuggcuguccuggaacucacuuuguagaccaggcuagccucgaacucagaaauccgccugccucugccucucgagugcugggauuagaggugugcaccaccaugcccggcauuauauuuuauaauuuuguguugaggauauauaucauucaguggagcacuugcauaauuuugcauaagggucuagccuaauucucaguaucacaagugucuucuuuguuuuagauagagauuuacuuccccuauuuauuaguaacuauugaaaguauaacagcuuucuuauuguuuucuuuuuugaacaaugucucauugccaggccaggccagaacucauguuuuauagcucauacuaagaaaucacagcagccuuaauaugcauggugugugccacugugccagguuaacuugucuguguuuuauaaaugcuaucuuguauaaauuagauaaacuuugagcuaaauugagaacuuuuacuuauaaacuaacuacaacuucacaucaauuauacaaugacaucuuaaaccugaaagcacugcuuucacuuacaguaagcaaacagaguguaggaauccuuuuuagaagguuccuaauuuuuuuuacuuuaaaauuuuauuuuuauuauuuuaaaguguaugugugugugugugugugugagagagaaagagagagagagagagagagagagagagagaacacagaugcagagagagagagagagaacagaugcccaaagaagccagauguuggaguuucuagagcuggaguuaauagcaauugugagccacccaguguaggugcugugaacugaauucagguccuccaaauagcaagcucuuaaucacuaaaauuaguacuuauguauaaguucuuuuuuguuuguucguuuuuuugagacagugccucaaaagagaccgaagucuaggcuaguuauucuaggcaaugcuccuaccccagucucccaaguguuggaaauauagguguguaccaucccuugauugcaaaugcagccaucuuauacaauucuauauguacaguaucugcuuugcauaagacaauaaauaauauaagcaauguacagguagugguaagaaggcaucauccuggagguagucagauuuuuauaaggaagguacacuagccuugacguauguaguguaggcuauggagaacuaggggcagucauuucuggaaaagccaaaugccugaacugaggaggaaggaaaaacaaacagaagaaaacaaacaaccccaaggagcagaugaacagaguacuauaguuggcguccaggugugggugggagccuuaaaggguaggaagcuugaauuuucagaaugauuggcucgagucauggagaggaggcccucagagugagggguaauguuacuggcaaggucucuagagggucuugguuaacugcugccugaaugaagauugguggugggcugaagugagccucaacagccuccagaggcugcugcacuugcugggauccugaccucuggaguuuagagccuaagcuguuaguggucaugcaaggaaugaaucccaaaacauauugggaagauagagcaagcagagggacaccaugaugggcugugggaguaagucauuggggaaaguuugagaaucccaggaugggaggacuagacuccuggccuaaucuaccaugcccacagaggcugagagucucagggacucagccuagaucuguccuaagacucaaaaucaagucuuugcccuuuuuugcugaauacccuggaagcuggaaccuuaguaauucagaaauucaggugcuacccccgccccccugcugccaucucuacccucuccaaguccugccauccccuaaagguaccaauggacucuggccucucugacccuggaauuuaucccacauugugacauucucuguguguguguguguguguguguguguguguguguguguguguguguguguguguguguguguguguguuucaagacaggauuugucuuuguagcccuggcuguccuggaacucacucuguaggcaagguuguccuugaauuuacagagaucagccagccucugccuuuugagugcugggaugaaaggugugcccgacugcauucuuaacuuuuguucuuuaaauguugaauaaucacgcuagcuguguguccugagugaacuacuccuguguaggaaaaaaaaaaaaaaacuagaaauaauuguuuggcuguauguuuaagcuuguuuauucaagcagaauucuaaauccuguauuaacauuguuuguuuuagauuaaagauaucugcauugaaccaaaauaaacuauuggcggauguaaauaggaacuugugggaaaaagugaaagacuacucugaugaagagguauuuuuaugccauuuucugaauaagaauugacacauuuugauacauuuggaacuguugcuuggccugcuguggugauauacccaaccuuuaaugcuagcucuuggaaggcugaggcagguggaucucugaguucaaggccagccugaacuacagagcuaguuccaguacagccaggacuacacaaggaaacccugugucaaacaaacaaacaaauaagcaaaaaagaacuguuacuugauaguauggaguuuuuuuaauuuagucuuagaucuaauguguugcuguggucuuaucuaauuauuaccaaguaauuguuaaauauaaccuuucuaauguaugauaucuaauuuaaccuguaaaaaauauauaagauguucccagcuucuuuuucuuuuugcauuuuccuuagguuuaaaugaagauuuccuuuaauugauuagcuauuuuacauguacccuaauauauaaucauguuuuguuaauuaagagccaaucauuuucuaguuuauaaaauaagugaaagaaucaaaacugaaguuuuugauuauauucuuaaauagauaugcagagccuaagugugauggcauauaccugugaucacagcacuuuagaggcagaagcugaaagagcacacauuuaagaccagccugaucuguauagugacuuccagcuugccaauuugcaaaugaaaaauucuugucuuaggaauuggaaucuagauuaggcaaaacccagcacaggcaauugaacucgccuucccagaccuaacuuaccuucucugauuuguuuuuaguaacauguacucuuuaacucucucauacagcugaagaacuaugggauuuaccuuaacaaaaucaaaucacguuauaccaagaugacaaaagucuucaaucaccaaggaaaaguggcucuguauaacaaauuggugcauucagcugagguaauuugagauguugauauauaguaauguauaguagauauaaaauaugacaugcuucuuaggagacauguaaaugaagcuuggauaaaaguuuguuuaucaaaagugaaguucuagaaaccagaagcuucagguuuuggcacugggaguuaaaugaaguauaguuacuaauauggccuaugucucacauguugucauccauuuuacauauugaaauaaaauacuugugauucugugucccuauucacacggaaggcaguguuaucuucuuuauauccauauucaguugcauauguauaugcauauguuuauccuuuuucuuuuaaaaaggccuuacacacagggcugagacuguagcucagugguaggacauuugcuuagcauuuguucagucucccauuugggagacagaagugggaugcucgugccagugagcacagcauuuaugcaugcacacaagagcaagcacaguagccuggugaugcuuaguaaguaucagcaaacaaguacaugaaguguuuuauacaguuucaucuuuuauagaaauaaaaauucaaaaauaguugugccuguugcacauaccuacaggaaacugaggcaggagaauugccauaaguucuggaucacauagcaagaaccugucucaauaauaacagcaauacaaacaaacuaacuaaaacacacacuuaaaggcuguaguucuguuuggccuguguccaucugaucacagaaaaaaauuaaccuuuuuaaagcaauaaauaucaauauccaugcaguucaugaaacauguauagaaaagaaaugcuauaauaaagagaaauacaaaauaacuucauuugucuuuuuacauuaaaaaacaaauuaaguccggacuaaaagucuugaccucaaaauuugucuguucaugccaguuugguggcacaggccuguaauccuagcuacuugaaaguccaaggcaggaauaucacaaguucagcaucagccuaggcaauugaguuguaagacccugacuuuaaauaaaaagugaaggaaaaaaaaaggacaggaauaaagggcaguagaucaugugacuaacauguucaguuacugguauugccaaauaaaaaugggaaacaaauuuacccauuuauaaucacgacaguaauuaaaacuauuaaaggauuguuuggaguuuaagguuuacaaucuauaauauuuuguguuuagaaugagaagaacaaacuucagauaaaaauaaaugagauggacacuauccucaagaagaucaauaacugucucgcugaaguggaaacagguaaagucuugcucuccucuauggcugaggauagagugcagugagagaucaccugccuagcgugcagaaaggcuuaggcucgacucccgcaacuacacaaacuuaaaggauaguuuucuauagaggcuucuauaaguuagaaaguuuggucuuacuaugcugucuuagcagcuugaguacuuaaaguggagcaaaauaaaacccuuuuuugggcuaaugaguuggcucagugcauaaaggugcuugccaccaagccuggugaccugaguuugaugccgggggcccucaugguggaaggagagaacugagucccauguguuuuccucugaucuucauaggcaugcuguggugcuaacccaccuuccaaaagaaguaaaugucauaaaaaaugauacuaaaaccugguucgcuauaaucauccauaacaguaaagaagagauauccaaaaaauuaaguucuuuugcaaggcucuucauaaccuauaccauaaucuuguauggcuuugcuucuuugggggacagagucuguauagcccgggguggccuagaauuugccugagcuacucuugaacuugugaucuuccugccuugccucccaagugcugguguuaugagugugugccuccaugcccaguauucugggauuuugguuuuuggguuuuuuuguuuguuuguuuguuuguuuguuuguuuguuuuugagacaggguuucucuguauaguccuggcuguccuggaacucacucuguagaccaggcuggccucgaacucagaaauccgccugccucugccucccaagugcugggauuaaaggcgugcgccaccacgcccagcuugguuuuuguuuuuuaaucacacuuguuuguuugugugugugugugugugugugugugugugucugugugucuguguguguguaauuuuaauguuauuuguuuaugagauuuuucuuuuacuuucauguucccugguccuuagucuguuuccuuuuuuugacacugcugauuauucuuuucuuccuaaaccauuuauuucauuuacccucugaggcauuacaacaccuaacucuaauuccauuauuucugggcuuuccuuuuagcuccuaugugggucucucuugcucaaacuaacccaucaguacccaggccaggugguucaugacugccuacaacucuagauccaggggauccaacacccuuuccuggcauccucaggcauacacucauacacacaggcacaugcaaacuuagguacacacacacacacacacacacacacacacacacacacacucaaacauacacacacauacagcaagagguaaaauuagcaugcuuuaguaaaaaagcauguuuuuuuaaacaucccuagcauuaugaauugcauagaaaaaaauaaauacaugcauccugcauuuaauugaaaaugaauauaugaauauuauaguuuuaaaauaacuuacaucauuacuuuacuuucuauuucauaauaaaagaaauagaaaccuuuagacuaaaccuuccaaacuuucuaauaacaaagaaaccagaccuuuaaucuguuuauucauuauuccuucuuuucucuccccuaacaccaaucuucccauuuaaacugauuuugccaggugugguagugcauacccuguaauaccaguacucaggaggcugaggcagaagauuugcuaaugaggccagccugaacuacauagugaguacuaggcuacccagcccuauauagcaagauacuaucucuuuuuuaaaaaucaaauaaauaaaugauuucuauuaugucuucucaguaaucuuauauugacuccucccuuuaucauauccauuuccauuuaauuuacauaccucgaugucaucuuuaaagcguacguaggaguguggcuuaguugcuuaaguguuugcuuagcaugcacagaacccugggauuccauccccaacaguaucugauggagucagauaugaauguacaugccuaugaccacagcacucggaagguugaggccucaaguuacaggucauuuucagcuauauaacuaaguucaaggucauccugagguacuuaagacucuuaaaaaaagagggaaaaaaaucauuggguaaaccuggcucaaaacuuguagucccagcguuugggaggccaaggcaagaagacugccuugaucucaagacugguguggguuacauuguugaguucuaggcuaaccugaauaguaggagauccuucagaaagggggagaaaagagcuagagaggugacucaacaguuugugagaacugucugcucuuccagaggaccucaaguucuauucccagcacccacauagugguuguagcugcauucccaggggaccuaauggccucuucugaccucauagggcacuaggcaugcaugugguacauagacaaaacacccauuuacaaauaauaaauuuguuuagaagccuucuacaccacauauaaaaaucaaauauaaauaacaaggcugggauggaguuuguuggcagaguauuuucaagucucuggauuugaucucaggacugaaaaaaaaaaaccacagaagaaaaacacaacagcugugcuucccuccccucuuuagguagcacuaaauggcuacccuuuucuucuuucauugcucauuuuucaaauuugcuuaguuuguaacuuuuuguuuguuuguuuguuuuuguuuuuguuuuucgaggcaggguuucucuguauagcccuggcuguccuggaacucacucuauagaccaggcuggcuccaaacucagaaauccgccugccucuaccuccuaagugcugggauuaaaagugugcgccaccacgcccggcaguuugcaacuuuuauaugaugguacucagaaauaagaacacauuaguagcccaaaccaaacaugauuugugcccuuguggaauuuuuuuuccucccauguccuaucauguaggauauacugaccucuaaaaugguugagaguguccuuaaacacccgaugcuucuuccuccaccuccgcaguacagacuguacaugugcuaccauccccgcuccuuaugcaacuuuuaauccagaagcaacuguagacacuaaacaaauaagcuggguaugcuauuacacgcuugacaucucagucuguaggcgacagagucaagaggaucaggagucugaggcuagccuguguuacacaagaccuuuguucaaaaacaccaaauuauccuucccccaaaaguaauuucauaguaaauucuguggaugauauuauaagguacugggauacuucaauagaaaucugaucuaguuaagaggucaaagcagccuuaccuauaccgaagagacuuuacagcuaaaauaugaaagaugaauaggaguaaaaaggaaaaaagagaagccaggcaugguucacaucacuaaucccaucacuugaaaagcugaggcaggaggauuacugugaguaugaggccagccugaacuacagaguaaaacaguuucuuuauaacacauacacagauaaauguguguucaugcacacacauacaaaaaacaacagacuauucacaauaaacacauuuaguaaacccauaccaacuacauguguuugaagauagagauaaaguaaaauagagaacaggagggaaugucuucuaaaagcuugauuuguuauuggggcuaggaauaggacagccucucaaggaacucuaaauaugcuuauaagaagugaacuaucacagucagcaauuggauggaacacagggcccccaauggaggagcuagagaaaguacccaaggagcuaaagggaucugcaacccuauagguagaacaacaauaugaacuaaccuguacccccuagagcucgugucucuagcugcauauguaacagaagauggccuagucggccaucaguggaaagagaggcccauugguuuugcaaacuuuauaugccccaguacagggaaacaccagggccaagaagugggaguggguggguaggggaugggggggaagggcaugggggggagggcauggggggacuuuugggauagcauuggaaauguaaaugaagaaaauaccuaauagaaaggaaggaaggaaggaaggaaggaaggaaggaaggaaggaaggaagggagggagagagagagagagagagagagagagagagagagagaaagaaagaaagaaagaaagaaagaaagaaagaaagaaagaaagaaagaaagaaagaaagaaagaaagaaagaaagaaagaaagagagaaacuaaugaacuagccguguguuuauuaagcacuaacggcuuauagagcgagcuugggucugaauagauaaguaaaugcaagcugauugucauggugcacaucuguaaucucaaguacuguggagguugaguuagagucugcaugaugaauuccaaaccagccugagcuacauagucaaacccuaucuuaaaaagguggguaggggaauauuuuugagguaaaaugcaagcuuggaguaggcacuguaaucccaguccuuagaagguaagggcaggaagaucaagaguuaggucagcuuacucagugguccagcuggcacucuaugagacccaguuucaaaaaggaaaacauuucaaugcuaacaugagacaaacugggcauggugacacaccuguuauccuaguuacuugggagacuuuggcaggaagaucacagguuuauggcuggccugaacaaggcugucucaaagguacuagaaagcaucaagagcacuagaugcauaagcuugcugaugaacccauuuaggaggaaagaaaugacucccaaaaguugucugcugaccucuagugcucaccacacucacauauacacacauucauacaugcacacacacacacacacacacacacauacauacauacacgaacacuaauaauaauaauaguuuuaaguacaagaugagaucacugucauuagcucagaguucacuuauaugauaccauaggucuuugaaaucauaguuuaggacuuuauuggcagaggauggguauuugggaaaacaguaaauauuacuaauauuucauuugaccaucuauuucucugauauuuaauauaucucuaaugcuugauguuuaccuuagaaacuaagaauuuggagaaugaagagaaaaaugaugccauggaagaaugggauucugaaaugagagaugcagagaaagguaacuaacuuaguuaaggugacaaggccagagagaacagcacuguugagaucauucacauguuagaugagauuagcuuagucagaauuuuucaguaaacuaagugaaaaaaaucuauguuucaaguuucuccugguguccuuuuuaugcuuguuuuauuuuguuuuguuuuuuuuuuauagaacuggaacagcugaaaacugaagaagaggagcuucagaggucagcuaacaguuggauguuaaaaauauuaaggcgccggauguggucacucauauguuuugaucccugugcauuuuagguccaccuggucuacauagggagcuucaggcuagcccuagccaaggcuacagucucucucucucccucucucccucucucccucucucccucucucccucucucucucucucucucucucucacacacacacacacacacacacacacagagcaauacacauaaaauaaaaaugaauacauuuaggaaaagaaagaaaugacauguaaauaaugacaaagccaauuaaauuugaguugacaaauauuaauuugacagauaguaaugucaacugaaauuaaguugacagaacucuggguauguugguacuuccuuauaaucuuagcagucagaaggcugagacauaaagauugcuguaauucaaggauaauagguagaugagauagguuuugaacccauaaagaucugccaucaaugcugggaucaaaggugugcaacaccauagccaaccucuaccucagcuuuuaagacagaauuucucaugaaccuagagcucaccaguuggcuagauugacuggcuagcaagcaccaggauucaucugucucugaaggaucugucccaacacuguuagaacaccuugcuuugucuuuacucggugccagggauccaaacucggcuccuuaagcuuucacagggaaacuucaucaacugagucaacuccccauccccaaaacauuuuguuacuauucugaacucacuaacaaauacuuuguuuuucugugaauaccuaauuuuauuugcagaaaguucuuagaaguagagacacagaaaacgcagacccuugcucagauagaauuuauaaaagaacaaacaacuaaaacugaagaauuacuggaucaauugagguaagcaaaaguagauagcauucaguuucuggucuauccugugccuuauuuauugcuaucgaccucuggaggauuugagguuuauuauuaauguuguuuaaaguuaggcuuucucuauguuguccauccuggccuagaauuucugaauccaaacaauugucgugccucagcuucucaagaauacccacauuccaaccccccacuacccagccauugcuauggccuuaaacacccacagcuguggcucucacccuccuuauucugcugcccuucaauaaagcuccucaugccaggcgacucccccgaccauaaauuauguuauugcuacuucauaaguguaauuuugcugcuguuacgaauuguaauguaaauauauguguuuuacagugagacaaccacuuugacaggguuguuugacucucaaagguugagaaccacuaacugaccuuuuuuaaaaaagucaguguacuucaaaccugagguaaaaacgucuaggggaguaaaaacucaugagcuuaaaauacuuuaaaauauuuuugugucuggaaaacugguucagugguuaaguguacugaucuugcagaagacccaguucauuucccaguacccacaugguagcucacaacuaccuauaaucaguuucucagggauccaaugcuaccuucuuaccucaggagccucccucauacauacacucaggcacacacauacacauaaaauaagaugaauauucuuuaaaauauaucuuuaacacuuuuuuuaacgauuacuuuuuuaaaggauuauuuauuuuauauaugagaguauacugucucuaucuuuagacacaccagaagaaggcauuggaucccauugcagaaguugugagccaccaugugguugcugcaaauuaaacucaggaccucuggaagagcagucagugcucuuaaccgcugagcaaucgcuccaaccccucuuuuuuuuuucccccuccccuuuuuuuuuaauuagauguuuucuucauuuacauuucaaaugguauccucuuuccuaguuuccucuccaaaaaucccauauacccuucccccucccccugcuccccaacccaccuacucucacuuccuggcccuggcauuccucuauaauggggccuagaaucuuugcaagaccaagggccucucuucccacugauggccaacuaggccauccucugcuacauaugcagcuggagacacaaggucuugggguacugguuaguucauauuguuguuccaccuauaggguugcagacccguucagcuccuugggaacuuucucuagcuucuccauuggggaccuuguguugcauccaauagaugacugugagcauccacuucuguguuugccaggagacagcuauaucaggguccugucagcaaaaucuuguugguauaugcaaaagugucucuccagccccucuuuaacacuuuuuaucaaauagauccccuuccccuccaauauaugaucaaaguuucaaauacauaagauugacccaaguguuguugaacauaccuguaaucacagcacuugggaagcagaggcaagagaauuauuauaaguucuugaucagccucauuuacauagcaaguucucagccaaccagagugcacaguuagacuugacucaaaaaaaaaaaaaccccacaaacaaacaagcaaacaaaaagcacaagacuguguagucauauuuucuuuuccaagauuuuguuuuagguuauuuauccucaaaagguaucuauuagucauaaagcuuccacuggugaucacucuguguguguguaauguuucacaaauuuuuguguuaucuuuguacaaggcuuaacuuguucuuauuuuacucuaugugccuauuuuaguauaugugcugccaaaguuguuguaucauguuuugagacaccaucucacugugugacacaggccagccuaaaacucaaggggaccugccugcuucagccucucacgggcuaggauggaaaaugugugucguucuuccaacuuggccauucaaauuauuuaaauagauaauuucccaauccggugcuccuauugguacuauaugaaugauaucacaaauucuucauuugggcuuguaauuucuuggcuugaacccccagcauugggaaggaaggaagaaaggguagacuuacuuguucuuguuugucauucucuaguuugucugagugggaugucauugaguggagugaugaucaagcuguauuuaccuuugucuaugauucaauagaacucaucaucaccuuuggagagccacuagguaaguagcaaagcuaaaaugaccucuacagaaaaauaaaugacuguauucucuaaagauaaaaaccuacauuuuauuauaauaauaacuuuuaacaaaauggcaauacugcugagaaucucagaagaauaagggacuuuaauaauaauacuuuggggaaguuugcuagagaucaaacccaggaacuccuacaugcuaaguuuaugcucuacugcuaucucacuaugaaagaauuguauguuguagaacaaagaauauaguagaauggaacaugguggcauggcuggacaggaucaucugcuaccuggugagacccugucucagaagacaacaaacaauaagaauaaaaagauaguugguuugaguucuuuuagauaaugaaauuaucucuauccaaauaauguuuuuuucucgcgugcgcacacauguguguguguguguguguguguguguguguguguguguguguucuguuagagaauuuacuugaaucgcuguucucuuuuuuuuuaagauuuauuuauuuauuacauguaaguacacuguagcugucuucagacaccccagaagagggcgucagaucucauuaccucugguugugagccaccaugugggugcugggauuugaacucaggaccucuggaagagcaguuggcacccuuaacugcugagccaucucuccagcccuuuuaaguuuuacucucaauauguauauguuuuucagcauguguguauauguauguauauguggacacccacagggacaggagaaccuguuggaucccuugaagcugggaauugcaagagauugugagccugauaugcugggaaccaaacuaaggcaucucucuccaccucacagcuguuuucuucaugcuaucuguaguaccuaggacacacaagaauuuaauaaaacauuuaucaaaaagacaagacuuggaauuugagaagcaagaaguaacuuacaccuaguagauauggagaaguuggucccacugucuucuuauggcuuuacuugauguuuuauuuguuugagagaaggucucggaauguauacuuagcuggccccaaauucagagaucuaccugccucugccuccugaaugcaguugaugugcaccuuguaccuguuugauucuugggaaaaaaaauguuugcauugaaauuaauuuagucaagggaguuugugauauuuuucaguuauaaaauacauucucuguguacugaugugacccaggaaccagauaguguuggcuuggcuguuuuucucccuguuguggggguugacuuuauuuuccauaauuucccccagguuuugguuuuguuuguuuguuuguuuguugcuuuuuguuuuuguuuuuuuguuugguggggacagguuguuguguuuuaguuuaucaagauaggcucucuguuuagccauagcugugcuaaaacucauucuauagaccgggcuagccucagacuuagauuugcccgacuacauucuaagugcugggauuaaugacauguaccaccaagccuaggucauaaauugguuuugaugugacccaagccugaaggcaggcacaguagcaaggucauaaauugguuuugaugugacccaagccugaaggcaggcacaguagcauaugccuuuaauucuagcacucaagaacucuuuaaucccagcacucaggaggcagugacagggggaucucugugaguuuuaggcuagccuggucuacagagcuaguuccaggacagaacagcucuguuauacagagaaacccugucucgaaaaagaaaaauaaggggggggaggguauuaaauaaauaaauaaauaaauaaauaaauaaauaaauaaauaaauaaauaaauaaauaaauaaagauaugucuuacacuuuaauuucuuucaagggccuacuaaaccaauauaauugaaugauaucaggggaucuuuaccauauacagagaauaaugugauucaagaauaaaccuucaauagaauucucaaguaggaaaaauauuuaugaccaggaaggauauaauucauuuaguagaauacaugccuagcauucaugaacgucuuggguucaguccccagcacugcauaaaccagguaugauaauaugugccuauaauucaggagaugaaguuaggucaagagaaucuaaacuccagagcuauccccagcuacauaugauuuuaacgccagcaggagaaaagagaaaaaucuccuuuucuguuuuuuuuuuuuaguuggucucccuuuuuuggacaaggcuugcaggaagauuaaugcacucaguuuucagucucuguuagaugguaaguucuaaauauuuaaaccucuaaauuuuguugguaauuuauagguacaauaacguccuuaaaauauguuuuaaaauaaaacugcuuguauaguauucuaaauucugaguagauuuuuuuaaagauuuauuuguuuuauauaugugagaacauugucacugucuucagacacaacagaagaggacaucagaucccauuacagaugguugugagccaccaugugguugcugggaauugaacucagaaccucuggaagagcagucagugcucuuaaccacugagccaucucuccagccccugaguagacuuuaaaagaaaugauuauauuacuccuagauauugaauaaugauuaauaauagcuauguuuauauuugaaauuagcacuauggguacuuagucucuauaccauguauguauauuacuuauaucaguacuauaaacagauauuauuuucuguuuuaccaauuaggaaacuauagaucagaaaaauuaaaugcuguucuuauaauuacauagauaauaaagaaagccuagcuuugaacucugucaaaauucaugcuuucaccaaaaucuguuauauaugcuuaggcucaaaguuuuauagaauggcuuauauaacuccguauguuauggucauguuuaaaaauaaaaaaauuguagccaggcuugguagcucacgccuuuaaucccagcacuugggagggacagccagggguauauagagaaaccgugucucaaaaaaacaaaauaaauaaauaaauacauuuaaaaauaugcuucuaguuugaaaauguuucuagcuuauauaauauuauauucaugccuuauuuaaaugauuaauaaauaaugcccuuauuuucauuuuuuuccuuauucagaagauaaagcuccucccuccucccuuuuaguucacaagcuuauuuuucaguacauugaggaacaggaauccuggaagaagaaaugcacagcacagcaucaggugccccagguaaagucuagugaggcuuugcaaggaaaucuugcacuauuagucacaaauagcagaauugaaauucuacguguauaauauuccccugaaauuauaaauauauuugguuguccacacuuugaggauuauaauagcuacuaaaccucaaaagguuuucuuugugugcgugcauaugugugugugucuugagcacugggauuaaaggcauaugccaccacugcccauuuuauuuaauuuuuuaguucccauucaaaauaaugugauguuguuguucuuguucuuuaguuuuguuuugugacugugucugucucuguagccuuguuugacuuauguagccaagguuaacccugaacuuuuuaucuccuugccuucuguaucccagugcuggaugcaaaccaaacccugggcucugugcauagucggcccagguggguuuuuuguuuguuuuuaaagaauuguuuauuuuaugaguacacuguagcugucuuuaaacaguuuuguuuuuuuguuuuuuuuuuuguuuuuuuuuuuuuuuuuguuaagaagagcgcaucagccaggcaugguggcgcacgccuuuaaucccagcacuugggaggcagagcaggugaauuucugaguucuaggccagccuggucuacagagugaguuccaggacagccagaacuacacagagaaacccuaucucgaaaaacaaaaacaaaaaaaagaagagugcaucagauccuauuacaaaugguugugagccacugugugguugcugggaauugaacucaggaccucuggaagagcucuuucuuaacugcugagccaucccucuagccccaacuuuuuuuuaaguuuuauuauuuauuuuauguauauagguguuuuuccugacuauaugucugagccaaaugugugcauugccugaggaugccagaagaggguaucaaaguccucuuaaacagaugauugugggcuaucauauggauguagaauuggaacccagauccuuugaaacugcagccagugcccuuaacuacugagccaucucuccagccacuagacuugaacuaacugagcaacaucccuaaauuccaaaauaaacauuucaguaugaucuuuucauacacacacacucuuauacuuuaaaaaucuguuuguuuauuuuuucuagaugcuucaagaacucucacugguagugaaccauuguaggcuucuuggagaggagaucgaauuuuuaaagcgaugggggccaaauuauagccuaaugcauauaaaugugaauaauacugagugaguauauucaguucccuggagcuguuuuaguaagguauuauaaguugaauggcuugaauagcagaaacauaauugacuuaauguucuggaggcuagaagucugcagucaauauuaguaggggugacgacaucacuacccauugagagacagucacaaacaaaaggccgaaggugccugaggcucuguccccaguaugcuuaccuccacccuacugugaaugugcauucuugugcaaucucucccucuccugagcaaguaacuauuauaaucaaugucuugcucuagauguuuuaccuucuuuucuauuugauaaggauaagaaauuauagccaccuaaguuucuuaugcaaguauaaaagaaaaaucuguuuuuaauugugucugucuuuuauagauugaggcuuuuauucuccaguugugcagcauuugcaaaguuugagauaacuuugucucccucggcccauuaucccuuggucccguuaccguucaccauucacaaucacauugggaagacuggguaaguacacacacagcccaauaagaguucuggcuacuuuuguauucuucuuucauuccaaaggaccuugacaguguuagcaaauacuuugcgaaugugucacuuccuuuugacuuccuuuuccaguauuuauucuuuuauagucaguggucuuauuacugucuccaguuuugcuggagucccaucuuuuaugauggcuuugguuuucaacacuucucuguaaauggaacuggagauguugcucaguugguagcaugcagaaaggcuugggcugcauucucacuaccauauaaauggagcauagggugcugcacaucuguaaucccagccgcuuuacaggaggaggaagaggacggagcaggaucagaaguucaagcucauccccagcagaccaugaucuacuuuacaccuuuucugaugaugcugugacauauuagaagcuguccuucauuaauucauuagcgaacaacagcuuaggauuuuguagcuggagaccagauggcucaguugguaaagagccugccacacaagcauaaagaccugugaucccaucccuagcacacggguaaaaucagggugaggugauacacacccauaaucccaguuccaggaagggcagagauagcaagaacccgagaagcaguagccagucagucagugaaagaccugucucaaaaaguaauuuguagagcgaacgaggaaaacauuguuugucuaccucugguagacacccacauacacauaaacacacaugugcaugcaugcacaaacacaaaacaaaguggggauuauggaaggggcuggagagauggcucaguaguugagagugcuguucuuccaggaguccuggguuuaguuccaagcacucaccuagucgugacacauuagaacagacagccugucaaaagaguacagcagccuacaaccaccucuaacuucaggggacucacugcccucuucuggauggcuccaacaccugcccucacauguacccauuccuauaggcacauaauuaaaaacaaaaucuuuuuuuuuaagcaauuagggguauuggagauauaacaaagugguagaaugcuugccuagcauguacaaaggccuauguuuaaucucuagcccuauaggcaaacaacaacaacaaaacaacuauaucaguauacuuuacaauuauauauauauauauuuagccuuauuuuagaauacaguuucaaguaaaguucugcuuauuuccagaaauauauauuugugcuuccuaagaacuugagauaguauccaaggacaugaguagcccugaaggggagagagguauaaguuuuucagggaaaguaauaaaaaauacccuuuugucuuuucuagccaugaugaaauugcugcaauuaucucuaaagugcccuuagaggaaaacuaccugaagaauguagucaagcaaauuuaccaagaucuacuuaaggacugaaaguuuucccguaagacccacagaucacagcuauaacaacaaaggaaaaaaaaauccauuuacccaggccccauauagaggcaaacgcuuauaaucucaggauuccagugagagaagaucaaggcuagccugggcugucuaggagaccugguugaaaaacaaaauacuuaaaugauauaucggggucaauauugauauuuaucuuuugucuuaacaucauauaaaaguagcaaaauucugccaggugguggugguacacgccuuuaaucccagcacuugggaggcagaggcaggcggauuucugaguucgaggccagccuggucuacagagugaguuccagaucagcccaggcuauacagagaaacccugucuugaaaaacaaaaacaaaacaaacaaaaaugcaaaauuccuccugaugauaucauaauuaauuuguaucauuaguuuuaaaauaccuaguugaaaaugaugaggucucaaauagcauguuaucugcuugcuauuauccuuauacccaagauuaaaugaucaaacaugugagaaaauuuuccuaaaguagcuuguugauagaccacuuaccuuguguguauaaagcccuauuuuuuaaaaagucuaaaguugugcucuucucuuaauacaagcucuaagggguaacauuuauaaggagguagugcacaaagauuaagccuuuccucuuuuuggguuuuuuuugggggggggggguguuugguguuguuuuuauuuguuuugguuuuugguuuuucgagacaggaugucucuguguagcccuggcuguccuggaacucacuuuguagaccaggcuggccuuaaacugagaaaucuaccugccucugccuuccaagugcugggauuaaaggcaugcgccaccacugccuagcuaaucauuucuuguuaucuagagcuguguauuuauggguuuugccuagcagauaugucuagaguggaaacacuucuaucagguucugguagaacauaucuauggcugcagauacucagaucacugaaagagggagaccacaugaucucaugacuucaagacgagcacggucaacauagccagggagauuugucuccauaacaccaacagaacauaucuauucacaaauuauucauucuucuccauuucagaaaugcuguuuaaaaaaaaaaacuacucaacuuuuggaaugguugccaucuugcaagucuuaguauuuuuuuacaauguuuauuaauguuuucucuuucuaauguauauucuuuuuauuucucauguauacucuuucuaggaaaagaucauucauuuuggccugauauauuauguaaauauaugaauauuuuguauuuguaauauaugugguaaugaaauaauuugccuucgguauaggucauuuccuuaucuauaaagaaugcuuuacaggccgggcgugguagcgcaugccuuuguuuuguuuuguuuuguuuuguuuuguuuuguuuuguuuuguuuuuccgagacaggguuucuuuauguagcgcuggcuguccuagaacucacucuguagaccaggcuggccuccaacucagaaaucugccugccucuaccucugccucugccuccugagugcugggauuaaagcacuggcuucaaucuuuuuuuaauaacaaaauuuaaacaauaucacauugcuauacaaguuucucacaaucauucuaaacuauugcuuucugaaaccacacuuuuacucauauacaagaacaauacauagauuguuuaauaaauuaacaguauugucucugagguagacaaaugugaacgaacuuucccccuacaugcuagucaauucuuaaucaugguaacuuuuguuucuuuuauauuuaauucuaaacuguguuuacaucuuaaaauuaauuuaucuuaaauuuuuacuuuuuauaucaugguaaaguccuuuuagucccacaaauguuuuuuaucuuuuuuuuuuuuugaaaguuuuuacuuaugaucuauacaucaaaagguuacacacucuaauggcuuucaaaagucaacacaaaacucuuuugacuuagaaauuaagccaaaucgcuucucggccucaagaaauuaagccaagauacccguaaaaaucuuuuaaagucaucaguaugguuuguuuccuaugagauuuaauucauccuuuuuccuguauagcuaaaaauuagagguuauauuuuuuccuuaaacuugaaaaaacugcuccaagaauuucucuuauaauaauggugucuguuuuuuggcuuuggauaauguaauuauguuuauauagguguuuguauuuuugaauauuuauaguuuuggcaaauuucauauuuuauaaguuuuucuuuuuuuucauuuuaaaggauuuuuuucauuauuaaaguacauugauuacuuguaauccuuuauaauuaguaucucuauuaagaguacucuguaguggggcuggagagguggcucagcaauuaguaccugcugugucuagcagccuuaauccagcuuucaucucaggagacagaggcugaugaauccccaaguucaaggcuggccaggu

SEQ ID NO: 1005 - RNA, 20036 nt, Mus musculus
uccuuguaaucaacuuuaguuuauuucagauuuguaccaaaaauacuccaggcaccucuccagauaagucacuuucaaaauagauucauagacccuuugccagcguugucaucccaaaagcugccaggucuccaguccaugguccagcccucacccaggaauacagggagcguauuauauacaugaugggugguaggagggcaguaccugggcugugcuggcuccuuuuguccucguagguagggugugacauuaaaggacaauaaauacauguugaauauuagcaaaaaagauuacaaguccuaugcucuguuguguggcucugaaguccauccaccucacuggcagcuggaagacaguucugcuacuucauucucagcucuuggccuucugggcuggguccacacuaaacccuauggcuauacugucuugauuuuucaagaauucacuuaagaggaagaaagcagaaaccuuagcugcaaguaauuuaaauucccccaauuuaaauuaagguaggagauuagaauaaauuaacugauaacauaaaaagcugagggauggugguguuagcagucagaucuccaggggccaggacaccuugcuuggcuuccugaacuccaugggggagucacagaggaaaaaagcaacuugauuucuuuuccacauuuaaggaguagcccccacgucauugaagugugauuauuauccuaaaauuacuucuaguucuuccaggucuuuuuggaaagcugaauccuaggauaaaagaaaacaaaucuaguaaaucuauacuagaaucagaauuaaguuuuucccaaaucacuagaaguugacaagggacccuuuucuguuuuacugagcugguagcagccuuccuccucacuuuccccaugauggcuuagagucuaugcaaucugucuccugcccugggagaggagcauguaagagacuccacacaaaaaggcaccugggaagaugugaguaaauaaagcauuggccauuuuaguucuagggugugagugugcuaagcucagaacccacauccaagccaagggcaguaacagccacugcggccagugcucuuaagggagauaagggaacaaaauccccugaagaucucuggccagcuagcucagcauguacaguggccaacaacaaaggaaccgugucucgagguggaaggcgagagcugaccauaugaguccuggcauaugccguggccuccccacacaaaguauuaccaccuagguuguaaauugaugugauccuaguacuugggaggcuguggucagauagaagccagccuaaacuacauuuugaaacacugucuuuaaaaaaaauuuuuuuuaccucauuagugacgucuggcaguuccugagccagcuucauccacuuucuagcuucagaguuuuuuccuaauucucuauagcacuaagaaagaaagaacaguuagaacuuaacaaagagaucagaaagacccauguguauguaugugcccagaagcugaggaugacggugcacaccuuuaauucaggaaacauaagcagguggaucuccugcauucucagccagccuggucuacauaucaagaccucgucuccaaagugagaaaggaaagaaaaaaagauauggcggcuuacaccuguaaccucaacauuuaggaagcagggauggggggauugcuguaacaguugucugagcuauugggacuguuguuacuagcauaccacucaauauuagcucucaaaaaaaaaauaggaguuuaguggcauagauggcucaguggcagagcauacauagacuuuguaauccccaguguuaaaagauuccauaaaccaggcagugguggcgcacgccuuuaaucccagcacuugggaggcagaggcagguggauuucugaguuugaggccagccuggucuacagagugaguuccaggacagccagggcuauacagaaaaacucugucucgacaccccccccccaaaaaaaagucccauaaauaaaauauaaguauuuccaucuagguuaaagaugaauuuaccuuagaaauauauacccguccagcuuuugaaaauccuggcuguaguuccucagccuggaagaagaagaaaaaaaucacuuuuaaagagguucauaaauucaagcugaaauacacguauuagaaagcucuauauaauaaucacaagauugauuuauuaugucuggaaauuggcaucuuuauaaacucaaaguaauuuugauuuucccucaaaauaagguaaauacagaauuguccccaacuaggagacacaucuuccccaucaaggaucccaagaauaagccacuguagcuuccacccacccuucccuucauaccuuaaggaaacucugcagagcguccugcacaguagcacuaagggggcuuucaaacaaggcgguagccguuuuuuuuuccaaccaguucaagugagaaaccugccaucaaaaaaugaaggugugacuuaucaggugcuugugauccuaacauucuagaugaagacgcuaucaguucauagguagaauaaggcuauaugaaaucccaucuccaaaaggccaguuucaggcugccaacccuagaccugagcaguacucauaggugaaggacagaaccaacuuccuuagguuguccucugacuuccacaugcgcccaugguauguguacauccacacguacccaagcacauacauacacauacaaauguauaucguuucuuggcuuggaacauguagcuuuaguagcagagggccuagcacaugugacuccuuagauuuagucaccagcacuauuacaaaguguguuugggaaugguaaauacaaaauguucugcauuaaaagcagugucuagacaggguaucauucacagcccuuaggcuaaggcagaagagcacgaguugagggcgcugggcuacaugcaacagggucaucuaccaacagcacgggcaguucagaggaaguaagagucagaccaggaagaccuugcuggagaugggugugacaggaacaucuugggccuuagacuauagcucaccugguagcaccaccugccaagaagaaagugaccccuggggucuucuggcugaaguucaauggcuuuguccacauguuccugaggagaaaauacaaauuaacaucaaaccuagaguuguugagaaaagagcagcaaagcccugaggcugugggaagccagccuaagggcgaaaggaaccggacugggcagcacaagggaagagaagccuguccucaccuugaagcuaaagccacucuggaugcguuucgagaugcccucaugcucagccagcugaccacagagcacugcauaccuaggggggaagcagcaagcucagggacaaggacuggacuaucagugcugagaaugugugccacccagggcagcuacaccuccgcucuacuuaagcacaauaaaaauguaucuuucaucuguaaagaauucucucuucuuagacucauggucucaguuaauacuuaggcuuacaauucuccaaaguaauuauucuaaguauuuuuuuuuaaugcccuuuuucucccugccuggacaccacccacccugaguaaaucucuccuuuauguuagaacauuuauucgggugagauggcacauuucaguaaucacaccacucacaaaggcuaaggcagaaggcuugucucauguacagcaaguacuagacuagcuacauagcaaaacuccuguguaaaacaaaaaacagacaaggucuugaccuggaucuuuaaaugucccuauuuucauagagcauagucacaaguauuguuacaacuuggaaacauagauuacagcuuagugaucugccaucgugugaggcucugagugacuuccaacaccacaaucugaaaagucagcaucaaacuccaggaggucuaagugcguucuugucaauaccuaaugaccauaugcgcacuaaaaggucucuagcuuaagaaacauacgggucguguaucauuaggaagaauuauguucucagcauggucaaaugagauguucaaggauuuuuguuaaacuugggaaccaauggagaaggggaagaaagcucuauuuuagccccuacguccucccugucaggagaacaagucaagucuuugucucauuguggcugggaaauguagcuccaggguagaguacuuacuugcccagcaaauguaagaucucuguuuaaugacaagugccauuugaaaagccaggaguauccaaccuuuuuuuaaaagauuuuuuuuuauguuugucuguguauggcuaugugcauaugagcacauguccacugagguaucagauugcuugaauuacagacagucaugagccacuaugauuggggagcugggaacugaaauggaauuuucaggaagagcacuaugugcuucuaaccacugaacuacaucucuagcagacacauuccacaacgcacaacguggagguccacgacaacucuggucaguucucuccugacacggugacauguauucuggggaugaacagggcuccagcagacuugcccugcaagugccuuuaucuacuugagccucucauaacccccaaacaaaccuuccagggcaacugaauucagugguaggaugcacucacuggacaagacccugucuucaguccccagcaccacacgaacauagacaccagaagaccuuacuaccugagcucugcccacaauacccaguacuagaagcaguugacaauggaugacuucccaugcccaaguuccuucugcauacacuugcuaaguaucuuggggguaggagauguauuggacacuuguaggggcucauuuccaaacugcuguuccuuaggacuagcuuuucauucuugagagcccagggaaagcaaugguaccuagaaaguuaccuggcuucugagcagaaccuuugcacggaaaguuucagccauagauggaaaaacacagccucucagcuuacaucugaggguagagauuugaaaagcagaggacaguggaagaagaaugaaccuuuuuuaaaaaccaagacagaugcuggaaucagggcccaagacaugaggccuuggcgcaugccuguuggcagaaggugucuccuagagaccacuaugagagucucuuggguuuauuuuugugugguacugaguauggaacccagggccuuaugugugcuaggcaaagauccuaccacugcaccacacccucaggccaauaagcuaauaagucaacuguucaacuuccuggguauaagcucacaucuuuuucucaugcaaaccaagcaaagaagccaaugucugccaccagccagggaucacagcuggggaaagagcuuuugcaggacaggaaaugcaaguuaucccagcuucucugaagagcggagaaccaggucuguagcgagugacucuuggaacgauauucaauccucuuagccccagcagaacacagcuuguauuuucccugccuugcccuccagcacaccucccuggccccugccuaggguuuuagaggccugcagaaauucagaacagugcuccccuuccugguuccugaagcaauugccucuggccaggguaaagaaaggguuuacacuggcuccccuaaaacuucaggauauuauuaccacagguggcacgcagcacucucaucuccuuucuucagagcagccucugcuucuucuuuuccuggaagacagguagauccagaguaaauacaggccccaagcacugccacaagcaacaguccaggaaaaacgaaugaccacuuugguuguauacagccucucuaccagcgugagccugaacucucuccguguuuauuuuuguuuugaggcuugggcuccccauguaacacagacugccccugaacuugaggcuugggcuccccauguaacacagacugccccugaacuugagauucugcucccaaguacugaguacaugagcuacgccuggcuccaacccaccaucuuuuuauaccuacuugauguucuuuugaagucaauuuuugcauuucaaauaugaaaaaggaagcaacagaaacugucuccaacagaccuuauucugaaaagacuguaaacaggcuuaaagauguuuauguaucacuaagauuauauauauuauuuauauuuuauucauaaaaguauuuguaauuugauaaaauucuuuguuuuguuaucaagacaggguuucucugcauagcccuggcuguccugaaacucacucuguagaccaggcuggccccaaacucagaucuacuugccucugccucccaagugcagauuaaagguaugugcuaccaucaccaggcuaauaaaauucuuuaaaaagccaauugaggcagcaaaagccuauaauccaagcauucagagacugaggcaggaaggucauaaauuugagguuacccuggacuacauauugaaacugucuucuaaaaaaguuugggggugggcuggagagauggcucagucauuaagagcaccgacugcucuuccaaagguccugaguucaaaucccagcaaccacauggugacucacaaccaucuguaaugagaucugacacccucuucuggugugucugaagacagcuacaguguacuuagauauaauaaauaaaucuuuaaaaaaaaaaaaaguuuggggguggcuaaagauggcucagcgacuaaaaguaccagcugcucuucuggaggccccaaguucaauucauagcacccacauagcagcucacaacagucucuacucugguuccagggcauuccaucagccucaaacagacacacaugugggcaaaacaaucagugcacguaaaaauaagucaaccauuuuuuaaaaagauuuuuacaaaccagggcugauggcuaaguggauggcgugcuugcuguggaagugugaggacuauaauuuaaguccccagcauccaugucuuagacggacacagcagccugccuguaaucccagcacuugggagacagagauggaaucccugggcuaugagugcacccacacucucauggagaaauagaaagaaaauugggaagaaacacaaauauaaacuggauggcagugguggcgcacuccuuaaaucucagcacuuaagaggcagaggcagguggaccucugaguucaaggccagccugaacuacagaaaaaguuccagaacagccaaggcuacacagagaaacccugucuugaaaaaucaaaaagaaaaccaaauauaauuguauguaagcugaagaaauuaaaauuacauccaaauguaucaauagucuuguauuaaaagggagucuuacagaacaaaaaagcugauuuagaaaacucagggcaaaaauuguucaacuuccauagcauguuuuggaacacauuuguauauccuaugaaaaacaguguuccaugggaaaagaugucagaccaugagauuacacaccuugaugaugucacgacucccaagugagggacaagauggcucaguggauuaaggcacuugcugccaagguuaacaacuugaguucuauucccuuaaguugucuucugauaaccacauguacaccauagcauacaugcccaugccuaaaauacauuucccaguggaacaaaugccuguaaucccagauccuagaaggcuaaggcaggaggaucucaaguucccugggcuaugucauaagacacugucaaaaaaaaaaaaaaaaaaggcuuauaggaaagugacuacccauggcuuguauauuaaaaacucaacucugucuggauacaguaaugugugccuguaaucugggcauugagagguaggggagucagaaguucaagcccaguguaagacaaaacaaacaaaaaacuuucaguuauuucggcuagagaggcaucuuauguugaugagcacuagcaggucugccaaguccaggagagauaaugguguauaugugucaauaaauucauuacaggcauuagaaaagucuaaaaaaggcguggggaggcuuguuaauccauccccuccauaagaucuucauggaagacuggaagauuggaggugccuagcuggccuggaacucacuauguacaacgagcugaucuuacacuugcaugggccucccggugcugagaucacagcaguguguuaccacauccagcucagacuuuuaauaagaauaaaguccaguggggagaggggagagaugguuagaggaaauccuuuggucaaacuucagcacaacuagaacuaucaccugaaaucuaagaaguaaaacaaucuuuaaaaucugggcauauuucgccuauagauaugucuaugcaccacaugugugucaugcccacaaaggccagaagagggcaucugauccccuacaacgggagccaccaugugagugcuggaaacugaucccaggucacuggaagagcagccaguagucuuaauugcugagucauaucuucaacacccacaaacuuuucccugaguguagugguacagcccuaggggauagaggcagagguacaggauugcugauaaaguuggaggccagcccagucuguguagccaguuccagagcagcuaaaccugucuccaggaauuuuaaggcagugucucauauaguucagacuggccucaaauucaugauccuccuucuagcugaaagcagaaacuuuugaagagaaaaacuaaguaauaacugaaccugaaacucacaguguaacuuaggcugccucccacucauggcagucuccugccucaacccccaagaauuaggguuauggugugagcugccacacccaagucauccuuuuuuuuuuuuuuuuuuuuaaaguucuagauucucuuacuucaugacugacaaagccaaguccuaagacuggcacaguucaauugaauucuagcuuccaaaauagagacuuaggaaacagacuuaguaaauggauucuggagacuuacagaagccagcaauaaucuuccaaacuucuucucuagauggcuacauacauacuacacucagucucagacucucugccuugccgacucaagcuuccuaaggagcaggcaaaccuuucuuugguuaagauuauggcgccuuucuuugugguugggaagucaaagcaaagacuagcguggccaugguguggacaugaaacacgacaagcaccgugcuacucacugccaagagcagaaaagcagaccugcuaucucagaggaggcccagggccuugggagguaguuugucccugcuaaggaacuauacuauuccuguccugacagaucuuguggcuccccugggccuugggcaaaugggcagcuguaucugcaagcagcuggcuacacucccgucgggccccugucagcacuuaccauuuagggcauaggacuucuucccgcucuccuccucaguaaggucugacaugucacuguaggcccgggccaggcgccacagaaagucuugucggcuuccauacuauagaccaaacaggaaugagucuccucagccaugaagaauggcggccccaguugcgccacccccccccccacuguagguuuguuuccaagacagugguauaaucacugacaucaggcaguuaacugaagauauuaucucgaauugauagcuugcacaaucaugggguaagaacguauuagucuccuaauaaugccaggaggaaaggucaacuccaagaagauaugagacacagcaaaagaaguuuaggcugacauggaauguuuaauacaaaggggaauucugcuaggcacgguggcaggcaccuuuaaucccauuacucaagaggcagaggaagguggaucuguagaagucugaagccauccacggcuacuuaguuaaaucugccucaaggggcggggggugucuaauuuaggggggaauuuacauaauaaauuuggcuugugagccugagggaauuguugaaugaccuacacagugucacuuauaauagaaauuucaaguagggcaugcagauucaacucucucaaggaaaacugaaggaacagggugugguggaguuggggggaggcacaaguauucuaguccuuugcacuuuccucccacccccacccacaccccuccaccccgcuagcgaggcagggcccccuggaauuguacacgaggcagaaaaccaagugagaagcuacaauaagcaguacgguagcuucaggaccucucugggaaaggauaagcaaccuagcaagauaugugcagaagcagcccucucaccccuaucgccuuucccuuguugcuuuguaggguuggaaaccccguggguguuuucauuccccgugggugucagauucgagggaggaggcagucucaccgccagcuuauuguugagcagcagcuggaagccuucccgcuuguccugcuugcugcccuggugcagcucaucggccugcagcaggaccagcugcacauccucucggccugaggagucauccuccuccaaggcggccgccgccggacuggacgccgccuccacauccagguccagagaguccuuccuccccauccucacggucucgcagcucacuucguccucagcaucuccacucuccuugucggagucccgcucguaaucagacuccgcguuggcuguuguauaacuggcagagaauuaagggacaggguuaaaggaggauuacuuagcucaaaacuaggguuuguucuccagccacaggaggaggacuauucagcacuguccacugagccagaucauuucuuauguaagggcagaaacuagucuucaagagaaaacuuggacuauaagcuagggaaaugauuggagaagaaguuuacaggcagcuagggugcugugccggucagggucaaguauaaaaucccuguuuagcuacuacuccaacugcagaaaacuagggaaggaacuguuuuagagccagggguuugguagucuucaucucagucacaacacauugccaggagcugccugcguggcuccagccucugaggcgugagcagcacccacgcauuucuccaauuucucucucaaauguguagcugcggccaaguuuacaaucaaaccucaauggcgguagagggagucuagggaacaugaaguggaugcaaacaccccucuagaacaucgucuccauggcugcugaagccaggugguuucuaggagccaacaccggagaggaagcuaagugucuuaguucucuguucaccagcagcuaaccaacuacuaguuaaaucauacaagaaaugggccugggacaacagaggauuuccaggggccagaaacagauacccgagaacccuccagaagcacaagaaagauuuuacauuucauuugggagccaaccuucuucccuggagugaagaauaaaggcagauucccuguagccaacagaaaucaaccaaacaaagagucucugcccacaugagacagccuaacaucuguccgaaugcuguaggcaaaagcacugucauccagagagccucucggggaggcuccugagggcaccagggaguagauauuaucggagccccagucuaagcauguggcuacuacuguuuagagcagcuuccuucuaucugaaaagcauccaaagcaucaauuacaagaaccugcaugagccaggcagugguggcucauaccuuuaaucccaguucaaggacagccuggucuauagauccgaguugcaggacagucagagcuaaacagauaaauccuguccugaaaacacacacacacacacauuugcaggaagaacuuggagauuaaaagaccuagggaaaguaccagacuucauaaccaaucugaguccugaggaaagagggcaagcuagagaaacuccagcugagcucagacaauaaccugcccaagugagaaaaccaagccauggucuccacccugccuagccagggccaaaguaaaguagguaaguaacgcagcuguguggagagcuugcuuuucuuugcuacaagaggagagcuaggcugagggaguucagauaggagauugugccuccagcacucccagaaugcacugcucuggcucuguugccuuuucccugaggcucacaggccagaacucugaaaagccaagcagcuaaaaaggugagacgggaccccaccaccaccugggugagagccccauggagcaagaaggcuaacagggagaguuuugcaccucagccccaccuaucacaccaagcuuaagcccaccucauggcuuuuaagggccuaaaaagagaucugcuaugugccaggguuauucacacuauuuacaacauucccuuaccuucuaccuccaaccuuuguggaaaucuaccagacaggauuucacugguugccaugccccaaggcuuuugagauaagcaugcaagagaaacaguucccacagagagcugauaaauuaaagacuugguuucccaaaugccugugccugcugcuaacugacugcuuucuuuacuccuaaagcucacuagagcucauuagagagcugagccugggacagagucaggagcaagccuagguccuaagccugugacucucagcaguagagauaagccacguuaagaccugaaggaaaggagacaagagaccaaggaguaaagaugagaacucguggcucggaugccagggaagcugggauucaaaggcacguuggguucuucaggaaaaauaucaagccacguuugguacgaugcccggggaauaaguucauacgccugcacagugacucugcuuucgccacugacagucagcaucuaaaaagacaaauuuguuacuggaagaaagacagaauccaggguaagagacaguuuggcaaguaaaggcacaugggacuaagcauggcugaaguugagcucaggacccacgugacgaaaggagagaauccacucucaguuuuccuccguccucugcugcacaacuguggcacauacuugugcaugcacacacaaaagaaauuaaaucaguguaaaaagauuuauaaauaaaaauaaacauuaaaaagagacuguagcugguggugauggugguggcauauccuuuaaucccugugcuugggaggcagaggcaggcgggucccugaguuugaggacagccaggacuacacagagaaaccagucucggaaaagaaaaacagaaaguuuaacucuccauagacuagccuaccaaaucaucccucaaagaaauuccuaccucccuaagguacacaugcuuaaagccacuucagagugugugaccuccuuucagaauuucccuuugaacuauauggcauguaccauauaggucauaaagaccuauauguauacacauguacuguauagacaaaaacuuacucacuauggccacugcccccgagagcagccagcuaagcugcaguuuguaccaccagcagcuuuccuaugccacaggaucagucauggggcugagcccagugcagcuguagcuaagaaagccauccaccccucuguugcccuaccugcuccucguggccaggaugcuccagggagcaccgcaugcaguaaggcaccuacucugacccacugacuccaggagacuaauuuguuuaggucacuucuugagacacaggaucuuacuaaguauucuauacuaaccucaaacuuacuacuguaauucuaggcuggcguugaacuuccgauccuccugccucagacuccugaaugcugaauuaccagcauguaccaugugcuugcugcccaaucaugaagaccucaguucacauccccagaagccagaugacuugaguaccuguaacccaugcuacaggaggcaaagacaggaagcucacugggacuugcuagccaccagccuagccacuagagcugucugggggaaauaaagcaaagggugauauaacagaacgcccuuaguccuccucuaacccccagauacacacgcacauagaucauacacaugggaaauaacuccaccgucagucucucagucuccauccaagugacugaguccaucaggccauguaagcaugaccuuagucccagugugaccgaguuccucaggcuucgcaagcaugaccuuagucccagcacuaucagucuuucuuugcaucccaaaugugucauuuugguccccuccucuaacaugaguuaaggaagcuccuggcagagcacuguuagguaaacugaaaagacuaguucuaucucagcacucaggaggaagaaacaggaggaucucugugaguuugaggucagucuacucuauagagugaguuccaggacagcuaggacuacauaauaagauccugucuggaaaaacaaaaaaacaaaaaacaaaucuaguucuacuauccaucaaauacacaacuagaaaucagacacccagacaguaguaauuugucuggagguccauagccagauuccgcugguuugggcuggguacucauuaacagccugggcauagcauaugugaagcccugaguucaauccuuggcaccaacaaauaacuacuucacuuauuucaagagacaccuaaacagaaaucaaagcugccagaaggccaagcagugcuggcucacaucuugacucgggaggcagagacagguggaucucaggggcuauccugggguacaguuugaguuccagaauagccaaggcuacauugagaaacccuaacucaggggaaauuuuuuuuuccauuaaagaucaauggcagggacaugaaaagggacaguaaauguauucuuaauuuuuguaggaaagccaaaugaagggcuggggauggaaccccauggcagagcacuugcuuagcauacgggagggucugggguugauccccaacaugaagagaaaaacaggacaaagcaggagaaaacaacaguccccuaaacacagccaaaugacuacugcauucaggccuuucacgggcagggagcuggugcaucuggucacauaugugccuauggaagcccugugugccacuccucagaucacagauaagccagcuuguuaggacagaggagauuuacagaagccgggcuaagucugagccuggacguuguauaacacugcucugagugacaaagcucaagcucuccaucugagaaacagaagaguagaaccugggccacagaauuaccaugaggaugaaguaagaaaauaccacuaaggcgcuuagcacacuaucugaggaagcaaaaaaauaaacgguagcuaguguuacaaguguucaagaguguaacugguagcugccauaggcacgcucugguuaacucagccacuuggacccaacaccuccacuacucucucacgugucuauucccuaaggagaaacaaaggucagcagaggucacccaguggaccugcuggaugacuggcaccagcaccacauacauagcagcugccaccagugacaucagacuguccuugagaccauagcuucagaauggagcuguggcuuaaaaguaaaaagcccugaccaaaguuggaagauccuguucugcuugccgcuguccuacuucacaggaaauccucuuaucagaucugcugagcacuugagagucaccuccccgguguccagaugccagagcaagcaggccagacacaccgagaggagagcggugccuggggaaagggagcccaaaacaggccuccaggucggugcacccugcagggagcacaggacaggccuccaggucgggcacacccugcucagccaccaaggaaggaagcggagcucuaagacaacgcuugugauggcacggaaaaaugcccuuaaaaauggcgugaagggcuggagagauggcucggugguuaagagcacugccugcucuuccagagguccugaguucaauucccagcaaccacaugguggcuuacaaccauuuuaaugagaucuggugcccuuuccugguaugucugaagacagcuacaguguacucauauaaauacaacaaauaaaucuuuuuaaaaaauggagugaaaagaagagccccuaggcugaagagauggcuuagcgugggagagcacgugcugcucuugcagaggacccaaguucaguccccagaacacacauggcuguuuacaacaaucuguaacuaugguucucggggaccuggugcccuuuucuggacucugcaggcgccaggcacacaagcagugcacuuaaauacacacaggcaaaauauacacauaaaauaaaauguaguuuuuaaaacaauauuuaaaaagucaccucauaaaacuaacagauguacacagagccaccacuaacauccccauguuacaucuggaugacacacaccaggaagcucuuucuguucacucauaccccaacuuuucaaaaaggauugacggcaccguguuuuggauguugauagauaguguuuugacaaguacaaugucgcuggacgcacacgcccuccaggagagacuacucacccucccucgcucucggcgucugugagugcagccccugaggaggcggugaaguagacagagcuggagcccguggagucacuccucucucuggcaaaagggaaccugcgccgccgggccacucucugguucucuucuauaugagagcuggaaaacaggcaccaccccagagugcacauuaggacucacacagccugucucuuccuccuuccucccucauuaaagcaucaagaaaggagaagauucugagucuuugcucucaggagacuaaggacagcgcuucaggcuaccuccuggcagacuaaacugggaagaaucgagguugggcugcuucaauaggccaaagggcacagcaggagcaacgcgauuagggaaaggaaggaaccagacgcgcagccuccuccacccugggucagcagcuauaggaugggcuuguuuagaaccacaaagagcagagcagaacacauccuagcugaaaagccauaggaaaagucaagcaagagacccagccacucaccggaccuccccaacaaucuccccagcuaguccuugcaggcuucucugaagcuccuccaccucgcgccgcagcgccauaagacuggucagcacaaaguccaggcgguccagcaccuucuccugcccuuccugugagaggcugggcaguauggcagcaucuccagcuucaccugggauagcccgaaacugugucacugaagcaaggcgaacagagauacccaugagauauagugagggaaagaaacaaaaccguucaaaucuagacuucuagagcacuugcuucuguuguucuguuuguuuguuuuuauguacauugguguuuugcucgcauggaugagggagucggauccccugguuacagacaguugugagcugccaugugggggcugggauuggacccagguccucugaaagagaauuuaguacuccuaaccacugagccaucuguccagcccucuugguuuuuuguuguuguugguuuugguuuuuguuuuuugagacagggucuauguaacuccagccgucugggaacuauguaggguuuaaaggcaugagacaugagcugggccauuuccuucuccuggaguucaauucacagaaaagaauuugagccucugggagcauacauuucacagcuaagucguagacaagucacuauucagaaaaaagaaagcaaacguuaaaaucugaaccaacaagauggcucaguggguaaaaguacucgcugcugaggcugacagccuagguucaaagccuaaaccaacauggggggggggggggcaggaaucagcuccugcacacagaagugcuguggaauguuuauauacuggugugucuacacguguacacacacacacacacacacacacacacacagagacacacacaaccucuaaggucacagucucuaaagaaacacuacuugaagaaccuuuagaacacagcagguaguguacaaugccugcaagggugugguaccuacaaggcagggcagcugcucugcuauagucaaagaaaaccuuuggccaggagugauagccucagaggugguggcaggaggguaaggaguuuaagacuagcuucagcuagacaguauucgaggcuaaccuaagcuauaugaccuaagcccugucucaaaaauacaaaaaggaaaaaaaaagucucuggccuuauagugcuaaauaccagguagucaacaccaacuacccaguaaaacaaaaacuggguuuguucaaauccugaucucugagugaauaguaacugccucucuugaggccauaauuaaucucaucagagcagagcaaaaagaaaaugaacagucaccaagaaaagguccauggaaaaaaacuggccaagcuccguaagaaaauaguuaccaagcugaauccucucacccugaacugagcgugaaugaauuaggaacuugguagacauuuaaagcaacuggacuagaauauacaauauggaagacggcaggccccauggagcagacaugcauacaucccucguuagaggaaaucuaggccagcagugccaggguacaccaaggaagauaacuagaaugcguaggcuuucucccauccucaugggaggccagacaacugcuaaaacauaacaaaugagcaaaguacaagugaggagaaagccaggucacuggcccugccacguuaccacuauguuaucagacgcugacagcugcaaccuagggugauaagugcgcagacacucuugcagaacucacauucccaguuagcacugaaucagaagauauaugagugcaguggucacagaaaacauuuccaaucagcacggaacgaggggggcuacacgagccucugucacccaaauaaggggagcgauucaaagccccagcugcucugcuuaaaugacuuaaccugaagacuuuuuacaaaacgaaauccauuucaucugucacugcuggcuuucaaccauuuggcuugaguugcaugaaugugcucucagccugugcuguggaaaguccacuggaccagacgacuggguccagcuuuaccucuuacucuguaacaaccucgagaaaguuacacaaucccuaugaaucuuucuucauaaaagggauuuuucaaacuuggauuacucuccaaacacgacuucauaucuggauacauauauucacgccaccagaacuuuuaauuccaaugagauuauuucuuuuuccuucuuucagacucuuccucugucaaacacaccccucacccagcacuucucaaaugcccuccguacacauucaugggcgcgaccagaacuaaaagugaaagcuacaguccugcaccaagcuuuccuggaaucggaggaaagggcacagcuuuccuuuuuggugaguuuuuccuaaaacugugaaacucagccuuuccacugccccgccauccugcucugcgaaagacagcccgagccccagugccaucaguaaguuaugaccugugcucuuacccuggcguccacgcucugaagccugcgcauaguccagggaguugggcagacugugacuccggccauggcgcuggguccguuuccaucgcuggcuguaaaggacgcacaggaauccaaggccggcggcaguaccaaguaacagucccaacccggcgcgggagccgcccagggcccccagucuagacauaguguaccugcagcccgcguaagaaacaggagcgaaccgagagagagucaugaggccggcccuccacccccgaggcagaacccguuagccacggccucacccagguccggccggacggugccgcagcccccggcucacccagguccagcccgcgggugccgcagcccccggcgcagacggacgcccugccaagaggcagcagcgccgguccaacgcgccccugcccagugcaguccggcuuccgcgccccuggccucccaacacccuguacgugacaaccucgcagccggcugcacacucucggccuuccggcgccccccgaagccacgcugggcccgcaggagaccaacucagacccuuacccagccaccagccaccauggcagcagcaggcaccgcgcuuucacucugucaaugauuuugacguccuuaauccgcgccaccugcuccgcgcacggugagacgcgcguggagaugacgcacgaggcucug

SEQ ID NO: 1006 - RNA, 3069 nt, Mus musculus
ucuguaggucauauuagaaaaaccuuuauugguugccuccuguuuccagaggaggcuugaagcugaguaccucugcacaggaacaggaaagagagaugucacagauguggauuuaucaggcagugugugucacagcuuccuuuacccuucuuucacacuugagugaccuggaggccagacccacaugguccagugcuucugggcucuggauucagaucugacccagccacagggcagggaguagcacaguuuguagccuugcccugucuugggccugguggaggauccuggagccucuugguggugcauuguccuuucugaucugguuaucccuguacuguuccugcagccuuucccagagguuccacauacaaugccuguggaaguucccagagcacuccuuugcagcugcugguuccaggagcuucuuccuagaguacuugcuuacagaucugugggaagcuugagucucaugcuguguuugcuaaugauguuaggccuuuccccugcauuuuccucugucuaccucuccugcugucagccccuccugcaccugcagcccagagcuggcaacuuuccuuccuugcccaagcuucugaugguuacauacugugucuggccagcgccauccaguggacuuuggucuaacagugucgguguuuaugcucugucauccaguacaguagccgucagucagauguggcuguugauuuaaaaugugccuaagugggcuggggagauggcucagcaauuaagaacacauacugcucuucuagaggcccugaguucaauuccuagcacccacaucagguggcucacaacugccuguaacucuagcuccaggggcauccaacaccuuugcccucugcauguaccuguauauacuuguuugugugcacacacacacacaauuaagaauaauuuuugaaaacaucuuuaaaauguggcuagagggcuggcauguggcucauuuagguagaguacuugcuuagcauacaugaaacccuggauuugauccccagugucucauaaaaaaaaaccuggguuugaucacacacacacaugaguaaucccaggcuccggagguggaggugggaggauaagaaguucaaggccacccucacuacauaugagaccucaucucaaaaacaaacaaauaaaaauuugcuaggaugaaaaauaacugaaauuuucuuuguguuugugucuggauggugugucugugugucugugagucugugugugugugugugugugugugugugugugugugucugugugugugaaguggaggucacagguugauuucagaugucuuucucaauuguucucgguguuuuauuuucugaggcaggcucucuugcugggccuggacugugccgauuuggcaaccuaaccaggcagcugccccugggaucccuagcuucuccaaccugagcaccagcauuccagaugggcuagcaucccugccugccuuuuauacucggguacuggaggucuaaucucaggcccuccugcuugcauagcaagcacuguauccacugagccauuccucagccucuggagcugacuucucaguuugcuuuuccuucauuaaacaguccugcgccguaaguggugacuugucuaguccugccucucugaccuccccacuucccuuucaucucaguuagacuaugucuuccuagacuggccugugacuuucuguuucugugacguggucuuuagaggcugcucugcccaggcugaguccuauuuccuggcucgccccugugccugccugucucuccacugaccucugacugguuccgugguugcagguuggaguuuccuuuuccuggucucuccagcuuccuucaggacuccugccagaaagugacucccauacauucccagcuggcuuuugccccuucacuuugggcgacuugaaggauuggucagcagccagagggcagggagaacuguggcuucugguccccaccuguucuuuaguccacauuguaccuuccucgccuggguccacaggcgccauuccuccagucaccccaguucucgcuacucucaccaggucagaaguggggcucgcuugggaauugcuccuuuagaaucugcagaacuucuuccagaagugaaagccccagguccacuuugaaggagaggaaagggucacugagguccggaguagguguccucgggaaguggggaguguccgaaagggccuccucugagcacuggugaagcggcccugucagggagauugcugaaggcaggguggccgaguagccagcuguguagcuugcugggggcuccagaauguuggggcagcuggagcucucucgguagaggcgugggggcuuggguggggccaguaggguggcucggggaugcucauccccccacaagggcagacgccggccgucuggccucccuugcaguucucggaugacuucccgguugcuguacuccucauggucaccaccagcagugcuggccuggcuaaguaugcugcccugucgaugcagucuccguggccgccccagggugauucgcuugaaaaaggaggcauugcggaaggagccuuuccgccaggucuccauggagcuccugagagucaucuagugggucuggcaucugagaagccccacaaaggggcucagcagcagcaggugaccuuuuugcuagggugcugaaugccagacaccagagggacacccuucaagggccaacagcagagguugugcguuucugcucagggugguccuucguuugccucugggguggugagagaagacuagcaggagggagguugucuaggagacagagacagcacugcgagcucccaccuggagagccuggcuguggaaaaccccaaaggaaguagcaguacucacagggcagaagggcaggacaaggcugagggcuggugagcagggcugaacucuggcaggagggcacacacuccuuccacaggcaggcagcagcucucucugcuggucccuggcaugaguuucgaucuucuggccgguguaggacugugcucucucugccagcaucuggggacucugauua

SEQ ID NO: 1007 - RNA, 841 nt, Mus musculus
agcccaggcacucggcugugucaagaugaagcugaacaucuccuucccuaccaccggcugucagaagcucaucgagguggaugacgagcguaagcuccgcaccuucuaugagaagcgcauggccacggaaguagucgcugaugcucuuggugaagaguggaaggguuaugugguccggaucagcggugggaaugauaagcaagguuuucccaugaagcaagguguucugacccauggcagagugcgccugcuguugaguaaggggcaucccuguuacagacuaaggagaacuguagagaggaagcgcaagucuguucucggaugcaucguggacgcuaaucucaguguucucaacuugguuauuguaaagaaaggagagaaggauauuccuggacugacagacacuacugugccucaucgggaccuaaaagagcuaguagaauccgaaagcuuuuuaaucucuccaaagaagaugauguccgccaguauguugucaggaagcccuuaaacaaagaagguaagaagcccaggaccaaagcacccaagauucagcgucuuguuacuccacgcguccuauaacacaaacgccgauguauugcucugaagaagcaacgcacuaagaagaacaggaggaggcugcagaauacgcuaaacuuuuggccaagagaaugaaggaagccaaagaaaagcgccaggaacagauugccaagagacguaggcuguccucgcugagagcuucuacuucuaagucugaguccagucagaaaugagucuuuaagagcaacaaauaaauaaugaccuugaaucucaaaaaaaaaaaugaagagagagaaaucagcac

SEQ ID NO: 1008 - RNA, 8436 nt, Mus musculus
ggccaauggcucaacacauuuuauuagaucccaguauagccaggauugggccugggaagcagauuucagguaucacuuuuagcuucaguauggugucuucuccaucugucucuguuugaggccagccucuuaggggagggccaugacuccuccucucaccuggccccucucagacuuauuauguuucuuccuuccagggacugggaagcucacaaaaggguguguuuaccaucaguagagcagggucuucugucccccuggaugcccugagacuuggcccaggagucuucccagccugcugguugccuguggcacagccaccucaggagaucauuagguuauccucaguguucuuggcaaggccgucgggggugguagggagaagucugauguucuuuaagaucaaaguuaucauggcccucccugcagaacaaaggggugaauggcagacaacuuggcaguccucaagccaagaacauccuccucucagaacacucucccagcacccaccggaagcaccgggcacaguagagguccccaucacagccagcacagcgcaaaguagcauccucauugcagauacagcaccaggggaguuccuccuccucagccuggggccccugaagcagagacuggggcuuaggaagagagaggaauggggacuacagagauggagccguaaggcagguggcaggcugucugugggaaguguggggauggaagccugagugaggccuugcucaccuccaucucugccuugcaggguugggcccgggauccuggagcugguuucucagggauguuaaagccacuugccucauccagggcagcuucuucagugagcugugaacagggagggagagaacuacuuccugcucuaggcacaagcugcccucccaucauuuguuuguuuuguggccuuggcuucucagcucuucacuguagcugaucugccauguuaccacccuggggguucuccuccccucagugucuuucccuaauacuagauaagagaaaaaggguaucagggggagagggagaggcagggagauauagauagacagaccaacugaccgacugaccgacauuccuggaucugauuuauugccuuuuguuucuucuuuaaucauggguacuacaaaccacgaaacugcagaaacucucugcagguggcacaaccaugcuucugguagaacacaggcagaucauggucagcuggcgaggacaguccaaagaagccccacgucccacacgugggaugaaaagaaaaacucauuuauguuuuuuaaaagaaaccgaaaguacaaaauucucacuacacuucacccuuuacucccuuccugccuaugcacauuuccuaugucaagacaccaggaagaacaggacccaggcuagaagaagugcuaaggaaugaccgcucauguggccccagugcagaggcccagcaugagaccagacagcugguacaacauugagcauggaggcagaggcagacuagggugacuggguggcuaacagggcuaccugcugcaugacucucuggauggcugucucuucauccucaucacugucugggaggugauaguccuggagggucacuggaaugagggacaggaacacaggaagaagugagguaagagauuucaccaaaucuuuucucuugccuucuagaacuguugguugcugggggcacuugguucagagcugagaaccaagcugcuugccucuaccccagcucugcaaggcuggaccaucagcccugagagcagagggcagaaugagaagcauuagcaccagaagggacugaagguuccacugccccaauauggcuaccucugaguccucauucucuauuuccccaucauacaucgcagcucugcauggcacauggcaugaccuuuggcacagggacccuuuaucugcuuuagcacugucaggggaaaauacagucugugguggcaguaggucuuggccaggggaccugaagaaggaugcuggcuagaaccuuuaccucugcugggguccugucccuucaguacagccaaucuuuuggcaagagccaggauccguuccugccugguguucuccuccuguagcucaacagcugccucagccagcagcuuguacuucucuuccuccagagacuggcuggccuggcccugggaauuugugcgcuggcuucucgcagcucccuuguugaggucauucuggagagaggcugcuggcaggggugauguaguuaggaagacagaagaaguccaagaucucauccuggaagccauuucucaacuagguuuaaccauacauuuucauuuucauugcucaguacuaggcuuuuauucauugguguauuuauuuuuguuuuuuucaaggcaagguuucucuguguaguccuggccugccuguaacucacuuugcagaccacguuggucuugaacugagaucugcccaccucugccucccaagugcaggucucaagugccgggauugaaggugugcacacuuccacgucuacuccuggaacacuuacuuacuuacuuacuuucuuucuuucucucucucucucucucucucucucucucucucucucucucucucucucucucucucucucucucucccccucccucccucccucccucccucccucccuuccuuccuuucuuucuuccuuguuuguuuuuuucgagacaggguuucucuguguagcccuggcuguccuggaacucacuuuguagaccaggcuagccucaaacuaagaaauccaccugccucugccucccaaaugcugggauuaaaggcgugcaccaccaccgcccggccucuuucuuuuuuuaauucuucucucauauauuacauucugacuuuaguuccccccucccucccguccugccaaucucucugccucaacuucacuuucuuucagucccaugccaguuucccuuucaccuccucucagaaaagagaagcccucccagggacaucagccauccacagcaagagaggaggugaccuacuaguaggaaaagggucucacaagcaggcaagagucagagacagccccugcucccagcuauaggaauccuacaugaacagcaagcuacucagccauagcauauaugcagaggaccuaggucagaccucuacgggaucccaccugagucccaaucaguccuuucugugggucuuguacucuugggguuucccugacuucucuaguucgucagauccuuccuccccucccuuugcaguacucucugagcuccuccucacguuugucugaaguagucugcaucuguucccgcaggagcuggaggaaggcucuccaacacucugaugaugauuuugcaggaaugacaaacuguaggucaaagguuuuguggcugggguggugccccuaucccuucauuugauggcuuggaacucaugaucuuucugcccuuaccucacaauucuaugacugcagagugccuuggaaaacuaguaauuuuaguugugucuuucaaagacaucaaccuugggagugacaauuuuggaauuuugcuuucuuuggaaaacacagaacuauuauaaggcuauguuuuuguuuuaauccccaauguggauauggggcugcuuuggauuuuccacaguagcugacuaugauuugccuugugccguaccaggggugugauuuugccagcugcagaauguuucugugagugugugacauuuguuauucuggggacuuuucagacaguauauaaauguuacagcccugagaggcuguugguggguuuuugguuguuguggguuuccguuuacuauguaguaaugugcagagaagaaaccagaagacggaauuagauauucugaaagcaaagaacaaucuuguccccaaggaauuucacaccccuauacagcaggaagauguccaccuguaaugucacuguuuuucaaccugacuuuauucagggaucucuuuccuuucgucccuauccuuuuuucucuaucaucuaguguuuuaaguugaaagggcagagaagagaagcaccuacaauguagcaauucagcucuacaucgcacacacugaguugguggcuauucugggcuugagaaucagaaugugaggggcuaggguuuagcuagacugucucucagagcuggacuuagcauuuucugggaauaacaggaagaagucauaacaguaacagcuaaguuagaugaugggcaggaagacauuugauaguaauccaugcaucagaugagugagguuauccacagagacucucugcaguagucuaucaaucuuaguuccacugguacauuuaagggcagauuuuuguuuacagguggggagcgggcaacugcacgguagggugcccagcaguauccccaucuuccacccaccagaagccaggaggaccugugaacugugaugaugaaaaugucuuuaaccaaacccaaaggugucuaaggcucaaaagcauuccuaguuggaacuacugcucaguagacuucauuaccacuguccaagaauuuucuaugaugucagaacccugcauagcauguccuagaucuacuguccaugaugugacccgcgagcucauguggguagcgaacaguggaaauguggcugguaugaggagacaaccgacccuaacucuuuucccugaagccucuuccucacugucagugcagucagucgcugcagagaguacucacgaaguucuuauuaugagccaggcauagucccaagcccuuacuguauuguuucauuuaguccucaugauuucucccaggacauagguuuuagcacaguagcuuaagcuuacugaugagaaagacucaggugagguaacucauguaugugguggaaguggaauucaccaucugauucuagagccagugcaagaggcccacgcuggcucuuuggagcuagcccucaguaaacagaaggucuuuugugcugacuauucucugacuuacauucaccucccaaaaggguggguaucagaggcaggacaugacuugggagaagccaaggggacaaguuaccugaggcucuugguuggcaguuuucaucaauagccaccucagcugucaacuguguuagcagauccugcgucugcugggccuggguccugguaucuggugccuggugugccugugcggaggagggcagcucaguggggaaagggcuguggggaaggccacaccaagagugcagaagaagucugagucagggguagaugcugaagaauuuucaaagcccaaggaaagggaugaauucaaguccacauaggugagucggucuggcggcucccaacaggacugaguauccacucugcugacgcacucaguccugcugcuuggccuuuguucuuuggcuuaggagcaggcuuaaggcucaggagguaggggugggaggcuuuaccaaucccugcaaagcacaggaucauacauguaucugggcuugugaagggugcucacccuaggaaauccuuuucuucuaagccacacacucaccggucucacggugugagaaggugggacucugcccugcaaggcugcaagccgauccuccaucuccugcguggaaggaauggggcccuggacuucauccuucagugcggcuagccgugccucuaucucggcuugugaggguacugacucugcaguuggaagggagaagauuuguaagggccagaggaagcucagaccucacuucugguaugugccuuuaaagguccccuggcccacucccacucacuaggcuuguuuuccugacgaagccgugcuaggcgcucagcgauggcuuggucuuugugggucaggcuuuggcuaugggaagugcuggacuuuuucuuggcuuccaaggcugccacacgccugggugaauaugagguagagacccuuaagguuaaagagaagacugauggcacccauucaaaucaaucugggccucuacaggccaucuucuguggccucuauucaugugguaccacagccuaacccagaugaccagcaggaggguaugccugacagggaaggagcucccaaaugccuuuucugauaacugguuaaugagcagcuuucaggauccaagagggaagccaggagccuggaggugggcauucucucugcccugcacccauuugcucuggagacuggaaggagagaugugguagugguguccuuguuucuucccagccccacuugucuucuucucagcacuuacuucuuauaguucugagguggugaccacuuggaagcauugucagaagacccucuggagaaaggacaucagaggacaauggugucagaaguccugcccuccuucccauugguaauuucuaccccaaauacuucccaggcagaccucuggccagggcgcacaaggccacaaggccugaccagaugcuuauugucaugucugucugaacccuugucagagcccaucucucaccuggucaggauuguguggcacugcuugcagacuuucuguuguguguugccagcccgggguaccagagcgcugaagcuaagacagccguuacagaaggcucggccacaauucuuacagccauacuauaagaaacaggaagcaggaggaagcaugucucacccagccccgauggcucuucucugagacccucuaagcacucacagaaagaaggaagugaaguugugaccagauuuugaaggaaggaggaagagugguaucccuaggguucuggccgagauggguucagcaauuccuuguuuccggagucuuauucaaauuagauaaaacuucaggcaaaauucacaugcuuucuaccauuuucaauuucuuaccauggggguguagugcaaagacaaacaaggcccagugugucaggucccuggcuugucaacaaaaagaaucagaguugggugcagaucccgugcuuucucuguucugguagagauggugggagguucgccucaggauaggguuguaacaauagcuucaauuauuaaguacuuagugugugccaggcacuaagccugcaccuuaaaauucaucauuuguuauaaccaucaucacuuacauacgucaucauauuugauccugaugcccaccaguauuaucucuauuuuaacaggggccagugaaauuacaugaccguucaauuagaucauucuuugaauaagacagggcagcugaaauuugaacucugacaccaaaauugauauguaagugcuccaauccuauacaccaugaauucgucccauuuacuucccuugcagcucacaaggggaaugugguugagaagaaggcuuuuucauugugcccuggggagaaaagggcaagcuguggacggggcagguuucagaacagagagcaaccggcaugcaugggaugacuuuaaagacagagauggagagaaggggaguggauagaauguagguggagauuuaaaaaaaaaguguagcuuuuggaaacuuuacaauuucuagggucuuuucagcuacagcaccucaccgaagcuacuuuacauuuucuuaauuuacauuauuucuuugugaguguaugcgugcagacauaugcauaucauggcauguguguggagaucagagaauaacuuucaggaguucucuccuuccaccauguggguccugggguucgaacuaaggucaucgggauuugcaggaagugcuuuuaccucacugaaccucaucagaccaucaucuuaacccggaaacgggugggcauccgacccacuuuacagagagguuaaccggguuacuucaucaaaaccacacaacugaaaagaagccgucaaacggucuuuagccugcaacucccuucccuucgccccgcguccucccuuggcccuucggcuuucugggaguacacucgccuccuucuugaagagggugaacuugacagcacagccguagcaccugcucuccauagcaguucucggcgcugcagaauugguagguuagccucucaccagcgcaggguaggccucucagacccucagguugugcagcccagucccacacgcccaucggcgcuguccaggggcggcccagcgcggagaauucugacuuugcacucaccaaggcggggcggcagcggaguggggcaugcugggagucguaguucauucuccgcagcgcgcuccuccacagccagucagacgagaaucggaaggcaucaucccaggaggcuuagcgcgcuuuugggccggcucggagcgaguaagccccgcgcccacgcacacgcucagacuccugggaguuguaguaucaauucaaguuuggacuagaaccauggcggugaccaaagagcucuuacaaauggaucuguacgcgcugcucggcauugaggagaaggcggcagacaaagaggugagaacuugauaggcaaagcaguucuucgguccucgcgucagggcgcgcgccuggcuccggcuuucuaug

SEQ ID NO: 1009 - RNA, 2270 nt, Mus musculus
cagugccugauaaauaaauguguuuauuugugcagugcugaagaaccaaacucuagauuuugugcauauaaagcaaguguucuaccaguaagaguuccaucuccagcccaaaacaaaggguuuaguucucucucucucuuucucucuccccccaccccacuuuggaacagggucucuuuucagccucagcuggacucaaccuugauuuuagccaagagugacuuugaacuccugaucuuccugccuccuucuaucagaugcuuggauuauaagcauguaucaccacacccagcuuuaaauauaggucuuuuuaauaucauguacacagugaauauaaucauaaacuucuggcaaugugguauugugauaaggugguacucucuugugguaguguucucuuagguauaagcuauuugggaaggcagaaaucaaacugugacaaaguucuuucuucccaggaaaugcacaaucauguuucuuccccagcauaccaugaugggcaucacuaugccaguggcuguggaacaucagaagauccagagagggccugacacccacguguuuccgcucccaguguccggaaugugaguggcuggaggguuugcaaucagugaaggcaggucauccuuggcuccaagaucaacacaugagacuacugucgguaagugauggggagaugguuuucauaguggggggagguaaaauaguaugaaaagacguagaaucuuucuuuaagaaccuugauuccauucccaggccccauguggaaguucacaauugccuuacuucaguucuagaagaauucaaguguccucuucugguuuuaacaggcacaaagcagacacaaaaugcauauaacauacaggcacucauacacagaacacucuuuagaaucuuuguuguugcuuugauuuuuugagacuggguuuuuccauguaacccuggcuguacuggacucuguagaccaggcaggucuugaacucaggagaucugccagccuccccaagugcuguaccaacaccagcgccaucagcagugccaucacuaggccaaauguuuuauagucuuaaagauauauauauauuuaugauacguguauguguguguaugugugaauaaauaccacauuugcacagguguuugaggaggccagaagaggguuucagaccccuuggagcuagaguucaagaggcugugagcccugagauguggaugcugggaauugaacucugguccuccacaagaguagcaauugcucugaacuguugauccgucucuccuggggggcuggggggcauaaauaagacaaaucuugccagauauagugacucaucucuguaauugcaacacuaggaaaugaugcagaaccagagaugcuuuucaaggccuugucucagaaauaaguuaauuugaaagaaaacaggaguguagauguccuguagacaucugggaugugaagaaaggacugcguguuuuucauuuaggaaaagcaaugagcuugguaugaagguguucccuguugcgugggagauuaacugaacccuucagagagcuggagccuccagguguccaaacagggaauuuauguggaagagaguggucaacuacucacugggaguuccccuugggaugggagaguaaaccugagauucagggaaggggacaauuuaccaacaaaagaugaagaguucaaaaggaaauguuuacaagaaugagggagaggcgcaaacaaaagggaaugcacuccugugggugaaacagggaagccaggauaccaggaaucaccuguugguccacucucgcagaaggaagggcuguccugagcugcaucagugaagcacgaaucccaggaucugguuuacacaaacgcagccuauccaacuuugggguucucuucuuacuggaaaacuggaaaugaugucccaagggcaggccacagacagcgaaaucguuugcauaagcuuuccccgacauuucuccuccaacuccuucccaaacgcccccagccaaggguagggaaugccggcucuaaccggaaaggaaggccggaggcaaccgcaccugcgccaccuugcaggggugucgcggcccaaugugggcuuagggacgcacuucugguguucagggacccaacgaguggcuggacuccguggagccaggguagagccgccuccagggcacgcgggccucacccacgccgcugggcguucggaaaccacgggcgcugcggcugggucugggguggcugagccgcccggcggguccagccg

SEQ ID NO: 1010 - RNA, 2270 nt, Mus musculus
cggcuggacccgccgggcggcucagccaccccagacccagccgcagcgcccgugguuuccgaacgcccagcggcgugggugaggcccgcgugcccuggaggcggcucuacccuggcuccacggaguccagccacucguugggucccugaacaccagaagugcgucccuaagcccacauugggccgcgacaccccugcaagguggcgcaggugcgguugccuccggccuuccuuuccgguuagagccggcauucccuacccuuggcugggggcguuugggaaggaguuggaggagaaaugucggggaaagcuuaugcaaacgauuucgcugucuguggccugcccuugggacaucauuuccaguuuuccaguaagaagagaaccccaaaguuggauaggcugcguuuguguaaaccagauccugggauucgugcuucacugaugcagcucaggacagcccuuccuucugcgagaguggaccaacaggugauuccugguauccuggcuucccuguuucacccacaggagugcauucccuuuuguuugcgccucucccucauucuuguaaacauuuccuuuugaacucuucaucuuuuguugguaaauuguccccuucccugaaucucagguuuacucucccaucccaaggggaacucccagugaguaguugaccacucucuuccacauaaauucccuguuuggacaccuggaggcuccagcucucugaaggguucaguuaaucucccacgcaacagggaacaccuucauaccaagcucauugcuuuuccuaaaugaaaaacacgcaguccuuucuucacaucccagaugucuacaggacaucuacacuccuguuuucuuucaaauuaacuuauuucugagacaaggccuugaaaagcaucucugguucugcaucauuuccuaguguugcaauuacagagaugagucacuauaucuggcaagauuugucuuauuuaugccccccagccccccaggagagacggaucaacaguucagagcaauugcuacucuuguggaggaccagaguucaauucccagcauccacaucucagggcucacagccucuugaacucuagcuccaaggggucugaaacccucuucuggccuccucaaacaccugugcaaaugugguauuuauucacacauacacacacauacacguaucauaaauauauauauaucuuuaagacuauaaaacauuuggccuagugauggcacugcugauggcgcugguguugguacagcacuuggggaggcuggcagaucuccugaguucaagaccugccuggucuacagaguccaguacagccaggguuacauggaaaaacccagucucaaaaaaucaaagcaacaacaaagauucuaaagaguguucuguguaugagugccuguauguuauaugcauuuugugucugcuuugugccuguuaaaaccagaagaggacacuugaauucuucuagaacugaaguaaggcaauugugaacuuccacauggggccugggaauggaaucaagguucuuaaagaaagauucuacgucuuuucauacuauuuuaccuccccccacuaugaaaaccaucuccccaucacuuaccgacaguagucucauguguugaucuuggagccaaggaugaccugccuucacugauugcaaacccuccagccacucacauuccggacacugggagcggaaacacgugggugucaggcccucucuggaucuucugauguuccacagccacuggcauagugaugcccaucaugguaugcuggggaagaaacaugauugugcauuuccugggaagaaagaacuuugucacaguuugauuucugccuucccaaauagcuuauaccuaagagaacacuaccacaagagaguaccaccuuaucacaauaccacauugccagaaguuuaugauuauauucacuguguacaugauauuaaaaagaccuauauuuaaagcuggguguggugauacaugcuuauaauccaagcaucugauagaaggaggcaggaagaucaggaguucaaagucacucuuggcuaaaaucaagguugaguccagcugaggcugaaaagagacccuguuccaaagugggguggggggagagagaaagagagagagagaacuaaacccuuuguuuugggcuggagauggaacucuuacugguagaacacuugcuuuauaugcacaaaaucuagaguuugguucuucagcacugcacaaauaaacacauuuauuuaucaggcacug

SEQ ID NO: 1011 - RNA, 2029 nt, Mus musculus
gcuugagaaauggaagguuuuauuugcagacuguauagcucaccuucuaagcuaugaccuuggggaaagggacggucccugccccuuccuccuucaggcuccuaccugcagcuccuccccucccuuugcugggccugaacucucacuuccugccccucugcuagcccagccaguuuggccagugccuggggaacccugagacccaguucuucccagggagcaguccuguccucccuggccuuggggcucgagggcagcccaggugucggccuucuccacagcuguccacccuucucccuuccugucuuccuccuuccaggcccaggccucuaaucugccuccuguccaccacucgccucacuuucuguuuucccucucaaucucucacugcccucuucuucauaccccaucucaaacgucuccaaaucaagcugaccauccgccagcccugcaagaugccccacuguucuccuugauccucgcacugugcuaggagagggggaugaccccgaggggccugcauucagccaaacugaccuguggccccaggauaagaaacugagaauuacaucccaagcugcucagcagcacugacgcugauggcgcuaucccaugaaaaucaaagugcugggauuuuccugugagucuugaccaaagaaauccaaauggggcagccccugcacagacagagcucacccuggcucaccaggguguacagcuuugaggcccaugugcccuguguucaauagagaacugaguuccagggguuggccaggcccugccaguacccgaugucucgggguccagaagucucaggccacccgccuaucucuugccauagcugcucacacaaagcagaagaacuucuuccagcgacagcgagacagcgugcgcacaccuuuugcguucaguuucuucuccagacgggcuuugugcucaaucgcacugagaauggccgagucgaacaccuccuucaaguucuucugcgucaaggccgagcacucaagguagcagcaggcgcggaucuucucagccagacccugggcuugggguugugguacugggcccucccggccuccuugguccaacugaauuaguacauugacaucgucccuuaggucagccugagugcccaccagcaacacgggugcuuggggguugugagugcggaucucaggcagccauuuuucuguuauguuuuggaaggagcugggcugcaccacgcugaagcaagccagaaagacaucgguguccggguagcagagagaacgaagccggucaaaguccuccugggguggcaaggcuaguuguuagcaacaucauucccuccacauuggaaccagaaucugcuucucccuuggggguggagaccuaaaagugcuaaagcccaaagccuauuccauucccacuccacgcagggauccucccagccuccaacccucuccaaccccuugcccaaggaaggcuacacccagguucucaccugcccugcggugucccaaagcucgauucgcacaggggcuccaucgaccaggacuugcacugcagagguggggaggggaaagcaugacuuaggcacagcauccucgucccuccugcaggccucaccagcgccaccuccgggccugcucccggggucuuccguacccucccgccagcaggcuacugaaugcacaacccuucccauccucaggggccccggggcuauagaacauaccggagaaggugucuagugcuguaggccgauagcgcgcgggguacccauugcagguguagcugacgaugaggcugcucuugcccaccgcgccaucgcccaccagcacgcauuugaugcccagcuccggaggggcgcugcgccgccgcggaggaggggucgaggccgggagaggcgguggcucggccucgcuuagcucccgcggcggcaugguccgcuccugggguagcagaggggccagcccggaccaggcuccgcggcacucggggaagcagguuccgcagccggacgcugacaaucuguccaagcugggca

SEQ ID NO: 1012 - RNA, 5015 nt, Mus musculus
acaguaccgccagcagcaguagcgcccagcgacaggcgcuccgggacgcaggcgucaucccuugggguguccucuccacuccgggacuccgaaucugcuuguuagggaugucgcucucccgcaagucccgucugccagccgaguuccugaaaagcugauuccccucgggacgcugcucccuugucgccuucucaaaaacuccgcugcucgaugccucgguagguaauccaggugagggcgacugggcgguggcugcucuaaguacguguccuggagcaaauccuagggucucgagcgggcuagugagggaguacacugcacccaagugacuuuggcugcagcucuuggccucggguuccuagccugcgagcagcgccgcuacugaaaccugcuugcuccagagccuuucuuauauauauuggcugcucuucgcagccugucagucagacagacucacggucacucuccccuccccuccaggccucuaguggcuacagucccagcacccaccggagggggccuccgcccccgccgcucccccugucagccagccaguagggcgcagguccccgccccucuuccaacuucugggcuuccagcucugcgcgugcccggcgagcaguccuuagagaucgucugcuuaaaggcugagacccucgccaccagaggauaggaggguagcccagugaugcggcgggaggugaggugguucccgaaugguccaggggguggaaacucuaagggguccccguaggcggugcaccugauccaggcauuagauaccuacaguccucuagcagguggggaaagcuuaaacuaggaaagcaaaaagcaggaccaggggauuuggaucucccuuuccuuuccagacuuuagguagcuccugccucgcuggccuccagccuaugugugcccacccuccacgcguccccagcaccgcagggaagccauccgacgccuuaaccuuucccuggcuauuccaagcaaggcaaagggccaagcgucuaggacucuggucuucucugcaccugguaggcgugucaccucaagcagcagggcgugcccagcgcgugccuucucucuuugucccccacccccacucccuccuggcucgugcuagagccaggacuagagguucgaaagagagguggggggcgugguucucgaagugggggggggguccucagcuguaugguaaugagguucuagucuuuucccucagugccuaucucaccugggucgcgcuuggucuccauauccucauccuggcccccacccgcguccccuagcuccgcuggaguagggaggaaacuuucuuaauuccagaauuuccuugggccacuugagaggcaaggugagagagcuugaggcugaucaggucuagaucucucugcauagggcaggauguaggguggaacuggaggcgcauagaguuguuugaguuucgggugguuucacccaugucacacgcgcgccucucccggguggccuccgagcgcaaacccugcagcugcuuucccagaacccgucgugcucccccgaggcugcagaccggggagggcuggcuucucccaguuuuggggggugcuagauuucucucucucucucucucucucucucucucucucucucucucucucucucucucucucucucucucucucucucucucucucucucucucucucucuccuacagugagagcggugggggcccuguggcuucagcugucagcccucccgcguggugauugcuggcuauggucggacgauaagaucagugcgggcggggguugaggggagcagggacgcggcuccagccccagggaggccgugguagggggaaguggaacccaacagcugccaaugacgaacauggucugauauuuugacuugggugguggugauggagaauuggggggggguaagaaacaugagguugugagcguggggugggggguggggugaggugaggcgacaggcuccggggucccccacgcacggccaccccucccagccaccaucuggcgcgagcggguuggcguggggaaccgaggugaggcgggggccggcagaugggcccaggcugcacuagcgaguuaauguagguuaugggcaagccgagucccaggcccgagggacggggagcucggggcguaccucccggcgguccuggcaaguggacuuccaaauccucucugucugcauccucuuugcaccguagaccugccuggagugccagagggugcucccucucucuccuuggagcugggcuugcaaccccaccugacucuaaugguuuucaucuaacaguuuucaucucaaaauccuagccugggaguuaguagaaacucuaacgcgggcacuugcuugacucucaagggagacucccacacgggauaucuauuauuuuggaaguggccuacccucauacacauuaguaugccaaaauauuuggcaaauagugaagggccaaacaaaaguuggaaucaccauuuuccucagaaauggacaaaucacccacuuauaaaauuucugaccuaagaaggaaaaaguguucauuuuuucucucucucuuuuuaccagaagcaccuauuacaauauuccucuucggaacaccacccuuagccuugggucccugcuagaguucccaucugcugguaucaaucuuuacccacauugcuaggcaccaagggcucaagcuguggugcccagugucucuccagaccacacagcuggaguccuucucugucacuccguaauuaguagaaccaacucucuaguggaagaaagacaacacccuucugguuacucaaaggaauggaagguugugaggcucauagcaggccucuagucagggccaucuggcucugacccugauguagauggccccuaggucucuaagccauacgaccuggguucccauaaacuacagcucuuucuugggccuacagcuuuucgacucuacagaguccucaacauuucccagcccugaagcccgaguagcagggaggccaggcgaagccuuucucccuacaagucuccugcuucuacuguucccuccucuuggccacugugcacgcuauuuuucaguuucucccauuaugcagaaccagcccccggaacugaaaaacaaaaacaaaaacgccaaagcugucuuucagcgguguccccaaacuggcugcagguuacuggggugcggcuucgggccuccuucuuagcuagaagccuacaagcgcuccccagggccaccagcgcagcucggagaccuccagcgcgguguuaucucaacucucaccggcuacccuucccaggggacaacgaucuggaccuggcacacugcacccggguagaggcgagguggggucugagcuacugcgcccgcaggacaggcugggggcggggaagaaggccugcccggggcggggcacuuaagccuugagagacacugcugcggucgcugcggagaaggggccacgugcugcgagccgcggccggggagcugcacagaaggcggggagauuugcaaacuguugcugccacauggcugcuucauucgauccauucacauugaaaugaggccggcgcgugccucaucugccgcagggcgcugccacgcgucaggcuggcccuccgcgugccaacuggggcaguggggcuggcagagccuggcagccgugggggcgcagcucuggccuagaggcugggagggggguaggggaaggaaaaucaacuucucuagccacuaaggcgccgcagauucucggaccuuggccccgcauuuaggagugaaccgacagaaaggaacaagacgaacgguuugagaggggggccaggaucgaugccgccgcuccccgcagaugcgccccggcagcgcugcucuccaucugccgcugcucgcaccugccggucaauaaaucgauuuuacaauuuaaugcagcagcuucccgcccgccucggacagaugccgccgcagaagcaccuccgcccucuccccuccccucgaggggcgccagcgguuaggaaccgguuucccgcuuagcaagcagcgccccgcggcgcggcgcacuuuucccuacugccccuuggagaaacugcguacuuggaguuuuugcccggggucagaguggauuccccagagaauaggccugaggcugagggaggagagaggaagaugaugacuuagcauuggccucgaggacuggcuggggggcuucaaggaaggaacaggaugcaggaacugaugauaaaaucccagggcuaggagagaagaggggcaugguguuguaagucacaauggguucugaggauugaagaggaggcccgagcacugagguggccuggggucucaccccauucuccccuuagucuggugaaugaguaugacucggauuuggccaagaaacguaaccacggcucuacaucuguucuuucaucccugcaaagugauaauaauagcgaucugggagacuguauuggacuauccauuuugcaagauucaaagaauaauuuaguuccuuucuuucccucuaggcaacaugaagacaaccagaggccaccucgggggcggggcacaaaugaaauucacggguagaggaaaagacagaggacacacuccuaagggaagaggcaauaggagcagaacggaggaggggaaagagcagagcgugaaaagucaagguuucggggccuuuuuugguaggaggccugugauaagguucuugacugaacaaccuggccuagagaaaaccuucccacugagacaacucuccugcuggaggguagucuuucagagcagcggccugcagaaaggaagagaugucauccuugaauggaucuaaucagagagggugcuggccucagagagagggggggcgcgggggcgcgcucggcuuuuccucauaccucugagagacccuacuuccuggguucacuguccacugucugguugcucaugccugaugacucaacauaugccaaauaaaggauacccaagugggcaggauuacugggcac

SEQ ID NO: 1013 - RNA, 1291 nt, Mus musculus
augugccuacuccaguaccugauugaacacacacacacacacacacacacacacacacacacacacacuccucccccaccucuuaaauuuuuaaauaaaugaaugaaugaaauuauuuauuguguugacugggcacgaugccguaggccuuuaauccuagcccacagggugaggcaggaguuucugugaagccagccuagucuacauaguguguuccaggacagccugagcuacaaacaaacguuuauuguaauaaugacugauaggcuucagcaccuucaaaguucuaguuuaucucuggauucaaaaugaacuguaguuccuaaaaugaguucuuguuaacauagugggcuuguggcuguucucuuugguuauaauguguuuuauugccccggcuuaauacauuguuuuagggcagggagagaaaaagauggaaaugagagcagaaacuaacugauggagguuguuuggguuaggagaggacccaguaccaaaggaauuagguccaugggguucuuuucagaagcuguagauuggggcuguuuugaaggacaugaagaugggauguggaagcaagugaaaccacucuauauggcauugcaguaguaaacaccagguaugcauuugucaagacucagggaaaccugcaagacgaugacguuuaacguacacuguggacuuugguuaauaacaaugcaccagaaguccucugcucguuuuacccagugcuccacacuuaggaauguagugguaguguuagcaacgggaugggggaagguuugggccacgugggaacucucaccucuuagucuuugaaaagaaucaacuaugauugcuaagcauuuguugcugcugcuccuccucccugugcugcuaguccuccuccuucguggcgguguuguagagcuugcaugugaguguguagguccacauccuaauaagaagggguuauucaugacuccaucuuucucugccuucuugccuugaggcaggaucccucccucaacucaaagcuugcucugugcagucaucgccccaguccuuuugcuugugcguuuuaguuuuucaagacaggguuucucuguguagccuuggcugcccuggaacacaaccccucuuuaaaaaaauaaucauuuuuuauuucucugugugugugcucaaauguacuauguguguguguaccagaagguaucagagccccuggaaauggaguuaaccagugguugugagccucccaauggaagaacagugaguucaaggccagccuggguuauguaagacccuaucugua

SEQ ID NO: 1014 - RNA, 1291 nt, Mus musculus
uacagauagggucuuacauaacccaggcuggccuugaacucacuguucuuccauugggaggcucacaaccacugguuaacuccauuuccaggggcucugauaccuucugguacacacacacauaguacauuugagcacacacacagagaaauaaaaaaugauuauuuuuuuaaagagggguuguguuccagggcagccaaggcuacacagagaaacccugucuugaaaaacuaaaacgcacaagcaaaaggacuggggcgaugacugcacagagcaagcuuugaguugagggagggauccugccucaaggcaagaaggcagagaaagauggagucaugaauaaccccuucuuauuaggauguggaccuacacacucacaugcaagcucuacaacaccgccacgaaggaggaggacuagcagcacagggaggaggagcagcagcaacaaaugcuuagcaaucauaguugauucuuuucaaagacuaagaggugagaguucccacguggcccaaaccuucccccaucccguugcuaacacuaccacuacauuccuaaguguggagcacuggguaaaacgagcagaggacuucuggugcauuguuauuaaccaaaguccacaguguacguuaaacgucaucgucuugcagguuucccugagucuugacaaaugcauaccugguguuuacuacugcaaugccauauagagugguuucacuugcuuccacaucccaucuucauguccuucaaaacagccccaaucuacagcuucugaaaagaaccccauggaccuaauuccuuugguacuggguccucuccuaacccaaacaaccuccaucaguuaguuucugcucucauuuccaucuuuuucucucccugcccuaaaacaauguauuaagccggggcaauaaaacacauuauaaccaaagagaacagccacaagcccacuauguuaacaagaacucauuuuaggaacuacaguucauuuugaauccagagauaaacuagaacuuugaaggugcugaagccuaucagucauuauuacaauaaacguuuguuuguagcucaggcuguccuggaacacacuauguagacuaggcuggcuucacagaaacuccugccucacccugugggcuaggauuaaaggccuacggcaucgugcccagucaacacaauaaauaauuucauucauucauuuauuuaaaaauuuaagaggugggggaggaguguguguguguguguguguguguguguguguguguguguguucaaucagguacuggaguaggcacau

SEQ ID NO: 1015 - RNA, 23892 nt, Mus musculus
uagaggcggcggaagugccaguccgcacggccaagauggcggcgcccaggcggguuugguuggaguagguugcuguuugcagagaccccgaucaaguuacucagguggagaacccagaagcaaggugucugguuacuuuaucauaccugcuugggagucuuugcacagaaguagcuuguguuaccuaaaccucggguacagcucuucauuucgagccucacgagcugucucuugguugcagacgcgggcgauccaggaugcuuaacuagagccugaggugcaaucucuggauuggucgugucgccgauaggcugcgauguaagaggcuauuccaaaacccaguaaauccauuguuaguuuuccuucgcuuuagagguuaucugucggaauuauccuuauuauaauucaaggcguaacuuuuagcacuaauugauuuuagacaaauccccccccuggaguuugugggggaguacauuugcuucuuuauguagcaugggacuugcuguuuucauucacugaaguuuauuuauauaacagauacuguggaaggcacgcugcaugcaguaauaacuugcuguuguuuugaaagguuuccuguaucccagguugaauugaaacgccuuaucuuccugccuccacuucccaaaugcugggauuagucugucucagccuugugcauuuuacaggcuugaaacuuaauuuggaauagcuuaaauaauuugccuaauuuuacacuaguaaguaguggagcuaguauuuuauuucugacuuagguuucuaauguugcuguuaaacaacccgucacagccccguguuuguguguguauuuacugggcagugaaacuacugggguucgggaaucgucucacaaacaccaaucucagacagggauaguuuagugagcauauauuccaugacuugaccaaauuccaugguccagauuugggaacuggaccauaccccuugaauuaagauccuacaggauuuuuaggccccaaauccacaaacaucugugccaaguuauucaggauuuagggauggaggauuuccuugggaacaugucuuuguuguacaccacucacuguguuccuauugguugggguauucaacuguggcaggggacuugccuuaucuaauauucaggucuuaacuugucuacugggaugggacuugucuaacauucaugugucuuaacuugccaauuaggaggucaauuacgcaaguacaugucucuuugugccaaguaaacuugacuugaccacuacucaagauggaaguauuauuccaaauaguuucuuauacugguacaagugucucuuuuuuuuuuuuuaaagauuuauuuauuuauuuauuuauuauauguaaguacacuguagcugucuucagacacuccagaagagggcgucagaucucguuacggaugguugugagccaccaugugguugcugggauuugaacuucggaccuucggaagagcagucgggugcucuuacccacugagccaucucaccagcccacaagugucucuuuuauguuggggaucauccccaaggcaacuuacaccauaaaagcucauacaaagguguagaaagugcuguugggugguugguuuggguccaagcgaggaguucuucugacuucugucuugauugguuucaaagggcacagaacauaacagaauauaucaucaaucuugacauuagaaaguuucuggcaacagcagaaacauaugagaagguuuccuuauaaugccaagcuauccagguaacaguuaccugggccuuaauauuuuaccuaggucccaacagaaaccaaggucuuaugcaugcuaggcaagcacucugccacugaucuacacuugacuacucaaaccagcacaugugcacacccucgcucacacacacacacacacacacacacacacaccuccuauaccuggagcuaacuauguagccuugggggcuggcuuugaauucaacuguucugccucagcugccugcaugcugauaauagccaugaacauuuauagccuuuuuuacacaccucgcccaaauuaaacucucaaaaagcuuuuuuagugguaacuuuguuuuugauuuuuuguggggagaaggucuugcuguauuauagcacaaacugucuuagggcucucaaauccuuuaaccuccugaaugcuaggguuacaggcauagccaaucacagaugguuaucgguaucguuccuuaaguuacacacucauguuaauauuuuaacauuucugcccccuuuagcccuuguguuaggaguguuuucuauacuggccuaguaaguauaguuauuucaucugauccugcauaggacugggaaauaaggaaauacauagauugcuugccaccguuaccauuguggccuauuugucgugucucucccugcuucuuacuguccucagccuuuagaagaugugucccaugugccauuuauuuacauuuuauuauguuacuuguuuauuuuguggaggggaggcacacaugccacacugugcuuguggaggucaggggacagcuugccguguggaggucaggggaccgcuugccggauuugguucucucuuuucaccauguggguugggaauugaguucagguugccagucuuggcagcaagugucuuuauugguugagccauugagguccuguugguuucauuguuuauuuucugugauaggguuuuuguagaccaaacuaaccuuaaauucaccaagauccacuagucuuugccucccuaaaggcaugugccacuuuaccuggugaauuuaucuuuuugaaaguguacauauaggcuggagagauggcucugagguugaaugcacacugacugcgcuuccagagguccuuaauucaauucccagcaaaccauaugguggcucacaaccaucuguaaugugaucugaugccaucuucuggccuacagguagaacacuguucauaagaaaucuuuuaaaaaagaaaauguacauacaauuuagaggcuuuuucaaacauaacaagguugcuaccaacaucaucuaauuugagaaaauuuugagaguuuugucacccacagauuguaaacaaccuaaauuggcaauacuuacuuuuugguuguuguuuuguuuuguguuuuguucuuuugagacagggucucacuguguagccucggcuguccuggaauucacuagguacaccaggcuggccuugaauucacagagaucuaccugccuuugccucccaagugcugggaucaaaggugugcgccaccaugccccacucuuguuuguuuuuugacacaggguuuuauguacuucaggcuggcuuuuaaacuuaccauauagccaaggguaaccuggaacuuucuacccucuugcuuuuuaccccaagugcuggggguuauagacaggugcagccgcccucgcguuggcuguaaauaaguuuacuagacugauggccagagagggcugauagagaaagaaaugccagugagcucacaucaaugcauggaaaagauaaagaccaccaggguucgguuguaaccgcugcuguuuugaugcuuuagggguggaugagagggaguacuggaaggagucguacaaagggcacagcuccagggccaugaugcuguccagaccgaagccuggagagucagagguggaccugcugcgcuuccagagccaguuccuugaggcuggugcagccccggcggugcagcuggugaaggggaguaggaggcauggugaugcuccuccagaccggcucccaccgcaggaccaucgggauguggugaugcuggacagugagugcuuucgagcaugggcgugaggagagagggcucagccucagggacccugcuuccauccugagguggcugaaugcugcuccaacuguaaccucuguugcugaaaguuuguuuuauuuuuauugcuuucauucauuccucugugugugugugugugugugugugugugugugugugugugugugugagagagagagagagagagagagagagagagagagagugugaguguuuggaacucacuauugagcacaagcuaacuuucaguuugugacaaucuucuuguaaauacugagggaccagaggugcaagccagcgcugcagcuucauuauacagaugaagaaacugaggcucagagagguuaaauaucauacccaagauaacacagcugaagcuagggcccagagcagcugucuuuuguucuuuguuucugcccccaauccauacuuccuuaggaacgugugaauauacuuaauaucugcauuccuuuucucucagaucucccagauuugcccccagcucugcuucccgcuccugcaaaaagagcaagaccgagcccuggucacccgcugccucacgaugaagacccugaagagaggcugaacaggcaugaucagcacaucacugcugucuugucuaagauuguuguacgugucagcccggcuggguggggcaaggcaucccauuugggcgagaaaaggguuuauaaguggaggguguuguagaaagguacacuuuuaacacuccacggucagguuggaacaugguuagaaccaccuagacuagauccaacauggguuccugaaccuagacuagauccaacauggguuccugaaccccuggaaugaggaucaugggggccacugguaucggguucagccuggagaagccuguagacagugccuauccauggccucugcaucugcuccugccuccagguuccugcccuguuugggguccugaugugcaucuuccuuacuuuguguugccacaggaacgagauacaaguucagucacugugacucugccugugcccagugguguugcuuucccgccuguguuccaucgcucucaggagagacagguaagccagaguucccuuagguggacuuucaguuaggcuuucuauugcugcaccaaaacaccaugaccagaaacaacuuggggaugaaaggcauuauuucaauuacauuuucaucaggaccccaaacagggcaggaaccuggaggcaggagcagaugcagaggccauggauaggcacugucuacuggcuugcucagccugcuuguuuauagaacccaggaccaccagcucaaggaagcaccccucacaaugggcugggcccuccccaucaaucacuaggaaaugccuuagagcuggaucuccuuucucaugacucuagcuugugucacguugccguaaaacuauccagcacaggcgaugcuuagggaaugagugguucucagagcgcaucuucccuagggagcucuggacaaugauaagcaagucccuuuuauuuucccuuaaagaaaaccauauguaaguaucuaugucugggccaggcaggcagaucucugaguuugaggccagccuggucuacagagugaguuccaggacagccaggacuauacagagaaacccugucucaaaaaaccaaaccaagaaaagaaaagagccaggagugguacaacgugccauguccgccaugcccacagagcccagaaagguagagugcccuuggagcgugaguuacagaugcuugagcuguccaaugacagagcugcgaauucaacucagguccucuggaagaacagcgggugcucuggaccacugagccaucuccagacgucucuuuagacauuuuguuuuuaucugugugaguguuucaccuggacguauguguguacacaacgugcacgccuggugcccauggagaucugaagaggcuuucuuauucccugggacugaaguuaaugacgugagccauguugugggaacuaggaguucaacucaaguucucugcuccuaaccacugaaccaucugucuguaaacacccccccccacccccccgccacccaaauacacacuuuuuaccuuugaaguuguuucaguaggaggcaggccucauacucacagaaaugucuuuuuugccucagccuuuccaagugauagaauuuugguuuuuuguuuauuuguuuguuuguuuugcgugguauggcuggggauugaacccagugcuuccugauccuggacaaugaugggcccugaguucuacccacaguuccagucggacuuucuucuuuggguguguuuauguguaaaugugcaugcugugaguucuggugguccaagaagcaccucaggugucauucccugccuucuccugucuuuaaaacagcuuagccuuguuguucacagcuuugcaugucggagucaauggcuuagggcuuagauugugugagaaagggucucucuguguagcccugggagucguaaagcgcacuguagaccagacuguccuggaacucacagagauccuccugccuccgccucucaagugcugccucuaaguauacaagcauauacuaucacauccagccuucagugcccuuugaauuuccagggauucuuuugucucugucuccuaucuugcuuuagaaguauugagauuacagauacgugcuaacuguaccaguuuaacauggguuauggggauucaaaucagaucuugauguuuauagaacagcuacauuuacuuuguguguguguguguguguguguguguguguguguguguguguguguguguguguguguaaauguguucaggccugggcaugaaaaucagaagaaaacuguaggagucaauucucgccuuccagcaugugggucccauggaucaaacccauguuaucaggcuucaagugcuccuacaaacuuggucauauugcuguuuuugauguuggugucuuuuuuuuuuaauuuauuuauuauuauauguaaguacacuguagcuaucuucagacacaccagaagagggugucagaucucauaacagaugguagugagccaccaugugguugcugggauuugaacucaagaccuucagaagaguagucagugcucuuaaccgcugagccaucucaccagcaaaccuguuuguuuuuucuuuucucuuuucuuuucuuuucuuuucuuuucuuuucuuuucuuuucuuuucuuuucuuuucuuuucuuuucuuuccuuuccuuuccuuuucucuucucuucucuucucuucucuucuuuucuuuucuuuucuuuuuuuuagacaaggucucauuucucaucaccaucuucaagcuugcuguguagcagagggugucuugaacuccucuuauuucugccucuaccuccagaaugcugauuuuagcuggguaccaccauaucccagaaguccuacuuucucugagaaacuuucuuuucucuuuguuccagagccuugguuuaaggagcuaagaaagaauggguaaugaauaucgacaacuugguuuuuucucuuuguccuguaggugaaaccagcagcaucugguaaaaggagcaucuuugcccaagagauugcagcaagaagggugucaggaaacagggugacaucagcugagcaaguuguccccagccuagacacaccagagggugagugcugccaggcugagggugacagcgcucagucauguuggcucguagaaauguauucucucuuugguggugguagagugggacaaagucaagauuaaugugugccagucuggccucgaacucacuguguaaugaagggugauuuuaaaauugugauucuccugcuuccaccucuggucugcuggaaauacagacaugugccaccaugccagguuauaugguuaugggaucaaaccccgggcuuuguguauccuagcaaagaugcaugcuagcaacagagcuacaucccuagccucucaaauguccguccauuuuucauucucauauucucucucucucaaaacuuuugcugggcagugguggcguaugccuuuaaucccagcacuugggaggcagaggcaggaggauuucugaguucgaggccagccuggucuacaaagugagcuccaggacagccagggcuauacagagaaacccugucucaaaaaacaaacaaacaaacaaaaaauuauguuuagacuuacuuaguuuuauuuuacgagugcuuguauuuugccugugcgugucuauguuauccugugugugccuggcacucucugagaucaagcaggggcauuggacucccuggaaaaggcauuugaaugguugugagucaccauauauauaggugcucagaacugaaccucagacuucugcaagaacagcaagugcucuuaacuccagagccauuucuucaccuccuccaagcuuuuuuuuuuuuuuuuuuuuuaaagauuuauuuauuuauuauagguaaguacacuguagcugucuucagacacuccagaagagggcaucagaucuuguuacagaugguugugagccaccaugugguugcugggauuugaacucuggaccuucagaagagcagucgggugcucuuacccacugagccaucucaccagcccccaagcuuuuuuuuuuuuuuuuuuucugcuuuuucgaaacaggguuucucuguguaacucuggcuguccuagaacucacucuguagaucaggcuggccucaaacucagaaaucugccugccucugccucccgagugcuaggauuaaaggugugcgccaccauugcugcccagcccacaagcauauuuuaaucaauuucagauagauacuacuaagggaggguaaguaauuaauucugccucuaauucuugaaagcuacaucuacaguauuagcaaccaaggcaccggagcuggagagauggccaguggugaagagugaggauugcucuuacagaaaacccuaacgugauugcuagcuccugugucaaguacuuacaacugcuuguaaucccaacucuaggggagccgaugccucauuuggaacacaugugcacuuggcauguccacacacaacccauauaugugugcaugacacacccauacagacacagacccacauacacacacauaauuaaaauaaaacuuuuaaaauuaaccucugagcccucucuccagcugucccauguaagucuuaagagaagaaugaaugagaaguggccaucuugccucccccaaaugccugaaaugcugugugguuuccuuucuguguccagggaagccccggggccaucgcuggucccugggacuaguugccuuauugaagaggccagaggguauagauagagcuaggagaguagagcaauaaaacugacugucuacuucuuucaggugcugugcccugugagacacccuccuucagggacagaagcaaccagcuuccugggaggagucauggcuuccacagaccaaaucuagucacaggaaaggggcucaggagcaagguggcugagcaggagguccagacaauccaugaagagaauguagcaagacuacaagccauggauccugaggagauccugaaggagcagcagcaguuacuggcucaacucgguauggauguuaagucuugcaguuagcuugcuggggccacacgaagcaggggcugccacuuguuggggaagacguguguguguuuguguguguguggcuauucuucuacuccugggagagauaugguauuaaguucauuuuacguucauuuuacuaaugaaugaaugaaugaaugaacaaacaaacaaacaaacagagcaggcucugcuacuuggagugguacaugccuuuaaucccagcauauggaacuacuuccaaucagaccagaguucgugcucagcuacauggcuaguuugaggccagucuggcucugagacccuuccucaaaaacaaagcuugaagcugauggcauagcucagugguuaacuaagcaagccuuugaccauguaaaggugggagagaacugacugcacuaaguugugcucagaccuguacauguacacauacugugcuccaauaguaacugaaaacaaaaaaauccucaaaaagaaaaaaaaaagugaggcucagaaauguaagagaaauucuccacaagucgcauagcugguaaggaauauagaguagauuaugggaggagggcuccaaucaaaacccagaauuuugcacaugccagacaaagugccuuauacagcuagugcugcagauuggauuuggugcuucugguggucuagccaccccugugccauuggguacuaccguaguuccugguguaguucacccugugcuuuaucacagcugugcucugcccucucuccuuuacccucuccuguaacuacagugacacauacaggagugugcugugucacaccuuucuucucagucagucuuguuccacauuauaugcggagcacuuaugugcuguauacucaauuuuuaguaaauguauuuacagacugagaagaaaugaagaaguuuggcugcgugcuguccuuucggcucuagucaacauucacuuguuucucagacaucugaccugguagcaagcagagguuccagcauaggaaccucugccagaggacuguggagggcaagggccaugggggauagucaggcucaggggcuacauaggugugggcuggcagggucauuacagagccacagguaggccugagccaggacagggaaguaguuugucuggaccuuagcacccagaggugggaaucuuccagcaggugucccaugaagagucacccuagccucuuacucucugccucuacccucagaccccagcuugguugccuucuugagaucucauagccagguccaggaacaaacaggaacaaaggccaccaagaagcagaguccaaagagacccucaguucuugucacuaaagaagagccugucacgucaacucguacaagggagccuaggacuggggacaagcuggaagaaaagccggaggccacgguggaggacaagauggaagacaagcugcagccaagaaccccagguauggaaggcaggcaccaucauuucuucagagaggaaaaaaauagccccgugugguggcgcaugcuuuuaauuccagcaucguugagaggcagagucgggcggaucucugugaguuugaggccagccuaaugucugcauaucaaguuccaggacagccaaggcuacagaaggggagugugcaugcuaccaagccagacagccugaguuagaucccuggaaucuacaugaugaaagagaaaaacaacuuacacacacgcacacacgcacacacacacgcacacgcacacacacacacacacacacacacacacacacacacacacucacacacauacuccucauacacaaaauaaauaaauguuaaaaaaagaaaaaaggguaggaaaaauguccuuugacccagccugcugauggggaaggugcucucucgcccuuggacaugggcuguucaucuucauuagugucuuuaaauuggcucaaugguccucauuugcuagcgcacagcuuucuacgcacacuucuguuuucuagucuugaaaccccuaccucuccccccaccugaagggugugacugaggcucccucccaagacagaccaucuuccuguccuugcucuugcuucauccccuuuccaucacuguauuggaggaauggcaggaucgggaaaagggagaaguguccaguucgggccucugaacaugccagaccagaagcagaggccaguggaaccacuuaucucccagaaacaagauuauuccauuagggauuaacaaaagaggaaauguaauuaugacagcccggaaccuccugcuccugagggacugcugggccagccagggagguugaguggggguggggugggggugaggacgcaggaggagaugauagagguguucuauacccugccccacuggagcagcauagcugccuccccuucuuggucuccauucucuugcuccuucagaggguuguaccagagaguggacuccuauacuuuccuugauguaugguguccuaucuucuuucucugucccuucuuccuuuucuucucuucuucuucaaacacgucuuugaggucagcauggggcuagagccaggaccagcuauguuugcuauaguugcuauaguugaaacauucauccaguugcuaggggugccagcccccaagccguaccauuuagccauagcugaggcagcugcuuucugccagugugcugagccccuugaggaacgcagugcuucugccucccuagcacugaaacugcccaugacccccagcaaagacuggcuccacauggacaccguagagcuggacaagcuccacuggacccaggaccugcccccacuccggcggcagcagacacaggaggugaggacgaacaggugggguggggugggguuacugcucuucugcccagaccuggggccugagaaauagcucuuauuuguucucagcuucucuccugucacccugccuggcccuauaggccccacaagccucguuuccagugagaggaagagcccagagcuaauccuaaaaggcuugagauuaaaggugacugagugugaggaacugcugcagcacccaacacaguccauuucuuuugucuuagagaaugcaggcucgauucagccuucagggcgagcuccuggcgccugauguggaucuucccacacaucugggccugcaccaccacggagaagaggccgagguaagggaugggguccuaggaggacugggcaacucuuggcaaacguuuagcaacugcaaaaacugugcaaaacuuggagcucuggucacuugccuuugaccuccugugugucccgcccuagcucagggccuugcugucacucaguuucuuagagucaagaugcugcuccuucuguugacauccuaccuuccuguaacucaagagccaggccuugcaugcuuucccucaggcuguucccucccucacgagcugccauccugguuuccucuggccuaacucaagcuguccuucaccuuggaaaguuuccagcccuccuuugcucacugacugagguccuaggccuugcgcuuggccaggcaguccguagacccccaagcucugccucucccucuucugaccacucuacugaugcuuccacauggaauucccauuuucacagccuagcaugguucacuccagagaauaucuguauccuuaguccaugcugggccacugacgccauacccauccacugagaccagauucacuuuccauggcuguccucugauuagaaauuaaacagcuauuacaucccuguuugcuguguggugccauugcucugugcaugaccuauaauuuuuauuagcuugagguuccaaggagagccaugacuagcugucacuuguuuaucuugccuuucccuugacaccuucccugugucuugauuccuucugacucucugucccugcaucagcgagcaggguauucucuacaggagcuguuccaccugacccguagccaggugucccagcagagagcacuagcauugcaaguguugucccagaucgucggcaggguaagugggcugcuggccugguccuaccaagccacaccccauccuucaucccuugaucuuagccuuuuccuccuuacugugggucagacuaggaauggggcaaaugugcaguaacgggucagcaaagguucuauccaaguucugcaucuuguacccaaggcccaggcuggugaguuuggggaccgccuagugggcagugucuugcgccuccucuuggaugcugguuuccucuuccugcugcgcuucucucuggaugacaggguggacagugucaucgcagcagcuguccgggcucuucguacucugcuaguggcuccuggagaugagguaugucagggugacagggcucugcucugcguucugggcauacccuuugccaaggcuuugaggcagacuggagaauaggguggcagguguaagccccuucugaagaccacaagccuugccucccugccgcugcuguguguuggcgagggauaauuuugcucuguccuggaccaugucuucuuucugucucuucccaccucuaccccauccucuggcaggagcuccuggaccgcaccuucucuugguaucauggagcuucgguguucccucugaugcccagccaggacgauaaagaggaugaagaugaagaugaggaacucgaaacagaaaaggugaagagaaagacaccugaggaaggaagccgcccucccccggaccuggccagacaugaugucaucaagguaaagggcacucugcauuuccauccuugaccuacagggcaggcucgaugagcaggagaggucaccaagaccugggugucccccuuauguggcaauggguuucuuucugcauccuaggggcuccuggcuaccaaccugcuuccucggcuccgcuaugugcuggaggugaccugcccaggacccucugugauccuugacauccuggcugugcuuauccgccuggcccggcauucccuggagucggccaugagggugagaagggaaggagggcacugagaauggacaaaaggucccaugcacucuucuuguuuuauuuuuugggucuuuuuauugauguuuuuguuacugcucuuguuuuuuuguuuuuuuguuuuuuuguuuuuuuuucugagacaggguuucucuguguagcccuggcugcccuggaacucacuuuguagaccaggcuggccucgaacucagaaauuugccugccucugccucccaaguacugggauuaaaggcgugcgccaccacgcccggcuacugcucuuguuuugagauagaauuucauuaugcucaagcaggucuagaccucacugcaucccuuaugcuggccugaaacuugcagaaauccuuccgcagcuuccugaguacugagauuauaggcauaagccuguggucuaugaccugagagaugauggaccucaucuugaucuucuuugccucccuuucccaccuaucucccacagguccuggaguguccucggcugauggagaccauaguucaagaguuccugccuaccaguugguccccuauagggguggggccuacucccagucuauauaaagugccuugugcuucugccaugaaacugcuuagaguccuggcuucagcugggaggaauauugcugcucgacugguaagcuggacacauggcaagagauggagggcauaagacagggcugauuugagcuggauuuacucugagugguggauagcuaccucaguccaucuuccucuuccucucuggucuguuugcuuagaaauucaacagaaaccagcaggugggacccuggucaccugggucuguugguauucuggucucaugauauggggaggauucccugaccccagccuguccagaguugcugcaugcagacaggccuucaucacccauagcuaagcagaaaaaguaccuagcaaauacuaacuaaaaagaagggaagaccacuggcuagggagccacucagcagguaaaggcacuugcugccaagcugaucacacaaguuuagccccuggaacucacauggaaggagaaggaaaagacuccucaagguuugucugauuuccauaugcauugucugacaggugagcgcuguggccccagauaaaugcuaaggaagaaugcugaaggaggggaccagagacuuagaauagggcagcuugagccuguuuccaggagagccaguacuagcuggaugacccugccacuguaccuucucaucucuagcuaagcggcuuugaugucaggagccgccugugccgauucauagcugaagcgccacaugaccuggccuugccccccgaggaagcagagauucugaccacugaggccuuccgucugugggccguggcugccuccuauggccaggguggugaccuuuacaggugaggagaagccggagauagguuucucgcagggcccugcuguccugcacuguugaguucugcaauacauccuucaguuuuguugaaggccgugaggaagggaggccaaauacgaugggggaaucucugcugggcaugaauugcuaggaaaaaguggaccaacugcauucuuugacaaaagcagaagucagauaucaguucccaguugugggguaaccuaggagguuuguagccuucccaguuuucagggccucgccuugcacaagugccucuguccugggcugucccccuccggcucuucgaguuucucuggguugaagcuccuggcagaauugugcucuccucuugccucccuguguagugaaugccaguugucuuccccagggagcuguacccagugcugcugcgggccuugcagacacugccuacagagcucagcgcucauccccuacagccccuggccaugcagcggguggccgcucuguucacacugcuuacccagcucacccuggcagcuagcagcauaccuccugagcccgccagguaggccagcuccaagccugucagcaggcaugcccauguggaaugcuccuccacagggaguaaggcggcccaugcuuaccuuugccccuuuggcacuccugcaguggcccugcugaguccugugugccggccaucccuuccucagucaccuggacacaggugucuggacucaagccacugguggagccaugucuaaagcagacccuaaaguuccugcccaggccggauguguggaaugcccugggcccagugcccagugccugccuucuguucuugggugcuuacuaucaggccuggagccggcaggugagugcagccugccucccugccugccuccagccuacauaccucuuccauuccuucucgguuggucccuuuucuaccucuucccccgcgugugguucugaguguaaacauggcugugcugaguggggcccucauaggccagacaguuacuuuucuacugagaaccacccucaccuuucgcuucuaccuguuccucccugcuuuguuucccaggggagccucugagagccauguugaugggaccagggaccccgagcagcagcucagcuuugucagcccucucaugcacgcuagauauuauguacuagagcaaguucagggcugucuccccuucagaaagaucaggcuguggaagccuccaaacagauuuuuugagacccucaguaugauggggcuggucuggauauauagggcuagggucuucuaguccaucagcucagugaaccccuugguucuccagucacacuugugcccagaagauuggcuucaggacauggagcgcuuguuggaugaguccuugcugccacugcugagccagccuccucugggcagucugugggauuccuuaagguacaaucugggacggccgcugggggagugcgggguggaggcaguucuccugaagggccccugggucugucuccccaguccaucccaggacauggcccuuuaggggccugaggaaacccaaauuuccagcaggagcaacccucaguacugugaggaacaugaacucuggucugcacagccaugcacggcuugcacucacagcccagaguccccucagcaugucuguucucccugcagggacugcuccccacucugcaauccgcuguccugugcuuccaacccggaagcccuccccagccuugugucacugggcugugcaggaggcugucccccucucaguguggcuggcucagccucacccuucccguuccucacugcccuccucucccucaucaacacucugguccagagccacaaggggcucuguggacaggugagccucgggugcccauuuggaggccaggcauggggacaagauagcagggguaggaaagagggagagaagugacucgcagggggcagcagucuggggagucccagaacccaucaguguuuguuuccagaucugaacaaacuuguuuccucagcugucugcuguguugacugccccaggacuccagaacuacuuucuccaguguguggcuccugcgccugccccacagcucacacccuucucugccugggcccugcaccaugaguaccaccuacaguaucuggugcuuuccuucgcccacaaagcggugggucccuaucugcagagucagccucacccuguugucucuccugccucucagcuguaguccauauucccugguucauauccuccaucuuucuaucacuuccucacucugucacuuccuuagucccucuguucuguguccuccaugcugccucccuacacugacuagagcccugucuccucccuaggcaacacugcagccagaaccagcugccagcacugcccuccaccaugcuguagccuugguccugcugagccggcuguugccuggaagcgaauaccuugcccaggagcugcugcugagcuguguguuccggcuggaguuccugccguaaguccagggguuucaggauucagggguuugguacuuuuggaugccccugaacuuuguuaacaaaacagcaucuuggagcuggaaaccuggguuuuagucucuauccuuauacuuaauuuguuauucccucaguaaagugaauugaggcuauucaucuucaccccaccugagaaugauaagacuccacaguaugucaauggcuaaaaaaaugucacauaagcuaagcuagggauguaguugagcaguaaagcaccuacuuggcaugugugaggcucugauucaaaguagggaucugguucacugaugcacaccucucauccuaguacucgggaggucagccugggcuacgugagagagagagagagagagagagagagauagauagauagauagauagauagauagauagauagauagauagauagauagauagguagguagguagguagguagguagguagguagguagguagguagguagauagauagauagauagauagauagauagauagauagauagauagauagauagauagauugauugauugauugauugauugauagaggucagccugggcuacaugagagauagauagauagauagauagauagauagauagauagauagauagauagauagauagauagauguauauagauauagguggauagguagagauagaugauagauaagugauggaugcauauauagauagauagaugauagauuauaaguaaauaaauaaauaaauaaacaaacaaauaaauagugaagagcugggugacaccuuaaccccagcacagcuagaggucaagcauggaaguuuaaguaaacuuucccucuguuccaucuccuaaugcuaugcaacauuauggugugagaggcugucaggggagcagagaggcacaggacuaaacuuagaaacucuagaucugggacagcugucuggaugcugugauucuagcccuuaguuuuggcuuuuguaucaugucacagggaaagugcuucagggggcccagaggcagcugacuucuccgauggacuguccuuagggagcaguggggacccucaguguagacgaggggcccuccucguucaagcuugccgggaucuccccagcauccgcagcugcuaccuggcccauuguucaccagcccgagccagucugcugagcucccaagccuuguacuguggagagcuacugcgagucucaagucugcuacugccuguaccuaaggagccacugcuggccacugacuggcccuuccagccguugauacaucucuaccaccgagcuucagauacucccucugggccaccugcugcugacacuguaggcguugccaugcggguccuacaaugggugcuaguucuggagagcuggcgccccgagguccucugggcugugcccccugcugcccgccuagcacgucucauguguguguaccugguggauagcgagcuguuucgagagacucccauacagcgacugguggcagcucuuuuagcucggcucugucggccccaagucuugccaaaccucaagcuggacugcccccucccuggccugaccucuuuuccugaccuuuaugccagcuucuuagaccauuuugaggcugucucuuuuggggaccacuuguuuggggcccugguccuccuuccucugcagcguagguucaguguuaccuugcgccucgcccucuuuggggagcacgugggaguguugcgagcacuuggccugccucugacucagguauguccuacacuaucaaggccuuccuaggacccuucacuagacacuaggggcagucuugagcaguguggcacuucggugggcaccauuaccucauuaccucuuugaaagcaucaagcuguaggaauagaaggguuuuuaucauggcaucuggcagagagcagguauacauauuauuacuauuggguuuuuucaagucaggguuugucuuuguagcuauggcuguucuggaacuuguucuggagaccaggcuggccugaaacucacagagcugccucugucuccugaguguugggguuaaagguguggaucaccacugucuggcaggguuuguguuauuaacagguuugguuucugcuugugaacuccuacaguuuagaagaagauaugcuaagaucaaaaaacaaaaacauacuuguuaauuacucagaucuuugguguguuaagucagaauucagagaauuuuuaaaagacuggaguggggcuggugagauggcucaguggguaagagcaccugacugcucuuccgaagguccagaguucaaaucccagcaagagaucugacucccucuucuggagugucugaagacagcuacaguguacuuacauauaauaaauaaauaaauaaaucuuaaaaaaaaaaaagauuggaguggacuuuaccuuaaggaaaagaugagguggaggagagagguugucuuagugcugaaguuugggaaaaauuugacucuuaagugcuuacuagaaaaaggcuaugaagcaaagcccuaaagggugaucagacuaaagagucagcucacagguuguaaagagaaccaggccuggcaacacaggcucucgggagcugagucaggaggauuagaagguuuuguuuugguuuuuagauuuauuuauuuuauacauaugaauacacuguaguugucuuuagauaccagaaaaugguaucagaucccguuacagaugguugugagccaccaugugguugcugggaauugaacucaggaccucuggaagagcagucagugcucugaaccacugaaccaucucgccagccccaggaauagaaguuuaaggacaagccuggugugguggcgcaugccuuuaaucccagcacuugggaggcagaggcaggcagauuucugaguucgaggccagccuggucuacagagugaguuccaggacagccaggacuacacagagaaacccugucuugaaaaaaaccaaaaaaaaaaaaaaaaaaaaaaaaagaagaagaaguuuaaggacagccuaggcuauauacagaguucuaguccagucuagggugaguccagacacucuucagcgugcuaaggauuguagcucaguugauagagagcuugcuagccacuccuagcuccacugucucaaaggaguaaggcagagaaacagaacaggaugccuaguguccucaaguucaugccugcaugagcauguccaccugcauucacguguacauaaaacacacacacauacacacgcacauguacauuuauuaaaacauaaaaaaauuaaaaauuuaauaguuacucauaguaauuuuuuuauuuaaaaacauuuuagagcccgguauaguggugcacaccuuuaaucccagcacuugggacgcagaggcaguugagucucugugagucugaagacagccugguuuauguagaaguucagagccagagcuucauaaagagacccuguuucaagggaaaauaaagguuuugagacagugccuuccuaugugacccaggcuggacucagccuuguaaccccugccguggccuucuguguaugugcaggaaugauaggcaccugcucccacucccagcucaguaaguauuguuuuuauuuauauuuuugggcggggguucaagacaggguuucucuggcuguccuggaacucacuuuguagaccaggcuggccucgaacucagagauccgccugccucugccucccgagugcugggauuaaaggcaugcgccaccaugccccguguauuuguauauuuuuauaaaauuggaauuacugcuuaaugaauuuuucauuuaaccuuacaucaugagcaguugccaucccuuaaauacucuuaagaaaucaauacuuaaaccgggagugguggcgcacgccaauaaucccagcacuugggagguagaggcagguggauuucugaguucgaggccagccuggucugcagagugagugaguuucaggacagccagggcuacacagagaaaccugucuugaaaaaacaaaacaacaacaacaacaaaaaagaaaucuacuuuguguguguguguuuacgugugugugugugugugugugugugcgcgcacuagaaauggaacacagggcuucaugcauccuaggaaggugcgcucaggcuguaaacuaugcccuaauaccaaccagucuuugcccuuuagcuuucaggcacuaaagaagggaggucuuucuaggaccugauuucugcccugugauuugauggcaugugaccaacagucauccacugcugcuacugauggacauucccacuuggcccucagcauaucauuuccuucugucacagcugccugugccucuggagugcuacacagagccugcugaagacagccugccucuccuucagcucuacuuccgggccuugguuacugguacacuccgugcacguuggugccccauccucuacacuguagccguggcucaugucaacaguuucaucuucugccaagacccaaagagcucaguaagucaccucucuauguucagagggaaggagggagcugguggaccaguuggggaugggcugaggguuaagugagucccuggguggguaccaguccucggcuuugugucauaucucucuuccguccacucccaggaugagguaaagacugcccgaaggaguaugcugcagagaacguggcugcugacagaugagguaguauugugggugucgggacggaaaagauacaggacauuaagguaccaaaccucaacaaacugaccacccacuucauggguuuugucuucucugcaggggcugcggcagcaucuccuccacuauaagcuucccaacuccagccucccagagggcuuugagcuguauucccaguuaccucgccugaggcagcagugccuucagacacugcccacagaggggcuccagaauggaggagucaagacauagggcacuugcccccagcuaaagaugacuacucuacucuccugggacugagcagugagccucccgagagaaggcaacacaagacuugccuuccugugagcacauuguuugagccuuuuuuagaacagaagggacucguauuacaucaugauacuggagcucaggaucugggggcugagggcugugccaggcguggaaggaggguggcuucaguguuuacccugcggugcccaggacagucugagcacagcucuccucacucaccuccagucuucaccagaccaggaugugcaauuacugugcuacacucugaaauaaauucuuuucuagucugacugaucuggacuguuuugucacauucagaguugguagcaaggauggauuuucccgaggagagagaugggagaaaaugucacaaugggagguaaacacauuaccaucuggggguggcagagguguguguccugggagucagugacagugcgccuggagugggugugguccuggaggacucagcaugcccuggaagugcugaggucagagaacccaaaugucagccugguguaguucuccuaugccguucucagugggcuuuuuuuuauaauguguguucaucuguaugugaguauggcauguguacagagaccagga

SEQ ID NO: 1016 - RNA, 2870 nt, Mus musculus
ggaaggaccuuuacccacugaacuaucuugauggcccuauucaaaauuuuuuuauuacauuuauuuauuugugugugugggugcacauauagcacaacuugugugcuaauuuucucauucuaccaugugggucucaggaauugaacucagguugucugccuuguucuuuuacccgcuaagccaugucacuaguuuuauuuuuaaaauaaaaugggggaguauuuaaaauugauuucacauuuuaaccuaguuuaauauuaaaacuguggcuccugauugcugagauuauaagcaugaauuaacaucacacuuaaccuaggcuaaccuugaacuccagucucugccucagacuccugaguucagagaucauaucccagauaaugcugcugcugcugcucuccuuuuccucuuccuccuguucuuccucuuccucuccaguuucucuucucuuuccuuccuuccuuucuuccuccuuugcuuucuuccuucuugcuguuuccuccccuccccucuucuuauuuugguuuauuuauuuauuuacuuugguuuuucgagacaggguuucucuguguagcccuggcuguccuggaacucacucuauagaccaggcuggccuugaaaauccaccugccucugcuacccaagugcugggauuaaaggcaugugccaccaccgcucggugugguuuauuuuuaaaauguguguauugacugcuuugucugaauguaugugccuggugcucucagaggucaaaagaagguguuauauuccccuggaacuggaguuaugaaugguugugagucagcacguguaugccggggaucaucuaugaucauugaacaagauuuccagccucaagauaaugcuuuuuuuuuuuuuuuuuuuuaagcacaaacacguuuauuuacuaaccaaagggaugauccuggguaaaccaaguuugacaugaaguuccauguaaaguguuugugauaaagagaacucaacagucaugaaaaauaaaaccaaagaagugaaacgguuugcuguuuaugaccacuaauugaauugagcauauucacuccuacagcuaacuccuguccaggaugacgaggaagcccucauugcaccuucucauagacccgagugcaccacaaucauccuucaguuuucucauuaucauguucuccuucccuucccguugcuggugcuggaccaggcaccgucuuugaaggugcagaccgucucaguuuuucugccaucagcuguaguuucaucaaacuucucucccaggguacaagagaacagggucgucuucacugugcucacgguuuugacggugauguuguugccaucacaaguaaugauacagucuggcuuggccauggcagccaucuuccuaagagccaguccuacuccuagcucuuucguguacuccucaaagccguggcuuuccaucaggcaccacuucccuuugagauccuuaagguuggccauggcaggcgggagagcacaaaagcagaagagaugcgguggcgagggcgcucaagauaaugcaucuuugaagucuuuuuuuuuuuuuuuuuugacacagguuucauuuaguugaggcuggccuugagaucauaauucucuugucucugccuuccaaauguugggauuacagacguguacuacuacaccuguuuuuuuguuuguuuguuuuuuuguuuguuuuuucaguuuuuuuguuuuguuuuguuuuuuaagauuuauuuauuuauuauaugugaguuguagcugucuucagacacuccagaagagagggagucagaucucauuagggaugguugugagucaccaugugguugcugggauuugaacucaggaccuucggaagagcauuuggguacucuuacccacuuagccagauaucucaacagcccccaaauuuuuuaauuuuuuuaauuuuugagacaaggguuucucuguauagcccuggcuguccuggaacucacucuguagaccaggcuggccucgaacucagaaauccgccugccucugacucccaagugaugggacuaaaggcgugcgcgccaccaccaccgccuuucaguuuguugagauaggaucuuggagacuuggcugaccuuuaacuugcuguuuagauaaguugcccucaaauuuguggcaguucuccugccuuaguuuuccgagcauugaaauuacagauaugagccaccaugccuggaucaguuugagauuuuguauuguuuuuugagauauguaaacuuuggcuggccugaaacucuguauaucaggcuggccuugaacucagagaucuuucugccucccaagugcugauauuaaagguguauaucaccgugcuugacuuuaguuuguuuugaaaaauuaaggaauuuuauuuuauuuauguguauugguauuuuugccuacauuuauggcacaacuuuuauuuguggugccacuggaggccaggagaugacauuagauucccuggaauuggaguuacaggcuguuaugagcugcuguguaggugcuaggaacuguacccaggacuuuuggaagagcagccaguccccauaaauacugagaacuauuuuucuagcuuccaguuugagauuccuaagugaagugcuaugguuuaagugacaguggucaucugguauguuugcaguguuggcagguugagacuguauggaaccuuguaaaccauaggcauuuuagauuuucucuaauggguuucuauuuuuucccauuguacuguuuccuguaauaaaagcuaucaucuaguuuauaucuuaaaaauagcacuuuccuucaaggccagccuggucuauagagugaguuccaggacagccagggcuacacagagaaacccugucucgaaa

SEQ ID NO: 1017 - RNA, 3518 nt, Mus musculus
cuuuagcagugccaucuauuuauuuguacccagagguggagccaggaggaucagaaguucagucaucuuugacuaugugauuuugaagccagcaagggauacaugaaacccuacuauaagcaaaaaugguuacuugguaaaucuaaacugaaucacugaaauaaguauagcuauauuauuaauuguagauuagaauauaaaaacacaaaugcucaaagaacucucagacucuuacuuuuuauaggcuaacuagacuccacuuugaaaacuuauggguauuguaccuauuaagggaucuaaugcugcaucuuagaaauuuguuguuaccuaaaacaaauuaaucuggaggaccauuucaguaguugagagaaaagcaguagggugagcaagcuguaaaucuugucaccuguagggagauggaguuguaagaaagucaugccuuuugagucagcaauggaggucugcaagaagcucuagaaauugugagaagaggucuucagagaaaacaaugagaaagcccugaaugugagggcagacauucuuaggauuuugggaaagugauugacaauaugcucaggaaacuagcuacucaguaaugaaaaucaguaauuguugaaaauugaaaucugguauuucauguuugcuuggagcagggaaagagcaccaaagagcauuucuguuguacuuucccaugcaaguuguucucguagauuuuuccaauuagagaugcuauuuggguugucuuuuuuugagaugcuaccgagucauucauaccuuaggggcagacauuuuacuaguaaauaaacucaaauuuuagucucagaaaaaugagauuuuuuugagaaaccauuauaacccucgagaaggcaucuugguuuaguaggaaagguucuugagucagagaagaggaacguguuaaagaaaugguuuucagucuucuaagaucuugaaugguuuuccugaaucauggauuucagaagucuguaaacuuuaguucaguuucugccuauguguugcguaucuccucaggaauaaauagcuaagugaaacgaagcaagucagaucaacccuguuggcuauccuuguccuuccucuuggcuccauccuuacauucuugguuuccuucaaaguguuuguauugucacuuagcacaaaauaaguuuuucuauuaucucuugagagugaaaaguuugggaauauggacugcauuuuauguuuucuacuuaauuauuucguaauuacuccuuuucacuuuaaacauuuacugguagguuagcagcaugaaaguaguaaaugguagagaaaaaaaccuaaaauuuuugauguuugguugagaauuauugcucucugacuuaguuuggcaauugucugacauacuuguugguuaauguuuucuuuacauuuuuaagcuucauugucuugaagaagcaacaacaacaacaaaaauauacauuguugguuaauguuuucuuuacauuuuuaagcuucauugucuugaagaagcaacaacaacaacaaaaauauucuugaccauuucuuuuuaagacaucuuucaucuugguaucaggcaauuuaguggcagcucuuuuuccuuuauagaaccuuucuuugcuuugcuuuucauuccagcacggugucuuggcagccuagccuacucuggaacgugaacucacuauagaauucagguuagccucgaacucgcagcaauccugcuucagccucaguguugagaauauaggcauaaacuuccauucucugcgcucaacaaggcuuucucgaauuuuccuaguguucuuuguuggcgaauauuggaaaauugcuuacucuucuuucgugguguuugcuucaagcuuuuccaguguucugguacuuuccaaccccauagcacuuuguacaggagguccuccguuuuuuuuuuuuuuuuuuuuuuuuuuuugaaggauuugcgaagccaggaggucuaugaagcuucauguggguggggcuggguacggcaggggcggggccggugagaagucucugggaaaggcugaagagucuuguugggaaaggccuggagggcagugguuucagaauuuucacgaaggcuucgaauacaggauugagcguauuguguaccucucuccugucucuccuuuccugauucuggaagcuucauaaguucuuucuggauuacuaaaaugcgaaaaggcuacggcuucggcuccgugggcggaacccaaggguccugacgcugcuccgggcuguuuggccuccugauguugggggaggggcaaagaggugcugcucgcgccucccuaugcgccugcgcggucggcuccaagcugguaggagcgcgugcgcagugacguggacauccggugcgugcgcaggcucuucagcugaagcggacacacggugugcgaacccuucagaauaacccuccccuagagggaugugaaggacucggggugaggccggccacgccccgcacgguaacucucgggccuggguggagggcgucgcuucaauaguggcccgauuggaguuuuuuugaguuuaaaccacuuguguauuugaacggcuugcccagcguuccgcagagagagcuucgcacgccugggccuggcugggccuuacgcugugcagccuuuggucccuugagcgaguugcgcaugucaucucgcacgccuccccgaccucacuuccgugucgcucggagaacuaacuaggaacaucgacgccggagaccgagaccacgaggcgggcggggugagaagugccuacggcacggcccugcccucgcgugcgugggguguugaacagcauggcacguuccgcgugacgauuucuagccugguuaucgauggaauaagcacagguuuuaagaguucagcucucugaguuucaacucuccgagggaaacaaccaaugucuguuucuccaaggaacuggaugcaguguuuugacaccuauucaaacauuuccuagcguguaauuucgggucaaauugaggcaaggccccgaauuuaaugagggggcgaugagugaguugaaugagagugagaacuuuguaaacaaaggagcugugauuuguaagugcuaauucgaaggcggagaaaacagguagggaacagguggugguuccuuuuucucuuucugggguaaccugacugguuuucuguccauaggacuucccguuucuguugaauuuucaaguacgucuuugagucgaguguaaggugcgcaagggcauuagccuucucuuucguuccccaagaaugucucuuuuucucuggcaaaaggaugguagcaggcaugggugaagagugccugaagaguggcuugauuaguagaacgggaaaaaucuccgucugagggagacccacucuuguucgcgucgccgaagccgacacguggaucuugagaaguuagggcucacuuaugcucagucuguggguguuguugagcuugccaagcuugcguguccaagugcuuggucaacucugccugucuugcuggcuuuuugcgcacgacgc

SEQ ID NO: 1018 - RNA, 65413 nt, Mus musculus
caggagcgggcggcggcgagagcuacugucgggcacagagagcgagcgacgcggguucugggguucuuacugaagugcggcggcggcggcggcaaguuguggggcggcagcauguucagcuggauggggcggcaggcuggcgggcgcgagcgcucgggcggcauggacgcggugcagacggugacgggcggccugcgcucucuguaccagcgcaaggugcugccgcuggaggaggcguaccgcuuccacgaguuucacucgccagcgcuggaggacgccgacuucgaaaacaagcccaugauccugcuggugggccaguacagcacgggcaagaccacguucaucagguaauuugccucgucggcucgcuaccccuccgcuagcgcacggccugcccucagguuacacuccgagcuugguggcccgucgccuucccgggucccguuucccaaggcucccuccccugagaccggcccccagcgcgcugcgagccccuuccuugcuguugccaaggccuuccuugagccugucacccuggccugggagugcaggaaagggagagaaggcaaggcucaucauuagugcaaccuagugcugaaagugauaaugaaggaaugcggcuccuagguggagagguaaccuuccagcacagugagaaugaaugaacgaacgaacgaaugaaugaaugagugaaugccacaguaggaguauugccaugcccuaggugccacguuccgccacagcggcggggcugcuaucauccagcuuuauggucuauaggaaguuagccuacaguguagcugccucaccagccuguggacugaaggggagugucagguuacuguuugcuaguuuccauuucuucacccuugacaaacugaaaauauuugucacggucacucugucuccggaagcaauaaccggcuugcccugcaguuccaaccacacagcuuccucuagagugacucgaugagaaauaauuuacaaugaaacggacugcuuuuuaaaugaggcgucuauuucccuaucuuugggaagaaucgacguucaaauccuuaucagacgaagcaaagugacugaacauuuaagaucuggauccugaguuuuggaauuagaacacucaucaucauuugauguucaacagguguucagaaaacugcaucugucuuggggacaugccauuucuuuuagguaugaccuccuuuuuuuccccuccugugaccuaaagaguuccaaaaaaauagaaaaguugucacuacaagaaauauguuaaauccaggccuguagauacacugugaaugaacucaacaaaggcaauacacuguaguuugaaaugugaacgaagagagggggaaaauaauguugaaauuauuucauguaaugcuuuuaaauuagcugaaaacaguguugaauauguuaacucagaaaugaaccuagaaauauuacaguaacugacagaugcaaagggcuaguugagauggugcuugccuguaauccaaggacuggggaagcuggaucaugguuauuuugccuuccaggccagccugggcuacauaacgcaaucuaggauaacccugacuagacaacaaaagaccgucuucaaaacaacagcaauaagaacagcaacaaaaccuaggaaacaaaaacaaaauaaauggcaagcaggugguacauuaaggucuugguagucgcaguugugaauuaucaggauaauauuacaggagugaagagagaacuuuuaagcuuagagcaauaagaguauagcauuuuaaaauguacugguggcagauacacagcagucccaccauuuccuccuguacgugccaugggccucacgguaccuaugcauaauuagggagccuuucuugauucuguacugaccuagccugaagacagugcauuccucugacuguagccugacucguaaacaagccucagguaggagaguacaacgcaauucucaggaagguggagcaauccucuuuccccgccucauauuauuuuguuauauucucauucuucugugcuucaguuuugagaagcuuugugggagagggcuaaaaggcagguucugagauuugacucauggcucuacuucuuuuuuuuuuuuuuuuuuuuuuugguuuuucgagacaggguuucucuguauagcccuggcuguccuggaacucacuuuguagaccagacuggccuggaacucagaaagccaccugccucugccuccugagugcugggauuaaaggugugcaccaccacgcuuggcuuauggcuauacuucuuaagcccuuuuuagagcuggaacucaguagaagcugcaacccagggaggaaucaccuuagcugggagcuugggccaguggcuuugcuauuccacaaagggcccaaaguggaccuugggguuagaagaagauacuacagacaggaagcuggaugaaucuucacuuguggcaucugaaauugguuuuagagagcaguagggggaagugauugguuuccaggaggaaaacaguaaacagagggcaccuguccuggagacuuggcacuuagagagguaaacaaaggagauguccaugagagcuggccuucuuggaccuugcuuuaguuagguccuggcuagggaccugggugcuuugcuucuagcuggaaguacuaaguguucacagaaacuuggggaaggggcuuaucuaugaagucacuuauucuuuuccauuugacuaacacaggagccacggcaucauggagggaaacauuccucuuuauuguaagccauucaucauaaccuuugauuaugugucuuacucccacaaacuuuauuuuucucucuuguuuuggagaaaacagaagucacauuauaugcgcuggaccaggacagucacagaagugaggcagcuaaguguguccuucauuuugauggaaaguuuuccagguagaaugccugaagagccugggguagugagaaaaucugcucaccccuguacagaugcucaccaaggggggggggggcaagugccaggaagaggguaaauaaagagugagguugaaguuaaauggaaagaacagauugguagaaucgccuauagaucuuagcagugaaaggcuggaggaagcuucagaugugguagagauauuugucaaagucuccuuaggguaaugguuaaacggcugacagcucuauugucugguuauuuuauuucucagaagacaggauauauaguaagaaguguuaaauagucuacuucuggcuggcaaggaaaaauuguccagagaaggagaagggauuagcacuaguaaaagugaccauaucaucuuugauuuucauaacuaagaaagggcagguguugggcuuaugucuaaaacuuggaaagaaaaaaguuucauggcuuaguuccacaguuaagagcacuuccuguucuuccaaaagacccaaacauccagaagauguuuggaguuugguucccaauacacaugucugguggcucauaccagccccagggaauccaaugcccucuucuggacuucaugggcaccugcauuuacaugugcgaacacacacacacacacaaacacacacaauuaaaaagaaauuuauuuagaaauugauuucagaggcucuagggaaaaaaagaucacuggguccagcugcuauaaagcaaaaucauuccacuguaaagcucgggaggugccccagagaucuauucaaacuacagauggcaaccuugcucuuaggaguucuacuuccucucuugcuccuguacuuuggcauguuucauauuauaaugagaaaaaaagugacuucagaaacuauguagacugggcgggggcuagcucaggggugguacuuaccuagcuugugugacguccuagauucaauccccagaacugaaacaaacuagacaggcuuuaaaggggcagggagcagggcaauaaagcaggaaaagacacaagcuguguccagauugcaagaguaaaacuguuggcagaccacaugguguuuuauauuuaaaauaucuugacaaaagacagaaaucuguuguauuuguauaaacaugagaugaacagccucaaagugacauuaagcaaacuaaccuguuugugauagcauccaaaaaggaugaaguauugacaccuuggaauaagcccaacaaaaagaaaggcaagacuucucugccuggaaaauuagaggcaucacugaaagaaguuaaggaggaacuaaauggaaaaaccacccaguaccuguggauuggaggccauauuaagaaggcagugcuccugaacugcuuucugucucgauguauguuauuucguggccuggaccuacuauacagcccaggguggccucagacuugugguaaugcuccuacuccugccucuggaguucugggguuauaggcguaugccaccaugccucgccugaauugguugucagauucaaaauaauucccauuaaaaucuuugcuuuuuuuuuuuuuuuuaauguuuguuugaggcaguaauugacaggcuauaucuauaauuuuuaggauuacagaagacagcucugaaaaagaacaguuuagauuuagaauuuaucauguaacuacugaaaaugaagcagcgugcaccagcaaaggacagacagaucaauggaccugggaaccccaaaauagaccuucauauuuauggucaacugauacuugauaagauacgaguaacaguucaauggaaaaagacuaggucccucaacaggugcugggacagcuggguucucgugugcacaggcauugaagggagacuguucacgaguacgcagauucuuuuuggagugcuaagagugcucugaaacuggguaaugguacugauuauagaacucugagaguaaaccacacacggaucuacauuuuagaugaguacauuuucuaguaugugaauuguauuccaguugggguugcgcuguagcucagcaguaaagugcuugccuaguaugcccagggucuuagguuuaaucacaagaauugaaaaauaaaaacaaaccaauaaaaacauucuuccaauaugaagcagccuauaauuuucauccccauaauucuguaauuagugccugucaaauaauuugugcaucugugugugcuaauuaaaaacaaaaaguguauuccaaaaagaaaaccaaguagaaacgagcuaaaguaacaaaagaacaaaaaacccaagggaacuaaagaguaaaugugagguagcgaguacagauagcuacuguggaauccccaugguuuuguuucucccuguacaucuucucagucaauaaauauucaucauucauaguacugaaguugauaaaguaagugaugaacauuuccaugaguaaaugcuuaguaagggcuagagagagagggauggcucagugguuaaggaugauaguugcuauuguagaggagccgguuugguucccuguauuuauagggugguuuacaaucuguagcccaguuccaggagaucugacaugcuuuucuggccuccacaggcacugcaugcauaugauauacucaaauucauaaagauaaaacacucguacauaaaagaaaaauuagugcuuaacauuauuauguauuaaaacuugaaaaaugcuguuucaaauauacuauuuaguggcugugaucaauagaucaauagauagaguacuuuucuagcaugcaaaggcccuggguuucaucccuaguaccacaaaaagcagguguaaugacacauaccuguaaucccagcgcuugggagauagagacagcaggagcagaaguucaaggucauuauuaucugccauagcaaguuugaggccaaucugggcuaaauaggacccucucucuccuucuccucuuuccuucuccuucccucucccucuccccucucucccuuucuccccucccucucuuccucccugccuccccucacauaaacauacacacauuuauauguauauauaguguucaguaggggaaggagguagaaauggugaacuacagcauuuucaacaagucucugacuugagucccauggauuuaaauggucauauaccuaucugcagagagacagcggacaaagcacacagaaugagguugccagccccuaaccuauaaggcugaagcguagggaaaggugaugccucuggguguguuaucagaaaagggaagggggaugcugaacaggcaaaauaagcauaaccuuccagaagccaagaggagagggcacaaagaaucagguauuucaggggugguagggaucaagucagagcuuauaggugaaucagccaucuggagccagagugaccauggcggaagcugugucagaaaguggugauaguggaagccggugaaggguugaggaaugugugggcaggaucaaauauagaaaauccucagccacaggacacuggaggggaggagcuacaggucagaggcauugcacuggcuugcuuaaagagcaugaccucaacaguuaucagugauuugaacagggcaggcuguagagaaaaggcaaccggugauugagaacaaaugaaacuagggcuugaaguagggugggagggcugugggacagguuagugugugacauuugugacaguauucagcacagccagauggucaguggcuuguccacucacuguauuaucaaauacaaguggccaaguaucacgacaaauguuggugaaaagagaccuuuguggugaugaugguggguuugguuuuguagugcugggguuugaaugaagguggugcaugugccaagcaaguaacccaacgccaagcuauaaccuuagcccaaagaguuuauuuuaauuaaaaacaaauauucucauuuagaugauuacuucugaagacauuaaauauacauuucaaacuuugggauugugagagagaaaguguugguuccugagucugacuguauaucugcaucagcuuucaaaacgaaggaagaucucagggucccaucugacacacccugguuuggaaugugguggucagaggcuuccucuaguucuccuguagccuuauccaggggacgucugagaaccacugaucugaagggccagccaguggaauccugacagcugaaccaucaagccuuaagaagaucagccuugaugcaguagagggagacugacuccagugaacuccccaccugguccuagcuuuaucucaucacauuuuuagcaaagacucagaugaagacauagaaauccugcuggagaguacaugauaaauuacaacucagcaaagcaauggguuuuuuuccccccacuuaauguugaaaauuucuaauaucauuaaauagucuucaaaaguaauuucaggggcugggaagaugucucagugggaaggcacacuugcucuugucagcaugagugccugaguucaaaucccuagcacccacauaaaagguugaauguagcucuuggguacuuguaacucaguaguguagagacagguggcugaaauguaggcaguuucugguucagugaaagacuuugucucuaggcaguaagguggggagcaguagaggaagacugcaccccaccucaugagccuugaaugguuguaucauuccacagaacagcuugaagcauuuguuuuuaaucuuacaguuaugcauaaugcuuugaugaauacuuuugaucagaagacuuuuaucuccagcuuuauuucuuaaacuagccugggcauaaacacugcauucaaaacaaaacaaaaaacucgggagauagcucaggcuauaaagugcuugccaugcaagcaugaggaucuaaguucaaccaccagaaaccacauaaaaauuucaggcaugcagucaugccuuuguaaucccaggguuuagaggggcagagacagguggagcucuggggccagccagcucacucagugagcuccgagccagugagaaccuauuucaaaacuaaauguggaugguccuggaggaaugucacccaagcacacaggcacauaugugcaucuguauacacacacacacacacacaccuauguauacaugcaaagacaccucacuaucuuuccaggguuauguauauuacuaaauuauaucuaucaguguccaugaauacauacuauuuuucagaaagguuacuucaauuuaaacucccacaggaaaugcguaucggcaucccaucuuuacuaggcugccaguaaguuugauaggaaaaacauuuuuuuaaauuugcuuuuuaaaaagcugguaagguucagcauauaaaccgggcauggugauugcacgccuuuaaucccagcacucgggaggcagaggcaggcggauuucugaguucgaggccagccuggucuacaaagugaguuccaggacagccagggcuacacagagaaacccugucucgaaaaacaaaaaacaaaacaaacaaacaaaaaaaagauugagcauauaaaauaguuacuaucuuuauuccuuugugaauucugugaacuuugccgaauuuccauuuccuauuaaguaaguuuccucauaggcuguuguuuaauaugaggucauuugggaccuuucucuuuguuauuauauucaugaauucuuaggccagcaccauaccauagugaaacacucuuuacuaaugguaacucagauccuccugagucuccuuauuuuccaaauaacuguuaauugucauuuucuuucuuuuuucuuuuaagauugauugauugauugauuuuauguguguacccuguagcugucuucagacacuccagaagagggcaucagauuuuuguuacggaugguugugagccaccaugugguugcugggauuugaacucaggaccuuuggaagagcagucggugcucuuacccgcugagccaucucaccagcccucauuuucuauuucuuguugagaacuuuuaaaucacauuguuaggugcuuccuugaaaaaucucacugggauccauuugugugagaacuguauuuuaucuaagugagauuuuugugucugcuguucccaagcagaaacugcccugcuuugacuggggccuucccucaucugucuguaaaggcggcugcuuuacugcuccagcccucugcagcucuuaggacuauucuagcuacuucagcugcugcugcugcugcugcugcuguaaaagauuuuuuuccuuuauguuauuuauggucugcaaucacuaguacauaagauagcuaucaagguuuugguuuuauucuggucauuuggcugaaggaguauuccaacaucuucugaguagagugcccugcguuuuucugcuuguaucaauuacacuugaaauuacauuuucuccucuuguuguucauaucuuauugaacugagaaugggacauucuugucaaaacuaucauuagggugacauuuucuuuguuauuuuaccuaaaguagucacaugaagaguuuuuuuccccauuauuaacuuuuaaagaauuuuauuuagcugagugugguaacauacaccuuuaaucccaaaguccagaggcagaguuagguggaucucuauaaguuugaggccagucugguaugcauauaugcauagaauguuccugccagcuacaguagcauagugagacuguguguguguguguguguguguguauuuauauauuuauaguuauauacuucuauuagaggcaaaacagaaugucugacaaaauuuaaauacuacuugugguuccuuuauaccugugcuguguagaaugcaauuauuagagagcaucaguauucauagaaaaaguguuaaacuuuucagaaaauccuguauuuugcauagcccucaugaagaacuauagugcucaaagagcaaagaauuuauagacuuaggaaagucugucagaucuauaaguuacaaaucauaacaucaaaacaaaugaauguucauuguaugcuugaaugaaaaacuugaaaaaugaacagugcagugaauuugauuccgagagauuucuccaccguccugaaagcauggaaggaaggcucggguggugaugcuguguggacagcaguuguucaaagcacagcucagcgucaaguaguuugaauuccacugagagcuggaaggcccaucagagggguaagauuucacccagcaaauuccagucuuuuggcucaacauguuaauguccauuccauugcuaggcacagcaauuucuagaauaauaucaccuacauacccaauccuaaugauaauauggcagcuuucaugcuuaagaaagacaguuuugcaaggcauggugacauacaccuuuaaucccagcacuggggaggcagaggcaggcagcucucugugaacucaaggccagucugaucuauuuagcaacuuccagaacagccaggaauauauagugacccuuccccauccccaaaacaaaauaaaacaaaaagcaauaauaaaacagaaguuuaaaaccacaaaaauaaauaaaaggauaauggagaucagauuugauuauugauuuacagacugauuuguaugucagggacuaagcccacaguuucauacaugcuaagcaccugcucuaccacugaacugcuuccccuggccugaguaaugaaaacuauguagcugccuagcagcuaggaaauggcaaacuaaauugauacuaccuuagaaagguuagagccauuaagcugagaaugaugacuugugugaaauccuagcaccuagagggcugagacaguaagauugcugugaguggccagccugagcuacagaguuaaauucaaauaaacaaaacaaaacucaaacaaaauaaaacucaaauaauaauaauauacucaaaaacucaaauaauaauaauaaacucaaauaaacaaaacaaauggucuuuuuaguggcauagaaaaacuaauggugaaaaagaaaaaaauauuagauagaauauaucaaaauguuaaaaauagccauggugcuggagagauggcucauugguuaagaacacugccugcuuguccggaggaccugcguucauuucucagcacccacuuggcagcucucaccaguuuguaacuccaguuccaggaucggugccuccuuggacaccaagcacucaaguggugcacagacauacuuucaggcaaaacacccauacacaugaauuaaaacuaacaaacaaacauauuauuucuaguguggcauggugaggccaccuggaauuuuagcaccagggaggaugagccacuaggauugcuguaaaucagagccuagucuggcuacauaaugagaccugaucucaaaaacaaaacaaaauaauuuucaguucaagacaagucagaaugguaggagucuuucuuucuaaucccugcccuugugaaauaaugggucaaauauuagcaaugaaaacaugagaauccaaauaguuauuauaaauugaaaugucuuaagacuuguucuucugaguuaaaaaugaaaugucuccacugaucucaagauuguauuuccuauuauguuucuuucacacuacauaauugaaaacuuaagcauguagagggagugagguccuugugcacacggauaagcacuggaggaaccaggagaguuaaacacgcaggugcuuaccaguuuuccacccagaaugcuggaauggauguauuugggggggugggggcgcgcuucgaaacaggguuucucuguguuccccuggcuguccugaaacucacuuuguagaccaggcuggccuugaacucagaaacccaccugccucugccucccaaguacugggauuaaagguaugcgccaaccacgucaggcugaauggauguauuuuauaaccugaugaucuuugcuagcuguagagucaggcuucacccagaauauuguuuguuuaucccagacuuuucuccuagcucuugaguaugcuuuucagucaauaaaacccaucugugugagagauaucaccuguccuuuacugcaaucuagguaacuucccuguuaucuuagggcagaccauccugacucccgcaggaguuauguuuuccucugcccuucucccuggcuugagcauuguuucugaguacacagaacuuaccuuucggaagagaguguuauguacuuguaaagaguucccguguuagcaugcuucagcuguguuggacacgugggacugaaguuaauuaucaagaaacuuuuuuugaaauuguguugugcuuaaacacuggcucuacuaaacugcuugauuuauuaaacucgagauguuugaaccaacaccagcugcugaguauuuuugaaccaaauuugcuucuugccucuugggauuguuccucugccagccauagcauuugcagagaccucuacauuaguagggcugggcgugguguacagugguacaguacuugccuaguacauuuaagguuuggguuuaaucccaguuacuacagauaaacaaauaaaaccuuauuaagagccaaaggauuaaggcaacuauuugaguuauuuaauucucccucuuuucuucuaaagauuuuguuguuguuauuuuauguguaugguuugccuuuguguauucauguauuccaugcaugccuggugcccuugaaggccagaagaggguguuggauuccccagacagacaguugugagccacugagagggugcuaugaacaaaaccccagucaugcaaaaacaguaagugcucuuuaccacugagucaucuuuccagcccccaaauuaauucuuuuuagaaguauuuuggugggccagcaagaaggccucgugaggaaaggugcuugcuaccaauccugaugaccugaguucaauccccagaacccacaccauggaaggagagaaccaauucccaaaagucuuauggccuccacucacacauguggcacauacuuauacacaaacacacacacacacacacacuuaaaugacuuuuaagauguauuugaagcacaauaaugaauugaaacugcacagaugcuguguguauaugaauguuucuuuaaauacuuuguuuucauaagcuguaucuguagauuuuagcuucagaaugucaaaguaauguucaagcaacaccccaaauauauguggaauauuuuuaguauacauaacucauuggauaccugcuuaaugcgaucuucugucugaacauuccuugugacucacagagcauguuccuguaaaugcuuccauuugguggugacucagccucucuaauugugauuuaacucaguuaaccuauuugaccuguaguuuauucaccuguaaaauggggaggaaaauagugcuuacccauaaggcauuuaccaauugagacuauuuauguaaaggcauuuauguaacaagucccccaauguuagguagaguguaucacuaaacaaaauagaaaaaugugaaaguaccaacccagagaaaaugcaugagaaauaaccaagugacaaaaaucauaggcacauggaguaaauaacauuuuuuuuucuucuucuucccccuucccuuucucuugcuccggcccugcucgcucuggcccauagguucuuuauuauuuguuucuuauugcagaugguugugagccaccaugugguugcaggaauuugaacucaugaccucuagaagagcaguuggugcucuuaaccacugagccaucucaccacccccaauaacaucuuuuuuuuaaaaaugcuaaauaauguuuuuuuucccuuaaaucugucugagaaaaugguauuuggguuacaguaaagggcuuucauuaucccaaggguuuuuuuuuucuucccuuugucauaaaugauacuuuuccuuuaaaauuaauuuuccuucucuagccuaagcauugaaagaaaagacacugucuacaugcagugaccucaucagaccaggacacagaaaggucaggucuccuguccacccucaccacuucugcccaaccacaugugguucaaaugucuguaccuuuuuauguucgcugauggcuugacucaagaccuuggagcaaucaucgauagagguggcagcgcucucugagaacacaggaaacggagcuaggugccaagggcagacaucaagccgcuaaggcacaggaugcuguggagugggcugcucugcucugcuuggcucugcuccaugguggauucuuuucuauagucuuccuguugccucuuguguuccuuuuauucuuguuaucacagauaagaccucagagucucuggaaugccagcuuugguaaauccucugaggucuucagagaagauuugacuccuggcucagccuuacacuggggucuguaagguaaagugacuggguaugucaccucaggauccacugcaacucccuucccaggcucugauuuuagccucaucccuucagggucacuuuugucaugucagacauuuauaucuucguuguucuucucuuucuacauagacauguuacugccugcccaacaguaugauguauaucugagugucaguucacaagggagagaaagaaggccuauagaugaccuccacaggagguaggagaggaugagggugacccauuuuaagugccuaaacugcuugauuuauuaaacucgagauguuugaaacaacaccagcugcugaguacuuuugagccaaauuugcuucuugccucuugggauuguuccucugccagccauagcacuuaugugaacaagugugugagugccuuugcaguaagguuguaccagcgauuccugcagcuacacaaagagguagauuuuaugacccucaccagcaccaaguauauggaagguuuuaaaauuuacuaauauacugcgucuuuucauuguaacuucacugauauaaaacugaacauugaacguggauaucuuuaguaccuguaggagagugccaguggacaguuucauauccuaagaaagcaguacaguaauccuuccuuguucuugucuuuguuugcaagccagagccugaaugcuucaucaaggccacagcugagggcacccuauucaagguaguuccuauuugcaguucaauaauaaggacuuguuaauauuuuuccuggcaggguugcugcugaggaagcuuuggcuucucuuacuguauaaacucagaagacaggaacaccugcugucuuuuaaacaagcucaucauugagguuuuccuugaaaguccuauuuaauucuacaguccuggaggugugcugugaguucaagucaauuaaacaucagaaaggaguuuagauaccucuugacagugagugucugaccuaaacagcccugaguuguccagucuaacuauagcaucucuauguucccaccuggggucucuucucaccagcccugguguggaccguggaggucucuccugaugaggccuagugaaggaacugagaagggucagguucuaaggggcacuugagauagagcucaacucugagguccccucccccaaagcugaugagacagugauacccccaguaaacauuggcccuauugccuucaagugucaaguacuuggacaugacccuuuugugaguuggaaacuguguguaccccaggaauccugcaacccuagaggcuauuaguucaaaguuuuucauuugcacaguugucucuaguccucagucucccucccugccaagccucacccaggcugagaggugugaaggucaaacuggacaucgccacaguacagccugucuuccaacucuagcuuugccguugagugacuggacuugagguuccagaggggcugcauuacacaccaguuagugugugaauacauacuggucuuaugguguggucuucucagagcucuugucugucugaucuguguggaauuuugaaagauuaaauaaugugaacauuucugcuccuaaaacuguugacugugcuauuaggcacacuaagacuuuggcuaaaaaagauuuucauauuuugaaaaacauuaaauaaggauguauuuugaaucgauagcauggucuugcuucagcuuuuuuuuuuuuuuuccaaggagaaugagguagugugcccuguguccuuagggaaucuaggggauugugggggaggacagugugagccccuuuccucucguauuaaaggaaauagaaaguccucauucccaggcuuauauccuggagugaggauccugaauguuccugcuuaucugagaaagccacuaaugccaggccaaguguaaagcucugaagacagugcacaucugagaaucugacugcuugcauuccguuuucacucacucacucacucacucacucacucacucacucacucacuguauaacauuaggcaaguugcuuggucucucugauaaccaguuuuccuaccuguaaaaugaagauauuaucacucaccugaaaguauuguaggaacugaaugaaacaauagugcauucauaagguagaguacaugcauaaguuacagugcauacaugaggcacagugcaugcauaagguauaaugcauacauaggacacaguacaugcauaugguuuuguacaugcauaagguaucagugugugcauacauaagacaaugcauucauaaggcauagugcauauauaaggcaaggugcaugcauaagacuuuaugucuuuucaguaaaugcuaggaguuauuaccaguugauuuuuuuuuucaugauuacucucaaauuacgggacaucuuagaacaaugcaccuauucuggaucucugcaguuucacagaaauguaaaaacuuuggguaaaguuaaaaguagcaccccggacagugguggcccacgucuuuaauuccagcacuugggaggcagaggcaggcggauuucugaguucaaggccagccuggucugcagagugaguuccaggacagccagggcuacacagagaaacccugucuugaaaaacaaacaaacaaacaaacaaaaaguuaaaaguagcaaugauagaaaaaaaggguuucggguaaagccuacuaauauugcuuaauuuucauuuuguuuacauaagaaagaaguuucacuucuccucauagugauggcaaauuguguuuggcauuugacuuuuaguucucucuuucuauccccagaaauagucacaggcuacauuugacucgucaggauuuauagaagcaaggaugguuuaguguuggaguagggagcuacagaaacucccuccccugacccuagucauucccugcuuauucccaggacgccugacauacagugacggcaacuuacacacggugccugggaaccauagagaaggugcuauccaugcaggccagggacacuuuucuaagggguugugaguucagcaguaguccagaacguguaggaauggugagguaacuggguaaugccucuccuaaguuggcaucuauuaugucagugggaccucagauaucuacuuuugguuuuggguuguucugauuuuugagacagggccucauguaaccuagguucgcuucaaacuuguauauaauaaagaaugacccugaaccucugacuuuuaaugagagugucugaguuguuggguaaccccaggcagcgcucuggcuucuugucugugacaucaugcucuuuucuuuucuuuuccagauacuuacuggagcaagauuucccaggcaugagaauugguccagagccaaccacagauuccuucauugcugugauguauggggagacugagggaagcaccccugggaaugcuuuaguuguggaucccaaaaagccauuccgaaagcuuagucgcuuuggaaaugcuuuccugaacagguaaggaccggcaagcuguccucugguugacuauugccuauuauuuguggaguccagacaagacagagcaugucuguucuggaagaggagaggguaggggugggggugggauggggguggggaggguugcuaaucaaucuuacuuuacucaaaucuguuccaagugacugagcauagccaaggcccaagauuggauguuguagcuccucaguaugaagacaaauggcgaguaaugcgauuugcacagaauuaguuaaggguguuuaguuucugucacuaguaguauuaaguagcuguaagauagccaccucucugguaugguaugcagggcuuuccacacucaggaaguuuagcccagagaagacguaaggucccugacacccagauuuggucuuuugauucaggacagguugccucaccuuccugaguguuccuuuagccuuucauuccuaagcuuugagcucuguccuuauucccuggagcagggcaggcugagauaggguaaaacccaaaagugagcuuauauacauggcauauacauaauuguucuagauauagauagauauggguugcucugccuugauuggggguguguuuugucugugccccaagcuugguugucugucagcagacuuuuccaguguagcugaggucuuagucggguaggccuucugcugcagcuccgcaguaggaugaggucuacugaccuuucugcuccacuguguccccucccuccuucccaucuuuccuucuuucuccccucacccaagaauuuuucuuuauuuuauuuuuuaauuauuuuauuuagcuuguuugguucuaauauauaugaaagagaacaugcaauucuuuucuuuuuguaucuggcuuauuucacauaacaugacauucucugauuccauuuugcuacaaaugacaagauuuucuuuucauggccaaguaauacucuauugcaugcauauaucacauuuucuuucuucucuuuuguacuguggcuagggauugaacauaguguucucauguguucuaccacugagcuauaaccucaguccucuuuuuacuuuuuuuuuuuuuuggagggggucccaggaucuugcccaggcuggccuugaacuccugcgccuaucuucuaguagcuaaaauugcagcuauccccagaacugacuaccguauuuucuuaucuuguccuuuguugauggcuaccugagcugcuuucauauuuucucugugaauagugccacgguaaccauggcugggcaagcaucuccugugcgcccaguuucauuucuucagguauauuagcuacacaggaaugagauggcaagugacagguggcucuuuguuauuugaggguacuauguuuuccauagugacugccccaccugacaucacuacagugcauaaaggugcguuucuccuccacauuaucaccagccuucaaaauaauauccauucugaugcgagcgaggugggaucccauugauuuguauuucccugauggugauaguuaacgauacugagcauuuuuucuuguguuuaacugacauuuuuauuucuuuugagaucauuuggccauuuuuuuauuauuauuauugguuguuugggaguugcugucuuuacuuuuggguucauuauguagucuagauuaucaacacccugaugaauguuuucccguuacauagauuguuuuucgcucuguugauuauuucucuucugugcagaguuuuuaguuugagguaauguuauuugucaauuucugcuuuuguuuuguauguguguguuuucuucuuaaaaacccuuuccucuucuuuccugccauuccuccacaccccucuuuuuccucuuuucugagucuggcuuuagagagugggggccagccaucagcuagaaguggagggccacuccagcugcuuagggagaggaaguagggcuggcacugaggcucagcaggagaccugagaucacuucuucuuucuagauguuucuaaaaauaagagcaacacucccuccuuccccccccccuucccaggccuaucagagccugggaggcuccauucaugaggacucuggagugaacacuuguacaguggcuguccugagagcccaggcagccuccaaguuucccucugugcacagaacccccuuaaagacauucagaugcuccuguugcaaacaaugauaacacauugaugggcagaaagagaacuggccugggcaagcaggagugugagggacauguagguggagucaugugaaagcuuauucuugucauucacagugacuuacagagcacuguccagaugacuuccccugugcaggaggggcugugccuuaacuccagagcagugacagugucuccuugugcaguaguuaagcccaggacccagggaaagaacccaaggucuugagugucucagaacaaaaugaaugaaccaaguccaaggaaacugagacaagacacaugcaugcauucacacccacacccacaucccccacacaagcacaucaaucaggugcuuucugggugcacaggacaugagugagcaauaagcagacuugucccaucucuggucuagacagaggcaggcccaguagccucccuccuggaagacugccuuagaauccuaacacucauugcccuugccuguugugugugugcucuuuuucuuuuccugacagaacuuuaaagagaaauaagcugacuuuuuuuuuuucaaaaucucauuuagcaaaguccauacuucuaagggaauaugcaggaagaaugguuauugguuuguuuuacuuucucaaauaauuugcuuuccugaaauaacaauguguuuuagaucucaaacuuuagagcagaugaguuugggagaaaaguauagaggagagauuuuaaauggcaggcuuuacucucuuagaauuuaaaaugggcugaaaauagcccaugcauugugcagucacauugaguccagggaaacagaaaaacaaaacccaaacaacucuacgacauauguccaucacuguccuagcauuacuuguauaugcaucauggaaagcugagcucgaguaaccugcaguccuuaugaaggugcauguggaggcugcagugaugaggaacugaugagcagugaggguaagaucaugccuuuggggcacucagccuaggggcaguguuaggauuagaacccaggccuagagaccacagugcugagcuguccagaggugcaguguuuaaacucugucugcugucccuauuuaacuucaggauaacaugaaacaauggagaagagacuaucucccaggguauaguuugcauaauuuuaucagcacuauacuugugggauuaacagagaauacaauggccaguucacuaguaagaaauggugaucaggaagaggcaaaauucagguuucccucuuccuacccuuugcuaccuuguacuccagcaaugaggaaugucugucucucaagccauccugauggcugugccugugugagacucacaaguacaagaugugccucauggaaauccacaaugcugacagcccaauuaagagguaucuguaugacaaggcagcugucucacacagugcauaagaaagaacaucaguuagggugaggcauucaaacuuguguguauauggugugugugugugugugugagagcucucugggauacagcaggguuagugucaaagucuggaacucuuaguaugacacacuuuuucuggaaacuaggucaaaauauaguaggaaggaaaaccaguuguuuucuguguagagcuuucucccuaagucuugaugacaggggccucucauggcuuuagccacugcucccaagggcaucuuuaaaagaguuaauuaccucuuaggguacuuaaagucaaguggugccuguagggugacagcaccuucgccauuaagcagaccuuggggaccugaguccacuaggcugauuguuuagagacuaaugagucagugaugcauuucagugaaauggagaagagucucugaaaagacagguuugaauuaggaaccagcacacuugaacaauacaaggaagagguaagucuagaacaauguuugauggaaaugaggcuuuaacaaucaguguuucaacuucccuccaccacgcugcuucaucugagagaaguuucacugugccccauuuuggagcugugccaugggguugcuaucccagccuguaucagggggcaguucaccacacagaagacacagacacugcccaaagcacccuaccuaugaguccugaaagacaccagugucuucagucagcgccugacaguuuccucuggcagucuguuguaaauuagauguuauagguuucccucagcuuacuuuucuaaagauggcagcauucuuaaacuacagauagccuuguauauuguuuuuaguuuuagugucuaguauaauuuuaaugacuguuuuucacaaaagaaaguaauuucuuuagucucucuuucugucucugucacuggguuuaaaagcaugcaccaccacugcccaacuuguuguuuguuuguuguuugauuuauuuuuauuuuaugcacauggauguuuugccuauauguguguuugugugccacauuucugccugguaccagcagaguccagaagaggacuucagauccccugcaacaguuguagcuguccuacagguucugggacucaaaccugaguccuuuggcagagcagccagugcucuuaaccaccaagccaucucuccgaugccaaaccauuguuucugguugacaguugcuuauaugauuuugguucuggcauuuaggaaaugcacccuuuucucugggcuugagcagauucuucuaaggugacauauugcuucuggcuuccuuccauggcagucaagagagaggcauuuauguagucuaaaugugaaugucacuucucccuggcacuagaaaguuacaucagucauuuaaagcagggcugugagauaauuuaguugucuugguuuuuuuuguagauuuucugcuuacaucauguaaccuuuguguauauauuuauugauaaagcaaguaagauuaaaggagguauuuugaaaccgcuccauccucccuuacuguugagcugagugaccaaccugguagaguugcuuagagagaccuagagaccuauggaagggagagugcucacaguacacaucugucucuuguucacagcuauccaacccuccacacagguagguagaguauguacacggaagccccagggcagugguacaucaguccuuuguuucaggauguuaccuugagugugauaaagaaacucagcaguaauucccaugugugccgugauaguaguagccauguauuaagauccacccaggucuaccagcuuacgucucaggucugucacuugucaccaguagacuaggacccuuccaagccccagucuacccuuuuguaaggccucucccguugcaguaaggauuuaauucaugaacauauaaauauaaaguaaagcagaccugacaugcagucagggauaggucaguacugguguuguauuaaucauaauugcuauaaaucuucauguuccauugaaaagucaaaaccaguacuaaggugcugcccaauuauuuuacaagucuagcuuuuuuguuuguuuguuuuaugcuuuaaggggguagggcugggguguugucacauauagcccaggcuagccucaaauucucuauguagcugaagauaauccugccucccgauuguccccagucuaccucccagauguuuggauaacagguaugagucacaaugcucagccuacaaauuuaguuuucuaauucauuuuuuaaaaauaauuauuuauuugagccgggaaugguggugcacgucuuuaaucccagcacucgggaggcagaggcaggcagauuucugaguuagaggccagccuggucuacaaagugaguuccaggacagucagggcuauacagagaaacccugucucaaaagaaaaaagauuauuuauuugacaggagagggaaugugugcuacugugaaugaguggaggucacaaaacaaccuaugggaaucaguucucuuuuuaauaucauauaggucuaggggauugaacucaggucaucagaaauggcuguaagcaccuuuaucuguugagccaucuuaccagcccaaauuuaucuuuuuuuaaaauuaauuuauuuauuucauguauguggguacacugucacugucuuuagacucaccagaaaauggcaucugaucccauuccagaugguugugauccaccaugugguugcugggaguugaacucaggaccucugaaagagcagucagugcucuuaaccucugagccaucucuguagcccccaaauuuaucuuuuaaauauuaaucauuaacuuagaauuuuagcuuuugugggcaguuuuaaguaaccuaaugcucuugcuaccuguguuccugugaggcagagcucgcgcccugcaugagaccuuauggugcccucacuugcuacugccuaucaccucugccccuuugcuacucuugacuuucccuaaacauggagauggagguaacaggcauugggguccaguggagaucuugaucgucuucuucuuuuaccuugggagacagaguucaucaggucggugggagggaccuaugggaaaaccaagagaggucugagaucucugcagcacagcagcauuuugugugaaauagaggccaggugucugcacugauuuagucacuccaggaaagagcaggaaauccaucuugggacagcaaaucucugcuuggaaauguuccagcaaaaacuccugaccuguccuccugugagggguaugacagaucuugucuuucaccuuccucucucagaauggaaagguuaaguggcgauugccaugauaacuuuagggguuccugauuacaguagaaugugcuuuuaggaacaugccuaaauguguacacuuaaccuugcaauaccugcuguggcacccucaguauccagugccugcuuguacucucugcccuccugccccugcuccaccucauacaguuucuuugacggaauggaguccgguccugcacacggcuucagcagccccuucucccgugccccuggagcccugcuggucuccuuuuuugacaguuguccuuccugcuguguggagauagcucaacaguaggccucuugcucuguggcucacacagcugaccugcugacauguucuugcuguacauuccaggagugagcggugcaggaauaguaagucccucuguuagcgucucacuaaaaucuaggaauuuuguguuuuggaaaaauugauacugagugugagcuugugguuuguagaaacaucacccuuccugugggaacaguuuguguaaauaguuuuacaaagguauggcauguuuaacauugccaguugucuccggauagacacaguguucaccaaguugugcucagagcucuguuccucccccaguucuagagagcagauugucucugagaaccugacaagcagugauugguggcuccuguguguccugcucauacugugcagguggacuuagggcaugacaggggccagagaagaagaggaauaaaagguuucucuuacauauacucggcuuuauuuguggugauauggagguuaacuuuaugcacugaguucuacuaaucugacuugggagauacuagcuuguagucuccugccagccaagcguuauugcaagaccccaugaugucaaaacugcuccgugcuucagaguuaccuugcuuucaucucgugggcugauuuggaaguauaaaaaagaaugugugacuaucuaguucugagccucuuaaaggacaguucucaugagugucagugauggcaccuugggccugaguguccuccccugcccaugguggcucuggucacagcugggggggggggggugaguccgccuugugccuugucuugcauucccagcauacuuacuuucugaguaauccccaccacuuccacugaauggaagaacugagcuguucccaaguguuuucaagccucugcccacacagauacagaagucaggcacuuuuaaaacaggaagaggagaggcacucuguuucccccuuaaagcauacacagacccaacaaagauccaaaccaggcucagugccugggguggaaguaacaaggcacuuccugcuauuacucauugccucacaaugggaaagcucccaaggacagggcagauucuaucuaguuuaguugucucccuuuacauagaaggaaacugagguccacagggaaaggccuuugucuaaggucucagaaaauuauugacaaaggcugaacagauucuaagcccaagucugcuagggaacaagucaaaaauuuccuuccaucccacucugcuucccaguuguugggcagauaacuggaagcauagcaacagggacccuggucagaaggaagaaguggcuggucagaaggaagaggugguaacaagugagagagaccaggaaagaggcuugaagauggucagaaccucuguugaccacaucuccucaccuauucucagagcucccuuaggauuccuaagcaucugaggaugauguuacccagagguaccugaccuuugcugagcuugaagcacaguguccuuggaguacaugcugagucauuggggcaucagaaagggacaccaacccuggacaucuagcugucacagagcagugggauggaacaaacucagauauucuagcuuaggagaaguguacccugaaggaggcagcagaaacuuaggaugcuuggacaaggaggugggaacaggaggcacauagggguaggaaucagacugaguuuaaagcucaacugugaaugucucagguacuuaaccuuugugagauucauagaaggauguuaaucuagggaucaaaguagguaguauuuguaaaacacccaaguguuugauaaauaaaccgcaguuaacacuaagggaucgaguggcaggaagaaauggguugcagcgcaucuuccacaccuguaugugcaauggcauuuguucugugaccccagugaaguuaccuuuaguuuccuccaagccccugcuuuacaguccacuucauaggcaucuuuagcgucugucuagcuucuuuuuauagacaucagugaguagagagcuucugaaagguccaguuucuagucccaacuuuguucugucucuuccagauucaugugcucacagcugcccaaccaaguucugaagagcaucagcaucaucgacaguccuggcauucugucuggggagaagcagcgcauaagccgaggucagugcuccagcugcuccucccacccucuccagaguugucugaggccccucaacuaugagcagagcauuucuacuccccucccauucuuuccauccuccaggacagucacagcccagggccucccacaguauccuaggcagccaaaaaagccccaagaagcaagugaggagguaucauagauucugucauuuuagcuaguacccagcucagguaaaucuccagcauucaagaggguuacuugguaacuguuacuugguaacuguuuaccuagacacaugauaauccucucacugguguagauuuuaccccaggagccccugaaucaucuugcccuguggaagcuuuuacuaggcagacucucucuaugcugugaugggaugggaacacagcagaagcaggcaugguuccuguccuugaggaaggagaaaugaagcagacacccuucauguugucauagaacuaaaucgggauugggugaaacaccaugaacugcagcccacuaucaaggcaugagggagccuggccuggugcagaguauggaaagaggcaccccugaggcagcccugaggcagugacauuugaaccaguaccugaaggaugaguaagaauuacucaaaggaaauucugauguggaaagagccuguauaucagaaaaucagaaagugcuuggacaaugacauggguccccuagccuuuagcagacaaaaccauggcuauuuccagaccugggcacagguauagugcugccuucuaucuccacuuccagaaaaaagggucguggaacagauccuaggacagagcaacacugaggagaaaugccuagucuugguucagguuggauccugagguuaugguugugagacagggcaaacagaccuacucccacacugcccuuggaaggaaaccaugcuucugaggugcucugcugcugucacuuccugcuaauagcgucacagcccucugcacagcaugccagggaaaccaugcaugccaaaccuaaguggcagccggucuggagucagccaugagugugaccaacagugaacucuucauaguccaggacgcagaaguucgguugcucaguccaggcaagcuguuagcuagcauugaaagggccucuguggccagugucccuccugccuuuggcauucuguggacucccagaguguggggucugccugagcuaagaccuucccaaagcucacccugugguccuuuacuguucuugcagggacacuaacagugucauuaacuaccuugagucuucacagaauaugaugauuaagaaaaaaauaauaacgccaggagugguggcgcaugccuuuaaucccagcacucgggaggcagaggcaggccaauuucugaguucgaggccagccuggucuacagagugaguuccaggacagccagggcuacacagagaaacccugucuugaaaaaacaaaaaaacaaaaaccaggcuuacauuggucuucucucaugaagauccuuguuguuuucuguuauaaaaauaauaacuauuguaaagaauucaaacaaguaaggguguaaagaaauacacagucagaacagaucuuccuacauauuuaaacacauaauuucuaacagaaaugcauugaccaacacguguucugcaauuguauuuugccauauuuguuugucuccauggaaacaugaaagaacaugcauuuuguuuuacuaauaauguggucauaauaugaacacucauucucacagagagcauuacagguuuuuuguuuguuuuugugaaucuuuauagcucaauacccagagaugauuuuggugucauuugagauagggucuaugugucuaaggccagugagacccuggcucaggaaacaagguagauagcaccugagaaaugacagccaacauuaucuucuuacugccacaugugugagcuuguccgcacaccugugggauugagugcacacacaccaguccaccauuaaucugaaaggcugguaaaauguuuuguuuagagggggaaaaagcaacuuuuacaguuuuucugagcuaucccaguuuacugcuucuacaugucugacuuaaguguucuggggaaauaugugacccuaauaaaucuuuuuaccacaaaauuuuaggacuuccagaguguggcuuccacguuaucuuccuuucuuccccaauggcaagccuucggacaaugcucaccuuccauaaucuuacaguuucucuuuuguguaguaauuacguaucugucaaacuauagcugcuucaugguggcgaugaagcuugguaugaugcuucuagugugcuuugaagaucagugucuuucaacacuugacgugaucugacucacauccuggccugauuuacuguaugaacacucacauccuaugcacagaaauaggacauauggcucaagccugccagcuggucccugacauucugagggacacagcaacuggugggaaaggaccuugugaccuaaacagcagugcuguggacuauagccaggguuccaagccuuuugguguuggggacauaguuggugacuagagucacucaacuaacauacucaguguauuaacuauaaaaaauauauagugccuuaaaucugcuucaucuucaacuacuguacacaucucacaugugcucagacuguccucuguccagcuaagaccagagcccugccuuugcuaguaauuaaggucagcauuggccgaugcaguacuuaacugugacugcaugggcauuaaaaacauucuaugcugacuuuauuggugaguaucugacucccuuacaaagccuacaaaaggaauggggugcugauguaucauccucacucuccauuucccuuuuuacaguugguagguuuaacacucaacaagccugugacagucucuugaaguguguauuuguaauaauguaacagccacgauaggucuugcuguaugucacuauaaacacugcuaguuauuuaggauuuuuaucuaauuuaaaccugaacauaaccaagaacaaacagaaccaaagacuccucacccuccccaccucuaggaagcauccuugaaagcagucauaagaauuuucccagcugccaggcagaugugugagacuugaggagcaugguaaaaaucacuuauggagucacauuuggagaucaggcucagaggaguaccuguuuccaacauuagcugacagccugagauguuuagaagccagcccacuuuccugccuguggggagucugcagagggccugcugggaaggagugguaacugugggaggaggaguguaugugaaugcugacugcugagcccccaggaagauuuacugacucacuccuacaaaccaagcagauggccaggcaguugaguguuaugcuacccugcuacacacuagacaggacggaccugaauggagagcuggcuucaugugucauacuggcagcccucaugcacauugcccagaguaaugaggaccaggcuccaaagauuuagagaccaggcagccuaguacccauuauauauauucaggaaggagucggauacuuuagugguaaaagcagaaauagguacuguugcacuugggguucaguuaugugucucccuuugccuauagcucuacacauccaugcuaauccucucauugcauuguaagcagugucuuuguucuguaccagguagaaagggaacugugguuagcaaaguaaugugaguguuuuacagccauuccucuucucuaggccagucacagugagaggagaaacacaugagguuucugagugauuccucacuauauuucacacuguuggguugaugcaaaucgugcccaacccacucuuagguuagaagcagccuguaccgguuagauagcucugcagaaucugacagauccagcaaugacccuagaagucaggacauuguacucuugccuccuauuggaguguaagucaacaggaauguaugaaugagacuaauugggucauugguuuauaccacuccauauggagauccuuuagguguguuuuaguuuaaucauagcaaaaccuuuaggaacaaagaauuggguuuauugacugaauuauacuuuccuuggauaguaugaaggauugaauacuuaucagucaggaauaaaaacacucugauauauuuauaauuucauugagaucaaguagcagcuacauauaagucccacaaauguucuugccaauaaaagacugugugguaaauuacucagauuuuuuuccaaauuaauuuuucugagauggguggguaaauccugacccaguucacucucugguagcuucuuugcucuugacagcgcccagauuguuaacauaauguguugagacaaaagaacacauuuauccacaugcgcguccuuguuuuuauucccagucuguuaucauucuggcucucagauugcuugcuuccuagacuacuguuuauuccaugcaaaaccuaaacaucagcuaggguuuauuucuagacucaguaugaagaccaguguguucccgcuauucgggacaaaccucuucaagucucacuccaaccauaguaucugugucugagcaaaacaggcaaaauguggcauggcagccagugcccuccgcaugucuguagcacaggggcauugaagugcugucuuaacuguauauaacuauuccugugcacuccugagaccgaguuuguguagccucuaaagacugauuauggcaacagaaauagaagaguuuuucccaucuaaaaaaaaaaaaagacagacaugguggcuugugucuguuauuccaguacuugguaaacugaggcagguuuaacaaguuugaggauagcauaggauacauaguaaguuugaagccagccugggcuacagagugagacccugucucaaacaacaaagcaagugacguuaacccuuugaucagacaugguggcccacaccccagcucucagauagcaagaguuugagacaggcaagccugggcuacagaaggagaccuuuucucaaaacagaaugaaacaaaacagcagcaacaaaaaugcagagaagucugaagggaaaaacaaccucuuggcuuaagucuuguaucaaaugugcuugcucucccagggcucauaccucagcaaaugaaaacugaagcucugucuugaagaaagccuuggaucuguuauucccagucuguucauuaaaaccagugacuacuagaacuggcaagaugaaagcagggcgggggcuggggggcagaaaaugcccugcuaauaaaagcaacgcggugguaguauuugagacagggaggaguuaacugccuuucugugacagcagugaacuucagaaccauucauuagcgucugcacauucacaaacagauaccuuugaguuuggcaccugaauaguggcagacccugugaacaggcaguuucaagagacugcccacaaacuugagguccucaaacuuaauaucacaaaagaauugccggggcuaggaaacagggcauggaaguccaagcugugauuaauaagggcacaaaaaggaaaaaaaauagaaaagacaaaaacagaccguaaucagggaaguacaagcauaccuacuugacaaguuuuuuugaacuuuaaauacaaaagaccggauuuugauggcugcccaggaaaagagagagaacauuuagagauaaccagauaagagugacuuccccucuuagguuuugggaaggagaaggauuuaagggaaaaauacaagcauacgaaaaggcgaaugagucuuucccagaagacuaaaaggccuggagcaaggugauauaaccacagcuauaccuaagcuucuuugcugcuguggucuuggcucagcugaccucaggauagagcagaugcggacaguguagugcagggcugugggggucaggcccgaguuaaagaguaugagcucgcuacaggguuucauucaacaaauacuuaacugagcaaacaagguggacacaaucaugcccugguggaauuuauguuacagugagacagacaaaaagaaacagguaaauuauucacugguaagauacugaguacugaggaggugauaugagacauuaugcucgaugaggagccagugaggugggcugguacacuugggauugugcagguaucuaugaagauaaccgguuagccaagaccuauguccugagaagaagcugguccugcagaguugggacaggucaagacugcauguuuuggcuacccgagugagucagaucugucccacguaggguuuagaggauagucuaaagcucgugacaagacaagcuugguucccagcacucaggucucacagcucacaacuaccuguacuuccagcuccagggaauuugacacccucuugugaccucugcaggugccuguauacaugugugcauacauauaaauaaaaucaaaagaaauuacuugaaaauguucaaaugucauauauucauuugcugauuuaaaauauuacauauucauuuuguucugagaucauuuuuguaauaaucaauguaaacuuagaaucaaauuauuuacuuugguucaaucaaggauugaaguuccuagagucagcaccuguguauaucuuaguuugcuuuuuauugcugugauaaagaacaugaccaaaaucaacuuggggaagaaaggguuuauuuggguuacaugucccaguagcaguuuauuaucaaggaaagccaagguaggaacucacagugggaguugaugcagaggacauugagcaguccugcuuacuggcuuguuuaaccuaccuuuaaacuaacccaggaccaacugacgggguggcaccacccacaguacacuagguccucccacauucaagaaaaugcccuaugggauugcccacaggccacucugauggggguauuuucucaacaaagguuuccucuucccagaugacccuaguucauaucaaguugacaaaaaaguauccagaacaauauaagaaacaaggaggaacacagagggaauuaaaaaucuuggauucaaauucagcucagcuauucaccagugagugguauggccuugggaguacaguuccuugcuuguagcauagaauuauaccaauaacauaggauugucguuaaugcauagaaaguagauaguagaagcugaguacaugccuauuagaccaguacuuaggagguagagguaggaugaucaggaguucaaggucagccugagcuacaucucuacuuugaggccaaccugggcuguggaagacucugccucaaaaauccagggagaugggacuagagagauggcugagguugaaugcauuugcuguuuuugcacaaguguuuugguccccagcacccauauuaugguucacaaccaccuguaacuccaguuccaaaggaucugauguccucuuuugaccuuccuggcccugcacacacauggugcacaugcauacucccaugcacacacacauuacauaaauaaauaaguaaaaaaaaaaaagccaugaaaaaggaaagggaggaagggagcgagaagagaggacaggaaggacagaaaacagagcagagagccgugauguaggccuguaagucccaaugugcaauaugggcuauauuuugaaauuuucuuugaaaaaaaaauucccaggugugguagugucaccuuuaaucccagcucuugggaggcaggugcuucucugugaguuccaggccagccuggacuauagugagauguuaucucaagcagggcuggagagauggcucagaaaggcccugcacagagugcacacacuccacagaugcaagugcacauagggcugaaccacauugguaccucucacuacaggagcuguaauuaaaaagugcacccagcagagagccaagauuaaguacuacgcaaagcugcuaagaaaaggguuccucuucccuuuaggggcauuguaucuucuuucuugucuuaagaagaaguaauuuauuaguuuucuuuuauuuagaauuguuucggccaucgccacaaucaaguauagaacacuuaucaccccagaaaaaaaacauacccuuucuggucauacugguugucccucagcugcaguuagguggucacugaccugcucuuuggauuugcuugccuguauauuucauaucaguuggaccaccuaggaagugucuguguuuaacaucagucauguuugcaaggcuuauuaagacuugcucucuuuuauggugacaugauuuucagucauaugguuauaccacacuucauucauucaucagcugauagauguuugaauuuuguaauguuuuggcuguugugaguguccugugaguguucauguguaauuuuugugaggacaugaguuguuguguaaauugcuagauuggacuacaauuguauauuuaaacuucaauuuuuuuuuaagauuuacuuauuuucaugugugagaguguuuaccugcauauguguauauaugauaucauaugcgagcgagcuaggaacagaagccucauccucugaaagagcagcaagcgaucuuaaccucggagcaccacccccuuuuagacugggucucacuacauauauagucuuagccucuaacuugcuaaguagaccaugcuaaccuccacuuuacagaaauccaccugacucuucuccuucaagugcugggauuaaagcagaguaucacaaguuggucugacuaacauuuaaccuuugaggagcuacugaaccuuuuuucuaaagcagcuauaccauuucauaauccaucaaaauaaugaggagucuacauccucaucaacauuuggacucucaguccucuagcugugguagcuggggaacucauuaccgaugagcuacccucucggcccugagugucuguugauccuagcucuccuggugguuaugaagcaggaucucauuguggguuuuaucugcaucuccccgccaguugaugauaaugagcagcuucuugaccaacugcauaucuucagagaaauguccacauggauucuuugccuauucuuuuuaauuggccuacuuauauugguuuuuugggggguuuuuuguuuguuuuuguuuuuucaagacaggauuucucucuguagcccuggcuguccuggaacucacucuguagaccauacuggccucaaacucagaaauccgccugccucugcuucccaagugcuggcaugaaagaugugugccaucacugcccggccccuacuuuuacuguuaaauugcaauaacucuuuauauauguauagucuagucagauacauaauuuacaauuuuuuuacacugugucuucacuuucuucucauuuauauauucuaagauauagauauuuucauuucaguucaucuuaccuucuugugcuuuggcaucuuaaucugagaaggucaaucaaggucaugaagauaugcucauaaagccagggauaguggugcaugccuggaaucccagcacuuaggagauggaaggaggaugcuuaaggucauccuuggcuacagccuggacuacauacauuuugcuuuuauauuuuuuuaguaguuuuauagauuagacuguuacaugaaaucaucaauacuuuaaccuaauuguuuuauaugguguggaucagggguaaagcuucuuuuguguguguauggaaauccugcugucccugcaccauuuguugaaaagauaguuauuuuccccaucaaacugucuuguugccuuguuucagaacuuaguucaccaagcacagugauggauuccuguaauccuagcacuuaguggguaaaaagaucagagucagucugggcuguguagaaaguuccaagcuagugugcacuccauaguaagauccuuucucaucaucaucaucuauagaagugagaguucaccuugggacucuaguuguaaucuauuagucugcccuaggggacucucuuuucuuagcaacaggauaaacaggcaaacuugcagcacaguuauuauaaacagaccugagugaagauaaagggccauguugauaugaaacucuuaccagagcaucugucuggagugcaggcaagggacgauaaccucggaugcccuuacgauuaucucuucuagacuacaaaaagaggaggggaacuaaaaugugggaaccgggggcuuugggaaggugggggagugauguguguguuggaacaugggcacguagccagugggcacacacauggcaggagacuugguuacuugguauagugagaauuaagaagugggugguggcgugguagagaacccuguagaaugugugucuacacacucagaucaugaagccauuucauacauuuagaguugaguuuagugaccucuaaacuuuggauuuagcauuaagggacaaaugucagcccccauagcuuaggcugaccccuaaugauucguugucagauucuauuuucuggcuugugcgaaggccugucagcuagggcugugagaugcuagacaucaccugccacacaagccuccaacaggaaauccugauuucuuuuugcuuuggagaaguuugcugacaaacacauuugugucuccuuuccaccgaugccaugggaaauuccacaucacuagcguugcugcuucugaugugaacgcaucaccacugugacucagaacggcauuugccaggcccuggcagagauuuuacuaacauuuuaaaugcauaauugaucauggagaaugauugcuuuuuuuccccaaacuuaaagucuagacuuuaacuugaaaaacaacacacacacacacacacacacacauugauggcgagguggacauuuuucuuaguuuaugaagggaacaacugauaaucauaaaccgggacagugaaguccaccagucucacccuugagaaggcagccuuggaaagcaauauaauugaugcuuuccucuuugugcuggggaguuuuuaucaacuugacacaugcuagggucaccugggaagaaggaaucucauuuaaggaaaugccucuguaagauuuccuguagguagggaagcccagcucaacuacccuuggcagauacccuuugaugcuaagaaagcaggcagaacaagccaguaagcacuacuccauggccucugcaucaccuccugccucuagguuccugcccuguuugaguuccugcccagacuuccuuugauaaugacugugauauagaacuguaagcugaaguaaacccguuccuccccaaguugcuuuuggucaugggguuuuaucagagcaauagaaacuuaacuaaaacacucuccagauacuaauuaaauccuauuuuuucagagauuuuuaugguaaucuucaaaaaaacugcauaccacccugcaguucuccucaucagaggcaguagaaaggaggggaaggagaucuucuggcauugguugucacauggugccaggcguuccugggcgugcucuucagugccuuuugcgcaugccgguugcuuuaguuuucacagccguaagacagcuguuuggcugacucuguacaacagauacucuggacauugaggaugagucaaaauacagaacaaaugcaaguugaaacacaagcuuaaauaccaaagccuugguguaccauagccagugguauuccuacuaugguugucuagucaggguggucucugaggagacauacagacuggacauagagaaugguaggaaaggccagggauguaugacacuuacagguagaaucccuagagccaccaaaaaagaauggaguuugccuaacagaguugagagaggcucuucaggagaagaugcugcauuugguaaaagcucggggucuauggugcacuggugaguagccaggcauaguggacgaggcggcucaggagggucugcagacaugugccaaaggccuagagaagaggugcauaaaucuugcuuugggaauaacaggaagccauugaaagguuaucuuuuaaaccucuugauuacccagagguaauuguuaccauuaugaacaucuggacauuuuuccugcagacuacuggucaauuucuguuguagauuguguuucucuuugcuugauaccaggauauuucugugucuuuuuauguccagcccuguucucucugcuccccaguuacauggcacacugaagugauuaguuccaggcuaaggcacaguugccacugccuccugguaccuggguggugaccagaggcagcuucucagggauucugacauaagagagugccacuuggaggacuugggagcagcauuaggccacugcuucugagucagaccccuagaacccuuucaccacaaacaugaaauuugauggcucuccuagacuuagagcucuagcucccagagccucuucuuugucuaggaaaaggcugcccgaggcagcgcugggcuggacucugaggguaaccaguaucucccagaggaaaaccuccaaugagagcaaaggucauuguaccccgcagaggucaccaggugaccaggggaaaggagucauggucugaagcuucuguucucugucacucuauguggagugcccagugcccucuaagcauuucagaucucucgaguuaagguuuuuacaaaccucuaaugaauuuaaagauuuuuuuuucacauuuguacuuucaaauguuuaauagccuccccuaguauaauggggccuuucuuuucagauugccucaauccuccuguuacaugugaaaaaaacaaaaaccuuccacaauagucucuauccuccuccugagggguggggaacccuauggugggugagauggcuacaaaugcagguugcuagauacagagaagcugcaugcugagaagugccuccuggagcagcuuuccacuucccaggcccugccacaggcugggaagauacuuugcugcuucaagccuucuuucuaggaaagaaaagcuuuaucagauaguccaaguaaaugcauagguacucgguaaacguuagcuauucucaggagccaugaagcacagagaaagauuaacuucggaguucacugccacauguguuggcuccucugccauccagacaaaccugugggugugaagagcugcggauaacagggcugaucaggcgccugggugcagguccugugaugaaggcaagcucacaaaggaucuggaagaggccgaccugagcucacagcacagcacagaguccuggagauaaaggagggacccuguauaagccauuuagcuuaguggugaguaaugggcaugguggccacugcuuaucauauagagauaugguuagacccaggaucucaguguuagcuugauccugggauucagagaucgaccaaaccucuucauucguucauuggagaacaaaagggaaaacccagaaugaguagauuggauauucguauuguauuuguauugacaguagagcagggggaagccagagaguacaacaaggcuagaauugggaggccugccacagggaguggucaggaaagagguguggcagcccaguucaugucacaguucuagguuuuucucccauggugcucuuuuucuguacuuggugauauuucucaaguguacugugcagcuuccuagaaaaaccccaucucacacauuucaccuggauccaaauaucccuuggguuuuguuuaugucuucauuucauuucuguuuugaaucagggucucacuguauaaccagacuggacuucuagagaucugccugucucuggcaccacaacaccaggcuuuauuugacuauuuugaaguaccguugguaacuauagcuauaacauagggacuguucuugguaaaauaagugagucuuuguuuuuuuaagagcccauuuguagacucacauagucucugcugauuggaucugcauuuguacauuuguacauuuguaacauaaacucaggauaucucugaguaaugguuuggcacaccauaacuuagugcuggagcuggucguaaugacuggcugcugucccacgcucacagaacacuaggcaguacuggauguuucaaagcaagggcaggguagguuuggguucuuggagucgggaguuguuuucaaggcuuuucuugagcccgucaucuugguauaccauuucucuuuagaaaaccauugguuugaagaaucgaugucuuuuugccccucugaaccagggaaugacaagauuuauugucaaagucaaagccuuauuugucaguguuuggcccuaucacacuuggguggagccuaauuauauuggcauuuugccucaagaaaauucagguaaucuuugccaagcugacucuuucugauuuauaaauguauuguuuaagauuuucuugucugauguacacacagcccacuugaaaaaaugagaaauggguauuuuuucaugugugacacugauuccuugauacuguuaauuuuuauacaauauuggaaggcugggccagucacuuuuuaagcauccuuugaccuuuccucugguaguuucuuucagcauagcguugucuggaauugggucacaaaggaaucaaauuuucgggacaaacuguuuacugcaauguucaauuuggcccagaugcuguagcauacaaauucuauauggaaggaauauaauaaaugggacauguuacuugcucauuuuauuagaguuaauuauucaguacuccuguaaccucuuuaggcugauccuguaacuacuggauaucuguauuaaauggaugcuaaaaagcugaacugugucucccaggcauuuggcuuuuuauggccucuuauccagaaccauauaaacagcuaguaaccuuaagauucaagagauccacccagcacucgggaggcaggggcagacggauuucugaguuccaggacagccagggcuacacagagaaacccugucucgaaaaaccaaaaaaaaaaaaagauucaagagguccccuggugaucaccggacuuaucucauagauguggaaacugaggccuggcaacagggaauaguuagcugggccaagugacaagacuugugugugucacugguagauucccaacaaggucccucaccagaaaagggccucagugucagauggcauccugcccuuuccccgcccucuuaccucacuuucauucugagauggaagguaagacaggaaacauuuuguuuucauucggcacacuacaagaagcaguggaauuuacugggcuaggauucaccuggaaccucccucugucuaguguuggugcacugacccuguugaggugagacuuuuccucauggucugcucggccauucuuauuauccucaccaucuuccugagcacugcuacugccuggaaguaaagggcaccuaauuccaggcucugugacccaggaaaaaggauugguuagaaauaagaauagagacaguuuguuaagaaauggaaaguacucccagagggaguaaagucuuaagguuuagccuccauccauguccuuuauaggacauuugaguagcaccugcuucuccuguuuuguuuuguuuuuuuuucacacugcuuuguuguuacacgaagccugguaagcaagugguccuagcccuucucugcugacuggcuucuuuuauguguugaucauuuaacuuuuuuuuuuucugauuguacauucugugggcacacugugcaugacacagguauggacagaagacaaccuuuggggauccguuuucuccuuccaccauauggguugugaguauaucaccagccuugauaugcuaguuugauauaacuuucucuggucucuugucuccugacacagacaggcugugagguuggcguguuuauuuuacaaggaaacgugcauagaaaaucugauuuacagggucuuggccugaaucccagagggagaaggauggggcgggaaacaagguaaacagcaggaagcccaggacugagcuuaucugggccugguuagaaucuaaauuuuagccaaaccccuucaggccaggugugcugaggcagggacuacuccugaguucagggaucuuauucuaacuagcuauguuccccaagagauaaccauuacccaccaaaaucuguaaaaaaaaacaaaacaaaacaaaaaaaaaccucacauugaaccuccacaaaaauaacucuucucugggacccuucugugcagaguuaccacagcacguguucucccuaagaccuacuggaacuaggguucagugucaauccagaaucaccaccccucagcaccacccucgccccaacacugugcagagggaaaaguagaauagagccaccuguccaucagaauaccaccacuugucccugcucugaaacgaacagcugauugggaucugcuguggugggggcagggccugcauagugcagggaugcuaguucaucuucagggugguggaagguacaccaguguagccuguaucuggaaagugcuggaaauugaauccccccucuccugcugaaaacacuauagaaggaaaggaacaucaucccuguggugccacacaacggauaaaggcgcagacucuggggcuagaaugccuggguuugguucaugcuguguacucuggggaagugagaugcccucucuagucaguuccugucuguaggucaggggaaaugauagcacccugcaggagugucacaaggacugcugagaggguucucuaggaagcucucggggcagggauggagcgagaaccauaaacauguacaucucuuguguaauuuuagcugucauuuugcucucaacaacaaugaaauguucagaaaaauauuuugcuaguuguaaaguaaacucagccuggaaacaaugaaaagacuccccacaaaagucugaccaaaguggcuguuauuguuuacugaagugccucuuuuuaaaacuaugguuagaaugccugaguggacccagauaguugaugcuuauuuuuagacaguauucacuuccuguaguuagaaauagcccauuuuuuagaacuauuuaaguaacuauaucuuucaaauugccaagaaacugauacuuauucaaaucaacccacuuggccaagccaaauuuauuuuauuuuauuuuuuauuuuauuuuuuauuuuauuguaauaagaauauuuuacaggcaaucuauucuccuuauaauuuucucuccuucucccaugcacaucuaauaaaaacaaaauuuuacuuauuuguaugucugaguggugggggcuugcauacaaaccacaacacagauguggaagucaaaggacaaaaauauaagaauuaguucucucuuccaccaaacagauuccaaggauaaaccuaaauugucaggccuggugacaagugacuuuacacacugagccaucuugcuggccccucuuaccaaauguuuauauccaguauggaauuaauucuggguacaguagaguugaaccaaucucuagggcucguucaucuggcauaacugggccguucugccaguuggccccucuuccccaggcccuagcagcuaccauucuccuguuugagucugugaguuugacuguuuuagcaucucauagguaggaucacguagccucugcauuuguuuguagccuuauuucauuuaucauaauguucccaacucauccauguugucacauugccacaugcugcagaauuuccuuucuuuaaagcuaaaugauacucugcauuaagaaucuaucacauccuccuuauacauacaucaaugcaugggcacaugcguuccacagcuuggcucaaaauaaagaccacaguuaacaugggaaugcaagcuaucugucucaauuucaagucuucccuccaaauacccagaaauuggauuagcaaauuguuugauaguuccauuuuuauuuuuucugagaacuaagacacauuuuuuuaaagauuuauuuauuauuauucauaaguacacuguagcugucuucagaugcaccagaagagggugucagauuucauuacgggugguaguaagccaccaugugguugcugggauuugaacucaggaccuucggaagagcagucaguccucuuacccgcugagccaucucaccagcccaagacacguuuguuaaacaccucuuauguucaauaguagauacuggguauauaguguuaggcaaaauggggagggaagccucauauugugggugcuaagaauaaaauucaggucgucuggaagagagcaagugcuauuaaccacuaagucaucccucuagccuugaauuuacaucuucuaaucgccaaauaaacacaccacuacagacuaacuaaguacugggaaaggaaagucaugucagagggaacuuggcuuagaugguguggagcaacugcaaugugcuuuugaguagcaaacaugauuaagaccuugccugcucuccaacuugcuaugguguacacuagugagaccugggccaggaggcacuccaaagccugaagcagagaacaagccuauaggaaggauacaggagggaagucccauccugcugcauggagggaggggccccauagguggucagacagggaacagaccagucagugcaagcagaaggaaaguacaggcagagguauggagacuggaaaggacaggccuccgacacaccacagagagccccuugugcuuuguaggguagggagagugggguucaauacaagacuucugaaaagacccaguggugaggcacaggcugaacauggagacuuugcucuguaaacauuguccucagaguacucacaauuuucaagaguuaggaauacuuuuaggggcuuaggggccauauuggagaggagggagcccagggaccaggguaguuugccuaggagggagccuggccagcauucucagugccuguggacacucaccaauuagguauagagagauagaaggguauagagagauagagggugaccagaaggcccaggagaucuugggaucacacuaacaaccaacacagaaguucugggauguauaagggcccaaacaagaacuagagcugccaacucuaggaggaaagguuggagcagagacugaaggccaccccaaggccacaugaccugggcagggagaaucugaccuugguucugauuguuuuccauuguuuuacauccuuuuauugacacacaacuuguuuaaaaguuauguaauuagaaauuuugcucuggggagaaauuuaagugccccccuuuauuaaaaagagccaaauuugcuuccucaauucccccaccucguaauuuaccugagccagagagcaacuucgaacccuagcugccauuuccuggcagcucuuucucuggcccaaaugaagaccauaguuuccacagacaccaugacggaaaggcccugauuggauggacaggccccuuccuuccugacccucccuuuguuccuggaacacagagccaggaaugccaaacuggaaucuuccgaagggcacauacccuuuucccaccucccaaagucuuaaaauuggccugauuauaucucauucuuguuucauaccaacagagguuccauuggagggucuuaaagaguugaaauguuuauaauuagggcuggagaggcagcugaguggugaagaguacaguuguggucuugcagcgggccgacgcucaguucccagcacccacgccgggacucaccaguaucuguaacucuaguuccagggggaccugaugcugccuccucaucuucauggacaccaggaaugcacaugaugcacauaugugcaugcagccugaacacucauacacucaaaauaugucuaaaacaauuaaaugaauguuuaaaaaacaucaugagcaccaaaggaagguaggugcugcuaugccauuccugcaguguucacacaugcaugcauaugugcaugcucauuuacaguaaaauacaucucuuauaauugugcaguuuggaaggcugugacaaaucuggacacagcuucaucacccuaggaggccucucuuuguugcagucacuuagggaucagucccagcuccacccugcuguaggcagcgcccguguggcaccuguccuugcuuguuaggauuuuauguugauaagcugcucaguuuauccucuaguaacuagcuuccuuuacuccaguugaugugucaggaguaacccauguugccugccucccuccuuauaagccuuuuaagagacaguuuggagcuagacaaagcuagauaccugaguuuuauaaaguuccucaguaacagccucucguccuagauccagacuguauuucacccuagccaggcaucuuuugauuaucauuuacugcgaccucacaguaccucaaacacuagauacaaaauuuuguuucuuuacuagguaacauuuugaacuguuuucuaggugcuaagauauucuaaauuucuuauauguuaagacugaggccaagccgggcgugguggcacacgccuuuuaaucccagcacuccggaggcagaggcagguggauuucugaguucaaagccagcuuggucuacaaagugaguuccaggacagccagggcuauacagagaaacccugucucaggaaaaaaaaaaaaaacugaggcccuaaauuguauguggguaauguuguuuuacgaacgaggcaacagacaaagucacagaacuacuaugauggaggcaggauuagauucaaggcaccuaugugucuaaacccaaacugcccacaguccacaauguguguaacuaugaagaagauggucccugugguuugugaacguauuuauaagcugaagagggacgcuggagagauggcucaggaguuaagagcacauacugcucuuuuagaguugugcauuccaguaccuaucuugggcagcucauagccugaauuccagcuccaaggguccuggcaccuuccucuggccuucauaggcacuugcacacguguagcucacacagacacacauaaaaaucuuuagggccauguaucguggcacaugccuuuaauuccauucuggggacagagacggguagaucucugaguuccgggcuaggcaagacuacaugagacucugucuugggagcuaaaaauaaaguucagcgagagacugaauauuauuauguauugucccaggggaauaaagcaaaaagugcucaagcaugcaggacaccauauaucuuccucuugccucuacacaagcucauacauaugugcgugcauacacaccacacacuugguacacucaggaugauccuugauugugucaggugaaaccagccacuuacaaaggacaaauacuguaugauucauucauaugcagcacuauaguagucagauucauaaaccuaguaaggagaaugcuguacccagaaacugagaguauagaggaugcuacauccagcauaacucuaggaauagaccugacagagauagugagcaaaugaggaaaagacagagacacagacagacaacuagguggucugggcucuuagcuaaagaaaccacugcacccuggaagcgcaguauguuucuuauaugcaauugaacagagaaguggaguuauuguauauagcagaacaaggaaauggggucaugacagacagauaaacaaagagacagaguuuauggcacacagcugcaccaagcgaauaagauuagcuaaucucagcaggaacauucucuguaggagcagucuuuaggccacacacauuggguacaguauugggagggggcuguggugacauauugauaacugucagugcuugcacuucucucauccaagguaggcuuugccgugccucugugggucugaggacccacagucuuugacauggccagcuuaugucaguagcacacauccucucaggacuucaggauucagggaguagagacuuguuacuucaugggcuuagaguuuuaauugggaagaugaaaaaguuuaggaaauggaaaguaaugaugguuguacaguagaagcauauugagugccagugaauuaggaucauacaaaaugacuaaaaagguaaaaaucauaaagguaugcacaggcgacugagcaaacuaaccuuccccaccuuauauaacccuguacuccucugagacguucagugacucuuuuuguggugaccccaaccauaaaauuauuuuguuuguuaugucauaacugcaauuugcugcuguuauaaaucauaauauaaaucucuguguuuucucauggucuuaggagaccgcugugaaagaguugugacucacagauagagaacuggucaggucagucacagaguuaauggggauguuggaaagcuaggcucaggaauggcugcaaacacaggacugcauucaccuucaugaauacauuuuccuccuauugucacaucguuuauuccuuugagguucagcccuccacucugguugaaagguaacagugucugagucuagaucacuuacuuguauccagccuacaaagaaaaaggacaccugguggcccacggagggcccucccauccgagcagaaagggaguuugucagaaagugacucaucuuccuuggcugcucauggcauuuucucuaaguguuucugagucucauccuggucgcagagagaccaaguaggaccagugggauaagucuaucacccucccauagagcaaucaccaaguaggucccucucucaaccagucccagccauccuccugacaccugaaggacacauauuuaugugcugaggcucagcuacugugaccugugguuuggggcugacuaguauacuaauacuaacuagucuaggugacaaugguauuuguuaacuugugaggcaguuugccuggccuuugagugccagagcucagaggaaaaucuugacucuguuuuuacauacuacuaugugacccguucagcaagucuuggcuuuugcucugucuaaacugguuguugaagaaaugagaguaaacucuggccuauauucugagcacucaaggaaucagaaguucuaaagccagacauacuagagaauuagaaaucuccacugugccuucaacagaaguaccaaguggggaggaagggaggaaaggccauggagggccacaggagggcuuccaugugucucaaguagguuuggaguuuuguuuaguauguguuguauuuuguuuuguuugggauggggacugguauaucccaggcuggccuggaauuagauauguaguuaagggugaccuuggacuugugaucuugccacuuccccccaggaguauagcagugcaccuuguuaugcagguugcgguggaacccacaacgucaugcauacuagacaagcauucuaccaacugagcuacauccuagccacacauuucugaauuuuuguuauuauuaaaaaacauaacuggcugggcauggugccaaauaccuuuaaucccaccuagcacuuuggaggcagaggcaggcagauuucugugaguucaaggcacuuacagguauaaguugauuucaaaaccaaccaaaacaaagcccuuacuagucugcucccuuacaccugauugucaaagggguggaaacuuuaguccacaagccucuaucuuuccuaagagaucauucucccugagccuuccucaucugccuuagggccauauuccaucuccagccagcauccuagguugauacuaacaguuugggcuucuacugcagaauauacgaacacugccuagguuuuuuuuuuuuaacauuuaugugaauauuaucauucuauagucaucuuuuuguuguuguuuguuuauuuguaucugucugcuaucuauagauugauugcuccaucuauuguugggauaaagguaguucuguaacucaggcuggccucguauuagcaauccuccuucccccaccugucaaguggugggaacuagcauaugagacaccaucucugacauuauagucaugucuuugaaacuaauuucuacccaacauugucuuguuuaugaaggguaagguuuuucuuuuuaagauauauuuauuuuuuguuuuauauguaugagugauuucuuguauguaagugugaaccauuguauaugaaguacccauagaagccagaagaggauguuggauauccuagaacuggauauucaaggauguaucuguauuuaggcaguuauuagaugacaugugagugcuagaaaccaagcccaaguccccuggaagagcagccagagcucuuaacuucugagcccucucuccaacaaccuauccauaaaggcuguuguuguuacugcuguugcuguuguuggauguuuguaaagaucugccuguguugacaggugaaggucuaguuaauucuuuuugcagucugguauuuguuaucugaauaaaccaggcuugguuuuucaaaguaucugcaguaagcaagauaccauguuaaaauuacaugguagcuauguuggcacucauuguaucauucucuagacuuuuaacacgaguuugaaaccauuagaaauggaagggaacaaggcagccgagcugggaaggcagcagcaagaugagggcuuagcuacaguguguaaguggagacuacgcuacagcugagcagccugggagcaaaauaaccuccgcugcuggccgccuguguaccucucuugggaacucacuuccuuggaggagauggcugacagccgugaccucaggaggaguguuuacuuaacuacuugauuuggaacagauugguggguagccaaauacacucaguggaauuuguuguggcccuggccauuuuaaaaaagaaauuggcaaugaccauacucuguaugacaguuuuuaaaaauacuuuuuaaacacacuuaagcuauaaauaguccucaugauaaauaucaaucacaacuuuuccccagaccacccuugaccuucucaacacucuauaaacuuggacuaaaagaaauuccuccauucccgugcuugccagacaccauggaaacugcagguggccucuaagcuucuucauugcagauguuuucugaaaagugagacucguccaaagaccagcccuguagcccauggucuauagugucaagaucagagguccauugugccaccuauccaagaccugugcugggugaagucagagucaggagugucaagugaaguugucuccaggagaccucaugugaaaugauuuucaggucauaggcucugcugccacagauucagcccucuuuacuggaacucugucccccaaacuuaugucccccaaaguugucagcauacuaacagaccuuuuucuccaccaggguaugacuucugccaggucuuacagugguuugccgagaggguugacaggaucauccugcucuuugacgcucacaaauuggacaucucagaugaguucucagaggcgaucaaggccuuccggggccaggaugacaaaauccgagugguacugaacaaggcugaccaaguggauacacagcagcugaugcgagucuauggggcccucauguggucucugggcaaggucaucaacacaccugaaguacuucgagucuacauugguucauuuugggcacagccccugcaaaacaccgacaaccgccggcucuuugaggcugaagcacaggaccucuuccgagacauccagagccugccccagaaggcugcagugcgcaaacucaaugaccucaucaagcgugcaagguuggccaaaguaagcaugagaugacagacugggcacugggcugguauuggauuacacugcuaacccuuguaggauugggcagcucuaucccagaaaguucaaaggagggagugugauugguggacaccuuuaaucucagcacuugggcagcagaaacaaguggaucuuugaguuucaaggccagcuuugucuucauaggaguuccaggccagccagggcuacacagugagacccuguccaaaacaaacaaacaacccacuauaaucuuacuguaccuuuaaccccaacauucaagagacagagacagggggaucucuaugaguuugcaauuaaccaggacuauacugagacccucucuauaaacuaacaaacuaaacuuuaaaaaagcaaagaagagccuugggaccaggaccaugcucugucccagucuguagucucaggcaggcggcugagacuuugaagccugguguuggaucugaaagcuggagccaacaagagccuuucacgcagugcuugugcgauucugugugacacagcacugggcacagcaccugggcacuggguacgaucggccagcgcaguaacuacaaggaaacugucagguagcauuguaguaggaugaugagaucucaacugguccaguauaggagagguggcauugccagagccaaugggaugcuggaaaaucaucacuaggcacugugcguuuaagggugaaacccagaacugcuagaagcugcccccagcuccacaagcugcugguucccuuucuuacaccccacggcaugcauacacuuuccucccucugucaccaaacuaaccccaggacaggguucuaagccacuugguuccaguccugcaaggcauugcucuaacuaguuugugaagccacuuagcugcagcucucacuacccuggaucgaaugcuuguuggcaggaggucugucugguuuucccuguuuagugacccuuuagcacaugguauuucucuuuucuagcuauuacaaaaucacuuaaccuucaaaguauauaaaaguaaauuaucuuuuuguuauuguuuuuguuuguuuguuuuucaagacaaaauuucucugcguagcccuggcuguccuaaaacuugcucuguagaccaggcuggccuggaacucaagagauuugccuuccucugccucccaaguuaugaaauuaaaggugggugccaccacugccaccacacacccggcucgccuaaauuacuuucuaaccaaagcuaguagcucuuguagacugcaaauuuuauggaauuuagugcccauggacauuuuaaacuuuccagucagcacuaaggggccagugacuacacgugcaacuagcuauauucagucauaaacagggaaagagugggaugugguggcucaucccuuugaucccagcacuuaggcaggggcaugcagaucucugaguucaaggccagcagccuguuuuauaaagcaaacuccaggacagccagggcuacacagagaaacacugucuugaaagaccaaaagaagagagagagaaagagggggaagaaggaggaacggaaagagggaaguuggaagagagagagagaaagaauaugaauaugaauauggaaaaugcugaguaccacagccuguagugcucccugucauuccugagcccuuggagcagaccagcauggccuagguuaguaaggcacaaaaugccucuguguucugacacugaauaaugaaaacccuugugcagauguaggggguggauggucaaacuugcugagcuaacuuaugggaaaagaaauagcauauucucuucuuccuaagaauaguaucuggcuuguuccuuuucacagaggaaaauguuugaggcacagcuacuuccaucuccagcuccacagugccauuugcacgugacaugucgcaaccccagcugagcaucaggacaggaagcugccugggcuggauaagaagcagaacugaacucagugaccuugggcccuaagguggcacaagcuguggguguucaucagagcuguaccccuauccccgcagcugcaagguuguguuccauuuaugagcuuggccacucauucuuaaagaggcaagggacaggcuguaggugaagcucagcaauaaauagagcagggccguggcucuguccccagccugggggaaaagaagaaaaaaauucuauccacaggggaccagacuagaggguaggaaaaugcuggaucagauagcauguguaaguguccuguggcugcuuuaccauaggccuagugacguaaacaaguucucucuacaaaccagaaguccaaaaucaagacguuaguagcucuacacauccacugaugcugucccacuccucuccuggcuuccggggggcucuggggcucauguuuuuauuuuaaucauucacagugaugugagauuuuaauaauacaaacaaaaagccugggaauuaaaugauuuugcuguuuuucuauuuuuauguugucaaugcugucuucaaaggaacaagagagcuucucguggucugggcgagccuuugccuccucaccuuuugucagguggggaggcagccugccagaagucuguuugcucugagaugacacacaaagcuuacugcaugauuccucagagaaagcuauuuuaggaaagcccagauacaaguuugggaaauagaauuuaguuuuauuugucuguaaaccugugcggaucucaaacuucucuuugggauagauggacaaaagccaaaagugaaucaaguucacugucagaccccauccugcacaaggauaggaaagacucccacccauguggaaagcuuacucaacaagaaaacaaagcggcuuuugaggaaggagccggugaggacgaggagagcucagggacucucagggucacugcagcucuguggaauuuaguuagcucuccaaaaacguaguuuccucuuagucacauguaauguacagggccuggcuuuccugcgugcagugucaaauuccuucuuggagaaguuuggcauucuguagcucaucggguugauagaggcugaagugugugaaagucucugugugguguguagugaugagcccguaaaugcuuauccacugcaaggcuuuaaaaauagcuccauccuugcuugggcuuuguggaugucagugcucaagccuauauauggaaaccugcuucucugaaggcugaccucagaugccucgaaaggcccccuuaaguccuccuuaaggcuguuagaaucacauguguuauuagaaccagcuuugaucugaacagaauaacaagcccuugcucaauaggacuuggcugcauccucauauauuuucguuucacauauuuucaccuuaaaaaauuaucuuuuggguuucugguuuauuauugaauucuuuuagcaggggcaagugagagauaggucucacucaguagcccacacugacuuggaacauacuguguagcucaggcuggccucaaccuguggcaauccuccugucucaggauccuaagagccgagauuacaaacgugaauuaccaugcccagcacuaacugaaaaacauuauuaccacaaacccacaaacagucuggaucggagcagagguauuucggacaguuuguugucaguauguggugugacaucaugcuuggugccaaguacacguguuguauguucagaaccaaaguugccaugaagucacacaguacuucaggggcaagugagcaccucagguucuucacaggcuugguugugcguucauuuuuggucaugcauucagaaagcuuuaauuguugccaauuuuauuucagauaaccccaacauucaguuaaacagccacuguuuaagaagcuggucccuaagcaauagucauacagcccaacgcacgcaucugcagauggcccguguacgcugcucgugcuugcccugcuguucagauccuguuggccccgcccaugugcacacauaccagaggcucucagcugagagauggcccagaucugcucacucucuccagcuuccuccuucucuuagaugcuaacgaagucuguuuucuuuaguagcauuuuccauucuacguaguuaauuuguaaaucacugcuccuuuuuuuuauauuuauuauuauauguaaguacacuguagcugucuucagacaccucagaagaggaggucagcucucauuauagaugguugugagccaccaugugguugcugggauuugaacucaggaccuuuggaagaguaguuaguuaaccgcugagccaucucgacagccccugcuccuuuuuuuuuuuuuuuaauauccuuuccuaucuuaguuauuuggugucugaauuacucuguacauuuaaaauucuauaaagaaaacuuuuguaaugaauacaacuuacugagcugaaguuggaaguaaguggaauaaugggacuguaagggaagggugugacaagccagacagcccugcuggggaucgcuugcccuuaggggcguuuccuccccagagagcuuuucguccagccuggucacaggcagcuggucucauacagaaguuacuuagugccaccuguggagaugacagcauucugccccuugaggcgugcccaguggucauucuuacuucguugggaccccuuacccagucuuggacacugggguucucucugcuuacccuuccuguguagucucagcauauguguucccccugguuccuccuuaaauccagcucucggauuaccugguccaggccacucucuggaacucuggaagugcauucuagcugcccuuaggcugcuuggcuccucaucuucucuugugguugaggaucagaauugugcauggaauggggucucauuuaucucuugucuaaagugugauaugcucaucugacauauccccucagguccacgccuacaucaucagcuaccugaagaaggaaaugccaaauauguuuggaaaagaaaauaagaagcgagaacuuaucuacaggcucccggaaaucuauguucagcugcagcgagaauaccagauuucugcaggggacuucccugaggucaaggccaugcagguacugggagacgcauaacagugucaagaggagguuguagaaacuagaguccuugccacauugccuagcugguuacaucugcacaggcccacaguccucccuauaaagcacaugacaggagcucagaggcacgcagccaccagcuguacaaugucaccucuuuuugucucuucauaucuaguagagauguggguucccaaagcaugucuacagguaaaugauuccgcagucacagaguggggcuuguuggggcccuggguccaggaagauugaagaauguauggcaugccuguguggggagucacugugcuaugggaauaugaacucacagagucagaagaagcuaaagacuagguucguauguaaaucuccuuucaaacuuggucucaauauuuaagaaacugauagguggauagguuucacccugagaccaacgguuguguuacugcauggcagagaguagcuaaagugaacguguggcuaagguugggacucucuuccccacuggccucggagaugaggaagaaaggagugggcagcacagaggugaggucagcuguaauaaaugaaacgcugacguggccagugcggggaaacggaugagacucacuguucuggugacagcuccuuaugucugcagucaaggcaagugcuucugcuaugaucuggucgcaggaucuagucaaaugguugguuuuuaauuuuuuuuuaaaauuuauucuuauaaaauacauccacagucuccccucccuccuccaguccccuccucuccucccaccuccacccccaacccccaccccaguccacugcuuuuccauuucuuuucacaaaacaucaggccucucaggcuaucaacugaacacaacauaacaagauguaauaagacuaggcacaaacccucauaucaaggcuagacuaggcaaccaaguaggagggaauuuguuuuaugacaaauacagagauauauucuuuuccuuucuagcaauaaaauggguguucuguucggaagaggaauuucuuuuucuuuuuaagauuuauuuauuuauuauauauaaguacacuguagcugucuucagacacaccagaagagggcaucagaucucuuuacagauggucgugagccaucaugugguugcugggauuugaacucaggaccucuggaagaacagucagugcucuuaacugcugagccaucucuccagcccaaggaaauucuuuuuuucuggccacaagauaacuaacuugaggugguuaguuguuucccagagaguuuuuuuuuucuuccuuugagacaggguuacucuguagccuuagcuggcuuggaacucagaaaucuaccugccucugccuguuagugcuaaaauuaaaggugugugccucgacugcccagcugagacuuucuuuuacaccuuagguuaugucccgcacuccauggcccaacugcagaacagcuguucccuugcacccuucauaaaggaacuucaauuuggaagggaacuuaguaucuuggcuuaaaugaaaaauacccaugugugucauggugcucauuagugauacacugcccaaaccacagagugacugcucuaagacccggaagcuccacuccaucccucugggccucucacaugacccuaggugggcucccauaacagaaauagacccugaaccuguaucugucugugcacauuaacaugggccuguugagguaaaucucccagguaugccccggcaaugaaaacacaccacaguuaauauggauacaugcugugcgccuagacugggcagaucucccgcuacacuaccaccgucuuccacaucuaugagaccccuuagacuugugguuucuccaguucccugaggugcuucugcuccgcuuuucuuuuuccuccucuacauccucucccucuuccauuuucuccuuccucucucccaaccuucugcuccacccuuccuuuuaucuguccaaucaucagcucuccuuuauuucacaaauuauggugggaagcagguuuacaggaaaucaccugagugcugacucaguccuuguucgaagccacucacaggauaacagaguuaacauaaauauaauuagccccagggcucuccacagcauuucccccuuucuguccaauuacaagacuauuuugucucagauauaauugaacauaacuauuauuauuuuguaauuuauaaaguacaagagaccuaacacccaguccaucaucuuuguuaauuaaacagaaccucugucaucuauccuuacuuaaaagacuuauaauucuacaucuggcuaugccuuggcuuuagauugaaugccaacugaaaaccauccucucaaaacucuuccuaucaaaguaaaaagccuggguuggcuaggagacuaugugguuuuucaaccccaucagaaauccaagaacaacugauauuaacugaaaauauauaggaagccuaaaacagcuuccagaacuuagccaauccauagagauggcugaucaccuggacagccccuuacuucaacacauguugcucugugucugucuuaaaggaaucuggccuuuuacacaaugacuguccugccaguugagaacacuagaaacaccaugcuguuacugcacacucaguuggccugaagaguuuaccccccaccccacccccaacaccccccuccucuccgggggaugaguugcacugccugaacagcagagggcagcagagccaucaucucccuugcucugccuuaucacaugcuugaaaacugcugaggggcaacagcuuguccuucacaccucugcuuggucugugaggaccucagggaccaguuuauuuccugugugcuuucugggcagacauagcugcuguuuucuagucauuccugcagaauuguggcuguuugcucuuuguuucuucauacagcugccaucagaauuccuguccucugcaggcuggcaguuugggcaaaugucauccccacauggcuguuugccagacacagguacccugugugcucaagacugagagucaguccccaaggaugggauaggugucccugcacccaggguaauucagacuccuuacccaggcacuuuggaauguuuguguaggaaggcccucuaucccuccucagcagcugacucauucgcccucgcugugacacugucagcagaagggcugaguacuggagcacuguuuguugcugaugguggaggugauuagaauccuguggcucuaaucaaccagcgagcacgcaggaccuagaaccagaacucacuguacauagcaggccugccuguuccagggcccggccaggugcagacaacuggguuucaucacagcagguuaaaugcacaaugcuggcugcuugcagguguugggagguccauucugaagacacaauaggcugcucuguccccucuacagucuaagugcuagggggcggcucuccuuccaaaugugagcucagaacuccugcccugccgcacacccuggagaucacaauuuuuguucuccuaccagagaaauauaagucaagguucagggaaagacccugccucaaacaaauaaucugagagcaauagaggaacauaacaugccugacagcugccccuggccucuuugcacaggcaugcaccuacacacacacacacacacacacacacacacacacacacacacaagauacacacauacauucacacacucuuucucaauguuucugcauuuacuuggaagaccauuuuucauuagaucuuuaagugugcugauguuaagcccuagguaguucucccuguucaaggccagagaaaguucaacuauagucccaugucacgguaaugaauaaaugagguccuaguuaccucccggagugcccaaagagucauauguguuugaaggaagcagcuucccuuaacuucagacaccuaugugauaucccuucucccuucugauuacuggguuucuccuuucuacuucauguuauccuuuuugcauggcucuuuugaaagucgacacugaacuccuggugucuuccuccuguuugaccaagguuccuuuaaagcagagcccaucccugggccugggagagccugauguauauccgucgauaacggcagugauaagagguggauaccugauggcuucgugaaggauggauaaugguggguggguggauguacgaguauggauguacaaguaaacaaagagaaacuauguagaacgggcuuucuaucacuacccagagagccucugugacccuccugcccggaagcuggcuucacccuggaaggacaguggcugaguuucccagcccucucuagagccugugcucugcuaacaggccacuucuuccaagagaugagguggagaccuguugugaccuggcuugauauucacccugcugcuuagguuucaacuugugcucauuuguccauacuuuugaaauaacugauuagccuacaggcacaaaauccccacagccccgauagguacccuguuggagaagcuucgguguagagaccgugcugccucugugagguuccccuacaguuuccagugcgggagccuccuagguucguuccuaagagguuaaagccaagaagcuugugccccaagcaguagcauugguaucuucaaauaauccaaaaccaaagugcuuugcaucagaaaccagggcaguugagacaggguguugcucuauagaccaggaaagucucgagcuugcagcaacucuauagucuuuacuaugcugggauuaugagacaugguaccacacacagccagcuacaacauucucaaauaauagucuuugggaguuuguuuuuauuuauuuuuuucuaaauaugguccccgaguuuuuaacaaagaacagauaaagcagauguggccccucgucuuuacucaccgggguagcccgugauugugaaaaagguugugacucugcccuuuuccacgacucucuggauuguguggcaguaacuaacguauuagcagaaccuuucugagagcaaacucauucuccgcauuaagggcaggugaaaggguuuucacaggcauaggaggcugcuguaacuccugcagccacagagauaccagcuacucuagaaaagccacaucucaacccugaagcuuguuuuuguucuaagccccucuugcaccuggggcgauuggacaugggugccccagcaaagaggccuucugaauggcccaggguguggugggaaucccguucccuccagugccuccugcagagaacauaacaccagaucuggguucccuccuguaggagcagcuggagaacuacgacuucaccaaguuccacucacugaagcccaagcugaucgaggcuguggacaacaugcugaccaacaagaucucaucccugaugggccucaucagccaggaggagaugaacaugcccacgcagauggugcagggcggcgccuuugauggcaccacagaggggcccuucaaccagggcuauggggagggggccaaggagggggccgaugaggaagagugggucguggcuaaagacaagccgguguaugacgaacucuuuuacacgcugucacccaucaauggcaagauaucgggugucaacgccaagaaggagauggugaccuccaagcugcccaacaguguccugggcaagaucuggaagcuggccgacugcgacugcgacggcaugcuagacgaggaggaguucgcgcuggccaagcaccucaucaagaucaagcuggacggcuacgagcugcccaacagccugcccccacaccuggugccccccucccacaggaagucccugccaaaggcugacugagggcccacagcuggggugggagggguggugccugggccugaagucugcucugccacugacucgcugaauguccguggccaaaguuccguccucuccgugacucgguuuucucauauguagggcagggagggcagaucccggacacuagaugaggucuuuaugccucuaaaauccugaaguuucuaucaaaauauugagaagagcaguauauagauauggagaucaaagaauaagaagaaaaaaaaauuauccaaagaagaauguaggugugacacaggcugucgaagucugggcacucagggauugagccagggacucacuggagccaucagagcugugcuggacaguaaguuaccaugagccucuuuguccuucagggggcacugagaggcagcaaaggaccuaauuuauuuuucuuacuguguuuccugcucuaucuagagaggaaaaggaacagaacagagaguuucugccuuccauagauuaaaaaccaaagagaagacuaauacccagguuugaaagaggaugugccaugucugugugggcccaucugcaguccccaucagaguaggcagccaggcaaggagaaccugucuugucccagcaccugcugccugacccugccaagccucccucaguuaggaauucauaauucacaaacugucagccccuggcaagaccugugugcccuucaaccacugaauguccccaaagcuuuuuugguagguggcagaauuuaaauucaauaaagcuugucuugauuuguguggagucccagagccuucggacccagguaaagcgagagcagccccauccugagcugugaguggaagagaccagcgcccuggugauugaugauguuguuugauuuuuaaagaaagaaaugcauuucauuguguccagguauguuuuucucacaagauguagccucucugaagaaaucucuguaauaccuuuucuuccaagcuagacaccucacaucaggagugccuaucugggccaggauuggucuacuucugccucuucaguguucuuucccaagcccaccuagucaggcgccgcaggggcugccuccuacuguacccugcucuguggcccagcagaagaacacugucaccaucacuuacgaaguaggaaucacagcgcagcagugaccacaugaccaacagcagcagaaaugaaugaaucugaacagcaucccugaaucuucacaaaaacauacuccaaucccuaauugucugcaucuggcaaccucagggucagaaccggggauuuaagagaaaaugcuaagagcucacacccauuucgcagcacuugggaggcagaugcagggggauuaccaugaguucgaagccagucugaacuacaucguuuguuuuaugguagucuguguaaaacagaauacuuacgccaccauucacacuuccuaucuuacuuucuaaauaaugguuuuaagagaaacacaguguuugcuuuacucugaaagcguguuuuuauuaauuggacacacacaggugaauguuugaucccggggcuguaacuguauuugugucaguguccauggagaggugaugccugggaggucuugacuuuccuccuaguugucuucugcuuucucugcacaguugucauauaucuaccuaaauauaaucacaaauguaugucucgugagucugucucuaaaaugcguccguauguucaauguagauauggccaagucacuucuguacagagccucagaggaggccuuucuagggacagcaggcuaagauuucugggaucugccuucccacuccucuccaccuucugcugggagaugccuagcagcuaagcuugcucugaccuggugauguucuugaacaaaaagaaaccaugggucuacuuuuguuacauucucuuguucuucauaauaacuuuaccagaaggaaaaaacagaaauggugauaaaaauaaaagauugugucuucucaggac

SEQ ID NO: 1019 - RNA, 3363 nt, Mus musculus
aaagauuuauuuauuaucuaaguacacuguagcugucuucagauucauuagaauagggcgacagaucucauuauggaugguugugaaucaccaugugguugcugggacuugaacucaggcccuuuggaagagcagucagugcucuuaaccgcugagccaucucuccagcccaucaaggaacaacuuaagcaaggccaucauguggcagcagguguuccuuguggccugacuuaggacgugugguggugaagaguggcccgcuauuaagcaagagacagauggggccagaauuguuagagcccaggcuugcaaagcagccagaggcugaagaguagaaacguaucucaggcccugugcuguuuagccagaggcuuaaauagcagagucacuuuagacuuagucccugggucugcagugagauuacgcacuaaguccccaccgcaggaagcugcucuaguucagauguccccguaguccuccugcccaguuuuccucugugaaggaaagagggcuggcuggcaauaagauagucugagagacugcacucacgugcuggugcuguuggguuauaauuguuguguuguuaguuguuuuuaaucucuuacuaugccaaguuaagcuuuaucaaagguuaugugaguacgagauuaauacagagucuggcgcucuccugauuugggcacuggcuggugucucagaagugagugguucaugggagaccacugcauuccuuuguuagucuugcuuaagcagaaauccuugccuugguuuauacaaaaucuagagagaauuucuuuuuucuaauuggaacuuccuagcauacguagcucagaaaguuauuuccuggguaaagcugcugacguguuuccacccaugagaaggacacauacaguagggcugaagugagccagugcagagucgugagggucagagcacccgggucagaagguguacugugagcguccggagugguugcuguuaaugagacuggaggugcaucucacccaggggcuacagcucucuccuuguagauguuacaguuacuucuuuugguuuuaucuuagagacuaugucagagacuggcauagugauguuguacuuccucccaaacagaaaacaacauuuauguccaugacuuacugacauuucaacaaaucacuacagucucaaaggccaagggcgcaucacuguucaccugugaccuccaggugagugugcuugagggggaccuuggcuuugugacuccacaucaccacguuccuaccacuccauggaaggacgacucugacauccaaacccaaaaccuucagagagaguacuuugcuuuggaucuuguuagaugagguacgagaugcagaauuugcauuccccaugugcuaauuaacaugccagguauuugugugucacaggggacuagccagagggaaagacgguugucagacaaacauuaguaggcaagcaagacuuuacauaguaucaugaacuuguucaugauauuaaauugacuuguucuaagcaggauugccauggucuuugucauuagagaguuuucauuguucaaaaaaagaucuuguuucugccaguucaucaucuucugucuuuugacuccccagcuucuucucagcugggaucacuguuagcuuuggcaacccacuuccacucuuuaucgcucucugccuggggguuuucucuucccaauucuuccuaaggauuauaagcaagucuguugucaccaacucaugacagccaugggcaagaaacauugaaggaaaggcaguuggggagagagcaguuaucaaaugggaagucuacucuggguuuuguuucugaauugggaauucucguguggagaagucaucuggaaccagaugugucuaagcauuugacagaguggugguccuccgcccagcuguggcaguggggcuuuaaggugcaggggauuugcagauuugcauucaaguugagguagggacucgccagucugcuugcugcugugccauggagucaucaaauccucacuggcucaggcgucucuccucagcacacugagacgggugaggagguguugcggauguguguggcagugaggaagaagcugcagcuguacuucuggaaggacagagaauuccacgaacugcagguaacguccacugugccugcugugcaggcagggugggagcuggcacuguagcuagccucgagccuccugguuagaucuaguuagccccggcuugagccuccugguuagaucuaguuagccccggcuugagccuccugguuagaucuaguuaaccccagcuugagguucuccccaggcagacacugaugcagaguccuaggccugcuuauuugugcccacaauuccacagcauuccugcacuuuaucuugucucuucuaagggaaccuuuccugcacuuuuuccaguuccugggugauuuauauucuuauuagggugacucauauuguuuauugguugguugguuuucuuuuguuauuguuuugagacaggaucucuagguagcucuggauuucuuggaacuugauaauguagaccaggcuggccuugaacucacagaaaucugccugccuuugccucccaagugcuagaacuaagcccagaccuuauuuguauuuuauuuauauaguucuucaagaauugugcucagcacuaacggcagacacuauugcauacaccagcagaauuuugcugaaaggacccugauauagcugucuccugugaggcuauacuagugccuggcaaauacagaaguggaugcucacagucaucuauaggauggaacagagggcccccaauguaggagcuagagaaaguaccuaagagcugaaagggucugcaacccuauagguggaacaacaauaugaacuaaccaguacccccgagcucgugucucuagcugcauauguagcagaagauggccuagucagccaucauugggaauagaggccccuuggucuagcaaacuugauaugccccaguacaggggaacaccagggccaagaggugggaguaaguggguaggggagcagggcgggggaagguauaggagacuuuugggauagcauuugaaauguaaaugaagaaaauaucuaauaaaaaaauuaaaaaaaaaagaauugugcucagguauggguagaggguauuuugcagaauggaaguaauauaacagaaaacaugaaucucaucccauccuguuuuaacaucuucucaguugaacuccuauucucuuuauccagggagacuuuagugugccagaugugcccaaguccauggcauggugugaaaauucuaucugcguugguuucaagagagacuauuaccugaucaggguaagccuucuguu

SEQ ID NO: 1020 - RNA, 49029 nt, Mus musculus
ggaagaaggcggaacuaccuagccggaagaaggcucaauacuuuggguaggcgcuucauggcugugaagauggcgguggcugcguggcuucaggugucuccuguuauuuuucuucuuuuaggggcgcagccguucccauuaucguuucuuggugcagguccggcacccguguuugcugcagauagaucgaaguggcacauuccgaugccgucggugaguguuggggucgcuacugagccugaaggggguaagagguggggcuacgguggcccaagggguccaggaagauuucuggaaagucggguucccaaagugaguggaauacccagagcguccguguagcugccgacgggaucccaccugcccugagcugagagcugagcuauuugcuguaggcgaggagugucaggggccaagcguguucuuaccgggaaaguaacagaacuuuaagcauggaacaggagagaaacuuaauacacagggagagauaguaguuucucuuucagcuagaauguuacaaaauccaguacuagggcuggaugaaagggagaugugaauagaagucuuuauuuuuaacucguguguguguguuuguaaaaauaguccuacggaugaaggguuuugauuugguuuaaacuuggaaacgucuuuugugauuaggggacuuggagauucaaaaaugcauuuuaacaugggaauagccaaaacgaaacaauucuaaaauguuguguaguaaggauagucuuuuguuuggauaguuaacugauaagucgacccauuuuagaaucucguuugacuuaguacaguacuuugaaccagaaaaaccagauuuuggugagaacugcuuuaaaaaccauuagccauuucguugaccuuuuugccuuuuuuuuuuuuuuguccuguucacuguacauuuauauggcaaauauuacagguuguauucauguugguaaaggguuuugggcuuugaguuguaguuuucuguuuguuacugaaaugauuaauaguuaaguccuuuuacauguaaaaguaaaacugcugaaaguuuauucaaaagucgguuguucugagggaugauucgugaguaaaaaaggaacuguccagcucaagccacuuugaaguuagguugaaauuuguagcagccucccacucaagagucccugcucuguggccuguagggagcggcaagagccaauaguuaggauaugacugacuuucacuaaagaaaauguuguuacugucuuuuugauuaagaaaauuuugaauauuuuauaaauguagguauucauauucugccuugaaaaucgaaaugcccugauguuaauuaucuucccuuuaucuuuucaggggaaagguuauuuuaauuuuggaaagauucuuuucagaaauacuaccaucuuacugaaaugugaguuucuaaacuucauugaguuauucggaucuuuuaaacuuagaaaauuauucucuacccuaguuugcuucugugugcgcgcgcgcauuugugugcauguaggaacauguaugcaugugugugaaggucagaggucaguuacuugugucuuccucaguugcugucagcccuguuuuuugagacaaggacucucuccuugaacuuggagcuugagguuuggcuagacuggcugaccagccagccucagggaucuucuugcccgcuucuuuggcacuggaauuacaggcauggauuuuuacauggaugcuaggaaucugaacucaggugcugaugcuugcugugacaggcaggcaucuuaccaacaaagccaucucccuagccccuuaauguauuuuuaaguccagaacuuuaauaaccuggcacuguuuagauaaaaauauuuaauuuauaaguccuaucugugagcaauauucugaguacuuauaugaauuuuuauugucuuauuguuuuucaguuugcuguuauguauagauacacuauuauauguagcuuauauuauauauuuguauuacauacuuaauguauacuuuauugaauucauauuggcuguauguuauacaguguguauguauauuuauguacauaaauuauauuuuuaaucauaguuaaguugaauuauauuuaauuuuguuuguagagugcuuacaucauuuuuagaucuguucugagucaggacaagauuuugugcuugugugcuuguuagcuauuuacugaaaacauggcccaagauugugagaccauugacuaagauacucaguauguuuaccaagggaguguuuaacacuucaaggaacauugaguucaaggauauuaccaggaaauagggacuguauagaagaaagccaguuuuucuagugagagaaacaaaagaucugaagccaaacugugcucuguuuuugagauggggauaguauucuagaucaucacugucaugugacuuuguuuguuuguuuggagacagaguuuuucucuguagcuuugugacugucuuggaauucacucuguacaccaggcuagccuggaacucaccgagauccaucuaucuuugccccugcaagugcugggauuaaagguggugcaccaccacggucuaccaggcuucucugguuuuugaaauagguucuuacuauguagcccaaggccagccuuagguucaguuucucaagugcuaggauuauuagacaugaacuacuaaaucuugguucauguguuuuguuuuguuuugagcaugccuuuaccuugaaaaugcaauuaaauugggugauuguauucuuuaguuuaauaagugguuguaaaauaacuuuugugugcugaguacuuauagguaccagagaagugguagaaaaacucucuucugucacugggcuuccacuccagugggagugaaaggagcagguaaaauuccugugaagaauauacucgugauccuuaguuuuaauugucaacagcacaacucagaguaacuugggaaaagaaucucaaugagggguugucuagaucugguuggucagugggugugugugugggauuguguugauuauguuaaucagugggggaaguuccaaucgaaauguaagcaggguuuggguccugaauuguguaggagaaaucugaguugaacagcaugaaugcaugcauuaauucucccuccgugauuuggguguggaugugaugugauuagcugccucgaguuccugcugccuugacuucacuccaaugacuuuauacuaaaauaaacccuuucuuucccaaguuauuuuuugucaggauguuuuuuccagccacagaaaaacacuugggauaauaccacaucugugaaaaugucuccuaaugacuuaaguugauuugaaccaguuuacucuugucuugugagguugguuuucuggcuguuacucauagcugugaggaguggaagcauggaguugcuuagcacagcuugaagauuuguguuguacuccucuaugucuuuucuaguuugucuuuuucuaauuugucuuuuucuaguuuguuuuugaccgcaugguauuucaccaaguuuaacaaucugcauauuuuaaaauguguacauuuuuuuuugaaagauccaaggcucuuuaaaucuuguuuuuaguuuuucuuuguuaucuccauaguuucuuugauuuuauacuuuaugcuuaugguguaugccuuccauagcuuagguaggaccauguucuuggucucucaagccuuauaguucaaaguucuaaauauugucuuaucuguccuuuaauacuuaccuuacuuuauguuugaaacaaaauucccagcauaucuuuuuuuguuguuauuuuaaagauuuauuuacuauuauacauaaguacacuguagcugacuucagacacaccagaagagggcgucagaucucauuaaugggugguuguuagccaccaugugguugcugggauuugaacucagaaccuuuggaggagcacucagugcucuuacccacugagccauauugccagcccccaguauaucuuuuuuuaaagacguaaaaaaauccauccauccauccauccaucuaucuaucuaucuaucuaucuaucuauccauccauccacuuacuuucuguauccuugugaaugaaggcauugcaugguguauguguggaaguuagaagccacuugcuagagucuguugucuucuaccguguuuuaucgcauccugggauaaaacucagcucuuuagacuuauucccugaccccauuuugcuggcccuguuuuuggacuuuaaacaagcaaucccuaucuuuuuuguuuguuuguuuguuuguuugcuuguuuuuuuagacaggguuucucuguauaguccuagcuguccuggcacucacuuuguagaccaggcuggccuugaacucagaaauccgccugccucugccucucaagugcugggauuaaaggugugugccaccacugccuggcucaucccuaucuuuuuauguucucccguuacuagccaaauuauaauuuccuugauaucuuuuccauaaguuaucagauggucagaauuuugcauauucuaguagagcucugcaaaaacugugcuagauauuuaaaaauuaguuuagggucuggaaagauggcacuaguuacccuuucagaggacccagguuugauuccagcacccacacaucaguuuguaaucauuuguaacuccaguuccaggggucugaaacccucuucuggccuuucugagcaucagacucauaaaugguacauagacaaaacaggcaaaacaaccguauacauaaaauaauaauuaaaaaaaacuuuuuuaaagguuauuugagaaaaccauuaaaaacaaagcuagaaaccuuuuauuugcuuauuuuuauuauauuaacauuaauuaauuaacuaauucauuaauuuuugguuuuuaagagaaucucucuauguaguuugguuauccuaggacucacuauauagaccaggcagguuuggagcucacagagaucugcuugccucugucucccaagugcuaggauucaagauauggguuauagccuccugguugcaucuuuuguaaugaauuaaaguagauuccuggggcugaaaagauggauuggugguuaagagcacuuguucuugcagaagacccaaguucaauucccaguaccccaaauggugauucacaacuguucauaacucuaauucuaggauacacaucauacagacauacauguaaguagaauauucauacauauaaaguaaguaaauaaauaaaaaagaaaauuccuaaauguagucauacugauuuuuuuguuauacuuacaaaauuaaggagucuuuaguauuuuguuucauccaaagcuggaaucaaagaggaaguuuugauuagauguuuguuuuguugugagccaaaaguuaaauuuuaaauguggucauguguuuuuuauuuguuucuuuuuuuguuuuguuuuguuuuuugucuugcuuuuggagauagucucauguagcugaaguuggcccugaacuccugauccuccuguuuccaccugcuaagugcuagaauuacaggcaagcaauacccaguccugccaucauguuuauuuuuggcauguuuacacagaggagucuccggugucuugcccugccucucaggacaguuggauuuacuuucucacaucugcagaguggugcuuugguucuuuagaguaucacguuccagguuccaaaguaugugggguuuuguuguauguauacauauaauauggugaauguauguauguauguauguauguauagguguuugugugugugagccugugcaggucagagaaggaugucaaauguuuaucugucugucuccacuuuauucacuugaaacagggucucucgcugaaccuggagcuaaguuggugguaucaauaaggguagauagggggugucaggucagauccucaggacuggauuaacaagccaugaacucccaaguggguacuagaaacugaaccuuggucuucuggaagaacagccugugcuccuuacugcugagccauuccucuaggccccuuuguguauucuugccaauuuucaaaguccaagccaugaauuuuccucucagugggucuguuugaaaaccauuuaacaaucauaaauauuacacuauccuacucuauuacucuguuacuauauacuguuuuucuguauuucuccaguaaauuuguggaucuuuaaaugaucuuugaacauuccuuuuuccccguuccccucuuaaucuaacacucaaauauugaacuuuuguauguguguguucugccugguaaauacuuaaauacauuugagguucugggacauagaaauagaucuacaguccaaagagguuaaagaaagaaagcuugccuagcuauuauuucugaggcagcagugacguuauugucuaaaggcuacuaggaaucuggguauguagcucacuccuguaaucgcaacauuggaggcugaaacggagggauggcgaugaauuuaaggccuggccucaaauccugccucaaaacaagccuaagaaaaaagaacaaagaguucuuugugugacccgaauuccuuauguuuaaagauauugaguaucuaagcuaggguggaaaauaaaaagaauguaaguuaauagagagaugcugaaagaaugcuucauuuggaauccucucauguuuacagugauuucuucuuucauaguugauggagagccuugugaccagucuuuaaauauaaccugguuucugaaaagugcugauugcuacaaugaaaucuacaauuucaagguaaaaaacaugaaacuacagacuuuuccugugacuuaaugguuaucuggucccagccuccuaacuuuacacagaaagaguagugcguacuuauggcccaucagagcugaaaccauagccuaggagucucagucugcaggcuugugucagcaguucucagacuuuuagucucagaauucauagccuuuaaaaaaaaugugggcuuaaaaaaccuuuuuuaaaaacuguguuuuaaacauuugaguuuauugugguauuggugcacacauaagccaugacaugaguacgaaugucagaagacacuugugcagguucuagggacugaacucaggucaccagacgugacagcagguuccuuuacuugcugagcaauuuuucugguccuccacaaggcuuuuguuuguuugguuuccucuuuuagaaauuaaaacagggcuaaagagauggcucagugguuaagagcacuggcugcccuuccagagaaccugaguucaguucccaggacucacaugcuagcucacaacuguccacaacuucaguuccagaucugacuucuggucucugcaggcaccaggcauauacuugguuuacagacauacacauagcaaaaacacccauacacauaauauaauaaaaucacuuuuaaauagauuauuuaaagaauuauuaaaauuaaaaaauugagauauucauuguuuuaaaguagcaauaauaagcucauuauguauucauuuaaguaacauuuuuuuguuuguuuuuuuaagacaggguuucucuguauagacuuggcuauccaggagcucacucuauagagcaggcugacuucgaacucacagauccaccuuccucugccucccaagugcugguauuaaaggcaugugcuaacaccaccugguauaaguaacacuuuuaaugaacauaaauuuuaaaaaaauuaauggauaagccaauauacauauuauaauguucccagguguguauuguacuuuuaaagacuuuauuuucauguuucuguauuuuaugugacuguguacuacauguguguagugcucuugaaggccagaagagagcgucagaaucucuggaaguagaguuacagauagcuaugaccuugcauguggguguucggaauugaaccugggcucccccagaagagcagccaguacucuuaagugcugagcugugccugauuuuaugcagugggaauauaaaccagggcuucauucaugcuaagcaaacagggccaacuaugcuacauccccagcuucuguauugaaguuuuacaggagugauggugauugcuuuugcuuucauuauauaaaguugggauggagcucaguguuaagagcagaggacaggaguuuuguuuugagcauccaauugaacagcucaaaacugccuguagccgggccuggugacacacaccuuuaauuuuaaucccagcacucgggaagaagaggcaggcggauuucuugaguucgaggccagccuggucugcaaagugaguuccaggacagccauggcuauacagagaaacccugucucgaaaaacuaaaaagaaaaaaaccuccaacaacaacaaaaaaaccugccuguaacuccagcuaaaacccuguagcuuccauggguacucccuguuuuacacaggauuacggauauauacauaugugugugugugucugccugucugucuauguuuguguguuauaauacauuuacauauauauguuuggaauaauaucauaggaaggaaugaaaagacugaagaauuuagagaaaugaugguucuagaauuugguuuaaaauauugaccuuuuucucuuaaucacaaauuaaacuaaugcuagaagguuuuuacauuugaaacuucaugugaucuagucaggaauuuagguccuguuuucauaagacauacaaauaguucuuuuggauugcuacaggauacaaguguggagaugggauuggagagauggcucaguaguuggcauguacugcucuuacagaugaccugaguucaguuuccaguaaccacccugcucauagccaagcuccuugugacugcaacuucaggggauccugaaggcuucugacagcauguguguacauaaucacauaaauuuacacauauguguacacauacuuguuuuaaaguauggagaugauggugguagauaugauauuugaaugugauuuugguaugggagaaaaaucacaacugauaaaugauauuuucuuucguaacuaucagaaaugggcuaugcuuggcagcaacaguuuuacaucccaagcuuaugaacaugaauguuguagauuuuguugauuuggucaaguaacaaauguauuuucaugugauaaaaacucuuuguaucugaaaauuuacuagucuucccagaauuguuagagaaguuuugugagcaaagacgauaauucugugguuauauuaaagggguguguguguguguguguguguguguguuccuguuuaggugcuuauuaugugugcaggccagaagacagcuucugguguuguucagaugcccuuguguuuucaaaacaaggucucucauuggccagcucucaucaagcaggcuaugcugacuggucagccagugagucccaggcccagccuguuuccaccuguuaugcacuaggauugcaaggacuccucuccgcacccagauuguuuuacauagguuuuggggcucaaccucaaguguuuguacuuugacaacaaacacuugagcaacugaacaauguccccaggcuucuccuguugguuuuaaaaauggcaaaguuauauauguacuacagauugacucuuuguccuucaaguccuugauuugcaacaggugagcuaaaauuuugcaucuucucuguuuuuucuaggcagaugaaauagagucauacuuggaaaaucucaagggaaaaaaaggcuugucugggagauaccaaacaucaucaagauuauuucagaacuguagugaacucuauaaagcacagguaaauucuugacagugguuagaaggaaagagaaaaggugaagaaaaaaagucaugucugacucucucccuuguccauuguuugucugcuaguucugucuucuagaagagaucucaauacuaugaaggaagcugcacuuucuuuccucggugcuauagcagauucuuauaaaaguuccauugccauccuaaccauuucugaaggcuaggcugggugcucugaguucauucacauugucagucaucaccacuguccauugcagacuuugauccugcugaacugaguggagucuguacuauccaaccgugauucagccugucugcacggugcuccccucuagucuauuuuugucccuauguguuugacaauucuggauacuucagagagggauuugaguuuuguucuuuuugguguggacucuguuuucuaggaucaccuaccuguguugcagcaugugcccaaauuugauccccuuuuagggcugaauucuguuauuuuauauaacacauuuuauuuaucuguucaucuguugauaguuauuuaacaaagcaauuuuuuaguugauaugucuucagauaacuagguuuuagauuuuauuauuauacaucugaaaucaaaaggguugaauucuacaccuuguuugugugaaaaggagagugaguaauauauagagaggugaauaauacagaugacuauacauuuacaaugcuuacauaaauauaaucacauaaaugcuacuuuuuauuugaaauucuagcuuuucaaaguuugugagguguguguguauauguguguguguguauguauguguguguguauacacaagccuaugguguuuaugcuggugcucuuguccaagugaaagccagaguuugacauacacugucuuccucauucacgucuaccuuauuucauguauuuuacuuuauuuuuugagacaguguugcucaugguaccuagcacuugcugcuuuggguagaugggguggcaagugaacuccugggaugggaucuacuugccucugcuccucucauccugggguugcacacucacaccaccgugcuuggcuuuguaugugguugcugggccuccaagaucaagcauuuuucccucugagccaucgcucagaccugaaauucaaaguuuuuucuuuuauuuuagaaaugggcgauaacacuaauuuuuggaugaggauuuuuagagugagggaagguuugaguauugaagaguucuugcuaacagcagcuucacuuugucuuuguuucauuugcuuggauucucuuagcaaaugcugcaaaguagcaugcagugcaccggaagguagguucucuauucaguguuuacaaguaauggauugaauauuuaacaauugacgaaugaaugaaguaauugauaauuaauuuugaaggucuuaucauagcuuaaaccuuacggaaaguagaaaaauuguaaaaugguaucacaaguugauagcaaacagaauaaacuguaacauugaauaauuucuucucguguuaguucuuuaaauucauuucuucagcuagaaggguugguuggaugugauuauagaaagcugcuugcugcauccaguuacucucaggucugcuguaguuuuuuagucauaggauacacuucuguugguaagguuuccugccuucuaaucuaauguaagcauugaauuguacaauccaauugcugaggaagcaaaauaccuucugcccaccuccccaucccccacaggacacacuugacugucuaaggcuuugacauucacaguugcccccuucuggagagacucagagacaguucuguccugugggccaggccaugcucagcaggguuuucuccacuuguuucuaguucauuggaauuuuuuuuuuuuaucugcugaugcuauuguuuuuuuacugcagugguauguguuuugcuuuaaccauuucuacauauuuugagcuauacauuuguuauuuauacaucuuuaauuuuuuuauagagcuuuucuggggauuuuacacaucgacuuccucuuuugggagaaaaacaggagguaauuguuuuucuguacauauuucugagagcaauguaaaaacugggaauuaacuuucuuaauuuucuuuucuguuuuaauguuuaaaggcuaaggagaaugcaacaaauguuaccuuuacuggagacaaaauuguaaguauucccgcauuggagcagugguggauauguuugauguuugaauaguuuucuuucacuguuguaauacuuaagaaggaaaggaagacuagaaauuguacaccaaaacuguccacgguaauggcuguuucuaggagacacuauuaguggguuuuuuuuuuccuucuuuguauuuucuagauuuuuuuuuaaacaaacaaaaaaacccauauuaccuugggaauccuuccccucugucaauauuuauguguaaauaagaaaaaaaaaaacaguuaaaaauuuuaaacuuagccugaaauuaucugugauagaauauaauuggaagaaucuuuagaaaauugaaauaaggcccaaauuaguuauuuuuaucaauacaguuguguggaggcucauuuauacuuauuuucugggggccagaaaaucaacucugcccuuaagaauacuugcugcucuuccagagggcccacauucucuuugguucccagcaaucucagcaggcucacaguuaccuguaacuagcuccagaugccucuuucugguugcuauggguacccauaugcauacauaugcauaugauuuuuuauaaaaagaacauauugcuaauuccucaaaaauauuuccagucuaaaauauagaggaaguauauaguaauuguuuuagaucaucuucuucacaaauccauuaaaguuuuaaauuuuaacuuuuuauuuuuuagauuuugggcuuucuucauuucacaaaucuaacugacuuuauagaccaggcaagccuccuaaguucugggauuacaggccugggcuacauuccugccuugugucucuagcuuuguaacaauuuuauuaagcauacuauaucucacacagucauccuuuuaaaguauaaaacuuggugggcuuuaguguuucacaguuuacagaaccacuaguggugagcuucagaauucuuggcucugaaagucuguacucacugucaguccacacugcucccuuccccacagccucuguccucagcuacuaaucgcauaguacaugaucuuguguguggcuucuuucccaguuuaacacuuuggccuuaaccuuucuucaugucugcuuaaagcacuaagagcuaucagggaugagugaugagggccugugccuauguagcccugcacauguguguggcuaucuagauuuccaggaauaguuuagacuucaaacuccacagagacucuucauuguauaacuuucuuuuccuuuuaacaauugguucagcuucuugauaaguacagcugcuaaugucacaucaggcagcuaugauuguuaacaguuaauauugaaugguuuugucaagugucguauguuguaacaaugagugauucugugucaggucagagagagccccuuagaauagaggauuuuagcaacuugccagucagcucacacgaaugguuuuugggggaccucuaagccuguuuuaccuuuucuuguggcuggcauagaguuggucagaacuugaaaaaauuaauaggacagggcauguugacauacuaccuuuaaucccagcacucagaggcagguagaucccugugaguucuaggccagccuaguuaacauaauauugacuguuuguguuauauauccuguugguuuugacaacugucuaaugacauucccaccaugauucuguuauacaggguagcuucagggcuuuaacaauucucuguucuuugcuuuucaucucuccauccuuccuaauaauugacaaauugcugaucuuuuuacuguuuauucuguucuacauuuuuuggaauaucacccaauuguagucaaaugacuauauagcuuuuucagguugacuucuccauaauauacauuugaaguuuuuaaauauuuucuggugguuagauagcucacuacucuuuagagcuguguaauaguucacugucugguuuuaucauuguuugguauuuauucaccuauugaaggacauuuugauugcuuuuaagugcuagcuaugaaugcuuugugagguuguuguguggauguagacuuucaguucauuugggcaagugccaaggagagugauugaugacuguaugguaacugcaugcuaaguuuugugauaauucucacagcuuauuacuucauuggaaacagacuauaucagagacagaauuacucuguaagacaucuguguuuagauuaccacaugcaacuuucaugaucuguuagaugggggaggugcgugcaugucauggugcacaaguggaggucagaggacaguuuugagagcugggucucucuuuccaccuuuauauggguucuggggaaucaaaagcaggucacuaggauucugcaaacaagcgucuucacugguugaaccaccucacuggagaaauuagcugcugcauugccgugguagcaugcugugcuguuuuaaaucacucaccaccuauugcuucccagaucaggcaggguaaugucagcuuuuaguccuggauaaauuguuggugccagggauauauaaacauagaauuuaacucgaggauuguggcugugguuuugucugagcugacagcucccugaagaauccggcuaaggaccugccuguguucugcuugacucagcaaucccaaggccaagcggcauuuugguuguuugugcuaaguauauuuagagacaaacauucugggcugcagcaacauagagaaagugggcaagcaauagguaagagcacaaaaccuguaaaguacaagggcagaaggagauauuuggaaggaaaggagcuuugcaaagcucuuguguauuccaggacagauacaugcuuuaaagagacuagcuaguuuucaugcuggcuggccuucuaacuacacacaccgaguaaagccuugccucaauuugcaaggacuaggaauggaucuuuucucuuuaucuuuuuagcuccugauguuuuaggaaaucuuacuaaaauaguaggcacucagccgcaagaacugagacuuggcugggacuauagcucaguaguagauucaaccucagaacugaaaacagugaaaggaaggcaagaaacaggcaggcaaaugaacaagcacagaugcugggaaccacauaggacaguguaugcaauuuacaaaaauaguuuagaaaagaaacuaagcaacaaaccuucagaacaccccucccuccugccuucagugacaaacagaaucuucuaucaucuagaauaugcuguuuucugucaacuacugugaguuaugcaaagaaagugucaaauuuaaaugcaguuucuaaaaagccucucaagacauucacacauuagauguaagaaagacuuugaacuuuuuaaaaugugcucaaaagaaugaaaggaaauuauggacaaaacacuaaauuaggaaauuaggaagaaacugauaaaaguuauaaaaaggaauaagcagaaaucacaaaguugagauauauauagugacuuauuccuauagaugcuguaagccagcacuugggaggcugaaacaggaggguuucaauaagauugagaucagccugggauacaugguggcacccugucacaaaacaacaacaaaacuggaaaccaugaagcugaaaagagcauugacuaaaguaagaaacugaugagggcugucaccauuugagcagguagaagaacccauccagagauggucaguugaaguuaccuguucagaggacuagagagcaaggaaugaaaacaaaugaacaaagccuuggagaccuaugcaucuaucaugcggaccagugugcauauaauggaagucugaggagaaaagagguauaaaagaauaaacaauagccaaaagcuuuugaaauuuaaugaauuucucauauugggauacacaaaggguucaagacuccaaguaggagugaauggacaagauuuugugcccauaaguuguaauguaacucauucacaaaaaugaaguacuaauaugugccacaacauagauaaauuugaaaacugagaccagucagauguuaaaggacaaauauuguuuaauucagccauugauguaaauuguccaugguagacaacaaaucucuggaaguaggaaguagguuaaguuguuucaaaugguggcgggauggagagagggaguuuuauugcccaauaaacaagggacugcuuuuaggagguuagcacgggggcauuugucuagucccagcuacuuaggaccugaaguaacaaucucuuaaguacagguuaaagaucagccugagagacaguaucucaaaauaaguuuugguguccaaguccauugaaucaugcucaguaacauuguuaaaauuaugacguauguaaaauuuaccucaauuaaauaaaaucaaacaauaguaacuacuuaucugauagguuuguuaagacuuaaacaaguagcaaauguuacaugccuaacagagugcugggcauauaaaugcugccacuacacuuaucaaacccuauacuaugaaaauuaguacauuuugaaauuuauaagaguaguuuuaagauguaagaguuaauagcagaaugguuaguuauacuaauugguuaaugacuaaguucagggaagguucaguaauugugaguaauagaacauaggauucuuaugacugugaaguuacacaugucucagcauccuccuugaagaaagauuggcaggaaucaaaguaggguuucagcaugacguaguuguuccugaaauagccagugaauauagaguugaaggaugugucugcuuguuuggacuugaaguugugugucauaaaaucuguugcauuuuguauccucuuggguuguaggacauuuugguuauuagagaaaaccuguaauuucauagggcuaaaauguauaaauguguaaaaucuggguuucauagauuaguaauguuuaccuagagaccucuggguaaaaccuacuuuuauguucacaguaacuggggcuggagagauggcucacugguuaagagcacugacugcucuuccagagguccugaguucaauucccagcaaccacauggugucucacaacuaucuguaauaugaucugaugcccucuucuggugugucugaggacagcuacaguguacucauauauacaaaauaaauaaauaaaucuuaaaaaaaaaagaugacuguaacaagcugcaagucuauguaguggugccucuucacggauggagaaaagaccaguggcuuuccuccgugguaggcaccagugcuuacuuaacaagccauggucucccaaaauguugguagaaauuaaaaccaggucagguuggaagagacucagcaagauugaggcugacaaaccuuucgauuguaagcaaucagacuuuuuauacccucaucagaaacaauaugauggcgauugccaguaagaauacaauuguaguugccagguuucaaugauguuugcaaguuaugcaggauaugcagaauuaaugucuaagaaugauuauucugucaaaccuguauaugcuuugcugacuucuagagauuacaaagauacacaaguaauccaaaugccucccuacuuaaggggaugccuugguuucucaggaacugaaaggcacacagugcccaaggaaacaugagcuuaagccugaaaaaccuaugaugcauaccucugaaaguagcuagaccaggucaacuccaugauucccugcaucuccaaaucuccuuuuucuuuaucguuuaaucuugguuguaaaaacuccugagugaggaaaucaguggucacuguuucuuaagagucaagagcuauuaacugccugacucuaagaagcacugccuucccacacaccuagacuagguuuaggggagagcuuuuauuuaaaugugagaccaugccaguauagguucugguaguuuggggaagggaauuugauucaagagugaguguguguguguguguguguguguguguguguguacagucauguauguauucuuuccuguauuuauaucaagaauuuuuaugugauauaaauaauuauucuagcaugaguuaaacucaaugauuuuuaauuacaguuuuucuuuguaaaagauaaauacauuaaauguagaccauguauagcaagaaugcaagggacuauguuguaucaguucaugaucuugccuacguugcugugugguguauaagcuugucuugcuugugaugaccauuucuguuacugaaagcugaggacuuucugggcuguauccugaagcgauguuccauacugcauuacuaacuugugcucuagauucuugagacuugaaguuuugaugccccuuuuucucccuaggcaaugcaugaaccauugcagacuuggcaagaugcuccauacauuuuuaucgugcauguuggcaucucguccucaaaggaaucaccaaaagaaaaugcacuaaguaaccuuuuuaccaguaaguucaauucuugucuuuuaaaaauauuuguuauuuucuauuuguuucacacaugaucaauaugaaaugggaaaauuagaaauauuuuuguauguguaggcacaauuccaaauacuuuccaugaaucacagauacuugguucuaguuuggcuuucuugcugugaauuuuuuuuucuuauaaagggaaacauuuaauuggggcuggcuuacaguuucagaaguaguccauuaucaucauggcagaaagcauauugacauacaggcagacaugcuucuagagaaggagccugcuaugaguauuuucaauuaguauucuuuaguauuuugaaguaaaauuuucaaaacuugaaucucuauguuaaaacuugggaauuuugaauuuucaucgacaacuuccuucuucccuuccuuccuuccuucaagaauuauuuauuuuauuuauaugaguacauacugucuucagacacaccagaagagggcauuggaucccauuacauaugguugugagccaccaugugguugcugggaauugaaaaagcagucagugcucuuaaccucugagccaucucuccagccugacaauuucuuaauaucaagaguuuuucuuuuuuuuuagcgauuuauuggacuuuuaaaaauuauguguucaugugcaauuaauuguauccaugugagucaagguuccuauccuggaguuacaaguuaugguaagccucccaacaugggugcuaggaucugaacuuggguccucuggaagagggguuuguacucugaccugcugagcaaucuuuccaguuccucaagaauuuuuuaucuuccuuccuucuuuguaacuacacaacugacagucuuuaccuuucaccuggaauuuugcaguaacuaguuguaguuucucugugguuuccauuuuugguuuuaauuuguacuguguaguuuccuucccuagccuugcuuucucgguagaguauccuugucuuacuucugaauuuauuggcaauauugguacauuucauuacaaaauacaauguuuacuauagauuuccgcccccccccagaauaucacuuaauuagauaaagaugcccuuguuuuccaacuuuacuauuuucuucuucuuuuuaauacuaagaaggaaggcucaguuuaaucaaaggcucaauuguauaugcauuaaaauuaucauagaauaagcauguuugcuuuuaccuauguaacccagcucucuagagccuaaggcaagaggauuauaaauucaagacccaauccaggaacccuagcaggcuaaacagugaggcccuguauuuuuguuguuguuugguuuuuuuuguuuuuuaaaggaacgaucacauaggcuuucuccuuggugaugcugugcugcguuguauuaacaggauucuaguuugaaaccauucuuuaaguuuugcuuugucuuaacacacacaaacacacccguaucuuuccauucauauacauuguuggguuccuuuuguuuauuguuuguguucaagaugaguuuuccuguaauuuuauuuucuuauuaucacugauucggcaugcagauuaugauaaccucauguagugaauuggagaauguccuuacuuucauagucuaugaaacaguuuuaaagaguaaauucaccuuuuuuuuucugugagaacuuuccuguacuccuguugcaaucugacagacuaucagccuggguagacuuucucuaugagaaguauuuuauucucguccuucucuuccccuugaaucagagguguacguguuuugagaaauucuugauugcuuuuacaacuucaaauuuauugacaagucuuuuuuucaucauauuucuuugcaaguaucucuauuuuuuuuuuacagucuuuaauauugguaggcaaagugaaucuacauaaucccagcaaucaggggguuugaggcaggaggaucaaggaguucaagaccaugcuuggcuacauagugaauuuggggccagcauggagucuuugagacccuguuacagaacccuagaaaugauggguuugggugauggcuuggucaguaaaguacuuguugcuguagcagaggguucugaguuuguauucuuaacucccagcugaagagcaggccacagugguaagagccacagugguaagagccacagugguaaaccucuguaaccccagcacaggagaggagagucagaucccuggaacuugcuggccaaccagcauagcugcugagagccagaucuguuucaaaaaauaagauggaaaguaacugaggaagcugccugacaccagccucuggccuccacacaugugugcaugcuuacauauaacauguguguauaucauaaagaaaaccaagaauuacauaaauaacaacauuuuucauauugccuuugucuucuuuaguuaguuaaaucuccauggaauuuuguuuuguuuuuggcuuuguuaauuucccagaccauuuuacauauuucauugaucuuucuuuguuuuuguuuguuuguuuguuuguuguuuuuuauuuuguuucuuugagacaggguuucucuuuguaguucuggcugaccuggaacucgcuuuguagaucagguuggccuuguacucauguagauccuccugccucugccuccugaaugcugagacuaaagacuuauguuaccauaccuagcucauugaccuuucuuacuugacuuucuuuuagauuuuugugauccuuguguugaguccuuaacucccaauucgcaaugggcuuuacuuugcccuguagugauauggcgguauagcagaucuagguggaccagguagugaccugcuuuaauuucuggaacucagaauguaugguucucaaccuuccuaaugcugcgacccuuuaauacagcuccucauguugugcugaccccaaccauaaaacuauucucauugcugcuucauaacuauaauuuugcuacuguuauguuaugaaucauaauguaaauaucugauauuugaccccaaaggggagugccgcccacagguugagaacugcugcucuggcuucacacuuuucugacagguaacaaacaggcagagaagagcaguugcugguauuucuuuucaguugucucagagagggaggggagaggcccaccucacgcucaacccugacccuguccuuucuccuguuugacucugacuuguuucagugcucacaaaggaacugcauguaaacgggcauguaaaccuuguuuucacgaccagaguccugcaugacugugcuucaaccuucugcacuguucugucuccauuccaucuugauuccuggaaauacuugucuuguuuucacauuuaaugucuuuuuuuuuucuuuuucuuuuucuccuuuuuuguuuuuuacacaucuguuggaggaagcacauuaaggcaugguuugaucaacaguaccacugggaaaucuagaauugucucugaaaguucucuucuuucauuuuuuuuuucagugcugggauuagacccagagcccacauaugcuaugcaaguguuguacccagcccaaaugucuuguuuugucuagcuguauagucuagguuagccucaaauuugcaacaaauccuccugccucaggcucucaaauggggagaauauaauucugugucaccacagugacuucuuucaucuucucauuaaaacuuuugauggagccuggccuccaaggcuaggauuaacgucaugcaccaggcccagccaagucagaguuugacuuagcaacuauuucuagaauuuuuucagcucuuuuagugacagcuuuuaaaccaucaaucuuuuuguuuuguuuuuuuguuuuucaagacacgguuucucuguguaguccuggcuguccuggaacuuguucuguagaccaggcuggccuugcacucagagacccaccuacuuuugccucucaaaugcuggaauuaaagaugugcucgcuccuccaccaccuggcaaucaucaaucuuuuauuguaauguaaaagauuggcucugacuggcuguauguagcugagcuaccccagagcucuggaucuuccagagucccgccagauacugggacuacacacccauaccaccaggacuggcucaaaacaguuaaucuuauaaucaguagaguugcuucaaggaggcagauuucucugacucauuuuguacauaacacauuuuuugguuccuuaaauaguauuuauuuacuuagucagguuuuugcaaaauguuugguaccaaguuuugggaaaugucaguuauguuuuauaaauagagcugugcuuugucaggacuuguguguauucuucuuggguuuguuuugguuuucauucuugaguaggauucugcuuauauaauuaaacugccagauuauuuuuacaucuuauuuuacuaggaaggguguauuacuuauauaguucauuaugaaauuaaaaaaaaauucucauuugaaagugacauccaucuugcaagaucauaaaaaaauaaguaaaaaaguauuagggaaucguaaugaugggcagaagacaagaauauuaggaaugcacuguaagaaguauuauaccaagaguguuugaauuuaaagaaggugaaauagcucucgauggaugaauagcucucggggauggcuuugugaagcagugccagugaguguagucuuuacaggcugugaauguggagcugaggaggucagccugugcuuacagucagugcuuacaggguguugaugaugagggggaccugagucuugaaaaaauccauccagccaaaucaacaacuguaagaauaagucaucauuuucaaagguuacuauaucuaaugcauuuuccaccaugauugaaguacuuaaaagugagugaugaaacuuuuacuaauuucauaaaauaaacacuaauuggguuuuauuugauuacugaaucuaucaaauuaauugagaucuguguuuugccagugacuguugaaguaaagggucccuaugaauaccuuacucuugaagacuacccacugaugauuguaagucaacaugucuuuuuaaccuugucaguaaauuaauaugaaauugucuguuuuguagcaguaucaaggauuaucccagugccauucagaaaaugcuacuugagguuuugguguuaacuuuuuaaauuagauuuucuuauuuuacauuagggguguaaguguuuugccuguuccgauuguguacuauaugagaaccucgugccggcagagauuagacaaagucauuggauccccuugaacuacaguuaagguuauugugagccccuaugugcaugcugggaacucaguccagguccucugcaagagcaacaguuguuccuaaccacugagacaccuccccagccccuaacuucuuauuagacagugaccuugagagaguguauguaguccugugggaccccuuuaucuguaggaugaaauugucaugacuuguggccuggagaaucucaguagcccccucacagcauacauuugggcucuagaacaguggauacccagcucugggcccgcucacagugacugaagcauguaucaucaucuuuauaugagugugcagaccgcauaagccugugcugaggaccuugucuguuugcagacuuguguucaugaucccucucucucccuugccuuuaguaguuuuccucuucaguuguguuucuugagucaugacuugucaggucucuguugucugcacugcugucuucacuuuaucacugaauucugagcuaaaaaggcccaaucagugcaaggagcaggcacuuuugaggacaguuauuucuguagucugccucuagucuacaucauucuagaucuagacuagaucauucuuucuuauuuauuaguauuacaugcuagagauacaguuauuuuucgaagagaagguagagacuguuugagguuuuuauauuuauuguaugcugauuuuaaaucugaauaauuuguucuuggcucuaauucugcuuuuuauuucauucccaauuggauaacaguuuuucauggugauguguauuguguacguacuauuugguguucucuggcuggcauggucugcuugcuacuggagagaucuccugagaauucaauuuuggauuggugcugucaucuuucuuggaauguuugagaaagcuguguuuuaugcagaauuucagaauauccgauacaaaggagaaucugguauguuuuaaaaggugccauuuuaaauuuuuuguuuauuuuauguacaugugugggucccugugcauggcaugccuguggaggucagagaccaacaugugggaaucaggucucuccuuucaccaugugugcccuggggauugagcucagguagucagguuugacauuagggaccuuuaucuacugaaccaucuuaccagacccaaaauuccccccuccuuuaaguuuuauauuuuuaaaugaucuauauguggguggauggaugguauguuacaugcacauaagugcaggugccuguggagccagagggaucagauccccagggaaccagagcggcaguuuugggucaccuagguguagguguuggacaccaaacucaaguccuuugcaagagcacuacaaacuccuaacugcugaaccaugcauuucuccagccccaaauuugccuuuuuuugaugccagaugagaugcauaccagcuucucucaagucaguagugguuauauaggucugccuuucaguuacuuuuaaaaugaccaaagcagagucauugccauugugacuuuuccuuuuaaucuuggauuucaggaguacaaaauuuuuguaugaugcaaaaauaauuguguugaaacacagaaaaguggcccuuuagggaacgauuaucauauuucuuaaaacucaguugugguugauagccaaggcaccccuaagaaagaaagaaaacauggccaauuuaauuguaagaugccacugauuucaagacacauagauauuugcaccaggguguuuaagggugcaucuaagaucugguaaaauacaguaauacaagaaaauggggaggcucuuaagguuuaguaagguugacugguaauuauaaaaauauuugguaugggcuggugagauggcucaguggguaagagcacccgacugcucuuccgaagguccagaguucaaaucccagcaaccacaugguggcucacaaccaucuguaacgagaucugaugcccucuucuggagugucugaagacagcuacaguguacuuacauauaauaaaauaaauaaaucuuuaaaaaaaaaauaaauaaaaaaaaauaaaaauauuugguaugguaguuuauuaaaauaguuuuaauuuccucucugacuguuacuaauuguuguugcaagauaugcuauaagguguucccugggucuuugaagagacuugaaaacagauguaaaguugaaaacuaugcacaugcacuaggaugugugugugugugcuuuucuguguauagccauaguucaguuuggaaggaaaaaaaaaggcagagaaauucccuugauacuauaaacuuucuguauaggguaagauagucugcuuagguuuuagggaaguugggugaguugaugaauuucgcacaccuagacuguugugcacauaacugaggucauuagugacauuagccaugugcuuauagaaauugcauaagagauauucucucuguaguaggucugcuacuguguucauucugaaaaguaguagagaccuacgugcuaguacuuggcuuaugcauuugguugaaacuggaguauagugcugucucuuucuuucauaguccagaaugccuugguccuugcagagcugcucucagcaguaaagcgcucacuggcucgaacccuggucaucauagucagucugggauacggcauagucaagugaguaccugcuucugaaugaaacacugauucggcgaaacaugcugacuagcuagugcugguucugagaagguugaugaaagaaguagugagcuaggaaaacaugucugaaguuuuguggcaguuuaaguguuagaaaugcuacuuuuuaucuuccuaaaaacucagcagugcaucugcagaaagauugcagugaagcaaauaauguagaaaaccaaacuuuuacagugaauucaguuggugaccaugugaaauguuuuugcaaauuacauuuauaaaaauauuuauuuuauguuuauggguggugugugugugucugucugucuuugugugucuuugugugaggauaccuggaacgaguuucauaugguugugagucaccauggaaaugcugggaaucagacucagggcucugcaagauuacaagugcucuaaacuauugaccaucucuccaucccacaaacaagauuuuucuguggaaagaauacucuuacuguaauugcuuaaaauuuuuaaauuuuuuuuaguuaaaaaaaaacuuugacccugucugaaaaaaaacaaaaagcaaacaacgaaaauuacugcaacgugcagcgcuguagucauugugugcauugcuccuugugguguacucaucaccgccauauaccuggcccucauuguuguagccccugcuguacaaguggaaaauuugggguuuacaguuguggaggaagagaacacaaacaaaauugaaguaaaugaguuaaauaucuaauacacagugaaagguacuguaguucacaggaaagggcgugaggaaugccaggcagggguuggaucuuggagcgguaaauaggacggcccgggagagcugcacuuaguggcacccaagccaaguucugaguaaagcaaggggcuauccguccaccuagcaaaagauucugaggugugauuggaucccgugcgugcuuggaagguggaacagcggaguuucaugauggucaccugugggaugugaaagagaagagaaacuggagaugaggccaacuucuagucugcucccagggcaggaaagaaucgccauuuccuuaaguccaggaagaucaaggaauuggcuuggcacaauggcaagguuaggagguuggcuaguggagugaggccagggccaagguagaaguuugauagucaucgagauguauuacuugucaugacacuguacaugguuaucaaggaagugagucuggagagggucaaagacuggggguuugaauauucuguuauucaaaugucagugccauggagaagaguagcagaggaaacugaguaaugguugaaggcaagaggcaaacugaagacaguguuccaaggaggaguucuuaauggaaucagaugaucagaaaggugggguaagaggacugagaaucaacuauugguuuaauuaaugaagaguguuaaugaccauagcaagaacaauuugggggaagugguagugacagaagcuaucucuugaguuagagacuaggagagggauaguucaaagacacuuaaguagaauaagaguuuaauggcuaaaguuuuguuuaaauauuuaaaugccuucuaugugugauaaagauuucuugaauguuggacuuacaagagcauguauggagggcaaucuguaggacuugguuuucuccuucauccagggcgauucuggggauuaaacuuaaaaucgcagccuuggccacaaguucauuuaucugcugagccaucuugcuaguugcauggguuuuuuguuuuuaacaucuuugucuuguaaaaaacaaauauaaauaguuacauuguuuauauuuuuuacuagcuagugugaaaggauagaaaaugagugauauguucauggaguggaacuagccauagacugguuguuguuaacugguuguuguuaagacucgaugacgggcuuuuuuauuggggguuuuuauauuguugaauguuucaaauuucucguauuuguguguaugugagaguguguguguguguguguguguguguguguguguauguauguguuuuugucagugugugugugugugugugugugugugagugaguguguguguguaugaguguguguguguguguguguguguguguguguguguguguguguguguguguguguauguguaaguguaagugugaauguuugugaggguguguuuuaguaacaagggaccagaucuuguucuaguauuucauuucuugucaucauuuauaaccagucaggaguguuuuuuuuuuuuuuuccuuucaggagcauguuauuccucuuugccuccagugcuguuacuucguauguuaccggucuugcugcuucuguaaucagucgguugucucuuugcuuccuuuuuaggccucgccuuggagucacucuucacaagguugugguggcaggggcacuuuaucuuuuauucucuggcauggaaggaguccucagaguuacaggggucaguauuguuuagaaugaauuacuuacuuauuuuauuuuuucuuagucugaguuuuuguggucgauuaguguccgauuucuaacgagucagugagugggugauagugggcugcucuugcugcccgugggcucugacuuccaauagacagauugagguugggcuuccuuuucuugagugaagugugaagggagcagaaauguuucacauuucagaguuuuuugauuguagaauguuugcauagcuccuuuuguuugagcauccuuuaaucuaaaaauucaacauccuaaaauuuaaaauguauaaacuuucugcauuguuguggacuugggguugugaauuagggaugcucaucuuguauaaccagauuuucugaucucauacauuagagcuugauaaauuuaguauaugagguguaauuaucuucuuuccaccuaccuucagauugguaauuauuuuuccccaauuuacuagcucaucuaaucaaaagcaacaguguucucuguuuacccagaacuuaagauuugaaaacuuaaaugcaauuacauuuuacacaguucguugccagggaagaaguaggcuuccugggccauuucaguuauuuuguuuuaaaaaaaaaaucaguuuuuuauaacccauuagauucaagugcuagguucuguacacuuggcuuugcccuuaguaaaacugagugcauuuaguuuugugacaguucccuuuccauacaguacuucauaauuguaacuuguuuuucaaaccacacugucccgugcccuggccucugaguacagucucuuuagacauugagcaguucuaacccucugucaauuucacuuucucuccucuaccguuacuauaguauuuuucuuacucauuggcucugauaguaagccuggcccucucugcaauugaugccuguauuauuuuauggauauccuuuaauaauucucuggugauuggguuguuagaauuauauacaaaacaucuuagauacaaacuaauagaaacuaagaaugcuguuuuguggaaagaucauuacuuauauuuuaaacuauuauuaguaacacuuuguuauucugagaaucaauaauucuuaguauguuaaugaugcaauaauuauuuaaaaugugagagauaccuuuuaaagauuuuagucuaguaaacacaagggcuuuuuaugguggccucgcaugggaacucugugguagaauucucagcaguuuuggugaguugagaauaauugacaguuugugugaauccuuuacagcugcaugcucucugcggguguagaagggaggaguguuugcuaggggcuggcccugugcucugcuuggguucacguguagaccgauuccugcugacuguguaaaugcagaaccauaugcuggucucuccuccugcuguucaucuuuuuucauccucuuuuucuuugucugcaggcccagacugaucuugcuuccuuggccuuuauacccuuggcuuuccuagacacugcccugugcugguggauauccuucucauuggcuuguuugguggccauucauuuucuccccuuggagaugggcuuccauuaaucuuucuguugauuucuccuuggucugggaaaugguuuauuuuauaugugaaugaccugagggcucagguaagcaguuccguuuguuuuuguuuugucguucuuaaaaucacagaauuugguugcuaagcacaugauaaaaaugucugcccucucuuuuuaaaauggaccuugcuuuuggguuuguucuuuguguuagaaucauuggcugcucagaucuugcucuuacuucuagucucuagcaauuaggaaauucuuugacacccgugaaaagaauuugauuccuaagauguguuuaggaacuguuuaagaggguugauccucccugucucauaacuaggaaggcagguuucagccccugaagggugaguuuguucuuuuaccugccuaucacucuucagaacaaauguugauccagucacaaagugacagcagauaagcagguuucuauuccuguuccuuaaacaucuguguaguagggaguugaccucauggguucagguuuuuggaauuuaucuuauaugguauuuuaaguuugguuugucuucauauguaugaacauauaugugcaaucaugcaucauuuucauccugauagguugugaugguuguaaaaaagcauaauaggaguggggugauggugguugcacauuuuuaaucccagcacuugggaggcagaggcaggcagauuucugaguuccaggccagccuggucuacagaaugaacuccaagacagccagggcuauacagagaaacccugucucaaagaaaaaaaaagauaauaauaaaauuauaauuuuucaaauuuuaguagauugccauauagcaaaaaagacugaaaaaucaggugucuggguccagaucaguaucugcuaaguaccaugauccuugaguucugggagagggagaauaaggugggcuuagcaucugggagagcucugacaggcacagugagcuccagcucccuucauuuuucuuaauuuuuuuuucucgauuuuagucuaagcugggcauugguggcacacgccuuuaaucccagcacuuggaaggcagaggcaggcggauuucugaguucaaggccagccuggucuacaaagugaguuccaggacagccaggacuauacagagaaacccugucuugaaaaaaaucaaacaaaaaaagauuuaaauuuuaauugugaguauauguaugcauugugcacaugagugcauugucugcagaggccaaaaaagggaugcuagauccccuugaucuggaguugccagcuguugugagcugccugaugugagagcugggaauccuagcccugguugucugcuagagcacuauguaauccuaacugcugagccagcucuccaggcccuuuguaauuuauuuuuaaaauuuuauuuguggagguggggaaugcaugcuauagugcacauaugaaggccagaggaugucuuccuaggaaguucuguccuucaccuccccucauaggacuucuggggauggaacucagcuugucaggcuggauugcuggguggcaagcaucucuacagcugagccuucucagccccagugccuucauuuuucugauugcaccucugauacuuaggcaugagagcagcgucaucugugguacucaucuuuugucuucuucccauaggagcuccuacuugggacuaaaguucuuaaaaugaagccucucugcuuugguagcugaauggccugggauccucagacaguuguuggguccucuuacguagcucacaguagugugggcagcugguguggugcuacuuguggacugaguauaggacucuagaaagcugugggcacaauugugaucaugauuagcuacaguggauuagcugggucggaggagcacagaaauacccacuuaaaccaaugguggugaccuacccugugcauguuacccacuuuaucaucuccauggugucuuucaucguuuacaguuucucuagcaagccuauauuuuuccuuguuuccauguauuuuuccucuuacuucuucauucucuaauuuuuugucuuacugaaauaauuauuuucuuauuaagcauggugagguugugguauuugugagaauaagugaaaauaagagcuguaagucucuaggucuguaacuuuacaaguaugcuccuagauccuaaaccagaggauuaauguacuuaccauuuucaauguucaauuccuugacuugcaaacacauauucauuagcuuaacucaaaccaugaagcuauuaaaacuucggaggaacauuguaaagcucucuuuguaccgacauuucaccaauacgcuuaucuuggcaguggcagguaaguuuggaauguuuuaaaugucacaucaugauccugugguuucuuuuagaacagaaauuauuuuuauuuguuauuuguaugguguuuugucugcgcaugucugugcaccacaucuguaccugaugcagagccagaagaggguauggaauccccaguaauuggaguucuguacaguugaguggugggugcuagcaacugaaccuggguucucugaaaaagcagccagugcucuuaacugcuaagccacaauagaaauucuuagccugagcgguccauugguuguuagagaaagucuuguuuuccguucaaggaaagcagucauaguucugguacuuuaaaauauuuaugaucuuuuuuuaaaaaaagauuaagaguaggagagaggucucugccaaaugcuuucuguguaagugugaggacaaauuuggaucccgguccucauaugcagaagccaggugugggguuagggaggugguuuaguagauaaaguacugccauacaaacaugaagaccuuaguucagauccccaggacccauguaaagagccagucauggugguaguccuaaugcuaggaaaguggaaacaggagaguuccugaagcccguugcucaguuagucuucccuaauuggucaucugugaggcuauccaaucauugagcuccaauuucagugagagauacuuccucaaacaguaaguuagaggaggaaaaaauuacauugaugaugaugauaaaagccauauauucuauuagcuauuguucuaauuccuaggguuucugaagcagccagaugauaaagacauaaugauugcaaaacuguauuuacagacaauguuagcaauaguauguauuaugggccuugcugaugguagguguuuaauaaauuuauauuaaaaauaacuaagugauuguaguguuuuguggucaggaauauggaauuguuuuauccaagaucagugaaucuaauugggguguaaacugccauucauguucugaccagguuuuucauuuccugcuagcgucuauuguguucaucaucuggacgaccaugaaguucagaauagugacuugccagucgguaaguuauaaacacauccaauagugagugaucauguugaugauacuauaguccaugauucuuagaaggugugagaguuuagggcuuggauucuacuccuacauagucugugcuaggacuguuuguuuguguguuuguuuauuuauugguccuagggauugaacccaggcccuuuuguauucuaggcaggagcuuugccacuaagccauacccccaaucucuauugauauguuuuauaugaccaugcuuaucauagaagagaauuuuguggaugguacccacagccugucauauugcaagcuugccuuaauucaaacucucaggcagugcugagcaccaugugagagugaugcaaaucggaguaaagcugugaucuuuaaguccagacagacacugugggcuguaggauuucuguggacauaggcagugcccucuuuuggucacacugauaaacgacaaaagacaauuauaaaauuggcaauaggaccaggcacguuggcauacacuuuuaaucccagcaggggauuagaaauuuaguuuaccgggcgugguggcguacgccuuuaaucccagcacucgggaggcggaggcagguggauuucugaguucgaggccagccuggucuacaaagugaguuccaggacagccagggcuauacagagaaacccugucucaaaaaaaagaaaaaagaaaaaaaaaaaaaagaaaaaaagaaauuuagcuuaaacugggugucauggugcauaccuuuauuuucagcacuuaggauucagagacaggcagauauaugaguuagagaccagccugguuccucauauauauuauaauuuaaaaauuagcauccaaauguugcuuucccugaggauucugggagcugugcaucuugacagguacucugugcaguguguuggcaccuuugcucuagccacaguaaguaugacaaaguaagaaacuacuuuuuucccaaguugauagucccgguacuugccuggugucuagcacaguagccuuugguaaacacagcuucaguguauaaauaaggguugcgaacagugauagucuacauacgguggugugcauuucccucuuuugcaggacuggcgagagcuguggguagaugaugccauuuggagauugcuguuuuccaugauccucuuugucaucaugauucuuuggcggccaucagcaaauaaccagagguacuuggacucuuuugcuuuauccugcugccagaaugaccccugucagauagggguggccuaugagggaagcugucaggacuguguugcauaguggagauggguagacacacuucuucgcgucuucuguuaccuugcuuuguaguucuugaaaggagcaguaggcacaagacaucccaagaccaaguucucagaacaaaggagauuuauuugccccagagggacacagggcagggaauaagagacaaagacagaagauggggcggggaggggugggggucggagaaggauaagggaacaaaggagaaaggaacaaggauauuuuuccuggaggacugcgccuguauagagaagagacagguguggcucauaggaaaauaguaguauauaaaggucaaagaggaaaccccauguuaggauguuuuugguuuuuuuuuuuuuuuuuuuuugauuggacagauuaauuaggguagccacaagggagcuuuugauugcuggacuucaguacuuugauagccagaccuugguaguuagcuucaggaggaggaaguagccaaauaagggacuagaacuugguuacuagcaguaggaaugcagucuaacgguguuauuaaggaagagggaaggccagccagagccauguuugucaugcucuggccuacuagagcucuucaggucuggcauccugucucucuuaugucugugagccuuaguuuccuguuuuguaguuacuuaggucuguuucaacucugacagcaucuuagacuacaaaugauugguuuagguaaauacaagagaaaauaguugagaaucucucuguaggccuugucuagcuuauggugaugauggggugagaugaaagucuguuacugucucuggaguucaggucaucauuuaaugguauuuguuuagugcaggaaaauucuggcuaggagcugccccguccucaucagcacccacaccuguguucccguucuuucccccccucucauauuuagaugauuaagagcuuauguuaaaccacauaacccaaaagggggagaguuaaaaacuuaauaaucagauaugcaaauaaaaacugggaaagaaaacaagugaaaguagcuuugcuguguuuuuaaaguacgcucuuacuguguucacucagaaaaaaaagugaaguaauagagaaaauaaaaggaagcugaaaaaauacugguagggaggaauguauagcuuugggggccucuauuauaucuguccuuaguuuguuacucauuagcucuaauuagguuuaaagguuuccuuuccuuugucuuuaaagguuuccgcauuacugucuugcuuucuuuucccaacauugccugcauucuuuauaacuucauguuaauugcuuaguuaugcuaaugguguuaaauauaagaagaauuaaaccuaauauaggguauaauaaugcccuguauaucgaugauguacuccaauauccccuuguccuguuccuccccacccuguugugugacagaauuuuuccuuggaaaacacaucuacccaccccagauaggaagcaacagaccaaaguacagaugcuacaaaaccacuuuggugaaccaaugaguuuuauugggguuauuuacaagaaucugagugaaggguuacagaacccuuacuuacagaagcagaaaugauucaaagacagcuguaucaccaaagccacccagcauggguggcagcucacaaagcuggggaccuggagcacacugcacagccugcagguagcuccacggguugaagaguguccuuuccaugugguucaguugcucuaacccucuucuaggcagcuggucuggucucagaaucuuugucccuuaccuuaucugagagucuucuuuuguagcuuggcugaaucuuuuuugcagcucagcuuucaauaucugagcgggacucuaagguuuuauugcuuacuuuggcaggaaggguuuuagugaaucugauugguuucaggaacuuguagaagcuauucuguguuguuuccuuccuguuuaaggaacuucccuacagaauagaauguuucacucuuugaggaaacuauuaaacaacaccccgcacacuguuuccuucauuccacagcuuucuaaauuauauguauuuuauucauuuauuaguuaauaucugcucuaucauuccauaccccaaacaaacacccaaauaugacccugcacuagcaaagaacucuucuacuuuuaccagagaaagucaagcuccagaguguggaagaagagcccagagaagauugggccagucuccugcucacugcaaacuuacugcuuauugcaagccugccaucuuucacagguuuaguaauuuacuagauagacaaacaaaggucagugcagagaguaggcucuuguuugcuguuuauuucaaagaaagaauaaaagcuaucauaagccaagaaaagagagucagagugcugagucuggagggaaccacaccaaagcuucuaguugugucugcaguguccccggcaguacugcuuuccuguggucaaauacaucacugccaagucuugccagcuucggaaaccugaacccagauuuucuguugggauucaauuacauacagcgguguggcugaccuuacacuuaacauccuuccugguagucaggauaauaccuuuaguuuccauuuccuagauaggucagaaguaacauggauauuaguucucauaugacauggccugcaacccacuuuuacagaccacacucuuuagagccuagaggaaacacaccuuuaaaaccagcacucaagagguagggacaugcagaucucugaguuugaggucagccuggucuacaguguaaguuccaguuauagccagggcuacacagacaaacccuguuuugaaaaaaaacaaaacaaaaauaagggccuucugaaggcauggagaugacagacacagaaguaccaugaauauaccuagcauauaacaaccagguugugguagggauaucuuuaaauaagaaacuaaucugucuucuaaaaccauugcagucccagguccauggagaggacccauuaguaaagacuccuguuaccacugugccugacaaccugagcucaguucccaugauucauaagaugugacuccuguacuuuguccucugaccuucauguguuacuacacuuuaccugcacacgcacacacauacacacaaaugaaugaaaaaccauuauauaauguuuucauaguuuuugaugcuguaacucauuuaacccuuuaugagacuugauaauuaaaagauaauugugcauacucuguaguauaaaaauaauguggcuacuaguaaacccauuucuuccuuaggcagccuuuuggcauaauuguuacaccuuaaggacucuuuaacucaccucuagucgcauugguuaucaaaaucuauguuauaauuagauuuuguaguaucuuguauuaaacuaugguuaugcuagauuuaagguaguugcucuccuuuuugggugguaguacuacggguugaaccuagagccuuauguagucuuccuuggcgauaaucucugcuuuacuuuucauucuuaaauuguuaugugggcuugaccuuauuuguuaacauuaaguagugucugugagaggagaccucugucuuacucugacuucagaugcuuuucaaacaccagcugugaucuuuaccaguuaaguuagccacgagagauuugaaacaaaugaaaauguuauuguagauaacaauaaagugugaagugccgagugaggucaagccuucuggggcagccaagucccauggcaguacugaggggaagguauccacgggaagguugacuaggccuuagccaucucaugugcagacugagauuuuuuuuuuuuuuuuuuuaauaggauguucaaguaggcuucauuuuagggauuuagguauggaucauuauaggaacauccaccaacucaauccaaaacaaaaaacaaacaaacaaacaaacaaacaaaaaaaacacugaaaaaaaaacacugaauaaaaaaaacccauuaucaucuuauuggaugcugaaaaacccuacacaacuucuuguuaaauguccuccagaguagaaggauacaagauacauucccaagcauaauaaaagcaauaaacaccaagccaauugacagcaucaaaucaauaagcaacaggauacauaaagggggucaagggaaugcaaaugggaaagaagaagucaaaggagaguaucuguaagugaugccagagggucuaccaugcuggucucuuuauaaccacugcuaauuuuuuuuuuuuaauuuauuacguauuuuccucaaugacauuuccaaugcuaucccaaaagucccccaaccccccccccccacuucccuagccacccauucccauuuuuuuggcccuggcguuccccuguacuggggcauauaaaguuuguguguccgaugggccucucuuuccagugauggccgacuaggccaucuuuugauacauauguagcuagaaucaagagcucuggaguacugguuaguucauaauguugcaccuacaggguugcagaucucuuuagcuccuuggauacuuacuuuagcuccuccauugggggcccugugauccauccaauagcugacugugagcauccacuuauguguuugcuaggccccugccuagucucacaagagacagcuauaucuggguccuuucagcaaaaucuugcuaguguaugcaguggugucaguguuuggaagcugauuauggggugaaucccuagauaaggcagucucuagaugguccauccuuuugucucagcuccaaacuuugucucuauaacuccuuccauggguguuuuguucccaauucuaagaagggguacaguguccacacuuuggucuucauucuucuagaguuucaugcauuuggcaaauuguaucuuauaucuuggguauacuaaguuuugggcuaauauccacuuaucagugaguacauauugugugaguuccuuugugacugaguuaccucgcucaggaugaugcccugcagguccauccauuugccuaggaauuucauaaauucauuuuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccucagacugagauuuuaaaauaccuacagcauuuaaaguuaggccuuggcuuuugguuuuugguuguuguuugguugguuuuuuuuuuuuuuuaacucgaaggccacaguuuuaaauuagaguuauuuucuuuugugugauauuugucuuugaaauauaucagguguuguuuuaaguacuucauagugaguugauuuuguggagguuuuuauuguuuaauaaaagacagggucugugucauccagacuagacuggcuuugaacucguauucagccuccgccuccgccgccucccucuugcugggucacaacugggccgcucacccugcuugacucuacuucuuggaaaauacuacggaguguucugacuguuguucucuugucuccauuuguacaugaggacauuaaguaacuugucuaaagucacaguaguguguggcccgagcuguccugcuacucggcuggugauacaggcauuuaaggacuucgugaaagggaggaagcauugcaauugcacuuccaacagaaguucugugauguuccaagagagacugcucccuuguggacuccuucuguuccuguuuugucagguuugccuucucaccguugucagaggaagaugaggaggaugagcagaaggagccgaugcugaaggaaagcuuuggugagcuuugaagaaaacucacuguucugauuugugcuucuaguauuuuuuuuccaagaaaauaauuuuaaaagaaaaaaaaaccccaaaaaccaugaguuaaucuguuugguaaaguuaggaugaggagagaauagcaagguuuaaagaugaaccauagcuggaccguuugauccuuuaauaccuuuaaucccagcacucgggaggcagaggcagguggauuucugaguucgaggccagccuggucuacagagugaguuccaggacagccaggguuacacagaaaaacccugucucggaaaacaaaacaaaacuucagacaguaagcuuaaaucucugaauauguuuuugcuuuuguugccagugugaggagaguucaccaaucuaugaggggauuguuguuuuuucuuuccuuuugcagaaggaaugaaaaugagaaguaccaagcaggaaccaaaugggacuaguaaaguaaacaaagcaguaagugggcgcuucccuuccuuccuggucuuggccugggcugcggcccacaguggaaccuagcauggcagugaauuaggccugaaugaugauuuuaguaauacuacauuucuguguuccugcacauggaugugaguggaguaggcuaugugcugugccugugugcaggucaggcgacaacuuucaagaguugacucuccgcuugccaccaugugaguucuagggauugaauccagaucuuccagcuuggcagcagcccccuugcugcccugcauuuaccuuuaccacaccuguacuuacccaaagcaguuacuguaaucacuagcaagacucuaaugacacuuuucacaaucuuuuuaaaaagcgacugcaguauuuguaagaacccacaaaaguaaaaguaaaacaccuaaguaguugaaguguucuugagaaaaagaacaaagcaaaagacaucacacuaauuuggcuucaaaauguggcacagugggacugaggaggcggcuuuccucuguggguaaagcaucucuguguaagcauauaagggccugaguacagauacccaggcccagcaucaaaugccccagguaccauguguaaccaagauuugggagguagagaaaggaacauccuuaguguuugcuggucagcccaucuagauaauaagaguucuccagagucagugagaaaacuugucucagaaaguaagguggguguaagauggcucagugauuaaacacuugugcugccaagccuaauggccugaguuuuaguagagaacuggcuccccuagauuuuucacacaacuauaaaugaauaaauaaauuuuuuaaaaggaagugaagaaugauugagaaaggcaaaugcuuauaucuagccugagugcacauauacucguacauaccugcauguaaugaacacauagauacuuauauguacacaaaguauuccacagagagcuagagccacaguucacaguagaggaugcccaacaugagucucagguauaaaucacagcauaacuaaauccaaccucuagagccauuguaaucaacugugaaccagcuggacauaguagagagcccaaaggguaaacuuacauacuucuggucaccugaauuuugacagagguacuaaggucacauaauaggaaaaggaaaguuuuuuguuuuccaaucaguaguguugaagaaacuggauuucuauucaaaaugaguuagaggcuguaggacuauaguucaauuguagaauaccagccucacaugaaugaggcccuagguucaaucccuaguacuguaaguagggugauuguagggguugcugauuaaggucuuaaauguaaggccugaaacuguaaaacucagagaagaaaaccagagagacacugcaucauacuguucugcauagagcuuuuaaaauuuguaucaagcaguccaggccucagucaacaauaagagucaucauacagaguugccucaaaccaaaaaggugcuguauggcagagcagucagcaggagugaguagacaacuaccucaugagaaaaaacauggcuaauauguauaaggaacucaaaauaagucaguagcagaaaaacaugcugauucaaaaggggucuucaauagaaauccucacaggacgucauuacaaauguaauguauuuuaaaaaugcucaccacagauaaucaagaaaugcaaaauaaauccacaaugaggugucuguccccucuguacccugcucaguauggguuagugagaaaucaaagugaagcugcuuauucuguuaccccguaauccugauauugggcaugcaagucuguguguggaaaagaugccugcauuuccaggccaacuguugcagccucaauagcaaagauacuucaguuaaauuuuacucaaugaccuggguaugauugagccuuuaauuccagcacacaggaaucagaggcaggcaaaucucucaguuaaaggccagcuagccaggguuacacagagaaaccccauguuuaaaauccugacauuuuuaggaacugguaaacuaggagacaguuucuuaaauaugccaagcccagaaaaacaauuguugcaugaucucuuauuugugaacuguaguaauguugaagucacaggaaaagacuaagugguaguuaggaugggggcuuguaggcauaauguuacugugcacuguguaaagaucauccguguguuauucaaacauugaguucugagaaucuccugucucaauguuggguaaacauugcucuccaauuauucccugugauuggucaauaaagagcugagcauccaaugacugaucagggaagagaaauggcuggacuuucucccagccaggggagaggacaggaagggagaugguccaggagacaucaugagaaaacaaguggaacagaaaaagcuauagaaugcaaauaucucaggaauuauuagaagauucagauagauuaauacugguccguuguugggccuuaaagcuguuaaaugaauaaaacaguccagucuccauuauuugggaacuagccagguuaagagaacacuguaacauuuauaaauuaacacuaaugggauacuagggagauguuagccaaagguauuugaagaagagaguugaauagaauuuucugucagccucauuuguuauguaugugugcuauggaggauaacgaaaggcugcuaaaagaauaaaggucuuaggaguucagaucuauucucgagacaaauuauuuauugguauguuuuaguaauagcugauauguauauguucccagcaggaagaugauuugaaauggguagaagaaaaugucccuucuucugugacugauguguaaguuuuugaauuauuaccuuaagaauccuguuucgguguuaguauuacuuuauuauuguuuucagugggaaacugaggagaaguguggugagaauaugaaguaucaaggaaugguuaaaauauuaggagcaacauaaaaccaaaaauaauuaggacuacucacuugcaugauauuucuguuuagaaugauuuagcucuaggucagucuaaaguccauuggcuaguucuuuuuaaauuucugaauuccuuccuggaucuuuaauguuaaugagacauugaccccgccacucugugggguauguuuuacucuuucuuuauaacuugaauaauucugauuauuuuuuaauuuguuuguaucuuaaaagagauacaaaucuuagcuaaguuguaaaaaagcuuuaaguuucgcucguuaucuauuguccuucaugaacaguuugugaccuuauuuaauaucauguuucucugcagagcacuuccggccuugcuggacucagacgagguuagugaucaaaucauggacuuuaucucauuugaucugguaacuaaauagccacucaugaauuccccauugacgaagaaucuugacugcccaacaacugaccaguguggacugguuuggcugaaaaagacaggaaugggcauacaaagauuccuuucuguauaucuuuguguacauagucucuuuuccagaguuacauggucagacuuacaaauuagaaguuaugaauuagaaguuaguaacaaacuagguguggugacgcaugccuuuaaucccagaggcagacagaucucugaguuugagaccauccuggucuacagagugagucuaagacagccagggcuacacagaaaaaccuugucuugaaaaaaaaacaaacaaaaaaaguugggaaacagacacugaacucuguacuuuguaguuauuuugucuuuaagaaauucaacuguauccuacucuaaucuuggaaagcuaggaauaggguugagaaaggacuacaguaaaucagaacaaaguuauugcaaguuaucuguuacuaaauuuagcacuucugugcuucuguucuguaaaaugguauuauaauuaguaucucuaauauuuaugaugauuuaaaucuguuuuuacccccuuuaaauuuugguuuuuaaauuuuacuuuuguguguggguguuuugccugcauguguguuuucaccacuuguauaucuggugcccucagaauccagaagaagauauuggauccccuagaacuggaguuacaagugguuguuagucagcacgugggugcugggaauugaaucaggucuucugaaagagcugccaguucucuuccugcugaaccuuuugacuaaguuuuuagucuuacuguggcuccauauaguccauugagaagcauucacauguugucuuauuguugccuaggcuuauggaacugacuauaacaucuuuugaauguguuaggguguucugaucauuguaacaaagugucuuaggaacauuuuaccagauucugacucuuuguugauuucucacuggccugcuuuauggcacuauaaaaaaugucaaauccuaaaauguuaaguccauuaaaacagugaaaacuguaccuuuccaaucugaauugcucuaccccacacuuugauuucuggguuccuuuuuuuuuuuuuuuaaauuaaaaaaaauuuuuuauuauaccuuuuuuuauuagguauuuucuuuauuuaccuuucaaaucuuaucuccuuuccuaguuuccccuccgaaaauccccuguccccuccuuccucccgcugcuucccaacccauccaccacucccacuuccuagcccuggcauuucccuauacuagggaccaagggcacaaccugcauaggaccaggggucucuccucccauugaugaccgacuaggccauccucugcugcauaugcagcaagagccaccagucccaccauguguuuucuuugauuggugguuuagucccaggaagcucugagaauacugguuaguucauauuguuguuccucuuauaggguugcagaccucuucagcucuagcuccuccauuggggacccugugcucaguccaguggaugacugugaacauccacuucuauauuugucaggcacuggcagagcugcucaguagacagcuauaucaggcuccuguuagcaaagcucuuguuggcauccacaauagugucugguuuugguggcuguuuaugggauggauccccagguggggcagucucuggcuggguuccauucuuaagauaccugggucucucuugaggucuuccucugcuucguguuugccaucaguggccuccuuaggccucagcucucuagcugcacuguguuccaugggcuaccacguguggcauucgugguuacugcagugcuuugggacauugguuucacccuucaacauuugccuguguggaaauacugcaaguaaacauaauggcuaccauggugcgcuuuaugugguaagaaacacaaaauuuagcauccuuacguuuuuuguuuuucuuuuucuuuuucaagacaggguuucucuguguagccucggcuguccuggaacucacuuauaaagugagaccaagcugggcucaaaaguuaaggaugcaccugucccugcccauuaagggcugggauuaaaagugugcaccaguaugcccgcaacguugccauuuuauuuuuaauuuuauuuauucauucauuuauuuauuuauucauuuauuuauuuauuuauuuauuuauuuauuuuugguuuuucaagacaguguuucucuguauagcccuggcugcccuggaacucgcuuuguagaccaggcuggccucaaacucagaaauccaccugccucugccuccugagugcugggauuaaagucgugcgccaccacgcccagcucuuauuuuuuuuauaguguacaguguauguguguguguguguguguguguagaggccagcggaucuauuuuguugucuuccucugugugucuuaucauauuuuuuaaacaauuuuucucauugaaucucaucgcagcaugauauuucugacuagcugggcaguaugccccugaguugguuacuauugcaccuuuuuauuuuuguauaagcacuuuucugcacauauguaaguacaucauguuuaugucugguaccugaggccagaagguacacagccagacucauacaccagaguucaguuaaaauaagauuuucacagaucuacgguacagcacugugcuugcauguaacaguauuguacacuaaaagccuguaagcauguugaauuuccuucugagauguaguugagucauuuaaccucagauggggccuguaauguuuuagaauuaccauagauauacuguuauaaacauuuaacauagaaagguauuugugaaaaagaauuguuugagccauuuauauagaauuuuuuuggaauuuagaccuuuuuaaguuauguacuuaaaauaaaucuuuuccuccuuaggaacgaaugaucacacacuuugaaaggucaaagauggaguaaauaaugggaaacugccauagaagauggcuuguaucagggaagagacagcuugcgugucagucuucugcacugcuccgugggauuaaaggaggcaaugacaucuguuccugaucucugugcaugggagcuggggagaggugucagccaaggagagcagcuuacugaaacauauccacgggaugagaaaaaccuaccggcuucuuuacaucaucgacacccuuucccucccaaccccaucaacagcuguuuuugcaagcuacauguugucccugaacuuucuauuccauuguuuaaucugucaaacuaggaaguuuaaaguuuaugaaaggacugugucauuuacaccauaauuugucaucucuaggagcaacugccugugauuuuauuuauuuaggaaguugguaaugggagaaauuaucauuuauuuuugaguuuccugagaagucaagauuacaucuugcagaaguaguuuguggggaauaggcccuuuugaguuaaggaacuauagaucuaucagugaccaagagggaauggggugggcagaaagcgagagaaacuuacaugugauucaaaaucaagugcaauuuuguuuacaaaugguguauauuaaagauuuuucuauuucagaugugcuuuaaagagaaauacuaacucuucugacaucugauauuaugacacaucccauugcuggcaauguggugcacacuccaaaacuuuuaaguaccauuuagucagccuccaagggcagcauugcagucacaggccaugcuugguuucccuucaugccauucuuugggauuacaccagaugccaagaggcacucuguguacgugcugugauuauucgcccugcaagagggauuaucaugcuucagaaggggagcuuacagagaggggacaggucccguugcuuuacaagcagguauucuugcaugaagugguauggaggcccuagacugcugcugcugcuuuuuuuuuuuuuuuuuuuuuuuuuuuuuuuuuuuuuacagauugaggguucuaguuucugauguuggcuuggagacggccuauaacaucaccagggauggguucacuugaagcacuguauuucaguuuugaucguuuuauccaguuuugccuucccuaaauuuuuguucuacaugaaaaguucaugccacuuuuuaauauaaaaauuuuaacaaaacuagugucucucucauuuauuucaaauuuucccuucacacccuucuuucagacccuaguagagacuuucuuuccaugacuuuuacuacagauuaucuuauuuucuguugaaacauaugacacaccagaggagggcaccagaucucauuauagauggcugugagccaccaugugguugcugggaacugaacucaggaccucuggaagagcagucagugcucuua

SEQ ID NO: 1021 - RNA, 879 nt, Mus musculus
gaggaggaggaggaggagaacaaucuucccuuuuuagaaauccggacacaggccuuggcaguugcggaagcagacuguaaaccccacgagagccucaccucuuccccccuccccaguuggaaggggcaaacacacccacagcagcaaugguggcagcugcaguuuccaagcccaugggcuaagucacgcccaucagcagccaacagacagcacucuugauuucauucagugucugcuucguuuuaaauuuuuuuguuuuuguuuuguuuguuuguuuuucgagacaggguuucucuguguagcccuggcuguccuggaacucacucuguagaccaggcuggccuugaacucagaaauccgccugccucugccucccgagugcugggauuaaaggaggcgugcaccaccacacccggcaauuuuuuaaaaaacuuuuaaacucauuaaagauucaguguuuugauuuuuaauguuguucuucacagcuucaagaaaccuuguuauuccugugaaguguucugugcuagcuaguuuuaugucagcuugacacaguaaaguuaucugaaaggagggagccucaacugagaaaaaugccuccauaagaugugauuguagggcauuuucuaaauuagugauugaggggggagggcccagaccaucguggguggggccaucgcugggcugaugauacuggguucuauaagaaagcuggcugagcaagccaugaagagcaagccaguaagcagcaccccuccauggccucugcaucaucuccugccuccagguuccugcucuguuugaguuucugcccugaguucccucagugaugggccguuccuuaccuggaagugugaccugaaauaaacacuuugcugccca

SEQ ID NO: 1022 - RNA, 59367 nt, Mus musculus
gccugaaccagacugaccucauguuaagagcaacuaggauuucaucucaacacaacacagcuagagccaucuaccacaaaagacccaguaggugcaucuccaccaaaccuagggggcuccuggucauguuccuucuccauuuugcaccaacucuuggugcacagccugaugccaccugaagugucuggcuugcugagaggucuguagauucugaaacugucuacuuagcuuguacuggguuguccauagcaccuguagauggcucucacucacggaggagcccagucgccaucugcacucaguucugccacuuuuagggugggucuauucuggggucaauagggcguggauaucugacaaaaauguggcuacauucugaaagaagcuaucuaaauaaaggcacacacauggcuaguuccaccauucuccuuauuagcauuucucagccacaggaggacugaguaucuuccagucauauuucaugcaucaccuccacaaagaucucguuuggggauagggagauaguugauacaggucuacgcaaccacgaggagcccagugguagcuuacaccuguaacuacaguaauggagaacaaugacaaggggaauucugcaggcccacuggccagucaagccaaaaggaugagguuugguacaagagagccuggauacgguggagggacugaggagcaauggcuuacgggguaaaauugcuguguuuggauccccagggcccacacaaauguaaauacuuguuggaguaaucacccaccuguacuuccaucccaagggggccagagaaagauuacugacaaaaagccaauuagcuagacuagcugaccuggcaagcucuggguucaauggagagaccuggccucaguguggaaggcagaagguaacaucaaccugaccuccacaagcaugcacacaaacauaaaggaaauauccaagucuaucugaccucugcuccugcgcacaucacaaagaaaacccuuuuggccuaugcacauaccugguccugucagguauugaaaggguucggucugguuaguguuggcauauuucuucuuuaauuuuuuuggguuucuauaucucucccucccauccaacucuuauuccacccucguuccuuccaauccaccaacauuagauaggagauaaagguaagaggggaaagagggcauagaccucuuuagacucguuccugcugauuagggguguuggguuccuuggggcaaguccaaucuucaucaacaguauauuuccugucucuuuguccaugacuugacaaaccccaagaaccaggaacagcaaggggaagcugcagcuuccaugggcccuuucaggucuguuccacuuauacccucuccagaauuaaacuaucugcagcuggcaaagccacacgcuugcuagugcauggagcaaaucauaaucaccugcugugaaguagccucuuaucauacaacugggauuaaaauaaaagcauaaaccggucaugguggcacaugccuuuaaucccagcacucuggaggcagaggcaggcagauuucugaguuugaggccagccuggucaacaaagugaguuccaggacagccaggguuauacagagaaaaccugucucgaaaaacaaaacaacaacaaacaaaacaaaacaaaauuaaaaaaaaagcauauauacauaucauaacuggguuuuuuaagcaaccaaaguucucaccacagguuaguguauccaugggaaacaaagcccuaguuucuggauagaauaauggaaaauacaauuaaaaucaaagauugcuuguaauuuuguuuuauguguauggguguuuugccugcauggcuggugcccauuaaggucacauccaauuccuuagaagugggagcuaaugaugguugugagcaccaugugggugcugggagccccccagguccucuagaagagcagucucuaugucccugaccauccccccagcuucacuacuucuaguucuugagcacacugaccacccagaucuuguucaagaucacugguguagaacacacgaauggggguauauuaauuacuauguaugaaauugagaaauagacaaauuuaagaucaaauaaaugaaaacaggaagguccagcgaccagugugcaaugcagaugugauuuucuuuuucacccuagcuccucugcucccuggccuuucucacauuaaacaaacuacuuaaccucagauccgucaauggcacguaugcaacacauuguuuccuggccacuguuuuguucuuuauggccaaaugaaaaaggccaauucaugaauaugcagacaaauaacaaaaugaacacuuaguaaaaguauuuuauuuucuucuuguacuugcuuuauaucucacuuacaaaguuaugaaguucacagcuuuuauaccaaaauguaagaaggcuguuuagaaauaucuuugcagucaaaugucaccugacauuucuucuaauccauauugaaaaaccaagguucgggguagcucugggcaucuacuuccccccacagccuuuccuucuccacucucugcccccacugagcuacuccuggucugggcugagcuggucugggccagucugggccaugucccuggggcuggaguugaagcggagguaagugguagguuugguuuacagagguuuccuacccaucugcauauggaaccaggugagacccaccacagcuuccuccuuuccuuccuaucaggccaacucccucaaacccaaggcucucaaugauaggacaugggugaaaccaccacaaguauggcaagugcagucuuuauaguaauucuagaaccuuccuugaagcaacaggaacaaauuugcuaaguaaacguaugugaacuuaagcaaaccuacuuacuguucaaccccacuuuacaauauauuucaauuuccuccucaaugaauuaucuuccauagaaugcugugucauucuuuaagugugcaccuacacucagcaccucagccacaugcccauguccucaaguugugccaugauaaucuaccaggaaaacaaacaaacaaacaacaaaaaaaccccaacaacaaaaccuuugcuggcaacaaucacuucaaccauaaaaguguagccucagacuguuauguguucaugaauucaaaccuccaacugcaaccucucccaggaaaaucauuuucuucacgacagcaacgaguguaauaaugcuaaccaugacgucucaagcucaugucaggacauguuuuugcuccuuuuugcuccuuuugcuccuguauacagacuagcagaaugugucaaaauguguuuugaaccuaguaaaaacuuucaaaauaauugaaagugccugguauuuuauuagaacugaaaauauacacaagagauuuuuaaaagauuuucuuugcuuugagcuguugcaaucagcauaaagaauuuuuuuaaauaugaacauuaaaaaccuuuaaguaacuuguaagaacugucuugcauuuugucagguauuaguuacuuuccucccuucaacaaagucaaacaaaugucagcaagacagagcugccccuucugagggcacuggaggcagauggugaacagacgucacggucgaccuaagaaguacgcacaguucucccuccuacaggcagcuccuguugaggagccaagacacucagggcucuucauuuucagaacacacugcaucuggggaacagugacccagugcccaaaacaaucccaccugugcuugaacucaucaucacacugcuuccgaaaaccccugcgaaacaaggaaagccaagugcaggugcccacaaugcuaccaagggaagcucagagcagucuguacuaauccucucagacugcaugcauguuccucaccacggucaacaccuuaccuccuucuuccuugcagcauaagguccuaccccuccucacuuugcauauucccuuuggugaacagggaacgugagcuuccuuagcauaccaacccagggaaugauccagggucagcauuaaacucguuaggaacuuuccuaagcaaucacuucccagaccacaaaagugugccuccucugcacacccuuacaggaaguggaggggagaggugggaaaggguuccuaaucucauaacuaugcugucaguaucuccucuguaucacacaaagguucucuucacaucuaagccacguggucaucaaaauuuuucccacacaauaggccacaugugaacagcuuguggccaugcaugagcuagugucagcuccuagauuaguuaacauuuucugaauccaguaagaacuacuggaaccuuuccuggaaagggggugcggggagggaggaccugccuacagccucuaucaauuccuaggagagucuauggggaggucugaucaggccagggacaaaaagaggccacaaucccaguagcagaaagugaggguauguggcaugaggguccacucgcucugaagaaucugagguuugaaaucuagaaacaaagcauuagauaguaaaacuuguucaguuuuacccacaagucuuuaagaaauccaagaacaaagccaucccacuaagauccacuaagauggguacucccaaugauagcuuucccuucaccacacuccacucuacggcuggcaugagcauggagacaggcaccggcuucacuagcucugccugccaccuaugccgaucaacugacucgagcugcuucucccagcucccucucuagggugccugcaguggguggaagcagccuggacgccuggccugccacugcucuaggcacagcaagacaguaggaacgaugggggcuggcaacggagcaacgcaaaaggugucaacucuucaugagguuccaagagccagagcuagaaagggaauaaagguuugugccuucuacucaagaagccaggaguguagacgcgcaggggacacccacugagcacucuggagugauuacugggaagugccgucuucagggacuucugaucauggacaaugucugaauucuaaaauacaguacgcagggcagccaggcacuucaggacacuacuguguuucccgucgcacucauagccagcuuuguccagcuacaucaauagugagacacugcacauaauuauuuuaaaaagaaaacuuuaaauuuaaauacccaguuauuucaaaaggaggaauuaaaacugaucucaaaaaaucuauuauaagccaucauaagaacauaaaacaaaaaucacaaacugaaucaauaaacuauauguaugauuagggucaaacuggguaacuaauuaaaaucugcaucuuuaauaaacaccuauaaacuagcagcacaaaccacuguaugucauuuguuccagaagaguagguuucuuagaaacugcuuaaaugucacuuacaggcucuagagcggaccugcguugugugugaccaaccuauccucagacugcucacacuuugcuaguggugggucuggcugugaaccauuuucucccucccagcuuuguuggaggacagauaggggccuggagaaggacagugaacggcccaugggagaauucuucacuaaggacuucccaacgugggaggcaaaaaacuucaugaaucuauuuugcugucaucuucagcguggcguucaauauguccugcaacguccuagggaacaaggagagaggggggucacaggucagaguuaaagcugaggagcacagcacugcaucgcauacacagugagggugggaggcucuggcaccucuuaaccaacaggaaaccauccccuuaaagaugacaucuccccuuugcacgagagcacaugugcuuauuaaaaacagcacaauuuuuuuuuuuuuuagaucuaauuuaauuaacccaaguuccugaguaauaaaauguaaaguuccuaggcacuccccguugacugcaauucugaccaccuuaggaaggcugggaagcaugguucucagggggucugcggagccagguggaccccacagaaauaccugcuuggauccuuuccuggcuguaaaaaaggcaucgcaguuccuccaucgacacuucagcgucuggaaguugggauugguguggucagucagcaaguguuguuucaagugauccacaacgccaaauaucagaguacagccauaccacugugagaaagaacagaugugcauggaggugagcagagcacagcgcgcgcccguguacacacacacacacacacacacacacacacacacacacacacgcacaugugcaaacacaagcaaccuucccucucaccauauuccucuggcuagccuaaacuuucuagguagaccaggcugaccuugagcucucagaauccagcugccucugcgaggauuaaagguccaggcuaccauccccaacuaaagcauacacuuuaucuuacaucauaaaauaaaauuuguugcauuuauuuuguaauccuuuuuaaaaaaugauagaccaguagcuuccccuuaauacugaaaagaauauauuuaacaauucuaagaaccaugaaauuaacuauacaaaacgauagaagcugaugaguggugcacaucugaaaucccagcauuugggagagagaagcaugaggaucaucaguucaagaccggcuuccgcuacauagugaacucccgggaagccagccagccugggcuacaggagaccugugucaagucuaacuuuaaaccucacaacuucuaucucuugaaucacaaucuuuuacuuaacugcuuaaaacaaaugcaacuuucugcaaacaaacaaacaaacaaaaaaagcaugugugugucuuaauuucacauaauuuucauaaagcacaaagacucuguuucuugcuuuuaaaccugcagucuuguagugaauguuaugauuucuaauuccaugauguucauuuauguuuuuaauuagcauguauuaaauaugcauaguggguuuuauuaugcuguucuccugauacugggaacugaaccuagggcuuuccacaugccaggcggaucacuucaccacugagccauggcccuccacuccuccuagcgauuacuaacugccuacagagccuuucggaagggugggacccuaagagcccuucccugggggauguucauuacuaaacaguaaugaaaauuugaguuuucuagucagauuacuuuaacuaccuuuguauuguagguacuuucccugaaacccuuauaaacaaaggcagugacuauauacaucuauacaucuauuaucuauuaucuauguaucuauaccuauauaucucaaagcugaaaauuaaugugccuacagacaagccuagacucaaauuugaaaaaaauauccaacauuaauucugguaaagggaucaggguuuggggaaaagaaacccagagcuaaacgucucgcuggucacuucuagcacuagaaccagcuaaaaacaaggccuauacagauggugcuuaaguuuugugggcuaauuauuagcuucuauucuuuaaaaaccacacaauuuagcccaguagacuaagacaaaauuagaaauuuaaaacugcaaguuucgguggcacacgccuuuaaucccagcacuugggaggcagaggcaggcgauuucugaguucaaggccagccuggucuacaaagugaguuccaggacagccagggcuauacagagaaacccugucucgaaaaaccaaaaaaaaaaaaaaaaaaaaaaaaaaagcaaguuuuuguucgccuauucaucagaaaccagcaaggacauaagucaagucuugaguacuuguaauaccagaggagggcugugcagacaggaaaggcuacaaaaauaagccccaccauuuacuuccuguacugauuuaaugaaacagaaaccaccuaggaggggagagacuucaguggcaaaggacuugcccaucaccugugaaguuuaacccuuaguacuacaaacaagacaaaacaacuccccgacuccucaaaacaaagcaaccaggggacaaagugagaagauacaauuuauauaucucauaucuaacuugagauuuuucaauaaagaagccaaaaagcauucuguguauucuuccaacaugaagcuugucugccauaaaguaaaagaauagguguaaggccaaucaugaaaugagaacguuacauugauugaugaucaagaggaucaacccagcccagaccaagcaacccucagggcuggugccaacagucccauucuuacccaacagcgguaauucugcaucagauugagccucacagccuggaugcugccaucauaacagccaguguaaaucuggaaaaagagguuugcuuaggguaucagacuaaauaaauauacacaaagaaaacagcuacaaaauacucuucacagaaauuuaaauaacauguaagaccuggucaaagccccucagagggucauccuugaccuguggcucacagcaaggauggcaggcuucaauguucccauguauucugcacugggacagugcugcuaacaaacugggagucuguuugcauugccaagaaagggcuucacuacucaagaucuugaaaacauccauccucauucgaccucacaauuaaaacccuaaguuaaacagggagccaggugggauggcuuuaaucccagcacugaggagagagaggcagguugaucucucugaguuugaagcuagccuggucugcacaaugaguucuaggccuaacaaggcuaccauuacacaguaaaaccuugucuaaaaacaaagaagaaaguuaaguagggucaggugaguugccucuaacuaugccacacuggccaaauauucugacuauguuuccaguguccuguucacagcaugucugcaaaagcaaguguuuuugguuuuuuguuuuuuuuuaaagcaucuaauugcaucuuccacuuagcuguaggaacagauuuuacugcacuuauuuuagcuauuaauggaaauagaauguucaacaacauuguuggguuacuccuuaacacaagcaaagcacucaguaaacaguaacggggcgcaucacaaucaaguugggaagauguuacuuaguagacacauuauuaucagcauauggaguucuaaguaaacacaaaggcaaagaaagacuugaaaagcaagcaauacccaccacacucuuauggauggucauacacauaaucaugucuuugugcccuccauaaacuugcagucgaucaugggacuuaagcagaagaaaaacaauuagagaaucaauuagucagcggaggacuugauaaagcuaccauuguagggaagacuggacagguuuuaaggggcuacagaugcucuccagaaagccuguaaguuuugucaaagaugacacuaagcucagcacuuggaaagagaaggcagugggucaggaguccaaagauucuuagcuacacagggcuacacaacccgucucaauuccuguccaccuagucacccaccacccauaagagaaagaaaggcaauacaaaaauauuaauuuugacaaccaggagcgugaucaaguaucucagagugguaucugagugcaguccuuggccuggcugcuuccuaaucaugguagaaggcuucuguaaauguggaucccaaucucacaccagcacaaucaccucaaagaaguuauacaaaguauguggaccuaauccuaccuguaacucauagacacgaacaaacuuguccaggcaagcagucaccaucacuuuccccagaauauucaccacagugacugcaugguuguggccuuuauagaugcgcacaagcuccccagucugcaucagaaaagaggaggcagucaacaggcugagcuuuaggauuccagccacaaucauugauugcaaaguucuaaggggagacucugagguaaacaaugcagcucuucuaaugcuaacagcucccgguuuuacucucaaggcaccauuagcugcacaaacauuacacauauccucagacuuuaacauuuauggacaaaccagguggcggagaggcacgccuuugaucccagcacuggggaggcagaggcagguggaugaaucugaguuccaggacagccugagcuacagacaguuuuuccaggauagccagggcuacacagagaaacccugucucaggaaaacaaaauaaaacagaacagaaaacauuuccugacuuuguguaucuguauaggcacacaugccacagcacacacucuggaggucagaggacaacuggaggucaguucucuccuucuaccaaauggguuaaggggaccgaacauaucucaucagguuuugugguaagcaccuucaccugcugaggcauucgccugcuccucucuuuuugaaguaugacuaucccugauccaaguaucagaaaugcuccagaaucuacaacuucagagcagaggcaucaaucgcaggugaaagcauaccaugugccaggucacagucaaaacuuagacacauuaaaaacagaauuaucuucaggcuauguauauaucaaauaacuuuuauauuuauacccaacauauuuauuuuauauaugcaaaugcaauauacaaacaaacaaucugaaauaagaaauaauagccaagcugcacucuauuaccauuucacuggucccaaguaacaugucaggauggcccaaagccaucuacagaccagcugcuugccucugagaccugagggucggcucgcaauaguuugaaucuguucuaauuuaaauacucgcuaagagccccaaguucaaaacaggcauucaaaugaaaccuuccauacaaucugagucuuucucugauuaguucuuuucgaugaggauaggauuuccagguuugaaaucacccaagagcacacacaugcacacggggcuuuacuagcuaaugagcgggucagauguaagaaccaagggucugaggaagccuccaagcuuuagacucccauguaaaacccuuccacugcagccgcacagcuuacauggauguugugagcaugcaccgacuggucgcuggagccacugaacacaaggucauucacuaccugaaagagaaauggcgcagucacuucugcggaaguucugucuccucuguaacuugaaaagcacacugguaaaugugaauuuccuuccuauuuugagaugaaugcaaacugcaugagauaauguuucccagacaauuuucuaacugaaaauacaugccuuaccacucaccagacacugaugaacuugccagggcauugcugaguucauggccuaugcaggacaacuaugaacuauccuagaagggcacagagugcggccacaauaaaauacauuugcuucuugcuagcuuugugcuuuaacccaggcacaaaggacuaugaucucccugacugugcucuuuacaggaugccuguucuaagccucaccgcacagcagcagaaacgccaucaaucccauccguucccucaccuucaugcacagaacagucuugcuguggcccuccaggguucggagcagcaguccguuccgugcaucacgaacacuaauggugcagucguaagauccuacaaccagcaguuuucgggcaccuuccugagcuguugcgaggcagcugacugcccgagggccauggcauucaaagaucuccugucgcuuguuguucugaaaaaacaacccaucauuccauaaaagcaauuuaaaaaaaaaaauucaaaaacagcuaacuaaaguggcuauaaacccucccaucuacugcccauccuaaaucccaaagguaugucagcuccaaccuucuuugcuguucaugacuucccuacccugaccuaguugggcaaacuacacggaaaauuauuuucuaccuuugaccugaacuguauugacccuaacaaccaccugacuccagcacagucucugccagacuuaggacucuuccacuguuauuuuucuuuucugaaaagggucuugcuaugcaacccagcugagucuugaaccauauagccaguccagacuacucucaaacacaggaauucuccugccucagucuucauacugcuggaagcaccaugccuauguucucauuguguuuuaucccccuaaaagauaugcuauauaucucaugacauuucaaaauuucucugcugagagguaccuguuuucuuaaacacauuuagauuuauuuuuauuuauuguauguguguacaugugggguacaccauuuauguauucagguuccaauggaggcuaugugaggguacuggcuccccuggcucuggaguuacuaguauugugagcagcaagaugagggaaaucugauccucccucucucucucuuuaauauuuauuuauuuauuauauauaaguacacuguagcugucuucagacacuccagaagacggcaucagauuuuguuacgggugguugugagccaccacgugguugcugggauuugaacucaggacccuuggaagagcagucggcacucuuaacugcugagccaucucaccagcccaaaucugagccucuuaaucaccuaguccucuuuccaauguaaagaagauuccaaacucucgggcaaagaucugaccaaccucugugggcauguggugcacaggcaaaacacucuuacacauaaaacaagagaaauuaaucuaaaacaaauaaguaaauuuaaauuuuccacauuuguguuacuuugaucuucugcuauacccucgccaccagaugugucuuagaagguguuuuaacagaagauagcagucuuccuaucagaauggaauguuuauaccauaaauucuaaaacacaugcucuaccucacacuuuaugcacgucuccccuaucucuucuccccugcuuucaaucuugcucacaaagcuucacauuucuucaaacauuuuuuaaaaagauauucuggguacauacaugaaguaaaacucccagaaacucagcagaaaguagcaguuggcagcugagcaaugacuucaagccaucuugacaugcuaagaacugucuggaguucagugucuagugauggacagagcuugcaagguaaacagucuaucuugaguacuauauucugcauucuagaacaucggccaaaaagagccagcccugauuugcaaaauucaugcaugcaaaaguuuucaaaucuguccucuacuucuugacuuucagccaucuaaaccuuucugccugacaucaaagucucuuugugaugucaaucucugacaacaauaccugcacaagagaaaaauauaacuauuaagcuuucguccuuauaaauagaauuguaauuugcccuuuuguuuuuauucauauugccuaauucaaucuaaucaggagacuggcacuucaauuaaaaaucugcacuuaucacaaguaucaauggaucaaaucacuugauuauacuagauauacuagagucuucaauuuuuauuugaaaaguuuccaaaaggccaaaacuaccuugcaugcuuuuccuuacacagucccagucagugcuguugcagaggagcccuggcacugaugggguguggagcuacagcagccacacuuccgaccccugccuccauggauagugcuccuauucccuucucucaucuucagccuguccuuucauguuagcugccacaaagccugcgacaaggugucccugauucuacuaguaagucuucuccaagcuugucaauguaccuucuaaaguagaaaugacaagucucuugaggcauaagcuugcuaccuauccuaucaggcaccaacaacuuaaccuuacucuguauagugguaguuuuauuuaucaacuagacacaaccuaggaucauaugggaaaaaaagucuuaaugagauuugucaauuugguuuguggauaauaugagagacuguccugaaugcacuaaguggggcagaaaggaggaugggggaaggacauggaccgcccaauguggguacaccauucccuggguuuagauccugacuguaagugugguaagggagccaaauacagaaaagcuugcauauacguauucacuucuuucuguucguugcuguggauaugacuggcugcuucaaguucuuucuuuccuugacuucuacuuaaugguguaacccugaauugucagccaaaucaaacaaacucuuuuugaguugcuuuuggcuggguauuuuaucacagcaacauaagcuaagaaacucugggauccaggauaggaagauggugaaaucugcucuccaaauaagguggaaaagaaugaggcugcauggcuguuaagggaaaccucaaaaugacuucaccuuacagaacaguccccaacuacagcaguguagucagggaagucacauucauucuccauggugucacucauaaaucagauggacugguuuaacauaugacucauuauuuggcccaaauaucaaggcuugguuuaauuuaguaaggcugcacuuugguccuagcauaugugagucugagcagacagaauaaaggacugaucucacuugcacaagagaguggguuuugaauaaaggcuaguucuguccuuccucacagacaggagaauuacuacacacuguuuccuaccggagacagagggcaggggaauccagccugcuuccccaaccacugaccuuuaugucgaaugugaccacagugccauuugcuaguccagcauagaggguucgccaucuauuaugaaggcagaggacacggucuuccagcuguaacuguuccauacacucucgggucugaaaagccaaaaccaaaaaauaaucccuuacuaacaaaggagaguggcaaugaguugugugaacaacuguuauucuaaacucuuaaaaugaugcugaaaagcacacaguagacuaucuuagguauguuuccucuuuaaagugugaggccaagaucacaggguggguacuaucaaaaagguaaacaaaaacaaaaaacaaaacaaacaaacaccccccccaaaacaaaccucuaaugauacugguauuucuaauuaaaaacaugaauucuuuuuuauuuauuuauuuuuauuucuuaugguuuuuucugagacaggguuucucugaguagcccuggcuguccuggaacucacuuuguagaccaggcuggccucgaacucagaaauccaccugccucugccucccgagugcugggauuaaaggcgugugcuaccaugcccggcuuacaugaauucuuuaaagggcuuuuuaaaugaagacagauaagcuuuagauagagcuguaccuggcaggcugaguacuggccuaguaggcauggaccccuggguccaguccccagcacaucacaaacagggugugaugacauaggccuguuucuuaguacuuggacagaggugguuuccuccucccaccacguggaucacauggaucuaaacuuuggcuaucaagccugacagcaagagucucucugcugagccaccuugugggccccguguucagcuuuuaaaaagugaguucugggaauaaaagguauucaaggcaagaacuuuaccaacugacuuauuucccuaugucccauaaaauuuaacuuuaaagaaauuaacaggggccagugagauagcucagcugauaaaggccuguaguccaaguucgauucuuuggaccauaaggcagaaagagaaaaaaaacuccucugaccucuacacacauguauauagauauacacacauacauacacaauguaaauagauaaauguaauuaaaaacauugucaggaggauuaauucuggcauaugacaugaaaguaagaccaauaggguaugcuguuacagcacaaaaucagcagauaauaaugaagaaacagaaaauaugauuuauacuaaaucucccaucuacccacgauuguaucagcaugcuaaacuauggcaaaaaugaggaagucaaacaaguaggaugaugauaaauauacaugaaagguuaauacacuugauuucucugcagccacucaccuuaauauuguagcagcggaugguguggucacuggaacccguguagaggacagaacucuucccagaggugugagugacaagaaggcaguucacuuuggaagugugucccucaaagacaccaacacacuuucgacucuaaggucaagcacaggucagauuaguacucccaaaauugggaaaauauggugguuugcauuagaaaugucaacagcuucuaaaaugucauggguauuugcauacucucaccaguuggugguacugucugggggaggguaggugguauagccuuguggacaaaguaugucagcaggggcaggcuuugauguuuaggauucacaguauuucuaguuuacucucugccccauuccugagguucaagaugggaggagcuucuuaaugcugccaccaugcccauugccagccacacaguucccaccauuauggacuacaacccucaggaacucuaagcccaaauaaacauuucuuucuagaagaugcccuggucauggcauuucaucauagcaauagaaauuagauaauaccuuuuauuauaauuauuaauaaaaaaaauguuauaacuuccagucuacugcuguauucacccaaauauguuacccagcacacaaugugugcuuaguaaauauuuguugugcacuaacugccaagcaaagucacauacagugagauaccuacaacuauauauuuacuaagcuacguccaaaaauacuauuaggucaaguuuuucuaagacaugggccaagagacuuagaaaaucuaggcugcugcugauugcccauagugguuauacauuugguuaccagcuuaugagaacacucacaacuuaaaugucaggugcuaucacugguccuaguggcuuaggaaugguuuccuaaaaacugucuuaaaugcuauaucuguguacauacaaaaucuauuuacaauguacauauauacauucauacauaggucucacaaccuggaaguuaagaccucauuuccuagauuuuuuuuuuuuuuuugagacauagucucauguagcuuaagcuguuuuuaagccuuuguaccagaggcuggcuuugaacuccugauccuccugccucuaccgccaccucccaagugauaggauuaaaggcauaugccaccacaccuagcucugcucuuguagaacauucgcucauacuuccauauaucacugcuuucuucugaggucauuuccaauacuucucauagcccuagaucacaaaccuguuaucaaccccuuaguuccucuuuuaacuuucuguauagaccuggcuguccuggaacucacuuugcagaccaggcuggccucgaacucagaaauucgccugccucugccuucugagugcugggauuaaaggcgugcgccaccaugcccagcucucauuuaacuuucaaguuuucauaccuuuaugguguugguucagucuugauuauaauuguggaagacaaaguuaguuuucacaucaauucuaaucuugaaaguguuucuugaagcaugaugagcaucacuuacauugaggggagacgugggaagggcuacuuucucuaagaaccuagauucuauaaucaccagcggaaaauuucuuucucuggcuggcgagauggcucagcgggcaagagcacugacugcucucccaaagguccuaaauucaaaucccagcaaccacaugauggcucacaaccacucguaauucuggugcaacugaagucaguuacaauguauuuauauguaauaauaaauaaaucuuugggccugagcaagcaggguugaccagagcgagcagagguccuaaaaauucaauuuccaacaaccauuugguacagcuacaguguacucacauacauaaaaauaaauaaauauuuaaaaauaaaaaauaaaaauucuuucucaaacacguugcaauagucacauccugcuuccucuauuauguagcagcuguaugacugaccccaucacuaacuucaaggcuggggccugacuguuccucaccuacuggauguugguucagagaauaaacugaaggacuuuuucucuggagagaggaagagacacuacagguuccucucagaaccacauuuaaggaaaaugugauguagaaggcagagcugaggaaaagaagccuacugcccaugcugacuggaggguccaccacauccagaucagccugaaccucuagggaagccaggacguucccuuucuguguguuaaagacaacauuagaccugccaccaaagguaaaauguuauacuuaccaccagauuauaaacccggacaguugugucugcugaacaaguauacaggaaguuuccaaauaucugaauugcauucacugcagccugguguccuucgaagcuuccuucuguaggcuccucaucaucucccggcucugaagauauuucuggaaaacacaaacagguuucagagacaugucugcugaggcacucaaaaccgucacaaccuuauagaggaccugaaguaaaucacucaacgguccucuuaaauucuaauuuccaagcagaaaguaagucacacuuuuuuaaaaaacuuuuuuauuagauauuuuccucauuuacauuucaaaugcuaacccaaaaguccccuauacccucccccccccugcuccccuacccacucacucccacuucuuggcccuggcguuccccuauauuggaauauaaaguuugcaagaccaagggggccucucuucccagugauggccgacuaggccaucaucugcuacauaugcagcuagagucaagagcuccggggguacugguuaguucauauuguugcuccuuggguauuuucucuagcucacacuuuucaaaguucuccauugggaagauuccaccaaaacaaaacaaaacaaaaacuuuagaacuaaugaagucagaaaagggagccaccagagccugacaggagugugcaacgugcaaagcccagggcccacagauguggugcugacccaggcagcgcucuuggcgcaacuucugacuuuaucuccugguccauaaauauauuuaagcuaauuugacuucuauauucuaaaacccccuuucccuguggcugcuuugaacacaacaauuaccugaagagugcuuagaugcuuugauggagaucaccgucuggguuuccgccacacugaaaaacaacaccaaaauuuucuuggcaucugggaagacuaggacagauggcaaaacuaaaaaauuucuaacucaaaaaaucaauuuuucuaucugaaaugugcuugaaauuuacaacaugauaaaaagaaaaagcaaagcaaacaagcaagcaaaccaaccaaaacaauaccaaaagaagaaaaccaagccgacuccaagagccaagauuuauaaagaaauucuaaaauucuacuuaaaagaguaaaugaaagaagagucgugaagccgcugcccagcacacacucaccucacaggaacaccauccuuguagcgggugccaagcucacugguagagcuaaccucaucacaaccagaacgagaaguuucuaugggguucuguucugcagcgauccaggcaucuuuuuucgauggacugucagguuucucgucucccgauucagaaguaucaauggcaacuacuucuaacugaggauuugugacuuccaggacuuccagagaagaaucgcugucuggcucaucucuggcaguuccuugcuccugaccagucuggcugguugucacuuucgccccuuuagcugccuuugcaguuuugaccuuccuugcaggcuuagccgugaacacauccugcucugugucacuguucucaggaacaugaguggcccgaagcgucuucuucuuccgaaguuucuucuucuucuugcuaccucuaguuucagcugaugccaguguggauucugccugcugcucaggcuggucagcuggagacugaguuuccuucucugcaggcguuucgggagugaaagacaaucucagaaaagaacugcugcaggcuucagauccacugcugccuuuggcugucucuucaccucuguuuaugccaggaagaucaggagacuggcaagagggagaguuuccuuugcuucuggaauuuccuugcuccacagaaaaauucagaucuuugcuaaccuccuggcaguucucuguugacucugaugcuaucacugcagggauggcuggguaaacugaagagccgucaucgaccacuccugaaucaggaaaucaaacagaaaaaucaacuuccgcaggcagcgacuuuugauuucucuuauauuuugaauauucacauauuuagugugucugugcauacaaggaauaagcuuggguguguccaugugccagggaacuuguguggcgaucagaggacaacuuuugaaacucauucuugcucucugccuugcacugugagcuccaagcuagcugauucgugaacuaccugaugacucuaccucagcuuuucaucuuacuguagggacgcuggguccgcacugcuugugagagaaagugacccacugagccuacuccccagcucccacagauggaucacuuuagugagacaggaaaaugauuuauugaguagaaacuggucagguuaugguaaacuauguccuuuauauagucuacauguaaacgaacauauacuuaugguuuaagacaucgaaauacagcucaggauguuuguaguucagugguaauacugggcuugccuaacacacaaucuccagcagccuucccccuuaaaaaagauaggaaauauggaacaaaauaauauagcuacacuuuuaagcucuguuaaauaaucucuacuaaggccaguauaaucauuccaugaauuucuaauguuuuaaacuauguuuuauuuauuuuguguacauggucauuugugaaggucaggggacaacuugcagaagucaguuuucucuacaauauggauccugaggaucaaacucagguuuucaggcuaggugauauaugcauccacuccaucugccauuucccaaagcauuauaguuuucaaaaccuaaauacagaucccauaaaauuacuaacuuaaacuucagcaugacagaucauagacauuagauccaguaccuacauaauacugcaaaagggugugaguagcaaaaacugaaggggauuuuagaacugguuuugcuuaaggaaucacaaugacuugugugugugugugaaguguguacauguaggucuacauaccauggugcaaguguggaugucaaaggacaacuuuggggugucaguucuugccuucugccauacugagaggcagacucucucuuguuggcuucugccgcugugcuucauacuucaggcuagcuggccugcaaacuugcaggcaaaucuccugccuuggcuucccaccccaaggaaugccgggauugcagauuugugccacugcacccagcaacaugaggugccaggauuacuuggcuagcuuuuuucugcugacaaauuuaauuuagacuguuugcuuuuuuuacugaauuuuuaauaugacauuauuuguaguuaugagaaguuauccucaacuguuaaaacccgaucccuggcuacuucucaacccacauaaguucccguuaauaccaguaaacaccagaacccugugaccagcaaugacacuugcuucucaggguuuuuaaucagucuugguuuacauaugagguaauagaugcaguaaugcucagaaauucagagugcaugccuuccugaguaaauggguugaccaagcuuaacccacacaccacaaagacagaagaaacacuuuagaagagucaaauggaugccaacucauuaagcuccaagaaagucagggaacaaugaaacuuaaaugaauucucuaaaguacuuuauuaguuuuuuaagucuuuacauuuauuuucucuguaugucuuagcacaggugugcauauggggguccagguucucuuccuucuuguggauucuagagauuuaaacucgggucaucaggcuugcugacaaaccuuuaccugcugagucaucucuccaaccccacauucucugaaguacuugaaaacaaaccuccuauaugaaguaucugucaguggaaaacuaacuauaauaauuaguuauuuuauuuuugagcaaggucucauuauagagccacagcaggccugaacuugcuauguagaucaagcugagaugugaucucuaacucgaaguuccaccugccccugucucccgagugcuggacuaaaggccugagcugacaugcauggcuuuguuucaauaggcuuuacacagugguggauaacugcccuucagggaugcccugaacucacaugaaagcuuacuuacuauuaguuugcaguaauuccuuggacacauuggaagcacagccuuguggcaaagcauucauauuccccucuuguucaggagacaugggcucuuguuuaaucugaaccgaugaaucaggggcagugccaugggcuuguaaaguacacgugguuauuuggagaggguuuccagaggaugguagagaugcaugggaaggagguggauccagaaaccccgggaaaaagggugcaggcagcagagcugucucaaaagaugucugagaucggcuguuccuuuguucucgugauaugaggcuacagggagccuggucugggugcucaggagguucauauguuucuagaacagaaagcauagacacagaacaaauccaagaauauuacuuguaaagucauuuauuucuuagucaauuucuauuuguuuuguuuugucucacuguuuagaccaggccggccuugaacucacagaucuccaucugcuucacaucccagugcuggaauuaaagguauguguugccauaccuggcuuccaauauuuauuuuuaaagacuaggaaaucauuuuaaguugggaaugguggcacacaccuuuaaucacagcucucgaacagcggagacuaaaggauaaagguucugagcagcuaccuacuaagcugaggcaacaugggcuacacaaggccuugucucaaaaaaaaaaaaaagaucagccagacaugguggcagagagucuuugcucccagcacagaggcagagauaagcagaucuccaugaugacgccggccugguaugcagagugaguucuagaacagccagggcuacagggaaagacccucccugaaaaaacuacaucaacaaaaaauuucaaacgugcaaaaauuaacuuaauaauguguuagcauucucccuuucaacuuguccaaacaaaaaugucuaacaaguacaaacuaucaagggcacagaggacagacuguaacauuuacauuucugaaaguacaaagugggucacaccugcaauccuaacauucaacaguuugaaaaagguagacugcacugaguucuaggucauccuaggccauaagucgugggacagccugggccacugauuaaggcucugucaaaacauaagaauaaaaauuuuaaaaagaaaaaaaucaaauuuuaaacggcuuauccuagucauacaguuaccaacagaugccaagauuugaacucaguccuucugauuccucaccaaagcaaucucugccacuucccucuccuucugucacuggaaccccacucuguaaaccacaccuaaggcaagcacccaacaaccaagcuccaucaccgauucucugagaugaggugggccuugaauucgcucuuugucucccaucucucccaugucagcuuccuaagcaguggagaugacuggccuggaccacucagcccagcucuguuacaauuuuugagacauccaagucucuggguuuuuuuacagaaugaaaccauggagaccugcaggaaaauguacgacauuccuacaacuuauuugcuuuagcccugacagauaacaaaaauuaacaguucaucaaacaugcucuaaauaaauaccuugcaauccuuguagaaucuguauucugugaguccucagugcacucaucuccacaguuaucugaaaguaaaauacuuggcuaagcauucuaagguccaccccgcagcucagugucccuaggacuucucagcuguuaccugcugcuuaagcacgaguagccucugaacuucaacguacgcugucugcagugcugcccgcgccugcaggagcuuguuguccaugcacugcagagacuugcucaguucuuccucucuuaaggaaauaguuaauagcuggucaaccugagaacguucugucaaaacaaaacaaaacaaaacaaaaggccaguuuaguaacagugucuucaaagauacaugugcuuaguacaaaccugucuuucuaucucaacaugugaaagagucucaaggaucuuacugacaucaaagcucaaaaacauucaaaauaagaaccagcagggaucuaaaggucugugcccucccccuagacacauauggcuuugguccugguccugucuucagcugucuaugugcuccucacauagggcuuuggcugagacugagcuucaggcuuacaguccuugcccucuuccucuuccuuuucggccaugguuuucuagucgguuacuuaaguuuuagauaguucucaauagucagacucuugcuuguuuauucauuuaucuguaucucuugcuugggagacagggacuaugcguuugacuuggaacuuucagagaucagcuugccucugucgugagugcugggaguaagugcaugugucagcaugacuggccuguuuguuuuguugcuuuaacugaauaauagcccgguuuuaccuugaacguuugagguaucugauagucuugaacuauuuacugaucccucugccuccaccuccccagugugccaccacacucucccugacgcuucucuuggcgugugauguaaucccaaugcuaaggcaccgcucugcucugccacuggugucacagcucuuuacuaaagcuucccugagcaaagucugguuuugauacugaacagaaaucuaaucagauucaaaucagaucccguuccuucuacuacacacuccucaauucacauuagaaaagcaaacaaggugccucaaaaauaaaaagcgaagcuagauguagugucucacaagccuaauuccauauuucuaguacuugggaugcagaggcacaacuaucuagaguucaaggcuagcaugggucacaaguuaaaaaagugagagggacaauauuuaauuaaaugacuuguuccuucucauuucaaauggaaaauucuaguaagauucccugccuauacugucuacagcauaacuuagccuucaguucuaugugguggcauguauuuaucuuagcugcaacuagauggagcaagcagucaauuuuuuuuuuucugcuuuuaaacaagacaacaggggccagggagauggcucagugguuaagagugcugacuacuguuccagagaucuugaguuaaauucccagcaagcaugggaucugaugcccuccucugucaugcaggcauacaagcaaauaaagcauucauauacauaaaauacauaaauauauaaauauuaaaacaagacaacaaugugagaaaggcuauguuuuaaccagauauggugucauaaguuugcaaucuugcuuugcagaggccaaccuggcuuuacagacagagccugccucagcagugaggacugaacuaggggccucaugccuucuggcaaguuuuuuuccauuuagccaccacucagcuccuuuuucaauuaaaacaaaacaacauuugcaagucuugcaguaugaagcuuguaagcccggcaccagaaggcugagaugagaguugaggacagucuauauagaaauacccugucucaaaacaaacaguaagugcugggaagcagaugaccaguguuugaugauuagaaaccacaacagauuaucaaaaggcugaagugcuaucauggcaacuucuugugaucagagacauagguagaguaccugccuagcauguaugaagcccuggguucaacacucagcauuguaaaaacgaaaacaauaauguucuucuguaacauuauauagccauaccuuucuucccuuuaauuuuccuucguuuauuuuuucucucaagacuugguaguucaggggaagauccauccuaagaagaauauugcauacugaguaugaugucauuuuccaagagagggacaaaaugguugcccuauaugaccuucugcuauugcaacuaucucuacaaggacaacagaggccuugugcacaacguaaccauuaguugacuuauuguuucuaauaaagaaagcccaaggcuuucuggucccuuagauguacuaaagcccgcugugccaagcaaucaguccaucgggugaagugacacggggacggaagagccaggaacacucuacugaguucaucuuggcauaggcugcgcucuaacuuccuggagaaaaccuuuccaacaagacaguaaagcaucuacaugacaaaucucaagguaacagcuucuccaauuaaauuccaagcuucaaguauauuuaaaaucaccuaacaguaccuccucugucugaaggagaacagaauuggccuuuagggagagggggugccaaaucacagguuugaccaccggaaagagaguuucugaacuuucuuuucagaaagggaccuagggacagggcuaucaucaucaucaccguuauuaccagggagccaggggagcauaaguguuaaaugaggggucaggagggcuuaacuagggcaauuacagggacuggggaaguguugcaguguucauguauacauucuaacgcuauuaagucucucucuggugguaaacuuuccagcuuaaccaagaagccaacauuugcacacguccuacaaacucagcaguaccaagugacucuaugaaagcagauuaaguuacaucugaagauguggccuauccuuagucaggugaauuacugcugggagaccacuuuuagagaugacuucacacuuuccugguacuguacauucgucucacauuacaucugguuuaguagagucacucagagaaaaaccagagagaaaccagaagaagggaaguaaagagcauuaaguucugcucuggagcaaaggaaaccacaccccagauacucagucaaaaugaguuaagccuuucuuaucaauauucaaguccucacaagagauacuuugcaaagacauggagagucauacucaccccgguggcucuucgcuucuuucuaauacugugaccaucgguuugcucagcaccagagguacagcugcugucaguggcugcaucugcuaagcuggagacugcaugaccugaagaugcauuugaugugagugaguuuccuucuccagugcucuccugggcauggcgcucugacagugggguagaccucuccuggcugugcaggucucgggcugaaugcaugacaggcauuaugugaccagacgguaacugugcacuaugucgccgcuggguaggaauguuuccaacccuuucaccuguuccgacagagggagucagaggggccacuuccuguucaagauacauggcugucuucugacucugggcagcacucagggcaguauuaggugaaggacucugcugggcuucauuuucuuuaccaguacccuccccaguaaagaagcuauacacaggagcccuguccaugaccacgcugcuuucagaaagacuucgcuuucuugccaagccagaggaugagggaauggaaacuccuucccacuggaauccuuccagacuggacagaucaggcucuucaucuaaauccaagacuuccuguucauuuugaaccaaagguaccauuucuaugccaaaccuuaaaaaaaaaaaaaaaaaaggaaaaaaagagaaaggaacaagucagauguggcuggggaguguuacaugugcuaggcucuccugcacagagggaggcuccugcugucaagaagcacaaccucugacacgaauuccagagcgagguagagaguacugcagcagcagcacaggcacucaauccaaacugugcagcuacaaggaugcaaguagauuagugacaacugcuccccucccaaauagagaucuuugucuucaauaaacauuuuaaaagcaaagaaaccagcuuaccaaguacucacaaccauuaagcaggucucuaagcuuucugcuuuaccagaccaugaacuuugcaaaaggacuaagaaaggaaaacaaggcaaaugaaccaacaacaguaaagucccugagccuggagggcuacacuuacaucguugcaaaacuaugauuuuccgccgccgggcgugguggcgcacgccuuuaaucccagcacucgggaggcagaggcaggcggauuucugaguucgaggccaaccuggucuacaaagugagcuccaggacagccagggcuauacagagaaacccugucucgaaaaaccaaaaaaaaaaaaaaaaaaaaaaaaaacuaugauuuuccaaguugaaccuaugcugagcacuucuugaccacuuagaacagcaucucaagaugcucugagugagcuuaagagaaagcauucugcaguccucucuguaguacccagaaugccuaugggggauuccacaagcucagugaaagguaguaacaacagguaguugaaaaaauugaccacuagcagggcggugguggcacaugccuuuaaucucaggcaaaagcaggccuucucugaguucgaggccagucuguucuauagaccagacagggcuauauagagaaaccccaucuugaaaaccaaaaagcaagcaagcaaacaaaucaaaaauuuuuaccauugguuccaaacauuaagauucagagacagcacauucuaguccaucugaacuaaagugacagauuucugaugacguauguaauccuagguccaauuaguguuucaggugccuccauuuuaauggcauccucugucaagacagacuaucacacgugucauauaggaacagccagugcuuaauacugaauuaaagcagacaucuacaauggguauuuuuggcacaaguuuaauuuaaguugaacaagaacuugguuuuaaucaaggccaaugugugguaaccuuuaaaagaagccaaggacagguaugagaggcacacaccuggguaagccuuugcccagcucuugcuuuuucuugguuacuugcugaaugaccuguucccaguugacauuucuccuugaugcauuuagaaucugucguaggguuggcuuaagcccagauuccuuuucuguuucauucuuucuauggccacuaacauugcgaauucgucgagcgcuauugagguuuggcucugggagauguguuccuguuuuggacuucaaacugaugugucggcuuagaucucucuggagcgaggcgggaaaaccaaguuuacuuaguucgggaagaagcgugccugggggcugauuauugagaucagguuuuugaagcucugcauccaggcuaguguccucaaagcucucaguuucaaaagguccaucagauuuaacaagguuguuguccugcgcaucuucuagagaggucuucaaguuuagcaguaagccagaguguggacuggucgcugcugacacuuguaccucagccucuuucuggagaacuguggaauuacauggggaggcggagagguucucggguguuccugggaucuggcucccuuguuccuuauccacggugugagugcugcaggacacaaccucuguggucagugaagccacaccuucacuuuuuaugccaugguuuucugcaucagaugucauggcacuguuuccagcugaguguggcugagacucgaugcucagagagucuuuggcagacucuucuacacuacuuucuuuugcaucguucuccguccuuuugggugugguagggaguggauucugcaguguuuugggacacuguagcacugugucuugggcuuucugugaugugcuauuuaacuucucgucagguucuuuuugagugccugauacaguuuuauucuccuuuaaaacacgaggacauaaaccgcgugauuuggauguguaggaagaaccauggcuaccuucuaaaguagaaguguucaggagaugugagugaucuccagaaggaaaggacuuugucuccuuauuuuuugagcgguucuuuaaauuuugcuuaugaggaccugauuuagggguuggaaguggaaggaguggggauuucaguaauggaaucuuauuugacuucugauguggcucagauugcucgguaauggggcaagcucuuggcaccucacagaaagcagugccaucagaaauggcuuugugacugggagauccaggagguccugcuuuuuguguuuuuaucacuggaggauuacuuguuuuaucaacugguuugcgcaguccugcaguuauuaagcuaaaauuaaagagaggcuucucuagugugucugacuugcugccaaugacuucuuucagggcugacuguaaaucuagagucuucugggaaggguaagguguccagcggcggaacuugucccuugcuuuggugccauuuuuuccauuaauuuuugaggcugccgugucuguuuguuuagugguuugacuuucucgcuguucaaaauugaacucaaguaagccuucugaaggaaacguaucgcuugcguaucccucaggaggacuccuguacuuggcagcuuugucccugucuugccucugccacuugcaucucuccugacuguacuugcuuggcuuauuagauuucuuguuccacaucuuggucaugucuuccauuugauaguuaggauuucuguuucugccuuguugaaauuugucuccagggccauuguaauuccagcuauucguacuacguacacuggauuuccaguuuccguuacuguuguucaugugccagcugggaaagccaccuguuccuucagaaugccaacuggaauuccuuccuguaccauuauaauuccaaucuaccaucccauuguuugaaugccagccuccuccagaauugcuaugauuaaggaaccaaguugaagagccucuuguagcaccuuuaugccagacagaacuuccucuugguccaccacuauuccucaaagaauguggaaagcuguuuuuucuaguacuauuaaagccauccuuuucccauuuccagucucucuguggggguccacgauggugucuugguggcugacuauagcucucucugucuugguaagggauucggucuucucgucuccacuggggcugccugucaucugaguuuacuucuuggcuguuacugggagguucaucuugucugaaagaaaaaacaguuugucauuauggauuuaaugaaauucuuacuugugcuucuuucuucuaguguuuguuuuuacaucuggaauguagcagacuaucuuucccuucauccuagacacauuuaaacuauccucccaauuugggggggggggggguaaaagggguuacuggucuagaauuuuguuucuauuaucugagcauuuuuacauuauccagcucuuuucaaaauaagggugguuauauuuugugguuaggauuauuauuuacuuuuuuuuuuuuuugguuuuucgagacaagguuucucuguguagcccuggcuguccuggaacucacuuuguagaccaggcuguccucgaacucaaaaacccgccugccucugccucccaagugaugggauuaaaggcgugcuccaccaccgcccaggauuauuguuaauguaacuccauguucagucaguggccauaucugauuucuucagaugcagguucuuacugaaaaaaaaucuauuuucuaacccacuuccauacaguuucuauuuaaaauaggcuuagaacugugcugaugcaguaaguuaggucccaaacucaguaaaacagcacaagccaaauaagggaucucacaagaagcuaaagagagcuucugagcugcaggcucuuuacagagaagcuacagcuacuuaagcuaucuauguuacauagguguccacaaaagggaauaacuuacuuaucacagcaaugugugaaaccauuuuucuuuacaaauuacuuauggugugucuaacauuccagcaaguaauaggugcucaaaacaccagguaauaaaguggccuaaaaucugcuucauuucugcuaaagacuagauuaauuaauucauuaaugcuuuuuaaaagauuaucucauuccauuuguacaauccagaaagauauuauuacuuuuuaaauggggaggcucaaguuuagagaagcuaaguaaugugaauggagucauauaaaugcaaaggggucaagcaaagguccgaaccuugcagacuuauacuacccacucaggccccacacaguaaaaaugucacagcaacaguuucugcaauugaauuucuuucucuaaacuugacuuagagcuggagagauggcucagcauuuaaaagcauuggcucuuccaagugaccugggguucaauucccagcacauacucaucaccaucuggaacuccuguuccaggggaccugacaccucuucuggccuccauggacagcaggcaugaguguggugcauagacacacauacaccuacacacauacaaagcaacaccuuaggcuggcguggugauaacacaccucuuacagcacugagaggcagaaguaggagcaucucagaguuugaggucagccuggucuaugcugugagcaccaggccagccaagguuucauagcaagacacugcuucaacaaacaaaacacauugacuaccaucuuaaaaacugaccuuaauuaauuagccuuuaaaagaaaacugauugugugugcacaugugcaugccauaguguaugugugcaaucaagagagcagaguacugggcuggugagauggcucaguggguaagagcacccgacugcucuuccgaagguccagaguucaaaucccagcaaccacaugguggcucacaaccaucuguaacaagaucugacucccucuucuggagugucugaagacagcuacaguguauuuacauauaauaaauaaauaaaucuuuaaaaaaaaaaaaaaaaaagagagcagaguacuuggcugcauuuccucuacccacagaaccaucuugauggcucuuaaauggccuuaugccuguaguauucuggacauaaauuagcuccuuuuucacaauauagaauuaaaaauucggggcuggugagauggcucaguggauaagagcacccgacugcucuuccgaagguccgcaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaaaaaaagaauuaaaaauucaucucucuggcaugguaacacuugccuguaagcucaguacuugcaacagggcuaagaagaaugugaguugacuaucuaaagagacccugcagcagucagucaaucaaucaauaaaaguaagugggugauuucauauaauuaugucauuacaggggcauauaagacucaaagaauaagcauaucagugucuaaucauagccuuugauaaugguugaucauuuacauagcuuagcuauaauaguuuuguuguguaugaaagaaacaaaaauuaguguccuacccauuuaacuuccuaaaacagaagcgcaggcuccaccagcugcacugaggucaugagaauaguaucugaaggaccgcacagcccaaggggucaacaaucauggugcuaugggcaucuuaagacuaagaaagucuuuuucaaggacuuacuuuuaaaauguuaauaucuaggguaaaacuacauauuuccuaccuauauuuaaaucucuaacaaaaagcaggucagaguauguauaaauaauauucaagaagaaucauuaaaauuuagaguuggaaguuuccucaucacauagaaggacuuuaacacuuguggacuucauuaauuguucucuccuauucucugucacauuaauaaauaagucguagcacacaccuauaaucccaccaccuagggagacagacacagaaauucagaaucaucuuucgcuaugagcaaacugaaaacuugcuauggcuacaugacugccuggcucaauuaaaaacaaacaaacaaaaaacuucaggcuauaaaaucagguaaguaaaaccauaaaugccuaacacauaaauacauaaacacagauauacaaaauuaggaaaaacaauuagggaacauauauuguucaaauagucuugcuauugucaaacuuaaaauauuaauguuuuaauauaauguaauauuaauauuacaucuagagugaaccaggcacuguauaguuguuaggaugccaaagguaaaauucagauuuaagaaaagcaccaugcuaauuuauaagaggucauccuuuccccuaagagauauuauuugggcaacaaaaaauauaauaauacaaaugauaaaagaugaaaugucuauucauuuuacuuauacucuacggcuuucucauagaaaaauuggauaauaagaacaguucaagacacaguaaccaagaccauaguuuucaggacuaaaaacaagacugaguuuaaagacagauaauauaacaguucaaaaaagcacuucauaguccuuaguccucagauagcaaacucaaacaaaacuuaauauuuaaaauaagauuaagcuuuaagggucuuaaagucaggcuuacuuaucuuucaaugucaaaucacaaggcugaguguagcuuaggcuuacuuaguagaguguacucuuugcugcacaaagcucuagaggcucauccucaggacagagaaguugucuacaucuaauucuaucucaaaaagcaaaacuaaaaacaaaccaacuuaccgacuuuguucuuuucuuucuuguauuaacugaacaaguuccuuaucaaaauacucuuccucuuccucuuccuuuccaucaucuucucuuuccugggcaucaacauuaucuuugugcaacuggccagaaaugugcuuugcauaugcagagagacccacuucugugacccggcacacucggcacucaugacuaaugucccuagggaaagagggagaugaaggacauucaaugcuccccacuggcauggcacacucaccagauugcuaguugccucugaaagacucuguaugcagauggccacaguggaagguuagagggaaucaagucggugcuccucucaccacuguuaguauauuugcuuauaaauuacuuuggaauaaauuuaagauucuuuuccagcaaucaagagguaaaacacuucaaauuaauaggcuuuaggagaaaucuucuugaauugcuguacuuaaaaucuugccgaaggaaacauggugaaaggggaggcagggcagggggcucagagcaaagacaagcugcucuggggcacacccaugauggcagcugcacucagaaagccuggugacagcacauccauuuaaucuccagcucuaaagugcucuuccagugaaaguuggggguggagcaaagaggagggggaacagccaaucucagcuugguaacuaaaaauuaaacagcuggcacucugccuggaaugugaagaguccggacccuggcaagagacaguaguagcaaauguucuuagucuggaugauacaugugacacacugcuucagcaggcuuauuuaaagggaauugaaaccaugucaaauguaggaaguuagcagcuguuaggcaaauguuuucucuccaguuucagaaaaugaugcaguccagauacacacaaaauuggcuuuuaccuaaacuggugaugacuggcuugcuucugucuacuuuuucuucuacuugacucaauagcaaaaucuccucuuuggccagucuuuuaaagauuucuuuuauauauauacacauacacugcagcugucuucagacacaccaggagagggcauuggaucccauuacagaugguugugagccaccaugugguugcugggaauugaacucaggaccucuggaagagcggucagugcucuuaacugcugagcuaucuauuuuuccaacuguguuuggccaguuuuaagaaucaaaaucuuaaauccucuuuaauauguagcagaucaauaauuuaacuguuucuaaguucuuucaauccccugauuacgucaucugucugugcaacaauaaugagaagcgugcaacuguggcuguccaauaauucaaacuuagucuaagugcuugugcuauggguuuauaguagugauauuucugugauucccacaccaauguggguaucuacaucugucugccuauauaaaucuccagacacaugcuaugaaacacacucagucaccucccccaacccccaguuuuaaccaaacucaaucaaaauaagcagaauugacaugaauuaacagaaguccuugaaacugagcacuucauuuacuagaagacacuuucuguuacaaaucacuugaaugcccauuuaaagcaaagcaaaacaaacacuuuaccaacaauuacuaaaugccaagcaaaacacuauguuacuuaguuacaaacuauaaaaacucaaacaaugccugauacaucuuaaaauacaaucaugagggcuagaaagauggcucaguaguuaagaacauuuuuccuugucucagagaauuucugagggccaugggaucugacacccauuucugaccucuguggacacugguucucacaugguaugcauuuacuacauaaauacacuaacauacaaaaaaauaaaucgcagggaacaaaaugcaaugcaguuggacaggaaaugguagguagcauugggagugcagggcauaaggcaauagguuugaucugcagcauugcacuaaguagaagcaaacaggaggaacaacaauaugaacuaaccaguacccccagaguucccugggacuaaaccaccaaccaaagaaaacacauggugggacucauggcucuagcugcauauguagcagaggauggccuagucggucaucaaugggaggagaggcccuugguccugugaagguucuaggcccuaguauaggggaaugccugggacaggaagcaggaguggguggguugggaagcaaggggaggguggaggggauaggggauuuuucggagaggaaauuagggaaggggauaacaauugaaauguaaauaaagaaaauaucuaauaaaaaauauaauuaaaaaguagaagaagcaagaggagacggcaguggcugcagucacuaacccuaacccugcagcacuugggaggcagaggcagagaccaauggaucucugugaguucaaggccagccugguucaaaaagcaaguuccagggcuacacaaagaaacccugucuugaaaaacaaaaaucaaaaaguaacccaacccccaauaaaggaaacagaaacagcauuauuaagggacugacaagcagaccucuguggguucaaagucagccuaguccaucuauauaccaaguuguagaccagccagggccacaaagggagacccugucucaaaaaugaaagggggagggggagcuuggaagagcaaaagcaguagcaacuuugggcacacacccacacccaauacuguuucuuauuuugaaagagucucugaaaauggaaaaauguagaaaucuuacacuuuuuuuuuuaaacuuuguagcacaaaugcuuucauuuaaaaauuuuaaaaugaagaacucugaccagguucccuaaaaauaucaauggguuacccaaaaaucaauguucuaauuccauacuauccuauaauauuuuaaugcauuauuuucuaaccacgucuauauauuuaaagauauguuuaaagauuaaaggaauguagaagcugggaaaugguggcgcacgccuuugaucccagcacuugggaggcagaggcaggcggguuucugaguucgaggacagccuggucuacagagugaguuccuggacagccagggcuacacagcgaaacccugucuuggaaaaaaaaaaaaaaaaaaaaaagaaagaaagaaagaaagagagagagagagagagagagagagagagagaggaaggaaggaaggaaggaaggaaggaaggaaggaaggaaggaaggaaggaagagaaaggaaaagaaaagaaaaagagaaaagaaaaggaaagaaaagagaaaagaaaagaaaagaaaagaaaagaaaagaaaagaaaagaaaagaaaagaauguggaaguagaggcagguggaucuuugugaguuuuaggucagccuggucuauucagugaguuccaggccagccaggacuacagaagugagacccugucacaaacaaacagcuucuuaagaauaaaguucuuugaaacaacuaaauugaugcuagcucauuucuaauaaauuucuuuaaauaaaguucuuugaaacaucuaaauugaugcuagcucauucucuuguaauagcaagcaaauaucucacagcaacacagaaaguuuauaauauaaauaggaaucugcucacaacgggcagcgccagaagacucuagagacuauacgacaaauaccgcacauacacugcagcugagauccaagccaacugucuuuaguuagaaaucacauuguuuucaucuacguuucuacuuauuguauaagacacagcauuggauguggccacaccaguucuauugggacuuuuguacaauguuuaauuuuuucaauauagauuauuaugacuuuauuuaugaaagaaaaauauauguucaagccaucaauauaccucuuuugaauuuuucauuaauaauuggcuuacauacuuuguauaaacauauaauuauggauaaaauguacugccuuugugucauaacuaauaaaggcaauaauuuuccucaggguguuugaagggcccaaauuagcuccauccugucaccacgcaauuuccccucauguacaaaaggcagucuuaagauacucuaugcauaagccuuucuuuauuaagccugcucuaacuaaaacuacaacagcugcucgauaaauaaaggcaugagucuuugauagcaucuaucugaaguaacugcucauaucacacaucuucccuaugcccauauuagaaaccacacaaaacuuaccaauauggucaaguuugccuuuaaaacggaauauaaaaacuuacguagccaggcauggugguacacaccuuuaauccuaagacucaggaggcagaggcagguggaucucugugaguuaaaagccagccuggucuacagagugaguuccagaacagucagggcuacacagagaaaucauuucucaaaaaaugaaaaggcaaaaaaucaaugaacuauuuuauauuuacaagaucauaacucaaaaguaaacaauaagcacaguaauuaaguaugaaauccagaagaaaugaucaccuauugaggcuaaggggaacgggauaaggauugaguugucucuaaggcacaaacuaguuaugacuauccuuaaauuaaggcuacacgucaaugaaguauguuugagacuuuaugggguucuucaaaaauugucucauuuuuaaugcaacuuauuuguuaugagcuagcaaauuauauaaaacuuguuauggcuggacauaacaugaaggaaccuuuaucgauaugaggaucucuaaauaaaaugaguuaggguggucaagauguuauuuacaagagaaaaggaaccuauagagcaacauagagucagcaugaggcucaguuauucaagauggaacaaagcguuuacauagaucuaaagaugugaaugaauauuaaguuugaguaggccagauaacaggacagaaagggauuuuauuaaagaggaaaaaggugaacagacuuuuuuucccucuuugagacaggguuucucuauguagccaagucuguccuggaacucccuauguagaccagacaggucuuaaacucagagauccuccugccucugcuuccugagugcugggaauaaaggugugugucuccauaccuggcccaacaagauacugcaauucuaaauucuagacaucuauacaucaaacauaaagacaccuauguucauaaaagaauugacucucauacaaugauacugagugacgucaauacccaacucuugccaacagacaggucgucuggacaaaaaccacagaaaugcuggagaauacccaacucuugccaacagacaggucgucuggacaaaaaccacagaaaugcuggagguaaaugauacaauaaaacaaaugaccuaagauauguauagagcauucuaucccaacaccaaagaauacaucccuuuuucagcaccucauggaagugcugaaacugaccacauaguauagaucccuuuauauuuguauauauuuuaggaagcuucuacucuaucaggcuuuucuauaugaccgcucaaaucgaucaaacaggaccucaguuuuagcugucccucccuuacuuccucuccucauccucuucccuauuaccacccccuccugcccaccacagcuaucucuucuauuuccucuucuuagggagagucaucccucacaccuagucccuuccucuaugccuaaccucugugguuauauggauugcagcuugcucaucaaagauugaaaagcuaaaaacagauauauaagcacauuggucuuuugaagugaagacuucuuuuuguugccaugaaacacaaccauuacacauuacaggaaccaggcaagaaagaaguccauuuauaugcugagauguuaaagucuaauaauagcacauacauuuacagacaauaaacuuacaauagaguuaacacauuaguaucaucaaacaacaggauaguagcuucacagaaacuuugaacuauuauucauacaauaaaauauaauucauauuucuuaauuuaccaauguuaccuuuaaucuacauuucaaucuuuauacuaguaaagaagacacacagaaaaaaggacauggaacacacacaaauaccacauucugucuaagccucuuuuaaacaucuuaaaacuuuaaaccauuagcagaacauuuucaaauacaccuaagaucucuuuauuugguucugcagacacaaauaagcuucaguauuccuaggcuauuucagcaagaaauuaauuuuccuaaaguaaaauuauggaaagucccagcugcaagaccaacacugcaggaauaaguccguuuacgagcugauucacaccaguucaacuugccugaguuguguugaauucuauccauguguagauuucagaugcacaaaccuaccacagcuuaucuuuuuuaaaugccccaaaucuacugcuauuaauuaugaacaaugacucaaugccaucauacgacaaucaucaugacggauuauuacaaagcaaguuaacaggcaccaucagcacuuaaacccccaugccaguaaguuuagggaagagagcuguuguccuuaccugcccuucagguucucaaguucccugugaugcaacaugcuucgcauguguucauccaucuccuucaaaacaaaacaaggcagauuaaaccaaaaggauugcuggggguagaguaggucugggagggugguaggugggguuucucuguagauauucaauuaacaauuuggguuaugaagcuggagaaauggcucagugguuaagagcaccugcuacuuuuccagagaacuggaguucaagucccagcacccaugucggguggccgagucacuacugccuguauccagugggaggccugugguggggaucccaugcccucuucuaacaaacacucccacauaugcauugcauaaacucauaagacacauacacauguuuggggaaaaauaaaaagugaaaaaauuauuuuaagggcuggagagauggcucagaagauaagagcacucacugacuccucuuccagagguccugaguucaauucccagcaaccacaugguggcucacaaccaucuguaaugagauccaaugcccucuucuguugugucuaaaaacagcuacaguguacucauacauaaaauaaauacaucuuuuuuuuuaaagauuuauuauuauacauaaguacacuguagcugucuuuaguuacaccagaagagggcgucagaucuccuuacggaugguugugagccaccaugugguugcugggaauugaacucaggaccuucagaagaguagucagagcucuuaaccacugagccaucuauccagccccuaaauacaucuuuaaaaaaaaaaaaaauuagccaggcaugguggcccacgccuuuaaucccagcacuugggaggcagaggcaggcggauuucugaguucgaggccagccuggucuacaaagugaguuccaggacagccagggcuacacagagaaacccugucucaaaaaaaaaaaaaaaaaaaaaaaagacaauuugaaguuccuaggucagaacuuuuugugauuacuccuuuacuccuuuucaauuuaaaaccaaaauugguuccacauuaaagaauucucuggcuauauuucaugcuaauuuuuauuuugugggguagggucucagaccaggcaggccuuagauucauuauguaguugagaaugaccuuggauucauuauguaguugagaaugaccuuggauguccucacaacucuaucucugcugcuaggauuauaggugaacaucgccauagcuggcucuuauuuuaaaaagaggaacguuuagguauuguaaauacauuaggcuggccuccacuugcacgcgugggauuacagcaugagcaccacagcaugaucuauacaaggaauucuaguucacccaggaccauacagaaaaacccaaggggccaagaagacaagggcuuggcagguaagggcacuugcugcugaaccugaugaccuggguucgauccuuggagggcacauggugaaaggagagaaucuaucuucgcaugugcacucugguauauaggcacauagucaaagucuuucgaauuacuuagcuuuuaaaacuauuuggcuacuuuaugaguauguggccuauguacaugcucauguugguacaacauacaugugugugauuguggaggucagagaccaucacuggacaucuaucuuucucaauugcuuccuaccucauuuuuaaucguuuuaagguugugugugugugugugagugugcaugcaugugaaugcagauggcuauggaggauccuuuggagcuagaguuaaaguggucgugagcugaccaacaugggaaccuagagccaaacuugaguccucugcaagaacaguaugcucuuagccacuaagccaucucuccagccccuccaccuuauugagacaguaucucaauaaacuggaagcuuaccaauucagcuaagcuggccagugaacaccagagaucugccugucucuauccugggauuauagauguacacuguugcugcuguguuagggauccaaacucaggucccuguuguuuguaugcaaagcacuuuacugacugggccaucuccucagucccugguugucuauuuuuaugcacagucuuucucaacucaacugaaaaguuucucaagaauaagcuacaacucuuauuuuaagguuugacagagucugucauauaaguuguuaauuaacacuuguugaaugaauaugguuggcugcauugauaaucgauagguauuaaaaauaaagucucuuagggauuggagagauggcuccgugguuaagcgcaaugacugcucuuccagagguccugaguucaauccccagcaaccacaugguggcucacaaccaucuauaaugggaucugauguccucuuguggugucugaagauagcuacaguguacaguucugugguggcauagaccuuucauuccaacacuaaggagucugagacaggaggaucucugaauucaaggccagccugguuuacggaucaagauccaggacagccaagggcuacaaagagaaacccuaucucaaaaaacaaaaacaaaaauuaaaaauaaaaaagucuuuuucuugggagcuggagagagagagcucagugguuugaaaaaacugacuacuuuccuaggaccuagguucaauuccauggcaccucacaaccaucugugugacuuuagggaucugaugucaucuucuggcauccucagacacugcauguacacggugcacaaacacacauuaaggcaaaaacaaauauaaguaaaauccccccaaaaauuuaaaaaguaaacaaaauaucucuauggagacuuuuaaaaaaaguauagacacaagcuuagcagcuaagaguacucauucuugcagaggacacggcacacacagaggagcucacaauucucuacaacuucagcuccaggaaaucuggcucuaccuucagaccucugugggcaccgagugugcauucaaugcacacacauacauucaggccaaguaccaauacacauaaaauaaaaauaacuaagucuuuaacaaacaauaacaucaacaaaacucuggucccugggaugcagcugggcacaauggagcacauuuaugguccuaacacucaggaggcuaaugguggaucuggauuuuaaagcgcagcuuugguuacaaccaaggccgggcugggacaaaugagaccaagacuuuggacacagcaauucaaucacuguucuacuuugcccacuuuucaacuuccccaauagauuauuagagaaguaaauaagcagcaauuacccaccccccagaaaagagaaaaggcacauacaaguuaaagagcuguaaauaucucauaauuagaguguugggagcggguguggcggcagucccaaaggcgccagggacugcagcuaagucauaugacuugcaccugacuuccucauauaagacacaaacaucuugagugcugcgcagguguaccaggauucaggugaauccaauuugguggagauuugccccugcugcccugauuagcugaagcugcgugccuggugagguggcguggccugcugugcguggaugggaacugagaguauaaaagagugagaggcccaggguucgagggagauauaaacaaggaagauauaaacaggggagauauaaacaagggagauauaaacaagaagaaauaggacugaauaaacgugugcagaaggauccuguaguggcgucguucuugcuggcgaguugggggcgcgcuggacaguuggugcugaaacccgggacaagaaacaucuucaggcacgagcgaagacccccugcuacagggaggauucagaacugcaucacggggaaggagugguuaauaaaaguuccuguaaaacagacuguugagaaggaucuggcauggauucagaacucuucagcuggggaacgguauugaugaagagaaagaagaaagaugaagacugaguaaacugcuguuagaaggacugguggucacaucguucuugcuggucgagagcagacgcgacaauugguggcccguacggggaaccgacucccccaccgaguucagaacuuucagcagucagugguugccggcaggguaaguucaaggugagugaaacuugcgaccccaggaguuugggaaggaccucgauaaaauagaggugagcauaaaguugccaggaaguaggcacaaaguaacccaggaguuugggaaggaccuccgauaaaauagaggcgaauauaacguugccaggaagcagguacaagguaacuaaagguucaugguuuugggauaaguuaagguuccugguuuggggacaaguuaaggaacuaugauaaccucaguguagugaucaauagauccucgcuguguaguuaugcuuuuuucucccauugacccuuuguggguaggucugauaguuuuggucuuguuuguucugauauauggacucuguuacuguuugaaucaagaggcagucaagacaggucagaaaauccuuacagagcaacaagaaaguaugucggaagaagagaagggcuuaaaaagaaaaaggaaaaagaaaggagacacaguguuaucagguggacagaaaggacaaaacaaaagagcugagguggaggaggaaggcaaauuagcuuuugugccgccucccuaugccuccucagcagccaccuguagguggaccuucuguccggauauuuggagaggaucgaccagaucugguguugacaugggcgagagggucuguuuguguguuuccacaggaccagacggaaccucuuugggugccggagagauuggugagacgcugcaagaaugaggcuccugauccaguugccccuguggaugugguggaugaucccacaagcacaaaggauggagccaagaugagagauccuuucgguauuccagaagccgauaccagcucgacaugacauucaaauuuuuccauccuuuuugaucccugaauuccccuuaaagagauagccucucuggcuaucuaucccuugcuucagggaagaugagcggggaugagagagcccugggauguaugcuuguuauaguguguguguguuuuguguuuggcacauguguuaggugcagagugugcggcccgcacuuucgccaugguagcguaggcuuuugcugcaguggaggcaggacaaucuccucagauucgguuugccgcucuaaaagaaauuaugcugcguuaugccguggggugcgaggcuaagcacugcacagaggauagcuugcuguuggcauccuguggaaggcacgucugauugcaugaagguucaguguccuaguucccuucccccaggaaaaacgacacgggagcuggccaagaccucucugggugaugagccuaagggaugguuuuguguagggccccuaugcuugcacacuggggaucagaccucuaccuucacccaugaggcuugcuugcagcaauuaagaucuggccauaaguuaauuaacauccuggccuuuugaugcaccugccacaagcaaaacacaaucuccccaggaguggcuuggcaugauagagagguagucagugauaagacucccugggcaugucaccaaccuaagacagggaucaaaccaaugcuguuugucacccaaggacggguaaggggcauggcugcugggggcuaucuacagacauucucucugccaaaaaagaaaaaagggggaauuguugggagcggguguggcggcagucccaaaggcgccagggacugcagcuaagucauaugacuugcaccugacuuccucauauaagacacaaacaucuugagugcugcgcagguguaccaggauucaggugaauccaauuugguggagauuugccccugcugcccugauuagcugaagcugcgugccuggugagguggcguggccugcugugcguggaugggaacugagaguauaaaagagugagaggcccaggguucgagggagauauaaacaaggaagauauaaacaggggagauauaaacaagggagauauaaacaagaagaaauaggacugaauaaacgugugcagaaggauccuguaguggcgucguucuugcuggcgaguugggggcgcgcucgacauuagagaacggcugcuuacauacagaguaauaacugaugguuucaguauacuauacucuguugauucaaacauuuucccauuuaaaccacaaaauuacaaguauuaacuuuauaaaaguugaaggauguagggauauuccuucauucaccagguauuccucaagugcuuauuauacccuauguacaaagcuaggcauacaagaaauaaauguggaaagaugcuucucugacagccaaguagucaaacuggaucucaagcccaagaagauuggacacaaacauccugcugugcuguaaauaacucaugcauuucuccaucauagccacaaacagugcaaccauucaacagcccacugcuguucuaucuucuguacugugaugaggaggacagcuguuucacaccgcuuucuuuaaaugugauuuuacuaaggacuguuuacuuucuaucucuacaaaagcuacaucuggacagaguuuuacaagugacccuuucuagcugugauugucugcaacuacaaccugagucaaguuaaagacacagaauuuagccgggcgugguggcgcacgccuuuaaucccagcacucgggaggcagaggcaggcggauuucugaguucgaggccagccuggucuacaaagugagugccaggacagccagggcuacacagagaaacccugucucgaaaaaccaaaccaaccaaccaaccaaccaaccaaccaaccaaccaaccaaccaaaaccaaagacacagaauuuaaaacuccaucaauaaccacucacaaugacuccuguaaucuccguacacaagagagguagaaggaucccugcaagucucagccaaccaguuauauaaugaggugcucaaggaaaaaagauaaaaauccaaaacaaaugaacaaaaacucgaaacaacuacuauuuucaaagcaaaagaauaaaagccaaaagugagaaauuguaagccauuucucugaggcacaagcaagucuuugggggcuggagagaugacucagcaguuacacucucuggaugcucuuccugaagcuccagguucaguucccaguaccuacacggcagcuuacaacuaccuaccuacaacuacaguucuagaacauccuccucugaccucuuugaguaucaggcaugcauguggugcacagauagacaaguaagcaaaaaacucauacacauacaauaaaauaaaucuaaaaauauguuguuuuuuaaaagcuuauuuugggggaacuaggaggauaucucaauuagauaagagcacuuauugcucaaguauaaggaccugagcugaaucccuggcacccacagacaaaaggucagccagggcacgugaaaccuuaccuacccuugcauacauaaugcacacaguuuuccuccuccucuuaauccuccuccucuuccucuuccuccucuucccacauuuggaucuuuuuuccuuugugcuauauguuccaucuguggacauucaggauacugucaacaccaccuuugcuacacuacacacuguuugcuugguagguuagccucaaacucaggaucccccugccucugugcccaggugcuggaauugcagaugugcaucacuaucacugcacuugucuugagccuggacacacaacaagcaagugaacauaauaaaagcaguauuuguuaaacaucugugaaucaaaaaguacacauauuuugggaacuaaggauauaacuaagagguagaauguuucccuagcucacauggaggucccugaagcagacacaaacuaaaauuucacaaacucauaaaaucucaauuaaccugaauuuuaauauauuuuucucuuuaacugguugcuaacugaaguucucuaaaucaugcacccucaaguauccuaaauucuggaaagagguuaaaaauauaguuacuggcuuuugagacuauauuuuuauuagauauuuuauuuacauuucaaauguuaucccccuuuccuaguuuccccuccaaaauccccuauccccuccccccacucuccaauccacccauucccacucccuggcagaggcaugccccuauacuggggcauagaacucucacaggaccaagaaagggccuuuccucccacugaugaccaacuaggccauccuuugcugcauaugcagcuagagcuaugagucccacaaugggacucagggcucuuugguuggugguuuagucccagggagcucugggggugcugguuaguucauaguuguuccuccuauggggcugcaaaccccuucagcuccuuggguacuuucucuagcuccuccauuggggacccuaaguuccauccaauggaugacugugagcauccacuucuguauucuccaggcacugguagagccucucaggauacaacuauaucaggcuucugucagcaagcacuuguuggcauccacaacagugucuggguuuggugguuguuuaugggauggauccccagguggggcaguugagacuagcuauaaaacacucauggcacucgggaggcagaggcagguggauuucugaguucaaggccagccuggucuacaaagugaguuccaggacagccagggcuauacagaaaaacccugucucgaaaaaacaaaaagaugcauggauugugauugaucuggggggggggggggcgaaggggcacaaauaagacguuuucacccagggcugggaaugugugaugguuuguauauccuuggaccagggagugguaccaucugaagguguggccuuguuggaauaggugugaccugguuggaaugggugugucacuguggguguggguauaagauccucacccuaguugccuggaagucagucuuccacuagcagccuuuggaugaagacauagaacucucagcuccuccugagucaugccugccuagauacugccauacucccaccuugaugauaauagacugaaccucugaaccuguaagccagccccaauuaaguguuguuuuuuauaagacuugccuuggucauggugucuguucacagcaguaaaacccuaacuaagacagaauggauuacagcuuaguugauugaauacuugacuaacaugcagagaccaugaauguguucuccagcacuguauaagcacugugacaacuaaagcuguaauucuaggacugggaggcagaggcagguggaucgucacagucugagguaaguguacacagugaacaaacaaacaauaucauuuuacaguuuaaauuucuaaauaucaagcuuuaacuauccucgaugauucaggugcugucucuuugcuguuaccuuuuuugagccauacacgauguggcacaauaugcauuuucguucucguaccauagugaccagaucugaagcacucaaugucaaccugcaagaaggacauaacauuuaguaaccuuuccagauagcaccuuuaauucacuuuucacuuugccccuuccucaaucuuuccaucucaauaauguaaauuccagcuuuaugaaaguuuaaaaacaaaacaacaacaacaauaaucuucugagugucagcccugaugaacuccccucuuauccuaugcaacaaauccugucauuucuaccgaaauacauccauccagcucucaacaucucucaccgcggaggcucuuaucacagcacagccuccugguguaggcacccacuuccauuuuacucucaaaaccauagcugaagauucucauaacaggauugggagaauggugguguuucuuuguuuagguccuugccaugccuacuggucuguuucuccccucaccuaauauaccucuaggucgccuguacugagugacacuucuggaagggccucacauugcacagaguaggucucacugaaaaguaaaaagguauauggccucuagcuaaggaaguuuuuaguauauacgguggcccuacagggagaugagaggcagaaacaggacagucucaucuguaggccagauagucugacuuauauagcaaagagaccgucucaaucaggguagaaaaacacggaaaagauguccucugaucuucacaugaaugcacgcccacagcacuacucauuaccaagcacucugacauauacucuuugugcaaaaagaacauuaaaaucuuuaaugggggucuggagagaugacucagcgguuaagagcacugacugcucuuccagagguccugaguucaauucccagcaaccacaugguggcucccaaacaaccaucaguaaugggauccaaugcccucuuuuguugugucugaagacagcgacaguguacucacauacaugaaauaaaucuuuaaaaaaaaaaacuuuaaugaauguuuauuucuucuuuuaauuuacuuuaauguaacuuuaauuuaaaguaaauuaaauuuacuuguaauuucuugaagcugauaacauguacaaauacauuuaugauuguuugcaccaauaauugaucuuuugaaagguuuuaauuauauguguugaguguuugcauggcaguaugugcaugugagugcaaauguugcuggagcccagaagagguugccagauucucuagauacauacaaucagugaaccauuugauguggguacugcaauccaaauuuggguccuaugcaagagcaguaaguggucucccacucaacaaucuuuugcaaacugcuggccaaugucaguucauccacucaagauaugaaaugauaguaucacuuuuaacugaccaaucucagccuagguauggaaucggggucugcuguggaucucaggauccagguuagaaccucggguuggaaucucauccacagacuuuuuuguuuuuuuaaagagggucucuauauauucacaaagcuggcugagggcucuaugcaaacggucuccuccuucuuucaucucccgaaugcugggacuacaggaaugcaccaucucacuugacuuuagaaguuuguuuguuuuuguuuuuguuuuuuuguacuaguuauaguaccuagggauaaucuuuuuguguacuauguaauacugucuuugugucuguauuauauagaugcugacuucugugcuggcagagaauacagugcagacuggacuuugguauuguuacuuugauugaaucaucgccugccgagguauuuuguaaacacuccuccucucacuuucugaagagacugaacuuugagaaggagucagaggcaggaacacuggcaagccugacacugaaagaagugguacuagaaacugagacaacaagccauguggcagacacugaauaauggaaguuguaagagcuggucgggaaccagaguaaccaaaggccuaaagcuauuuuaaauaacuaugucuccgggucauuacccagagcuggggagggcauagaaagucuguaugggacauaguacccagugccacacaaaugccaggcacugcucugucacugaacuauaucucccccaaagauguucgacaauguacaaauguugguggcuuuacucucucaucacugaccaaaagcgcucaucaugguuggagacggcaccuacugcucuugcagaggacccaaguucaaucccuguacauaugucaagcaccucacaacuaccugcaacuccaguuccacaggguccacaccucuagccucuacaagcaccuguucauacaugcacauaaccacacucaaacaaacacacacauauauaaucaaauaagcuuaaaaaaaaaaaaagguuucuagggccaguaguugaagaguuagguuaaaagcaccaacuguucuuccaggggaccuggguucaacucccagcacucagauuacagcucacaaauggcugcaacuccaguuccaggauucgaugggcucuacuugccucuguagaugcugaguguguauguggugcacagacaugcaagaaggcaaaauaaauuuaaaauuaaaucgcacgaaggcaaaauaaauuuaaaauuaaaugauuuuuaaaaagcuuccaacauuuauauuuuccauggagauggagcugcuuuggcagauguacuacacagccuacccuuugaguugaaaaaggugucuugccgggcaugguggcaaacgccuuuaaucccagcacuugggaggcagaggcaggcggauuucugaguucgaggccagcauggucuacagaguaaguuccaggacagccaaggcuauacagaaaaacccugucuugaaaaaccaaaccaaaaaaaaaaaaagaaagaaaaggugucuugauauaucuaaucgggaacauugcccuuuuccuccuucaagccuuuugcauauuuuccacaaugaccucagcuaauggaugaacagggaucuuuguauucuucacuuuaugaaugauguuuuuggguuauaaaaaauaguuuugagguuauaaauuuaacuuaugugaagugcuugcuugccuauuaugaaucagauucugguuuugauccauaacacugcagaaauaaaauguggguugaggaagcagccuggcaguaaaggcuugccuagcugguaggccuacggcucuguccuaagcacugaacagaccuuuuacccaguuucacaaauaucucccuccccugcaccucauccuucuuagaaagaaaugaaaacuauacucuugccuuaguauucuauaacugcgaagauaccaagauauagcaagauauaaaaacuuauuuauguguaugaugcucuauuuacauguaugccuucacagcagaagacggcaucagauuuccauuauagaugguugagagccaccaucugggaaucuuugggaauugaacucagggccucuggaagugcagccagugcucuuaacuacugagacaucucuauagcccccaaggcaaaguauuucauuggaggcuaguuuacaauuuuagaggcuuauuauuaguccauuaucaaggcaaggagcaagguggcagguaguuguggcgcuagagaaaaagcuaagagcuaaaacuugaacuggaagcagaggagggagggggaagaggaagaaggugggaaggggcaggggagggagacagggagagggccuuuugaaaccuuuugaagcccauccccagugacaaacuuccucuaacaaggccacaccuccuaauccuauccuaaacuccacucccugaagacuaggugacuaagcauucaaacaaaugagccuguagggcacauucaaucacaauuucuuauuugcauguuaaaauuuaaaagauaaacauaacgugcuaaugaaaaagaaagcagccaggcuugguggugcacgccuuuaaucccagcacuugggaggcagaggcaggcgauuucugaguucgaggccagccuggucuacaaagugaguuccaggacagccagggcuauacagaaaaacccugucucgaaaaaacaaaaacaaaaaaaaagaagaaaaauaaaaagaaagcagauggaugcucacagucaucuauaggauggaacacagggcccccaauggaggagcuagagaaagcacccaaggagcuggaggggucugcaacccuauagguggaacaacaauaugaacuaaccaguacccccagagcuugugucucuagcugcauauguaacagaagauggccuaguuaagccaucauugggaagagaggccccuaggucuugcaaacuuuauaugccccaguacgggggaacgccagggccaagaagugggaguggguggguaggggagcaggggaggggggugugggggggaggguauugggaacuuuugggauagcauuugaaauguaaauuaagaaaauaucuaauaaaauaaaauuaagaaaaaaaaaagaaagaaaacagagucaggaguguuagcacacuccuuuaauuccagcacuugggguuaggguuaggcaggugaaucucugagaguugaauacccagucuggucuacaaagaguccaggacagucagggcuauuacacagagaaacauggggggcgggguggaggacaaaaaacaaacaacccccaaacaaaacagcaacaacaaaaagcaaagggucuggagagauggcucaugaguuaagaacacugacuguucuuccagaggaccugaguucaauucccagcaaacauaugguggcucacaagcaucugcaauggaaucagaugcccuucuugugccugaagacaaauaaaucuuaaaacaaaacaaaaaaaaggacaagcugggcaugguggcgcacgacuuuaaucccagcacuggggggggggggggggggggaagaggcaggugguuuucugaguucaaggccagccuggucuacaaagugaguuccaggacagccaggacuauacagaggaacccugucucgaaaaauccaaccccccccccaaaaaaaaaguauuuuacuauaaaauaugugcuucaauauauaaaugcuugggcaugacuuuauuagaaaucauaaaauuaugaaugcagcaccuagaaaaacauacugguauuaagacuuaucacuugcugagugugauggcauacacuuuuaaucccagcacuggggaggcagaagcaggcagaucucuggguuugaggcaagccuugucuccaagcaaguaccagcuuaaggugucugaucaucauaaaacaggcaugguagcacacacuaguaauucuagcaccagaaaggcugaugcuagacccaugaaagggucauggauuugagcuagcuaucuccagcucugucuccacaaacgagcaacagcaauaagaaagcacaaguaaacuagaauaaacuucccauucauauucuagcaccagggaggcuguuuuucaaagccagauugguucaggcuagcuguggcuacagagcaaagaauuauuaaacaaacaaaugaaaaacagugagaaaccaccauugaggcuaaauuuaccacuaagcccacuagucaaucucaguaucauuaaaaaaugggaaaccucagcagacagcaucacagacagagcauuuagcaggaauccaauaagcacuguucucuagcauccaguugguuguaacaagcuuagugauauguaucacaagccugaaucaucaguuuuaucuacacaggugucuucaacaaaucaaggugaaaaagcaagaaaugaaacuucucuguguuaaaagagaccucaagauguagacuaacaaaugcaacaacauuguagccuuugaagguuccugaugguaagccgugcagucccaguuacucaugaggcacagaacagaagcaaguucaagacagccugggcaagguagacagacugauccaugucucaaaaagagggaggaaauguccaaaguagcucagugaaacaaacaaacacaaacacacacacacacuuuuuaaaacaaaacaaaaaagcuaggcgugauggugcuuauaauuuuagcacuugggaaguaugcagacuuaaaggucagcuuuagcuucaugaaacccuaucaaagaaaacaaacaauuuaguauugaauaauauagauagggcugggcagugguggcacacaccuuuaauccaagcacuugggagauagaggcagguggauuucugaguucuagaccagccuggucuacagagugaguuccaggacagccagggcuacacacagaaacccugucucgaaaaaccaaaaaguguuuguuuagcuugaaaagaaaaagaaaaagaaaaaaaaaaaaaaaaaaaagucacagacugugaaacugaaacucuggaaccacuucuauccuucauccuugacaaacauuuuccacuuucagaaguggcucagucuaacaaaagcacaaauuuuacaaguccucugauacacaccugguagcucauacuucuggacagccccuuucagacuacaaccacagcaacagaguguaagcuguucaugggcaacuugcauccuagaugagcaguuaagaguaauguaaccuuuaguauaaaaauccucaacuucccuuuccagaacccauuuacaaaacacaaacuauguagagaucucaucuuggguuuaagagccaaggcacucaauguucccugcuuuucucagagaccagccuugaauuuguucuaaucuggauguacaguaaggacaugguuuuucuguuuaaaacaccuuccuugugucaaagccacugguucugcaccagacugaugaaaucccuucacaccuuuucuuuccugacuguugaagcucucuucaaaaauccaucuugacccucucuccaguuaaaaucuacgaugggcuguacgaaauuccagcacugugauugaacucaggaucaaguuugaggccagucugggcuacauaagccagauucucuccaaaacuaugaaucaaaauaaacucuacuauuuucuguaucuaguaguucaguccgaucucgaaggagugcuuagaaugucuaauuuggggcuagagagaggcuuagugguuaagaucaccgacugcucuuccgaagguccugaguucaaaucccagcaaccacaugguggcucacaaccauccggaaugagaucugacgcccucuucuggugcaucugaggacagcuacuguguacuuagauauaauaacaaauaagucuuuaaaaaaaaaaaaaaaaagccgggcauggugacacacgccuuuaaucccagcacuugggaggcagaggcaggcggauuucugaguucgaggccagccugguccacaaagugaguuccaggacagccagagcuauacagagaaacccugucucaaaaaacaaaaauaaaaacaaaaacaaaaaaagaaugucuaauuggguguaucagaaagagaugagcguagccaucaccggagaugaaguucacuaacuccacaacgugaaaacuucaacaaaucacucucaguaucucaguaccucauguaaaaaguacuacccaaaaacaucuacuacaacagcuuguuaaauucccaagacacaccugaauguacuuaucacacgcaaagcagauacuaaguaacucguagaugaaucugaucauucauucuuucguuuuuuggcguuacacuuuuaagauuccccccuguaguuuuagaacaggauuuggcucuuaaucagucugugauuggaaucacuuuaauauaaaccgauaugguggcuagaacuguaaucugcuuccaaguugggguaaaaaaacacacacacacacacaacacugaaaucuggaacuuccccaaaaagauaguuuacguuacuuucaaagaugacuauaccuaacagacugaaacgggaggcggugcaauaaucuccucuccacacuacgcaccaaaaucguacuaaauauuaaauggacacauaccguuccacuaguugcuacuacauugcuaagacgcaucccacaaguagaguccucaaaagcaggaaaaagaggcgacacuguuagucucggaaggcuagagauggcccuggccugaaaccuacagcuuuuaaacuaaggcugagauuccuccuagacuagaccccaugccgacagaggucagggccugccccaaaggucaaaaaccuggagccacgcguccagucuggguugcgaacagaaucggauugcccuugcuggaaucugugcccagaagccagacgcaccgcucgccaauaaacccuaaacccacacaggucagaaggggcaucguagcguggucgcaugcaggcgcagcuccaccaccuguccagggggcagacccucgggcuccgauacgcccaaccaggccgcauccuccuuacucacacucacagcccgaccuuccuacgccaucuggccgccgaggacccggcgagggagcucccagacgcccccuuagccuccgguccggcggcggcccgggacccgcuccccgccgggcacugacgccgccgccgccgccgcuacuaccaccaucgcgcaagcgcgcaggcgcacgca

SEQ ID NO: 1023 - RNA, 776 nt, Mus musculus
cagacacaccucuaccacuggagccaaucgccgcggagaggguguuaaaucuccugccacgcaggcggagauccugggaagucacccguuaacccuacagauucuccccgggaggaguucuuccaacuaucaucccugaaggcagccuugcacgggacgcuuuaguguuugaaagacuaggaaaaacucgcgacugccaaagucuacaggguguuuuggcccguuuaaaccagggaaauagaugcguaaauaccuuucaguuaacagaauacggucacaggaauuccgaagcagcuuuggccaacaaugaacaaaacauuuauuuugaggaaugucugaaggauugacacaggaaguuacucuuaaagucacgaaggauaugauaaguaggaguacuucggaagucuacgagauaaagaguuuuccaggcagugggaacaacaacaacaacgcagcgccuucuggaaguuucuuguuagaaguuuaagaguucgcuuucugagacaaaagaaaaugugaagacgugguagcucacauuguguaauccucaggcuaucagaaacugaggcuggaggaucacuugaccucuggaauguaaagccaaacugauaacuuagugagauccuauuucagaguacagucuaucacuggguugggggggagaauggaagagcccuuuuagccccgagaccaccgccaucagggcugaggaucaagcuagaucuuuaaaggucuuguaaaauuuggaauaauaaaccuaggauucguuuuauacc

SEQ ID NO: 1024 - RNA, 5286 nt, Mus musculus
ccaagugguuuagcaguaacccagcugcagucugcgaggacgcugggucccacggguuggcggccgccauggcuuccgcacaccucuggaacuggcgcgaggagugaggggcaacaccgcgaacaggcgcgcgguuugaugaugucacagggcguuccugcccgggcggaagcccugggagcgcgucucaggcgagcgcggguccccgguguucccuggcggagucuucuuugcacugagcgguaggaggcgagucucaagcucccuguuccggcagcagcuaucggaggcucccuggcccuuagcucugcugccaaagcaucaggaccuugugguagcgcugccugcucgccuguuuucuccuugccacucuugggcuggccccagggaaguagggauaggcagaaggugacaauugggacaggagacccaaacgggagauuuagcgacgacuguaugucuagacuaggcggugacagcuaugcuucuuuuccugcagggaacugagccguggcgcuaggauggguaacagugcucuccgugcucauguggaaacagcgcagaaaacuggugucuuucagcuuaaagaccguggucugaccgaggugagaccugaggggaccggaccaagaaacuaaaagggcuaggguuggcgggguggcgaagacuauuggugcaggauuuuuccaaacugugagcuccuuucuccaguuccccucagaguugcagaagcugacaagcaaucuuaggaccaucgauuuauccaacaacaagauugacagccuaccgccucugauaauaggaaaguucacucugcuaaagagccucucccucaacaacaacaaacugaguauggaauuugugucugggcagcuuuugcuaguaaucagcaguuaugaaggguguuuuuccuguuagaugauuuuuguuaugaaaucauuuuaggggaugcagaauguuagaguauugaagcuuuaaucucuuguaauuaaauauaaaagccucuuugggugguauaaugauuauuacuagguuaauuuggaccuggaagaccuuugggaaucgauauaaacaguuaucuaauuucggggcaggguggaaugggaggaucuuuuaaacucccucagaucguuuuuagaauacagcuaagcaaaaggaaccccuuacacacauacacaauuuucugcauuuugauggcuucuuaaccucccaaacaguuugugaaaccuaaacaugaccugugagaauucuauguaagaagccagaccuggugacuuagaccuacaguagccccagcuacucagagguugaggcagaaagaucuuaauuucaaggcuauccuagacaacuuaaugagauccugucucaaaaacaagaugaagcaggcuaccauacugucuuuuuauaaaugucauuaauucuaucggauuuguuuuuuaauuucuucuucaccagcuguucuaccugaugaauuaugcaaucugaaaaaacuagagacacuaagucucaacaacaaucaccugagagagcuaccaucuaccuuugggcaguugucugcccugaagacgcugagccucucugggaaucagcugggagcauuacccccccagcuuuguugccugagacaucuagauguaguagaucucucuaaaaaccagauucggaguauaccugacacaguuggggagcugcaggccaucgaacucaaucucaaccagaaccagguccauacuuuguguuguuuugccccucuccccaguguauguuugcauuuauggucuucugauuucuuguuccuuaaacgauaaucauggaguuggaaauuagaagcuaaaagauauauaaggugaacuuacuccaaugcccagaaucauggaguggguugauaguggcuguguaauuguguugaaaguguuuugaggaaggaguaacagggugagauaauuacacacacacacacacaaaauuaaaccuaucgaagguuuuacagauauuuucuuuucacacccauuauuuagugaggagccgugucaggggugauauaguguaggaaugagaccuguacccauaggaucugagagucagacguuagaaauuguugagaaauccaugugauagcuguucuggagcuacguuauaauuggacgacuuuacaugugaaauguuuugaagcuccuugguuaacauuaguauggagauggugcucugcuucagauaugaggcacagugaugaaacauuugagauucgguagccuugaguuuuuagcauuuauguauauguacauuaugcauguauauuagcuacuauguucauguuauuacugugcuaaauuguaguuagcauaauauucagccuuugagguugguuuugucuuuuuccugagauuucuaggaaagaacugucauugguauucguugaauaauuccacauucccuacuacuagaccaguuucucagaccuuacuuggauaaccuggggaccuuaaggucaccuaaguguuugauucaguacgugagaagucuaagaaucugcagaaucugcauuuucuguaaguuccuaggugaugguuugagaugcagguagucaacagaauuuagugaccagaauuuaguuuuagugaaaacuguagauacacagcuguauucgagauuaguacacaggacuguugauacagauuuugaagucacaagugaaaugguuuuaagaaugauuguuuucuagaagguucuaaauguuaaauaggaagcauuaggaauuuauuucugcuugaauauaauuauaaagaaauaaaaagggugguggugaugcaugccuuucaucccaacacucaggaggcagaggcagggagaucucuuaaguuagaggcaaacuugguuuacagagcaaguucaaggccagugcuucagagaaauucugucucaaaaaaacaaaaagaaagcaaacaacaaaaaaugacacccccaaaaaauuuucaggaaaaauucagaagucaugcacuagagggagccucaagaaauggguaguccaggcagaugcugcagugugggaagcaugacuuuggcuucagcagagugguagguaucaagauguucaugugguuguuucugaguggcagcuugcugguaagcuuuucccuuaaacuuacauuauuuccuacaauaaauacacagugcuuuuauuauugguuuuuauuucugaaaagcuacugguaaccuucaaauaauuuggaaguggaggaguaacagaagguauguuacaggcuucugugcgaguagguagugagaaaacggaggcgguaaaagaaaaacuaggacacagucaagagcuguuucaguguaguaacguggccauuaugcucucuguccucuuacuguuugguuguugacagaucucucagcucucugugaagauauccugcuguccucgccucaagguccuccggcuggaagagaacugccuugagcucagcaugcuuccacagagcauccucagugacucccaaaucugccugcuugcuguggaaggcaaucucuuugaaauaaagaaacuucgagaacuagaggguuaugauaagguguguauuaacaucuuuuacauuuuuagugccugcuccagagaaaaaacuaaugagauuaaacuuaagugaugucuacaguuagcauuugacaaguuuguuuuggagguagcucuaagacuuggccagacuguauugugccaagugacuuucuccacauauugauuaucgcacugcaucuuuugauguuuccuagccaaaaaaaagaggcaaaaauuaaugaauuuaaguagauuuugccagguuuggagcaggguuuuaauccuagcacuugggaggcagaggcaggcagaucugaguccaaggccagcccagggcuacauagugagauucugccuugaaaaggaguuaguuuuguaugaaauuaaucaagucaaauuaaaaagaaaaaaaaaacauaaaaacguaagucaaaaaguaucccugggggagggggggcuggagaaauggcucaggaguuaagagcacugacuguucuuucagaggaccaggauucaauuccuagcccccacauggcagcucccaacuauccauaacuccuguugcaggggauccaacacccucacacagauauagaugcagucaaaacaccaaacuacguaaaauaaaaauaaaucauugaaaaaaaaaggauucuuauauuugucuacaccaaaugccauauguauaauuuucuuucauguuuuuaguacauggagagguucacagccaccaagaagaaauuugcaugauauucuccaggaucaugggacagacuuggaaccucuguugaaaucugacugagucaaaggcuccugauguuggauacacugcagagaacauuuuacuuaaugacuuuuuccuuuuuaggacuaugucagauaagcugaaggaaagggauuuaggaguaggagacaggaagaacccuucaucuugagccguguaggucauggccaguguugaucuucaaaacuaucauuaguugggcucuaaggaaccugcuguucaugaagggaggaaaugcugcuugccauagcuggagacuuugaguuugcgaacugucagcuuucauaaagucuuucccaucaccucuguguuaauacuucauauuuuuuaugaaauucuaauuugugggaaacguaugacuaaggaugaauguguuuguuccuguacacuaacucaauagcaguguuuacacuuggaacuuaggauguaccuaaauauguagcugucuugaagagaccuuugucaaaggagcaccaacacaacagccaccgagaauguuccccaaggcugcaguagcaaauuuuuuuuuuuuuacuauugcaggugccuuauugguagaaggcucugaaagagcuaaaacuauaugcaaaaauuauacaaaauuuuuguuuuuagacagguuuuugcuauguagcccaggcuggccucagacucaaaaucucccaaccucacaccucuccccucccccacaugcugggauuguaggcaugcgcuacacucagccuacuuguaggauuuuaaauuaauuuuaauaaucaagauuuuccugaagcuuuguuaaaaaucaugugcuauuucugguaacuccucccccuuuuguauuuauaacuguacuaaucagauuaccuucaagaaaaccauugcuacaauauuuuaaaauaacuuauguuuaucauaguuacucucugaaugagagaauauucuaaauaaaauauuuuuaaugaac

SEQ ID NO: 1025 - RNA, 1160 nt, Mus musculus
cauucuaccaucaggaccauagaacaccaccaccgcaccgcacacagcacaggaauccuuccuaccaguggccaggacaagagccgguugaaugaugucaauaguuuccgaacagaacuucucuaaggccagcgcucugccuggaucuugaaaucugcucaggugaaugucggauaucugucaaaagcaggcauuggacagacacguuaucugagucaggaagagccgcaccgacacggguggcccgucagcucucggggagcggaagggaaagaaaaagaugcccuaacgaaccccggggaaggagagccgagccucccggcggacugcgaccgaggcccccugcugggcgagcccgccccgcgcugugcccuccccuggccucccgccacuucaccugcagcccccagaagauguuguuggcuuccgagcccggggcggggugcggccucugggagccucugggcuucggcagcggcguagucggcccagccaggccguagugcuccaacagcagggcggccaccgcggccgccgccagcccugccaccacccggaccgccagcauucucgccaucucggcgcagccccggagcgcuccggcccgcacuuccggccucuguggccucccgccgccuccgcaacucgccucagcccaggccuccgcgccgcggcagcccgguugcccggcguuugacaaccuagugaggaccaggaagagccaagcgaggggguggcagggaggcagcucgccaccuggcuccaccagggucuggcaucccugaccguggugcgaccucagcaccuguaaagcgaaguuaaugacaccuugcgugcgugcggggugcuugugagaaucaaagugaguaucaggacgccucuuaaaguacaaaugcgacgggcggcucacucuggcuccuucacgaauaacauaaccccacaggauuccuuaucuuguggaaauuaucuuuuuccuuaaucugauuuuauauguacuuguuaugguauuguggcacuguaguauacuuguaaauuaacuuuuucuauugccugaagcagaauuagagucuagucguggccuuaauuuaucaaaccuacuucuuuauuguuggcuuucaacucuuuaauauguguugcuauuaagaauaaacauuuuuaua

SEQ ID NO: 1026 - RNA, 16255 nt, Mus musculus
cacguaauagccgcgguggauaagcggcgugcgccgcacgggucccgggaccagcagcgccgcaaaggggucgcgcacguauccgugugcggcaagcgaucguuugcugagggagcugcugucguuggugcucuggaccguucccgcccggcgcuggcggccucgcgggcccaugacgagaaggugcucagcaauacugcacacagaacacuuaccgagcucccgcucauccgcuucugggugcgucacuuccgagaagaccgcucucugccaaaacccgcgagagguuuuuugaccuuccccccccccacccccccuuuccaaauuacguuuuccugggaacacgccagcugcuucgguaacagcuagcgcuuggagagcucaaguuaccucuuuguacaggcauuuucugcagggaaaaaaaaaacuuguguagauccucuuauuugagaacauuuuuaggugaaucggaggcugacgaccugauaccgguuugguccggcaaaagaggaccagcaccucggaucuuaagcaauccagaguagauugguccuugcacaaaaguaacaguugcuccuuuauugaguguucucguugcgagggagaacucauuuagaucuuaaauuaggccauauggaaagugaagaaagagaccuuuacggauaauuacugauuauuauuaacccacugccccuguacgugcuguuuauucucauguagucuaaauucugugcuaggucuacagugaguaaguauucagcauguaaaaaugacacuccccuccacuuccaagauucugugauucguaugugguauugaguaugucugcugaaaaucgcuauagaagagaugugauuauucccuguggcguuguuguuuaaaggaagcaacccagguuggacuuuuaaaguuucuacauuugaugcuuaggagauaccaguaagaaagcacucccagagaugcguagaaacuucaucauuuacuaauuuagugucugcuuggauuaggaaaggaaauagaaagacuugaagaaugguuaacucagagcaguaguauguaacggcugagaguaugaguucuggaguccaacuggaucaagaaaaauuuucuaugaagauuugguuauuggaaaauguuuuaggguuaggaacucguuaguggucuuagaagagcagauuguguggcagaaugauucagugcgugcaagauauguuaauaaaggcaucuagucgaccagaaggaucagagacaggaggcagcaaauacuacccuccauccagagacaggauuuucgccugacagacccaacccauuuaaggaaaguguuugugcgacguaaauaugaaauaacauguuuucuuguaaaagcaaauucgugcuacauguguaagcuaaccugaccuacgcaguagauuaaaggagcccagaguuaaagggacagacgaacgcuggauuuuuaguuuucggguguuuuuuuuuuucuuguucuuuuuuuuuuuuacuagucauuuccccauugcagacacaccuaaguuagcuuugcuuaacuuaaguuagugggagcaggggguugagggggcuugggagguguaaaaagaagauaucagcagugacuguguuucuguuugcauguuagaucugaaaauaguuacauuuguuauuguaggugaaagugaucccagagccacacauagugcaagucuuguuuaaaauggcaaucugaaggaaguccagcaccucagagauucccacuuugauaaguuuaucguccaagccgagaauaagagcaaagagaaacuuuuccuucuacugaagugauggaggccggacagcaguggccugggaagacagacuuuuaucugcaauuaccaaaagugguaagaauuaacuacagaguucuuguuacuguauaauggcuuuuguauuguuuuccacaaaagagaaguaaagcuuauggguagaaauuguagaguggguauagcugaaccaaguagcuggccuaguauaaacuacaacuaggaaccaggccaccagggccugauguauggggcucuggaucucguggacucuugugaacugauuguccucuuguguuaggagcuccaugcccacuugaauggcuccauuaguuccaguaccaugaagaaacugauagccaagaagccacaucuuaacguucauggucacaugaccaugauugacaaggggaagaaaaggacuuuacaagagugaguuugggagguugugggaauuuuuuguggcuguauuuugggauuauaauauauaagaaucagauuuuaauacuuagauaggguagacaucuggcauaaaauauauaaccuaacucacagugcuuuuccaacugucagacugacaguauguuuaaugauuuauauuguuugucauauugaguuguuccuuagauuugaaaauaaagacagauugauuuuucucuauuugcuaguccuggcaggauuaaagaauaggaauggcuguuucauacuuuucaauauaaauaaguaauaucuuauuuuagcuauuaaauugucuuucuagaucaauguaauuuugaaaaaagguguauccuauaguucuuuguaaauuuaaauauauacuuacuauuaaccucaaauuuacuaauuaauuccauucugaggguuuuucuugaguaacagguuuugaugagggaaguguguuaagacauuuuuuuuuucauuuguagauguuuccagauguuccaaguuauacaucagcuuacuacuagugcugaggacauccugauggugagacacagaggcagguuaaaauggcgugacuuuccacagcagugcacagcucaccuugcgcauguccuuuggcuuucauccacgcucugauggagaugcuugcucuuuccccccacuuccuucccccucuuuauuuuuuccuuucuuuuucuauuaauuuacagauuuuuuuucaugacaacucuuugaaaagucaguguaagacauuggccuaagagcuaauguaaagucuguuguugucuuaaaaaaagaggaagcggguggaagggaaaggaagggagugagagaagaaccaaggucagcauuguauugaacggggaggagaaaggcaggagagccugacccugauuuccauguaggacaugucauaagaaauaguugggagcuggagagaugcucagugguuaagagcacugguugcucuugcagaggaccuggguuugauucccagcaacuacaugguauugggaccccucuguaacuccaguucuaggcaucugaccugguccucuucugaccucuucagcacugcacacacguggugcacagacauaugugcagggaaaaacauuugugcauacaaaauaaauuuucacaaaagagaaauauuuguccucagauaggcauauuucuuaucuguuccucucucucuucuuuuucauggagccuagaccggucucauauuuucucuguaguugaggcuggcuuugcauuccuagucuuccugucuccaccuuucaaaugcugggauucagguguucaccaccaugcccaggucaguaaggaaaacugugacaaaucccuguaauccagcacuuaaaaaggaccacaaaaucaaggagacccuggguuugguuugauucuuaccacaccuacauguccccugucugccccccgcccaaaaauguauauguauauguaucuguguucugcagaguuaacuuugaaguaguaaguuuuuucccuccuuggaauaagcauguucauuguauugauuuccuuauagagaagaguuaacuuugauaauuuaauaauuuccucacuucauuuuuuuaaacaacagacuuuaauuagcucuuaggccaaugucuuacacugauuuuuaaaagaauugucauuaaaaaaauaaucuguucaucaaaaguuaaguauguauuuccaauguaucagucacuuuaccaaggggacauaaagagaccuagacacagccccugcuucuggggcuuugucaguagauggagccauggacuucgagaagcucucuguuggaugcagagagaaggauuuauaggcauccaaaaugaugcacucucauuaucugcuuggcagaugccagggaacacugugugcuacaagagcuuagaucuuacuuuauuaguggauauuacggggaagagaaugaaauucuagguuuuaagagcuugaucugcuaugaguagaguaaugcuuuguuuaccugcuuucauuuuguuucagauugaaagcugguggaaagcucuuaaaugagaugagacauaaagauucuaugcauuuggcuuagugcugcuggcacaagcauccacaggugauaacagugaaguagucguauaugacaugaacaucuaucuauaagacuaagagaucacuugcuauagaagugagauugugggucauccuggcuggguuuugucaacuugacacaaaccucgacagacacagcaaaagggagucuucauugauaaaaugccuccauaagauuggucuguaggcaagucuacuggauuaguuuucgguuaauuauuccuguggcaggaccuagccugccauggacaguguaccccugcugagcaaaccuugagaagcaagccaguaggcagaacuccauggcuucugcuuaguuucugccugccuccagguuccugccuccagguucccagcuggacuucucucagugauggagcaugaguugacaguuguaaacuuaaauaaacccuuuuauccccaaguugcauuuagucacaguguuuuaucaaagcaauagaaacccuaacuaagacaugggguucauguaaaccauggucaagaucaccuauuuaugauaugaaagagucaggacuggaauauggaugaaaaauaagaugcucuacaagggccauaugugguggccuagacuuuuauuccugguauucgaggagcagaggcagauggaucucuaugaguuugaggucagccuggucuaugugauaaguuucaggccagccagggcugcauaguaagaucagguaaguuuagggcccaccuagaauaucugagacucugucucaaaaaagagaagagaagagaggagaggagaggagaggagagaggagaggagaggagaggagaggagaggagaggagaggagaggagaggagaggagagagaagagaagagaagagagggaaagagagggaaggguagggaagggaagggaagggaagggaagggaaggaaagggaagggaagggaagggaagggaagggaagggaagggaagggaaggaaaggaaaggaaaggaaaggaaaggaaaggaaaggaaaggaaaggaaaggaaaggaaaggaaaggaaaggaggcaaagagaagagcggcugauaugaagggaauggggucauggaaacuguugucaaacugacauagucuguacuaggaauggaaaaagcaggcagucccuacuaccugggagguuuccaacaggcuuugccaaugaaauuagauaaaaaggaagcuguagcacuuggccgguccauuggucaccuuccuauagcauugucaacauuguauguauugccuuuauuaucaggucacaaaagacgucauuaaggaauuugcagaugauggugucaaguaccuggagcugaggagcacucccagagaagaaaaugcuacugguaacauuuaacuaguccugagugaauguccuuguaggcagauuucugaguuugaggccagccuggucuacagagugaguuccaggacagccagggcuacacagagaaacccugucuugaaacacugccucccccgcaaaaaaaggcaaggugaauggcaccagaggaagaccaucgauuagauuaauuuaaucuaaacuauuuaaucagccucagaacaauuacuggcaaauuaccccuaaucuauauuuuauaugccagacuagcuaauauccagccgcauucccugaguacuugcuguuugagucuugccuggguucuuucugcuccagcaaucuguccuuagggggcauuucacacagccauggacuccuaguccaucgagucuaauggagacaacuugccacucuucuucuuuccaaaaaucccaccuaccucuauucuccccaguaauuggcuguagcuucccuuauuuaaccagucagaauggauaggugagcaaagaucuuacauuguuugacacgugagaaucuguucauugggacugugaccagaucuuggggccagugcuuaguauuugaauacauaaaagcaccaaacgaacccacaacagguuguucucuggccuccacacagauuugcauauacacacaaacacccucugaauguuuaggcacauagacacaaaggauauugccuuugcuuuguuccugccuugugaauaaugucacugaauggcagucacuggaaagucugauacucagagacucuuuagggacugggaauauuagguuagaaacaagcuaagcccucuggggacagaguugaacugggcaugguuuguaggaauuuuauagaacuuucaggagcgcuugcuuuaucaggcuaggcauggagccucccacccgugauguuuaaaaucagaauguuguguguccgcccuggggcugggcagcuugcugauuguuguucuguguuuuucauccaggcgaggccuggagcuggaguuacacuugugguuagccaccugguauaggugcuaagaaccaaacuggcccuuaaguccagauaggcucuuaaauccugagccgucuugcuggccccccgaggagaaacguuuuaguauaauauucuuugucuguggcccuguagacugacccuaaaacaucauguuugcuaggcaaaugcucugccacugagucacagucguauucccuaaaagauguggcccaggcuggguucaaacuugagauccucagcaucuaccucuucagaguaacccaccauuacgugaugucacaacaguuaaugaugacugcauuucagucacauugaagaaaaaccaaaaucaacuuuagggacaauaagugguuuauaaaaauguucauaagcaaacauaaaaguaaugaaagacagaaaaugaaaaaaaauaccaaaugacaggcaauacagucccauggggaaauuaaccuuggggagaggggcucuauggggggagcuggcagcauuugggauggcaagaaagaaugagagaaagaagaaagaaaacuaaucuuuguccucugaccucuacaugugugcuauaacauguuucuuauauaauaguaauuuuuaacuuaaaaaauaaguaauuaauaucuaauaaaauuuuuuuaaaaauaaguaauuaagagccagcauggugguacuaucuuaaucuuggcauuuggaggaccgaggcaggaagaccuuuauuuuagagaccagccuggucuacaaagaccauuucaaaaaaaccaaauaaauaaaaagauguuuuuacuuaacaggauuuuuuuuucuaguuuagagaagaggaaaaaaaaaucccucuugcagugagccaguuugguucucagcgcccauaucagauggcuaacucuggguccaggccucuucugggcucucuggauacuuaugcacaccugugcaugugcacauucccacaagauaaaacgcuuguaaauguuucucuaaaggucaugcucauuccucucgagccaggcccuagcauggcauacagggacauucauucagugaugcugcuggaaggguuaauaggugauaaugucuuuacaugugcuccucuguguucuuucaaggaaugacuaggaagacuuacguggaauccguccuugaaggcauaaaacaaugcaaacaggaaaacuuagauauugauguuagguaagaugaugguauaucaguaacaguuacccuuuuaaaaaacagaaugugauaucuuauaaagguaagaugaauuuuuuuuaaaucaacuauuaucugauuuuuaccuacaauacaaauaaauagacucaaggacccuguugcuuaagaugagaacacaauacugaauuuagucaucuggcagucaaauucuaguauuuuugcucaaguugaguauggcuucucacugcuguuaagcugaaguggacuuuuuagagcuaccugcauagacccagaugaucuggcugccuuucuucaaacaccgccuaacccacucacuccucuuaguccauauuagcuuacucucucuccuauaggcuaaaacuauccaucucagugccuugcacuuacaggcacuuaugccucccaccagguccuggcauagcucaauuuggcuguuguuuccucaaggaggccaucuugaccaaucuauccagcaugcuucuggcccccaaauccccuucucacccaugguccucuauggcauuaauuuguauuguugugaaguacacacacccuuugacuggaguggaaguucagagaaaugagcccuuguuguugauucacuacuauaucuccaguucuuugaacaaagucagccuucugaugguguuucugucuuuugagacagggucaaguaacccagaugggccuggaacuugcucuauagacaagguuguccuugaacuccugauccuccugccuuuaccucccacgugcugagauuauggcaugugccaugaugcuucaucaccuauuuauucuugccaaaaacuaaaucugauauaauuaagcuucuagagucaguccaauuauuucuuuauaaaaaauaccagagagcauuuuaaaauagggaugcaacaaauccagacugagaagcuuugaggagaaagaaccuuuuuuuuuuuuuaaacaaaaaaacuacauacaguuccaggcaauaagacucuuucauagacaaaagguccuugagaacccauauccaguugucuucugacuuucacaagcuaaaaaugcacaccaugccuguacuugcuuuccuacaaaugagcaugugcacacccaugcauaaaauacacauuaaaaaagguaugaauacaaugacuaacaaaaaguacagacuucauuuagauccugauuaaaacuaaagcuaaaauaaaaaaauauacacacacauacaaccaaagauaugaaaaaaaaaagugagauaauuagaaauuugaagacuggauaccaguacuccuuaggcauuuaugucuuguucuguauagcagacuacaaugucauauuuagacucacuacuuuauauaguaagccauauccaaguagcccgccauucuuuccugucaacauucagaagugucuuuuuuauauguauuacuaguuuuucaaauguagguuuuguuuuguuuuguuuugcuuugcuuugcuuugcuuugcuuugcuuuagaucgggucuaaacaugguguaauguggcccaggcuggccucaaacuccacccauucauucucugauaauuuugugguucuggguuguccuuacucccgguggcuuugugcuaaguaacucagugaagcagcugaguaagcagaaggcauaugauuaaagguagccuuucugggaucaguugguuugaaauuacuagagguuuucguuuugguuuggguuuccugagacuuuucuccugcaucccagaacggccuugaacucacauuguagcccaggauggucuuccugccucaccuuccagguacuuugauauaggcacacaugcaccuaugccuggcuucaucugugauuuucuuuaucauaucuuucugccaaguuaguaacaacuguauuuuucuuauauuaaagguauuugauggcaauugacagaagagguggcccaacaauagccagggagacugucgaacuugcuaaagaguucuuccucucuacugagaauacaguucuuggccuugaccucaguggagauccaacuguaaguuacuacauuuucucugcuacuggcagaaucagucaguggggugagggucaguuuggagcuucauaucaugcauuuguguccagcagacaccaaaugaagcccuguucugcucuagaucgccagaauacauagcauggcucuucuuaagggguuuuaaaagaaauaccauaaaaauaggucauagcuguuacuggauaugaccaaucuccauucuucuaaagacaacuuacaacuaguaacagucuuugcgugcauguuaauugcauuauguguguugaauagagaaaggugcugaguguaauuaugccauaaacccccuagaaagaaagcuuucaugagcuuccugagugaaagauucaaacaaaaauccugauacuuggggccagauaguucuuuguugugagcuguuucugauguuugucuguuuuugugauuuacauguaugguguuguuuguuguuuuuuuuaaauuaugaaagcuuucuaaaccaagugaguucuccacaauacuaaacaacuaugugucuuucagaaauaaaaauuuuggccugucauauccaacuuagguauugagcuuagcucacugguauuggacuuaagauucaaggucagggauauccuuuucaugguauauucccuaaaguguccaacacauagcucuccauaagcaagagguucggaagaaaccaaugugccaucauuuuaccccuuuauugggguagaaccccacaugccuuaguaugcucagacuucucaugcacccucauuuuaucuuuaagauaggacaagcuaacgacuucuuggagccucuuuuagaagcuaaaaaagcaggucugaaguuggcauugcaucuugccgagguaaguacuguuauagaguggagaggacagauuauaauuuaaaaagaagaguugucuguaaguaacuagaaauaagccuaucuuggggaaaacauuuuuuccuuuucuuuuuaugagguguggucucauguaauccagacuggccucgauucacguggcagccgagaaucaccuugaacuugugauccuucugccuccaccucccaagugcaaggguuucugacaugugucacaauucuauuuagaagacaucuuuagaagggggaguuagaaguauuuuuaaaugauaauuaaaacauuaaggcaugauuugcuuuaauguuacuguuucuaaguuuucucauuauuuuguaaccaguuauccccagccugugccggaucagaaccugcuugggaucuuaguuucuuauuugcugcauugaguagaaaauaguucauuuaaaauguucuggcuagcuggacagugguggccuuuaaucucugcacucaggaggcagaggcagguggaucuuugaguucaaggccagccuaaucuacagaguaaguuccagggcuccuauagcccugucuugaacucucccugccccaccccccccuccaaaaaagaaaaaaauguucuuguuauuugcuuucuaguccaccuaggagaaaaugagccuuguuagacguuuccugauuccugauuguaguguguccaugucaguauaccuugucaauauacagcaugagcgcacaagcgcugagaaaagugugaggcucacgaaguuagaguuccccuacuuccaccaucccagacugugagguguuuuuaaaaacauuuuuuuuuugacuaaaaguuuuauaugccugaagaaauuucaaguauaaggaauuacagcaccaaaagaaaaggauguaaaauccucccaagagguggcauuaaauuuagugaacguaauucuguccuuuuuuuccuaauauaugugaacacacguacacacauauauacauauagaauauaucacuauuuuuuguguggaaauucauuuuucuuagcuuuauguucacaguucauaagauuauuauuaggcuguaaaugacuaacacagcuaagaagguuugagaggguuuaaguaauuauguuuucuaagaguguugguauucacuacucagagggcagaaugaaauacuuugguuaccagcagaggccacugauccccuccucucacucuucugaagauuccaaacagggaaaaagaaaaucagaugcugcugagucugcucccugacagaauugggcaugggacauuccuuagcgccucugaggcaggggcccuggaccaaguggacuucgugaggcaacaccagauaccccucgguaagacuuagacugucauguugccuagacgccccuuuagcccuucuuucucuaggcccuggauugcaagauuuauauggaaaaguacugaucuauaauucagauauuuacaaaguaagacacggugucuuguuagacguuuccugauuccugauugugugugugcuuucuuggucucauuuaagugguggaauuuuuagauucuauuagaagauaaauuuuaggagggcaggucucugucucuuucucucccucugucugugugugugugugucuuucuguuucccuguuccucucccucuccucuucccccucuuuuucucccucucucuuuuucugucuuugucccuguguucaucguacugacugcuacagucccuaguguuaggaacucaaucuucuguuguuucguuguugguuuguuuauuuaaaaaguaaaggucgagccaggugguaguggcacacgccuuuagucccagcacuugggaggcagaggccgguggauuucugaguuggaggccagccugaucuacugucucgaaaaaccaaaugaaugaaugaaugaaugaaugaaugaaugaaugaaugaaugaaugaaugaaugaaugaauaaaaaguaaaggucggcuggaaagauggcucagugguugagaagauggagagagccaucucuucagagcaacggaguucuguuucaauuagccaccuguaacuagagcuccaagggaucuggugcccucuucuggacuccucaaggcccugcacucauguguacauacagaaaauuuaaaaaauaaaggucauuuagaauuuugaagaugaguauaauaaaauuaacacauagguucagugagaugguucacaaguauccugccaacugugaugaccugaguucuaucuggagacucacagguuccucucauauucauauucauauucauucucucucucucucucucucucuucuuaccucuaaauaaauguaacaaauauaaaauucauguuauggaaauguauaacauuuaauuaagaauuauacccaggcaugguaacacagaccuauaauccuaccauguaggaggcugaggcaggagcauuacuaguuugagacuauccuagauuaauuagggaaacuugucucaaaaacuagauaaauuggugcugaagagguggcuuagugguuaagagcacugguguucuuccagaggcccuggguuuaauaucuagaacccacaugggagcacacagcucucuguaccuucagauccaggggaucaccacuuaccuacuggccucccuccucaggcaccaggcauacaagugacacauagacauacacaggcaaaacaucugacauauaaaauaaaaauuaaaaaaccuguugggaaauuguaaagcuauuuuuccauaccaacugaucauugcacacuugcuuuguuuaugaaauaaugacuuuguuacagucacuacaccaauagugacuuuauuugcugagaauaaagcaguaaaugaaguagacaguuuccuucauuagaacucaucagaagacaaaaaaaaaaaaaaagaaaagaaaaaaaagagucaguguuaggccgggcaugauagcacaccuauauucccagcacugcagaggcagauagaucucugugaguucaaaggcagccuggucuacguagccagucaggaauauauagccagaccuuuucuuaaaacaacaaaccaaaaacaauggaugugaagcccuaugaaggauugugauaggcugguuauauuccaggccuguaaucuuucucuccaucuugguagagcaagggaagcaaaucacugaagaaagcauuauaguuggguauaguggcagucacagcgauaauacauaucucgguacaagugcauuaucugaagcacauuuuguguuuuucuauguaguguuggaagcaaaugcagagcucuacaugugcagggcaggcccucuucugcugaggcacauccccacucagaacaaguccacaucacaaguaaugaacauuuugugggguaaugaaacugcuuaaaucagcagaguuuggaagguuucuuguggaucugcauggcagucgaugaacgaguucacuuacuugcuuuuaauagauggauuuuccccuuucuucuagaacuuuguuugaccucaaacaucaaaagccagacagucccuucuuaugaucagcaucacuuuggauuuugguacagcauugcucauccuucugugaucuguguaagaaguauuauauuucugcuucuuucuuguuacauugacuuaagucauauacuuacuaucuugcuugcugucuucccugagugccugaaggaaaugucccaguagcagagcugggggugggggugggggggggggaggaaggagaggcugcagagggcucaggcaauuucauuugguucugagaagcaauaggguaguauuuggggaagcuuuaaaaagaugcuggugcccaguacccaugccacaggauucuugcuuuauuugaucuuggaugagcccugggcaugaauaugcuuuaaauuuucuuuaugugcuuuuaacaugcagucaggguugaagcacucuggucuuuuuuuuuuuuuuuuuaauauaaacacguuuuuuacagaugugcauuuuauaaguucuuguuuagaguccugaaaugggaaaauacgauucugaaccacaaaaaaaaaaaaguuaauuuuuacaaagcaucuuauuuuggacucuucuuguuugcauugcagacugaugauaaagguguuuuugcgacauaccuuucucaagaauaucaacuggcagcagaaacauuuaauuugaccccauuucaggugugggaucuguccuaugaauccaucaacuacaucuuugcuugugacaacaccagaucugaacugagaaaaagguggacucacuugaagcagaaaguguuaaacuguaaugaggugaacuacuuuugauuauacauuguagccaagaucuuccugcccuguguauccuacucaguuacugcccacuugaaaugacuucccuugaauuuggguagccaaguauauauggggucuaacuccagccccuucaacugguaaguucgagguuuugcauggcugcacuuccaugcugcuuuugcuggaggguuguuuagcccucauuuccuagugacucuuguuuuuacacuuagugcucuuuagacauuugugaccgugaaccuucugagaaguugaaacucuuugucuucagggaaaucucuguuuuguuagguuuaaucagacuccuuccacuuccuuuuacccuuucaaguauuaacuuuuuuagacuguugauguuaggucacagugcacaccugaacuguuugugugggugccuaguugucaggugacuguaguaacaaagcuagaaucuggcuuugcccuucuccuaauaucuuuagaaauauauaacggggguuggaguaaucccuucaguuuaagaaaagaaaagaacgacuggcuugaaguaaaaaagacacauagcuggagcuucugauuuaaaaucagguucuauuuggcuuccuuguggaagcuaccaggaccucuacagugcuaggacucucuuaaaagaucuuuguagcaaugguagcauuguggcuucuaggguucuuagaucaccaauaaucccaugcccacaugauagccuacagguauagacuuauauaaacacacauauaccauggccacauuagccgacuuuagcagauaacaaaugucuugguugguuuuuuucacaagcuagagucauuugggaagagggacccucaacugagaaaauauucccacaagauuggcccaaucagugcuugaucaguuagugggcccaugccacagagggugauaccacccuuagggacaugguucuggguggaaagcaaaggaaauggaacaaggcacgaggagcaagccauaggcaacacuccuccauggcuucagcuuuaguuccugccucaacuucccaggaugacagacuacaaauuauaagaggaaauaacccuuuccuccuuacauuacauuugguuaugguguuuugucacagcauuaaaaacacuaaaacaauaaugu

SEQ ID NO: 1027 - RNA, 2647 nt, Mus musculus
gguggggacagauagagugaaacaauguaaguuuucuauaaacacugaauuucuuaguuucuuccagaaucuacaaggacucuggaaguauauccuacaauagauuauacugcauuuauagcaucuugauuuuuuuccuuucuuuucccuccuugcugccgcugccuccuccuccuccucuccaucuaaauugcaccugucccuuguggacuagcagucaaaagagcaaacuagagauguggcgauagaaaaagcaguuaaagaugcccacaggagucaucuguuucuccuacacuccacacaccuaguauagagucaugcagccaaugggugcucaguacuaauugccauuuccucaaguauagguaaaacacacuauacccuaaaugacaaggaaaguggugaugcuaccagucuguacacacacacacacacacacacacacacacacaacuauauauaaauaagaguaucuauuuaagcacaaaauuacaaguuuuuacaaucaaugguauugacuuaauucccacauauucauagauguaugauaaaagccuuguacaguacaagugaaaacacccuacuguguccuuauacuggaaaacaguuaauacauagacauaggcacaaauauauaguugcaacauuuauuauuucuugaaaggcagggucucacuacguagcccuggcgaccuguagcuuacuauggagauuucacugcccuugaucucagagauccgacugccucagucuucaaauugcaaguauagaaguacagguguacaucaccaugaaaacuggcaacuggguuaaagacauuuacuaagccuaguaguguuacuacacaagacauacucuuuaacauaacuugcucugagaaaagucuagaaagucagcauucaaaggaaggaaaguaacuggguaaauuggaguggggcagacuguccaaaacuaguuguaaaacugaugcuaggugggugagaaaugggaaaacagugaagcaaaagaggagaaaauauaaagcucacuaaagcuugaaguaggaaaaaaccuuaagaaugcaugauagagccguagagucugcagagaaucaauuagcagagacagggaaagcuacagggagacccugaguuguacugagcuguggauacugcugagaggaaagcagcauggcucugggaggugaguuuaggagacuagcuccuuugggagauaaacagcagaaauuacugucuauugaagauacuuugaugagcaggucagagaaaagaugaccauggccagauggccaagacauggaauaacuaauuuucacauuuauuaagaucugagauaguagcaaggagaaagacuauccuaaaauuuauuaggaugaguaauuaauugugguucugguacugaggaauuguaaacaaagaaguaacauuagcaauaaagggaaaaugguaucucaauuaugcugccuaagcaagcaagaagguacaagaaaccccugucuaacgcagggccucaggauccgagacggcuuuggaagugaacugcaaugccaaggaagaugagauuauugugaacugcaaugucaaggaagaugagauuauuaucuuuaguauuaaucugucuauguauaguauuguggaaacaggcauaaggguauuaguagacagaugguuccaaaugucuuguaucuuaaacugcuucuguuucucuuccuauaaagcaaaauaauguuuauaccuagucugccucucagggauaucauguuaauaaauguuaugccaauaaagugcucuguuuuucuucagcuguuucaguacaaauuuuauauauacaaacuauauaaaauuauuaguuuggccauaaguucuuauaaucaagauguggaugacagaaaaauaaauucucugauauuuuucuucuuguucuuuuacguuaccugucugaaccuuuacauuguaggcaaagaaauaaauuaauaucauaucaaguuaacugggcaagguuuuaaauuauauaggaccaacucaucaacuuacaaaugagaagacuaaaaagaacaggguguacucucauuacuagaggaagaacuaguuuaucucaaacuaccucacaaacaaauagugccagugcugaggauggcuagaagcaaagguaaagccaaagagaaaacacuaagggggagcgagagguccaggccucuagcccuuccgugucuacagccuuugcgguagagaagagagugucgucugcucucaugucuccuuagcacuguuacuacuuuuccauauuuucucacugaauauauacauacugauuuucugucaauuuuuauucuguaacacuuugaaaggcuauaaaaugccuaaacggaggguggggauguaucucaguggcagagugcuugccuagcaugugcaaggcccuggauucaauuccccagcacaguaaaaaaaaaaaaaaaaaaaaucauuuuacagauuuuaucuguauaaguggauauaguuagaaauauaagguuauaaaacaguguguauuacagagacaaaauuuguagcugugacgaaaggauggaccaucuagugauugccauaugcagggauccaucccauaaucagcuuccaaaugcugacaccauugcauacacuagcaa

SEQ ID NO: 1028 - RNA, 29801 nt, Mus musculus
ccccgaaccaaagucaagugccgaacacugggucucuugcucgcgccucccgaacgaaguaagaacucggcaagaguuccggggcgacagauggggaaggucgcgcaccgggggagccgacuugggcuucuaaauugagguggacuaggggagaguuacaggaguuggugaagcgaggaagcucgaggggcggcaguggugggucuccugagaacgaggccgaugcgggccggugcugcgaguccgugggcuucgagcacagcuccacagcggcggcugccaaguuccagcuuuguuuucuucccuccggccgggucacucugggagacgucggcagucggucaaaaugccacagacccugccaaggcguccugaggacucccgccggcccaccccaggccgcgucucucucaaccagcuucucaacucacucucaucccuuccccuccugggcuagccucagucccgcucucaagccggaaguccgagcgggcuucuccuggagcccaggacgcaugcgcgacggcaccggcgccuccucgcggcuccgcggcgggagcgaggcggugggcgccugggccgcgcgcacuuccgggaugcggcgcgcggcucuguggcaucuccucucccgguggacugcggggauucagggcaagagauuccgcugggugugaggggucgcccggagaggcgcugaaaagaggaggugguagaucuagggacucccgagccgcccuagaaaugauucacgaacugcucuuggcccugaguggguacccaggguccauuuucaccuggaacaagcggaguggccugcagguaugcagggggucagagacgagucgcuugccgcgcggcgggugcagcugagccgcagcgaaggggcgggacccggggaacuccaaccgaccggcgcccgcgagcggggagaaaccgagggccaacccuacggagcuccggcuaugggggcccugcggucccgcgacuccugcuagagaaccacuaggaguggauagaaccacacuucuuuucacugcauaugaauuuguuguuaaacugaaucccuaaauguguagcuggaauuagaugauaguuauuugagggaaaagggggagggauagggaacucuugcauugauucaaauugaauuuugaaaguaguggaaauguauacaaagcgcucaagacacaauacucaguaaauuguguuggaugaaaaaaaugaauuuguaaacauaugguguuucccuccuuucuucgaaaauuucuguaccaggugaagaacuugagaggggguuuuuccuguaauuagaagaguauaacaggaauguacccguuaguuguuuucucuuccucucccccucuguuccuuuaucucccccaacccccgugagaagcccagauauagcgugauacucaauauuuugccgaaacuaaauuggcaacacugaguuuaauagccaggcguaguguuugugccuguaaucccagccuuugggaaguugaagcaggauuauuggugugauucaaguccagccugggcuucacuguggaaccuucucucaaaaaagaaagcaagaaaagaagggaacagagggcagagaaaggcaaagaaaagaaugacaacuacaaaugugucuaaguguguuguguaaaaugguaucagugacuucaagguggaguugacuuuuucacaguaauuaagccuaaacuagaauuuuuuuuuuuaaaacuagaguaugugucuauguuguaugagugugggcauauaugucacagaguguaugaagaggucaacuuuauggagucacuucucucuucccacauuuguguagguuucagggauuuaacucaggucuucagguuuguguagcaaaugccugacucucugagccauuucacugaucuuaaaccuagaacuuuucuaaaacucugucaacaagaaguguucaaauuugauaacuguacccaaggagcuaaagggaucugcaacccuauagguagaacaacauuaugaacuaaccaguaccccggagcucuugacucuuagcuucauauguaucaaaagauggccuaaucggccaucacuggaaagagaggcccauuggacuugcaaauuuuauaugccccaguacaggggaaugccagggccaaaaagugggaguggggggguagggggguuggggggguauggggggcuuuugggauagcauuggaaauguaaaugaggaaaauaccuaauaaaaauauuuuuaaaaagucacaaaaaaauugauaacuguagaagugucaucaguaauaaaagacacacauacauauauauugaaucuguaacugugauuaacaccugucauucauauuaucuguuaucacaguuaucuccacuuuuuacuucugaaaacuaagacauugagaggugccaugauguaacuugccuaagcuuucaagcaaaacauaauuugaagauauaagccaagggagucucugucccugucuguuucugucuguccucucuccucuccucuccccugauccccucuguguaggucagaggacaacuugcaagaauuuccuacuaugugagucccagaacaucuuuccagcuccuauugugugaauucuuucucuaggguaccuauuuuaagaacaagcaauuacaucuggaugaggaacacgaccuuguaauuguguaacaauaccuuguuaaccagaauuaccaacccaguaacaaggaaaauuaaaaccauguaaaaccaugggcaccuuacggaaaggaaauagaaaagagaauagaaagcauuuuaagcugcaaagaaccuugauuggugacuagcaggcauuagcuuccuuuaugacuggugacuagcaggcauuagcuuccuuuaugacuaucccucuucuuucagguuucccaggauuuuccauuucuucaccccagugagacuaguguccugaaucgacucugccggcuuggcacagacuacauucgauucacugaguucauugaacaguauacaggccaugugcagcaacaggugagauccuguuaucuggauaugggcuucuacagggcaggagugcuaucaggcagugaauucacugguaaagcaaguuagaaauuucuggaauacuccugaguuuaugaaucacuggaaaugcucaagggaaggcaagaucucugacuuuucuuggguaacaacaaaaacucuacucauguucuuacacagauuuuauguaaugagaauuccuacuucucaacuucuaaaagaaaguccuuucuuuugauuuuuuguuuuuguuuguuuguuuuaaaaugagcaacaguaacaacauuuuguguuaaugagugaugaaugaagacucauucagguuuucuguaaugccauaagagcagaauaacauuggcugguuguaaacccgucuggucucauguccauccuaugaacauuucucuuuaggaacuucaggauccuucugguuuuuuuuuuuuuuuuuuuuuuuuuuuguaaccucuucuggcugacuacauuguguuuucuaaccucugaacacaagguucuguaacacaucuggagcugaauucuguacuucuguacuguugagagccugguuacccagaucucuaccuccaucauagccuuuagcuaacuguuaaccauuacuuccucauauaaaacgauaugagaagcuuuauaugaagcugaccagagucacuaggcucuucccuccaaagaauaaauaauaaagaccacugagucacacucagacaagcccagcuacagaaaagacucucagucaagccaggcugccuggagagcagcagggaccaaccagacaacuugaaggauccuugaaagacaagccauauuuuauauguccccucgaugagcgucuugaugcuuuuaagauuuacuuuuauugcaugggucugaguucugcuugcugcaucugugugcaccauguguauguccuguaccugcccagaccagaagguauugagucccccaggaacuagaauuaccagugcuuaugagaaucaccauugggagaagcaccuuaagacacaaagucaacaacuuagaauagcuucagguauucccuaaaaccagacacacacacacaccccaagcagcccccaaagaagcagaaaccagcuuagaagaggcucagaccaacugagcuaccuggacaggauacuccaaccuguugagcugccuguaggcuaugcagugugcuccagguucucagauuugugagccgucacccuaaccauguuaggcuggaguuuggcaaguaaccccucacucauauuccuauaaauacuccaaauaaaacugacugguucacagcaguaucuauacuuuggucugucauggcuccucaucuagugacuagaggagguguguguguguguuguguucaggaaaaauuuugucacacaacagacacuaggaaccaaauccuacaacaaaaccuuucccuuaaccauacuguggccaugucagcacuucuuuccugaggcaccuugcauacauuuuauuuucagucauuuaucuucuuucucuugcuaaaauacugcuuugauauggaauuauuuauuaaaaaauguaagcacuccuaguaaaagacgguaucuucucggguugcuggcucugacugagacguugcccgucuuuguuuauuugcaggaccaccauccuccccagcagggccaagggggacugcaugggaucuaccugagagccuucugcacagggcuggauucaguuuugcagccguaucgccaagcacugcuugauuuggaacaagaggugaggaggaggagguaauacagacagcaacauccugaggggauaguagauuagagcauguucuugacuuagaaguggcguuugagaaggucagcuagguaagagugagcuauuucccguguggcuagaggguacgguuuucaaaguggcuccagaguggacuugucaucugaaaaguaacuguuucaucuauuaguucugcagagcuuaaagcaaacacugagcucauugucacauucucuccuaguuuauauagagcaaauucaaguuauugguguaggauucugauaagugugcuuuuauugcaguuccuggcugacccgcaucucuccauaucacaugucaauuacuccuuagaucagguaugccuuggaaugcuaaaaugcuuuggagucuugccguuuuuaaauaaucccaauuuguggcgguauauuaaaaacuuuuuaaccuaaggucagagcccaauaaauauauuuucugaauuuuauuagcugugcuuuguuagaugagaacugcuuuaaaaguguaauguauaugccaccugccugucauccugguauacucaggaggaaggggcuaaccuagucuauaaguuuucuucaguaaguucugggccagcuuuaaaaacaaaaacaaaaacaaaaacaaaaacugagcaacaaaaaguuccacguuuaauuaggccuuaauaugaugugaauauuguccuguugacauggauaguagcagggacacaagacucaagguacagaguguuuugaugucagauugacuuaggaugcccaacuugacuauucugugguauugcaucuggaaacaaaaguauuacuuuccccaccccacccgguuuuuuguuuuugucuuuuuguuuguuuuuugagacaggguuucucuguguaucccugccguccugaaacacuguaaaccaggcuggccuggaauucacagagauccaccuuucucugccucucaagugcuauaauuaaggugugucuuuuaaucuugaguugaucuuuuuuuuaauccuguauuuaauucacaccuugaguuuccucugcuuugcaguuccagcuccuuuuccccucugugaugguuguaguggagcaaauuaaaagccaaaaggugagaacuuuuuaugauaaacuucaaagaaaaucuaauaaucaauacuguuuuacagacuuuuuggaagacacugcuuuuaauauuuuuuauguauuuguuuagcauuaucucuuuacaguccauauaaaauaucagacauucaagaauaagacaugcuuucuuuaaacaccuugugauugagaaaguagaguauguagcucuaccuaagaauguugcugagguuagagaaaauacuuugggcauuugguggugaaagcagguuguacuaaggguuuagaaccucuggcuuugaauagggacaagagacccacuuagaaagaagaugguuuccugagaguuaagaaucacugggcaaaacucagcuuguuauauucauacaugacacccauugucaaaaguuuuaucacacauugaacaguuaauuccccgcgcccccccaccccaucagaagauugucuuuuuugagugggguaauaucuaugaggaaaauccuuaggcauuuuauaggaauucuuuucuucuguuuacccauuauuggacuaaggagacaaaugaauugugcucagcucaguucuccauguuuucuggccauaguaucugugccuuagguuguuacucgcaguguaguuagucgacuuacacuguagcugcuuuacuucuucagugaguguagauccguaaagcccugcuccauugacugcuaacaaagccagugggaaagugcuucagagaugacugcgcucauuaaagucaaugguuauugcucugugccauacccuugcugagagcuuuacauacauaauuauauacgcucagggucauagagaacaagguaaacaauaggaucuguguaacucaaagacugugcuccugaccacucuauuaaacuugaaaugggagggaaccuccuacaugaguggaguuaguagugaguguacagauuuccaugccuagcugcaucucucaguugacuuugagcuuccacuggcuaugggaagaaugggaacaaauagagggucugagaugagucauccuuucuaccuggccagguagcagcagaggaaccaguaugcuagugcuccaguuuuaaauacugaggaacuugagaccaugggcugagggggagaauggggaccaauugcaaauaggcucaccuaaggggauuguuuuuagagugaugaaauaguauaaacucauaucagagugaugauuguguaauacuguaaauuuacuaaaagcccuuaauacacuuuagauaggcauguaaauuuaggauauacaaauuauaccucaaagugauuuguaagaaaagccuggagggcacagagacuuccaguuagggucaggguucauaccuaguuaguagucugacuugaaccuuaucaaagacuuuuccuugguuuugaagugccaguuccccaugacucugguuucuucagugacuuggcucucaagccaguguguauauuagaguguacuagcaagcaccugaagugcuugguaaaccauaggugucugagcuuuacccccaaauuugcauuuauuuaaaaaaauauuuuugccaacuugacaaaugagucauuugugaaaaggaaccucaguugaggaaacaccuccaucagauuacuuauaggcaaaucuauagugcauuuucuugaugaaugauuggugugggaggcccaggucacugacggcagugccacaccugggcagguggucuuggauaauagggcaggcugagccagcugugggggugggaguggggcacaguaagccaguaagcaacauuucucgauggccuuugcuucaguuccugccuugagcucuugccccuacuagccuucaugaugaccuauaaaccuauacaaacuauaaacugauauaacccuuuccccagcaaguugccuuuagaaaccugagacaacagguaacacugacacugagggcggaagagucugucuuuacaaauugacuauauagacaucuugggagggacuauauuagcuacuggacugugcugucuugguugauguagaauaugaguuucuguaaccuagauugauaaggcuauauuuuccacagauucauggcugucaaauccuggaaacaguuuacaaacauagcugugggggcuugccuccaguccgaagcgcauuagaaaaguaaguccuggcuuccguaaguauugggaauaggggagggagucaagugacuucacuuguccugguuuauuuugaggucauaucaggugacucaucuucuuaauguguucuuagaaucuguuugcaaguauauuauugagaauuuuugcauugauguucauaacugaaauugaucugauucuuucuuugaugggucuuaugugguuuggguauuggguaauuggccccauaaaacaaauugggcaguguucuuccuguuucuauuuguagaauaaugugaggagugcugaccugcacuuuucacugacucaugcugaguaugauuauuuuuugcugucugucugcuucuuuugaaugugaguucuuuuuguucuggagccuucgggugugcuguuaaguacuaguaugagaucucuccaguuuuuuuucuuuuuuuuuuuaaauaaaugacaaauaacucacuuuguuuauauuuuuaaugugagugcgcccucugcagauacaccugcaugccagaagagggcaucagaacccuuuauagauagucaugggccacuaugugguugcugggaauugaacucaggaccucuggaagaacagccagugcucuuagcugccgagccaucucaccaaccccauauguaggcacuuagugcuaugaauuugacacuuagaauagcacucauuuuauuuuauaaguuuuuauauguuguauauuccuuuucauuaaacucuagaaagucuucuuucuuaauuucugucuuggcccauuuuucauucaguagugaguuguuuaguuucuaugagucuguaagguuucuguuauuaaugauauccaguuuuaaucuagauaggauaucaggugguauuucaauuuucuugagacuugcuuuguauccaaguauguggucgguuuuggagaaaguucugugaggcacugagaagaagguauauucuuuugugauugggugaaauguucuguaaaauacauguuaaguccauuugguauaacaucaguuagcuccaguauuuucguuucguuuuugucuagauggccugucuauuggagagagugggauauugaaguuuaccacuguuagugugugaggguugguaugugauuuaagcuguagccauguuucuuuuaagaacuuggguguccuuguguuugaugcauggauguuaagaauugucuucuuggaguuuuccuuugaugaguauguaguguacucccugucuuuucugauuaguuuugguuuaaagucuguuuugucaauacaccagcuugcuucuuaagugcauuugcuuggaauagcuuuuuccaucauuuuacccuuagguaaugucuauucuugaugacaaggugagaaguguuuguuaauucugguuaucuugguggugaugguguuucuccuuuuuugauuugcugucuggaauuauucauucccuguguuuucuuggguauaguuagccucuuuagguugggaauuuuccuccuaguaccuucuguaaggcagaauuuguaaauagauauugcuuaaauuugguuuuaucauggaaugucugauuuuauccaucaauggugauugaaaguuuugcuggguauaguagucugggcuggcaucuguggucccuuagaauccauagcaaaucugacuuuuagauucuccuuugagaagucagguguuauucugaugggucugccuuuauauguuacuugcucuuuuucccuugcaccuuuccauauucuuucuuugcucuauagguuuaguguuuugauuauuaugugcugggugaacuuucuuuucuauuucauucuauuucuuguucugugcacuuccuguacuugauaggcaucuccuuuagguuaggggaauuuuccucuaugauuuuguugaaaaugcucucuaugccuuugacuuuguuucuucucuuuccucuguuuauauuauuuuuagaauuggucuuuucaucaugucccagauuccuaguuguuuugggccaggaguucagauuaacauuuucuuugaccaaggaauuuauuucuucuaucuugucuuccaugccugagauucucuuuucuaucucuuguauucuguuaaugaggcuugccucugagguuccugugcaaguuccuaaauuuuucauuuccagauuucccucaguuugguuuucuuuauugauucuauuuccauuuucaugucuugcaugguuuuauucauuuccuuccacuguucauuuauguuuccauagauuucuuuaagugauuuauucauuuucucuuuaaugacuucugucauauucaugaaggccauuugaagggcuuuuucuuaugauucaucuguauugcaauacucagggccugcuguggguaguuaggcucuagugaagauccuggcuguuacuguguuuucauacuggcaucuaggcaucuggguuugggaagauuauaauucuagguaucuagaauugauaucuggccuugucuuuauugaguggguguuuuguucuuugguuucugcuucuucucugguucuuaagaguguggcuauacagagaaagccugucucaaaaaaaaaaaaaaaagugugguggcuuuguguugccugguggaaaaugcuucugggauccugguaguuguggccacuagggguuccaaguaagaugugugucuucauauugggagcugacacuuaggaaaggagcugagggaguucaccaggaucugcccuaggaauggaggcagagagugaggagaguccacaauaggaggucugcuacagagcuggaggugagacugggggauuggauauggaggagagggguggggggaagaucuggaguuagccuucucgcuucccuaguuaguuccuaagggaggccugcuggaguugggcugggguaugggaaugggggagcaagguuaggaggugaaggucuguguaaacuaaaggagaugggcagaggguaacaggaggcugaugcaggugcugcuacagagcugggggugagacugggggauuggauuuggaagaacaaagggggaggucagcuuaccugccacagugcuauuuaauuuuauuaaagaaucucuuuuuaguuuguauauuuuaaguaguagacuaaagcucuauuucuuccccccacucucauuuugaaaaauaucaauccuacaaagaaauuaaauauaaagcacuugauuauccuuuaauuuuaccaauuguuaacauuuugccuaauucaucuuuuuucuuucuccuauaugcaugugaaauauguauauauuccaauuuuguuguugggacauuagaaaguaguugcagauauucuaacuuaacuccuacauaguuagcuuauaucucuuuagaagcaaggcauucuuuuuuuaauauaaccucaauacucuauuauccaccaaaaaaauuaauuugauauuuagaauauuuugaaauuucuccauuuguccagaauagcuguuauguuuuucacaauucagaucuaguacauuuucauauguuacauuuaauuaugucuuuuuaagucuaucucucuauucuggccucuucucauuuucuugguguguggauguguguguguguuuaguuuuucaucagagucucauucaauaaccuaggcccuccuugaacucauagugauccuccugcuucauccuucaauugcuggaauuacaggcauagcccucauguuccugagcuuuuuaaagucuccuccaguuugaaacagcucccuggaguagaagagauggcuuggugguuaggagcaauuucugcuuuucaugguacaugguucaguucucagcacccacauggcaacucacaacugucuauaaaugcagcucuaguaggauuagucaccucucucuuucagacaccuguacucaggugacacacacacaaaagcacacauauacauaaaauaaaaauaauuuuuaaaaaccuuuagaacuguaagacagcccacuuccucuugucauugucugugacgaaaacacucaggaacucuuaacacugucuguuggaugcacacaauuuaaacuuuucugauuccuucuuccugauuagauuuggguuagacauuuuuagcaagacgacuuacaugcauggcauuguuucagaaaguuaguuuaucccaugaugcuucuguggaguugauaccauggugucugucaaguuucucuguugcaaagauaccuuuaucucuucauagugaauaugcccucuggccacccuucaagaccaucuuaaacccauuccccagcuaccuuccugaauuuuauuuuauuuugauuucugcauuuuauugacaaaccugguauccacauauugaaucuuuuuucccugugcaauuccaagaauaauaaauucaggccauguucagaaaaaaguggcuccauuaccuccacuuauguaagacucauuaguuuuggaauuuacacaaagaacaaaauuauuuguccuaaaaaaauacuuccugauuuuaaugaauuauauaguacagguuggaguacaaguauauaguacuguaguuacauaugaaaguuuaaucagucugucuaaguaauuaaauuaucacaguuaucuauaucuuguuucucccacgacucacuaaccuauugagcuucugucuguccuaucaaaauuucaaacgugaccucuggcuauggugagucucaggauucuaaauagacugguaaagcucuugcuuccuucucuccucagaauccuggcugugugccauggagucauguauaaacagcucucagccuggaugcugcauggacuccuuuuggaucagcaugaagaguucuucaucaaacagggcccaucuucugguacucucagugcgcagcuggaagaggaugaggaggaccugggcauuggaggccugacaggaaaacagcugagagaacugcaggaccuggugaggacacggcaggaagcccggggcagccgccugucgggaacaccugcagcugacucacugaccuaccuuggccuaucacagccuggcugccuuccaugaguggaucaguuagacacacugggcuuucucuuaauuaguuagaaacgacaaaauagcaagugguuuugaaauccuuguuucuccuuucuacauuauaugcucuuacaaguuuagugaugaguuuuauauuuaaaaacucagugcuagucugagggauugaugccauuggucaaagugcuguguaagugugaggaccuguguucaaauuccaagaacccaugugaaagcggaugcuagauacugugaacaucuguaaucucagugcuccugcagagagaugggaggcagaaacgggaucucuggaagcccgaaggcuagcuagcuugauauacacagcagaacaacaaggagaccuggucucagggaagaugugaggacacacacuaacacacagagguaaauuaaaggauaagaacucagcgcuuuccgccgugccaguuuucuuccugagaucuacaccuuguuuaccagucgcacagaucauggguugggaguuaagaccugucaucauacuucacugaccgauuauuuucuucacuagcgccuaauugaggaagagaauaugcuggccccaucucugaagcaguuuucgcugaggguagagauuuuaccaucauacauuccagugagaguugcugaaaaaauccucuuuguuggagaaucuguccaaauguuugagaaucaaaaugugaaccugacaaggaaagguaggaaugcccuuguucuauuggucccauccucagaggcucuguaucugcaacacuggcccaaagcaugcaggguuagaguggcugaugacaacaaugacugcagcaaaaccgcucugauagauuugccugggccacuguggcccccuccacccugucugcccugacuccugucugaugaucaugucaucauaauccacaggguccaucuugaaaaaccaggaggacacauucgcugccgagcugcaccggcucaagcagcagccacucuucagccugguggauuuugagcaggugguagaucggauucguagcacuguggcugaggucugucuuuucucuucuaguguuccagaagacaugaguuuguagaacccuaaagggagagagagcggggagggggguaccuauggggcuggagagauggcucagugguuaagagcacuggauucaacuuugguucgauucccaggacccacauaguggcuuucaaccaucugccacuccagcuccaagagauccagugcccuauucuggcuuccagaggcacugggcagacauugauacagauaaucacuaggcacacacccucacacaugaaaagaaauaagugaaagaacgucuguuuuucagguagaaauggaacugauguguuuuaaucaguugauuaaagggaagucucaguuuaauuucuaacacucaugaauuugggugaggaaaagcuuuguguguaugucuguguguuugugcccauguguguguguuuuauuaucgaccauguauuucacuuguacaugguaaucuuggaaggaaagccacgcacacaggauggugguccuggcccuugagacaagugggaggguugcuagggauucuagguacugggacuucuugagcugagggugcuuauauugauuggccuguucauugugaacuucaagauguaagcuuaugauuuauuuguuuuucuguauaauagucacuacuuucacuaaaauuuuggauauguaagagaaaaacucuuguaucuaaaguuguuuauuauuuauauggagacauaguaaugcuaauuuauugcuggcuagucuuacacauuccccuuaacucuguguaacuaacuuuuuuuuaaaggcuuauuuauuuuauguauaugagugcacugucgcucucuucagacacaccagaagagggcaucagaucccauuacagaugguugugagccaccaugugguugcugagaauugaacucagaaccucuggaaaagcagucagugcucuuaaccucugagucaucucuccaaucccuggguaacuaacuuaauucugggguuugauacuauaaaauuuuuuauguacaaaagauuacaucaccugaaaauaagaaaauaagaaguguuuuacaacacuucuucuaauguuuaacaccccaccauacauuguucuaggaucuuuauugauaaaguagacaggucgccuuuguuugcauaaauugugucaaacagcagagguaauauuggacgucucugaacuccugacgcuuagagaugcagagaauuccugcauuacuaugacauuugcuguaggcuucuagaaggcaguguaauaaacuauucucuuccuaguuagcuggguuuuuuucuuaagugcugucagguuuaccaguugccccuguguuaguggaggagagcagucuugccuuggauccauuucucuuucauaguuuuuauaucuguaugcauuaguuaagaaagacaauugucuuauucuuggguaguuuuuacauaagccuuauaaaauggguuagguaggugcuuuuguuccuuuucuuuuuguuuguuaaacagucuguguuuucuuuguuuguaauuguuacuuagaguuugaacuucccugaaaagugaucuaggcuuccuuaggaagagaaccuugacuggcugaguauguuuuaaaacuaaguugccauaaagcuucuucuuguaacaguuuugaugacucuguagcuuugcaacuugacuauuucagguggacuuaaauuuuuaaaauacuugcuuaucuauaaauagguuuuguuuuguuuuguuuacuuaaguuuugucuuuuaaacaugauuuuguggccugucaguaguagcauagggcaggcagaggcaaguggaucucugcauuugaggccagcuugguuuacaggacaacagccagggcuacagagaaacccugucuaggaaaaaaaaaaaaaaaagaauaaauaaauaaauaaauugugugucuggguguguaguguauguacuuauguuacaagguagguagguguguguguguugugugagugcgugcgugccuguggagauuaguuucagaaaucuucuguuuucacucuccuaccuuacuguuaggacagcaucuuucugaaccaagagcucacuguuugggcuggccuggcuggccagggagccccagcacucccugccucccugucugccagcauuggguuaggcacgagccacugcucagcuuucacauagaugcuggagaucugaacuuggguccuuaugcuugcuuagcaagguuuuucaucacugagccaucuugccagccccaguuuuucucauuauuuagucuuguuaggcuuuuauuaagauuaauaaacuaguuagaaccagcuuuucccccuuaauuuaaaacauacuaacuuacacauuuagaaaaauuauauauaaauguaacaucuggguaccuggagaugcagaaaaagcauuggcuaaaacucuccauuaguucaugacuuauaaaaaaagaaaaagaaaaucuaggcuuucugguacacaccccaucaguguagcacugggaaaacuauagcauagcaggaagaugacugccaacuccaggccagcuuugcauaggcagcaaucccauuuagcuuuuugggguuuuuuuuuuuucuucuguuuuuuuguuuuguuuuuguuuuuauaaaaaggacucgagagauggcuuaucaguuaagagcaguggcuugcucucccaguggaccuggauuugauuuccaacaccuacaaaauggcucacaaccaucuggaauuccagcuccagggaaucuggcauccuuaucuagccucugagggcacgagccaggcauaugauacaaagauaugcaugcaggcauaacacccauacaaguguaaaaaaaaaaaucauacaacuuaucuaugcaucuccagguacccagaugauuuuuccuauuaacuuuaauguugugcuuuuuugagacagggucuccuucuguagagacucuuccuguccuggaacuaacuauauagauuaggcuggccuugaacucaacagagcuccuucuaccucugcuucugaugcugaaauucaaggcaugagcuacuccgcuuggcuacagucaugcuuucucaaaagugacuggggaaaaaaaaaucaaauauguacucaacuuuguagccauuuaaaaaugguauucacacagaguuguauauguagcuauuaccauuaauuucaggacauuuuuaucuuguauagguuuuguuucugucugcucauuccuaggauuagcugaacuuggguucacuguaauggauuuuuguguuuuuuuuuuuaaucucaucacagcaccucuggaagcuaaugguggaagagucagauuuacugggucagcugaagguaauaacugacacucuuuuaaauccggaaaugauucuggaaagcagucuuaucuacacugccacagucgauucauuuguucuuacucaagugaggaaaauauauuuuaugcuacaaaucuuuucuacucuaaagauucaagcuuacuuucuucuguugugauguaaauaccaucaaacagagucuuccugcuuugggaggcugcucuguaugucucuuuaaaaugucaagccuguauccuucagacugcuaguaucagccucucugugucuaauucauuugggguggucagggccuccaggcucugauuuacugaauuguacacugaaauucuuuccccagaucauuaaagacuuuuaccugcugggacgaggagaacuguuccaggccuucauugacacagcucagcacauguugaaaacaccacccacugcaguaacagagcaugguaauuuuccuguggcccugagaguaaaguuugcucagguugcaggguguuucuuggcugguguuguguguugcauguuugccugcagaggccagaagagggaggacuugagucacaagcaguuguuauagcuaaagcuuccuuaugcuugggguauaacuaggucucagaacaacuaaagugaaggacuucaguacuuucaagacuucuccuuacccugacaacuccccuagacaucaguagccauuccuggucucuagaagcaaacuaaagaaaucuagugaagugcuuuguuuuaacugguuacagccagauccacauggcuauaacuuuaacagugaagaagucaaguuuaggagaugccucuuucagcaagugucuucccuuugguuaguuuaauggccaccccuauccaagcacaagaagaauaauauaauaaagaucugaaacaagacaaaggaaauggaagagaaaauaagggccuugauuguuuaaaucaagucuauaaacaaaacagccagaauauagauuaaaaaaaucagauauguuaacccauuugacaugcugucuccccaggaauugaguauugccagccccgcugacacuacagggacuguccggagcaggaacgacucucaggauuguuaacaaggaggaggacuuaaugcugucaggcagaagccacagaugcccugacccugaaccuguugcuuuccugugcuuucuuacagaugugaauguggccuuucaacagucagcacacaagguguugcuagaugacgacaaccuucucccucuguugcaccugacgauugaguaucaugggaaggaccacaaaggucugcuauucucugauugcuuccucucugcaucuucuggucuuuuucaucccuccucagaagcugcauaauuucagacuguagaaaucaccuagucuacuauuccaauuuuguacagguacaaacguaauuccaggaagguugagaugcucugcccaagguuguuuuugagaugcgucuauauuuuucucuaaaacaccucucaggaaaagcccucacagaaguuuccuccccucuaccuuuauugacucucaaugcugcuuuucaguaccacuggaguacauuuugugugugugguucaccuucucucuaugguucuaauuaacaaaguuauuaucguauuucuuuacguagcagaugccacccagccaagagaagugccuucucgggagacauccccccgggaagcuccuucuuccggcugggcugcucuagggcuuuccuacaaaguacaguggccacugcacauucucuucaccccagcugucuuggaaaagugaguauuucugaguuucucccaaauaaauauuacuuguuacauccaagggaaaaggaaaguggaguggaguaggacugauagaagccagccugguguccagcugguuucuacacuagcaugcuagagguugcagacucggccugucuucaggaacuagaccggagucuaguuuguuuuuucuugcugugaaaaagcaacuugagaggaaagggcuuauuuggcguaaaugucuggacagcaguccuucauugagagcagucaguauaggaauuccagcaggagcagaaaccagaggaaugcuucuuacuggcuugcuccucgauauaguaucacccacaguggcugggcccuucugcaucagucaagaacaugcuccacagauuugcccacaggcagaucugaugaaggcaguucacauuagugaggugacagccaugagacaauauggaaugauaaggacuugaacaaauggacguagaauccauuagacuaggacuggagaaauagcucauuucguaaagggaggaccugaguuugaauucccagaaugcaccugaagcugagugugagcaugccuugccugguaauccuagcauuucuauuaugagacaggaaguagacaagagaguccaccagccagccaguuuggcaugcacagaggcaaacagcaaaaagacacugucucaaacaagguguaaggggcagucugguuucauauuuaccugagugccauagcauaugcccacuugcauucacuucacacacuuaaaaaugacacuuuuuaagauuuuuuuauguggaugugcgucugcacacauguaugcgggugcccauggagaccagaacuggagcugcaugcaaugugaggcacccaguaugggugcuaggaacugaauucagcaagugaucuuaaccacugagccaucucucuagcccgacuuuguuugagagaagucucuauauacagccuuggcuguccuggaacucacucuguagaccaggcuggccucagacuccgagaugugccugccucugccucccaagcacugggauuaaaggcuuguaccacaauacccagcccagauauguuucaauuggcaaauaaguaauuguagguuuguuauuuguagacuaguuuguagccuuuggaauaugaagacucagguaugguacuaaguucuggcacuugacuauucccaucaguucauaggacuuucuccccugguuuuuaugauuuacuauucaugauguuaauauacuugggacccauguauaaguuagguuucuguuguauguggugaggacuauacccagaaacaaaggguuuuauuugggcuugagcauauagcaucaggaagggaagucagagcaggaaccuggaagcagggacugaagcaggaauccuggaggagggcugcuuccaaucuuguuucuuggaaugaacaucugcccagugcauggugggacaggauauccccacgagggaggugagaaaaacacagugcacccugagacaggauaaggagaccguucucacuauggucacagaguaaggaaaaggccaucucuuucagcccaccucucuagccucauucuucccuacucagccauuuuguagaauauacagaagagcacagaagcagggaacagugaggcugaugcaaggagaagauucagccacagguucagaacucacaguccaguccaguuagacaaguguacaggccuuguccagagacuccaaaacuuagcuacucaccuccuuguuugaugugggcuuuacuuaauauugcuuuaaaaguaaugcuuuuaauguuuaauaaaauaaaaacauuuuaauauuuaaaguauuuacuauuuuaauauuuaugauacuuuaauguuaucuuaauaaaauacuuuaauauuuaauaucuuacuauuuaagacauuuuuaguauuuaauguuuuuauguacacaugugugauguguauagggugucugugugauaugagugacugacuacaggguuaaaaugacauuggauguccucucucauguucuaccuuauucccgugugacaggcucuuacugaaguuuaguuauuuuguuguucaacugaaauucauuucauuuccucugcuaucuaauuuacugcauaaauacauuauucuugucacucacuagagaggugacagaggaaucccugugucugugguguauguauguguguuggggugggggguggaguaaggucuguaucucaaugcugcuucugccauagguacaauguuguuuuuaaguacuuacugagugugcgccguguccaagcugaacugcagcacugcugggcacuccagaugcagcgcaaacaccucaaaucuaaccagacggacgcagucaaguggcgccuaagaaaccacauggccuucuugguagauaaucuucaguacuaucuccagguacguucugugcaauggauggaagaggugggaaaaggagcccagaaagcagaaaagggucugcuguucuguauuugguaaaaugcuacaguuggagaaaacugaguauuucuaucucuaggcuuggcauuuuaaguggaaauaaauggauaaagggaauuaggauacuuaugagcaaugcacugauugcugaugugacccuuugucauuguggcgugauauuaucaauuaaaaaguucauaucagcugggcagugguggcgcauaccuuuaaucccagcacucgggaggcagaggcagguggauuucugaguuccaggccagccuggucuacacagugaguuccaggacagccugggcuacagagaaacccugucucggaaaaccaaaaaaaaaaaaaaaaaguucauaucaaaaaaccaugcaacaacucccacccccaaugacuggaaaaaaaaacccaacucauaaucuuuugaguaaucuuauaauucuguguuguuccuucacugugcuugucccauaucuauccuugacuacaugcugaggaagccugcuauugcuaacuaagucaguggagaggacgaggcaggaguggauuucacuggguaggggaguggucuacaaagacauuugaaaugauuaagaauuacacauccauggagcuagaaaggugauuuagcagcuaaaagcacugacuacacuugcagagggucugaguuuguuuccuaguauccacaugguggcuccaaccaucugcaauucuaauccaaaggaucugauauccucuucuggcaucuguguguguuacacacacacacacaagcaaaacacacuuacuuuuuuuuuuuuuggaaguaacaacugugacugggaauguaggucaguugguagaguacuuauauagcauucagaaaggguuugagcucuggcacugcaaaaugucagguguggcggcacuagccugugauccuaacauuucagagguagaaggaagaggaccgggaguucaaggucauucuuggcuacacagugagcuucaggccagccuggguuacaugaaacccugucucaaaaacagaaauuauacaaccaguucuguugacacacaacuguaacauccacacugggaagugucaggaaggagaauugcaaagccugagcugcagcaagacccuguauaaaaagaaacaaaagucagggaauguaauucauuguuacagccuuccccugaauacacaggccucaagcaacacacacucuacaagacucagagcaacugaaacaugucacuggucagccuaaaguggcuaaaaggaagaugagggcuggugagauggcucaguggguaaaggcuggagccaccaagccugaugaccugggaccaacccugaaaaguuguccuuugcccuccacaugccucuguggcaugagcaauucacacacauacuaaaaauaaaacaugagaagaaccauaaaauggaacacucagaaugugccaggugcuaaaaaaagguuuuuuuaucuaucagguagaugugcuggagucucaguucucacagcugcuucaucagaucaauucuacgagggacuuugaaagcauccgauuggcacacgaccacuuccuaagcaaucugcuggcccaauccuuuauuuugcugaagccuguaaguaggggugauugguugcuuagccuaauaugucccugucggcucuuggacuugacgagauaugagacuguuauucaucgcauguucaaguccaucuuuacauuucugacacuuaaaauacaguguuaaagggaacgagaauguaagagugugguaaacagauagagauaaaaagaacuuuauguuuaacacacacacacaccccaagugaccuacagaaauucaggaaucucccugacucuacaggaaaacaacagagcucacuuucuuagaaaucuguuggaccaggaucaaccagucauuugaaaguuguucucauagguacaucgugucuaaugcucuggguguacguccaucugcaaguacacacauuuagcucuucugacagcuacucaacauugacuacauauuggaacuugugaaaaaaaucuaaggccagaaaucacuuaagucaaacgugcagauuggggucucagcaccaauaacugcaagcacacaagcuggccccaaucccaaggugagcgugcaacucagauaacccuggagugcuuaugcuuucaucucuguggugagcaagcuguacucauccgggcaccaaccauaaaugguauggggcuucuuugaacucugguauuuggggcuguuacuugcuacaccuagaaggagugacuuaagcagcugccacucucagugguuggcacuguucuugcauagcauggguauauccuugaggaagagcacguuagaacaacaggucaucauaauugaagucuuuauugagugcuuacuguaugcaaggcacuggggauacaaagagguauaagucauggcucugcccuuaaggagcucacaaucuaguuggaaaacaacaagacauguacauacaaaagucagcaacagcacggguggcccgacaaucaccagugaacaacacagguacuacaacagaagaaggguggagaccgcuaaaggcugcaguggggaaggaguaguucacagagaaugaggcuugaacuguuaguaaagagaagagaaucucagggaacaacacucagagcucaaaggcaagagcauucucagugggucuaaggaaggaggaguuaauggugacuagagcagagguuuugugcagggagucagagaagccagcugucccaagaagggauguucauucuguguguuacuugggagggccaaacagcuuugaagguugcggugucucugcugagaucagacaugggagguaguaggcuguuaaaaacuauuuucccaaaccuugcauuucucagcgauuucuucauuucuuaacgccagcuauauuuuuggauagguguuucacugccugaaugaaauccuagaucucugucacaguuuuuguucacuggucagucagaaccuagguccacuggaugagcgcggagcggcccagcugagcauucucgugaaggugagucugccuagccacugaaaauacauaccucuccccccagcuguggagcaggcagucugcuccgggucaauaaagcguuuuccagaacagacauagaaaugacgagauaaaaagauaaaagcgcugguaucggugaauauauaaugugcugccucacaguguucagaaauaguucagcccugaauaguuucuucagcccaccaaguaugcacuggcuuugugcucauuuucucacaucccacuuccuucccugaaccagccuccuaucucacuuauaauuauaaucucagacuauauuuaucuccuuguaacaaagcaggaucacugcaaucccaguaugugauggaauauauuaaucuuaaaugagcuguuaaauuccuacuaacgagaaagcacuuucaugggagucaugcaucucacggacauguacuaagaagucauguuaggagcugauagaaaugggaauaugggaaggccaggugguccugcaaacauuuaagcaaagcuuuuccaaagacccccuugguucccaguacccuagccuggucacugacagcucgggucucucaacagggcuuuagucgccagucuucacuccuguucaagauucuuuccaguguucggaaucaccagaucaacucagauuuggcucaguuacugcuccggcuagacuauaauaaauacuauacccaggcuggugggacucugggcagguaggaacaauucauggggcacuuacuagauuuggaggaggggguuaaugaacaauagaagaccaaaaugcaacucuggccaucaccuccagauuacccucauuuuauaaacaaggcucagagaugcaggaagggguuggggguaugggaguagggugaucauguucuacaauuuuacuggaauuuauuuucuagugaaguucaucagcauauuaaaauacuaaagcugaggguaaggucuguguuaggcuauguacugcuauguucugggggcagucuggcuuccacugccugcucugacauguacuagcagcaguguggcuguggugccaugcucucuucuaaacuuccuuaaaucuaauacugauauccaguggucaucgucggcuucuuaagagagcuguguuguugccaugguguuagcucuaucucagauugccauguuucuuuggaaggcauggcauuuaaugaaacuuuuuuuuucuuuuauaguuuugggauguaaaagaaaacucugguucaaaaaaugaaacagcccugccacauucugaugucuguaacaaaucucucaaaucauucaucaaaugccugcagacugcugaaagggucuucuagaagaaaugcagagguauaaaaauccucccugccauuccuguaggggaacuggggucugauaucccucugcugaccacacgaaggauuuugaagacaucuguuggguggguucauuuguguaaccgggguuuauugaacacuuacuauauuccuauggaagauaaccacaguaaacaguggguuggcucauguaagaacggaaucacgcuccugaacaggucagcuucugugucaccaccaaaugagaaaacccuucagagagccugugagcuuucccucuuucuguaccuuguaacuacacagacuaucuuuauccuucccuaaaauuuaagauuugaguauccuuuaucugaagaauugagccagugaguucuaauucuuucagacuaguaaaagggcaauucuggcuaaagaggauagaggucaaauuguuuagauuuagaaacaauuuaguuuucacugcaacccaguuuucccaccuuagaccugccacaugaguuaagguuuuauggucagauagccuagccaccacgggcugagaacauacuaauguucucaucagcauaaacaaaacacuucacugacaucuuucccuccaagcuggacaagaaugaaacauccgggccucagucuguagucacugaguccucucuucaucuacacugucuaccaaccacuaugaaagccugagcccguacuugucaacuacccaggaggauuaucccaccuuguuaccucaccucuaaaagcagauaacagccugcugcuuguuuuuguaaauaaaguacuauucaaacagccacacauacucaauuuagcuauugucggugauugcucacagacaagacaaguuguugagacagacaaguguggucacaaagccuaaaaguauuuacuauuuggcacuauagaaaaaaugagaccgcuggcuuuauuuagagaaugagaagccguucgcuaacagggaugaugaugaugagugugaggaaggaauaacuuccaacaguugugacagcuuauuuuauagaaaaccgucccagcaaauuuauagucacuguccauucauuaacaacuggucauguucauguucccaguagcaggucaucugucaauaaacuccugauacccagagcuguucccagucccacucaacuuuagcacuacuguuuacccaggcccucaccuacuuuaaacuguuuuuggaaguauaacauuuuagguagccugggauaaccuugacagugaugccacaaaauaaagcucacuccucuauuuuuaucucccuuuguuugcuguacugcuaaagugacaagccugcugacaacuucagagaagauccuauguuuaucauguucugagauuaagcucaaagaaacagaugaagacaucccaguuacuacaaccaaagagauucaacauuuauuuuaucauaaaaguccagcaaauaaaacuauguacaagguccaugcaaagaauacaauuacacacaagacacacuuaaaaccugauuaaaacacaaucuccacaauagcagggaauaaaaccaguaagaccaaguaucuuuagugagaaacauaaucauguuuauauuuuggaugcugcuugaauccaauucucuccccaacaaugaggcacuggaucacccauucuugugauaccacaggcaguugcaaggcuucagcacacuugagcaccgaggcugggcaugaggggucugucaccaccacaucaaauaccccuaaagcaaugucuguaaaaaguaggggaagugaaugagggagggacacucaguuuagcuccuauuaaaacaagacaggugugccuucuaacagguauucccuacucugccaaaccaaagcccucuacucuagguacuguauguucauaaucuaaaauaaaaguugcaaucaccacgucuggccuuguagaacuauugaauggaaauaccacuggagacuauagaagccugaauagcguuauccuucacuuacgucaaccuacccuuuuugaaggugggacuuaucuuaaaaaugaggacagacuuggaauacacaugcugacaggugugagucuaaggacacccuggaaugacuaugaaacacagaugcuucccaguaccuuuguugugggcacuugaauggugcugcuucacagaggcugccccuccagucauaaggaucucagaccagagcuccaagaaguucuguuguugaucugacaccaagaggaccuucagauucuggaaaggguuuucacgggguugccugugaaggaguuggagacaauauuuaggaacuggaaaggaacuuaguauggcccaucauaucuaacaacucugcaaagggaguccuugucugcgcuuuccuagcucugccauguguugaacaugcucugccucgcuucuggaggagguaugcauuccaggagcccagacuuugcuaguaaacaaaucagguuaguccccuucccucucuaaguuuaaaauugaaacuuaauccuaguuucaaugcuuccccuacuggggaacacugaccacauacacuaaucuuuccacacauucagaagguucccagugaggcucuggcaauaaaguacuuuaacugcugauaucauuucaaauucauucaaauucugauuuagucuacagacauuccaguuucuaguaacacuuaaauuucucaacuagacuuucuucccaaaugccauucuuccuguugucucagcucuaaaugggcuuccaaacacucaccaauccagaauucguugcucuucaaggcuauacccagcaggcagcagauaauuacgauaguuuugaaguugguuggcauggcaacugucauggacccagacaugagacacacaaggaaugccacuggcaaggcacaggaaguacuuccggguucgacagugcugguccgcaauuaggagacacugguaggcuguguuacacuagaagaaaagaaacccagcugacuggucugguaguguuuaggaaaaccuuugcugauuagcugcaccuaaugagcccucgagaacagguguaaugacuuccaacugguaucaaaaaauacuaucuaaucuguuuuuguaccaaagguuguguuggcucacugaaaagcccaaacugcuuccugugacaguuuguuucaccuacaucuuuuggaaggccuaaaucucaaaggucaaccauacccaguaccccaccuuccggcuagggaaacacuaccaccaauaggcuuucuacuguauaaguucaaucuguugcugucucuacagaaccacuaccaccuaacacaagcucuagcgugucuucucuguguacacugaaaaugcugggcuggaguagcacacuggcacaguacccugcauuucaguaaaccacccaaaccccucuugggccuuuucucaauacagaaagaagguagccacaaaauaaaguccucaccugggcuucauugaagucuucaaggauauacccagcuccugcucgaagcuggcauucuguauacugcuuguugaaaggaggaauuucuaaaaauucuguauauguaacaaaaauaauuauuuuuacuauuauaaaaucuaaguacuuuaau

SEQ ID NO: 1029 - RNA, 78147 nt, Mus musculus
cgugacgggaaaagggggagcucgcggccaguggcggcgguggcgacaguggcgaccuggggaucgaccuggaggggccugggcagcgugcagaaaccucuagauccagcgcgaggcaccucucgccgggaugccagguagugcugcgagcggagccgagcuagcgggccgcagaggcccggguggcgggcuugaagggcuggccgccuggagggggcgggguggcaagcauggcggcggugacggggacgggguuggagggccggggaggggguggggaggcagccgccgcggugguccugaggccgcaugagggccgugggcuucccgcccgccgggguugcgaagaggucuucccggggcucaguggcgucagaacgcggggagaguugugugggggauggaaaggggcggggagaagaggugaggaaggaagcgugucugagggaaggugaagagaaaggagggagggagggggagaucgaaggauccagaggcgcggugguaaauaacggagaaaugagggcuggggagauggcugagaaagugcuaagagcgauugcaaaugugggcuacuggguagcccuagaauggucccuuucucgaucucacacuuccgccccuuuauuuagucucagauuguguguggaaagcucaauaggguuacucuucgaacugaucuuuuguuauuccauuccaggggagcagauggacccuacuggaagucaauuggauucagauuucucucagcaagacacuccuugccugauaauagaagauucucagccugaaagccagguucuggaagaagaugcaggcucucacuucagcgugcuaucucgacaccuuccuaaucugcagaugcacaaagagaaccccguguuggugagugagugaugaugcccuguucaaguuauuauuuuuuucugaccccccuacaccaaacuaacccagaaaauuaacguguuuaguugauuguuagcuuuuggauaaaguugguggggaacgaaaaaugaaaucaacguguucucacccacagaaaggucccuguuguacuacuuuguguacugugaggaucuuaugugcucauguuuucuaggauauuguaucaaauccggaacaaucugcuguagaacaaggagacaguaauagcucauucaaugaacaucugaaagaaaagaaagcuucaggugagcaguugaaggcuuggcucucugcaguguuuaagguccugugggggcagaacgauuuaaacaugcaguugagauuauguguaaggaagccuaguuuguuaucuaguguucaguaagccuuuggauacccgugauuaguuugguguugccuccauuucucaauuuguauuaaaauuugauggcaaaugucuucugugcuaauauccaccuccuucugucuuuuucagauccuguggagucuucucauuuggguaccagugguuccaucagucaggucauugaacgguuaccucagccaaacaggacaagcagguaaacuauuguuucagucaaaggaguugauuucaauuuacuauucgaucgacucuuaucuguaccugcugauucaucccaaagauaaagauauuaaucuuguuuugugaauuggggagugggauuuggggauucuauagguaguucuguuuuaggacugagagcugggaucucuuuugugaaguaacacuucguucaacuccuacaacuucaaauuguaauguauacccuaaagaguuuucaaguuuuacagugucuuaugcauaucaggauggugguguccucuguguuaggccugcuacugacuucugacauaaucuuaaguuaauucuauccuuaagcagcugugcaguaaagacauuguccccagugggguacugaugggcagggacauuaaagcuuuacuauguucagggagagccagcccuuccuucucuuucuuacuauucuguuucucaggcuucugcccgguucuucuuuggucaaagaacacagacagccuuaguagccuugaggaggaggcugaggcucugguuaagagagagggauguuagccugacaugucugcaacugugcuuuaccuuagaguguuuugucugcaguguguuauauuguauuugcacauacguuuuucccucacgaagaaauguguacuuuuaaucagucugaaaacuagugugcucaucuugaccauuggauaacuuucaugaggcucauaauguuaaaauauauuugaaggaguuuggauuuaaaaaugggagccugauauggucuuguacaacuuucauuccaauucuucuggggcaggaguggguagaucuaugugaauccaagaccauccugguguacaaguagacuuccagaccagccagggcuagggaccuccccgcuccaaguaaauaaauaaacaaauaaauuuauuucuccuguagcuugcauuucuugcuuuugggauugcuaguccuugcugucuucaguuugcccuaauuacagguggacgccucccgugggcauuccuugccguuugucaugaugcuugucccuauacccgacugcuucaacuuaccugugacuauauuguuuguuucguuuuugauacauagucucauucuguaguccaugcuguucuguaacucacuguguaguacagucugaccucuaauaguggugauccuccugucucagcccucaguugcugagauuacaggugagccaucacgccuggugccacguaccuuuuguuaucuuucuuugcuuugguuucuaaugucuuugaggaauucgugcuggagcagaugugcuuuucuggcuuguaaccugggugcacgguagggacaagaacuggcacgcuccauuguaacauuuuaacuacagcagugcugucugggugcuccaggcugccuuuccgguuugaaaucaauguguugcucuugcucuuuguguaaauacggauuuuauggccauguucaauagauguacugugugacauguacuuuguuaucauggggcuuguaacuuaauagggggagacccaguuuuuaccucaguccuaaguugcaauuauguuuauuacaaagagaacaauguguaaauaauccagcugggaguaaaggaauacuucuuugaggaaugcagucuaaacaauaaaugcaaauguguuagucacaguuaggggguugagacgcugccaugccccaugagaggaagaucuuuccagagagugcauuccaugugcagaggccacagagcuggggagaauuugagacugauuccaaaagaguggaaguuucucagaacacaaaacaaauaacacacacaaauagcauacacauuuacacacacaguauacauauacacaguaugcaugcacuuacagcacacauacacacagcacacacauaguacacauacauagcacacauacaugcaccuagaaucuuuucugaauagcggauauuuugaaacacuaacucugcuugggaaaauuuuuuugugucauaaaauucccccugccccaucuuguuuuacccagaguucugaugauauaaacagaugucccuaaauagggauuguccuauaauauaacauggaggaauacauauauuuaaauuuuccuguuagauuuuuaaaaauuguuuuuuguguuugaggggcagauauacacauauacuguggaggucagaggauagcuuacaggagggaaucaguucuucucccauguguauuuugggguuugaacucagaucaacaagcuugguggcaaguaucuucacugacugggucaucuuccuggccccaaauauugucauuuuaaauauucauuuguauguauuuaacuuuuugagguuucauucuauguguaauggauauuugccuguacguuuaugucugugcacaacauguauugagugccccaugagaccaggagaagguguuggauccucugcaaccugaguuacagaugguugcuagcugccacgugggugcaaggaagugaccccaguccucaggaagagcagccaauguggaaagacugaugugugggucauauauuggagcuguggcacaaguuuguuuuauuaaaaagaaauguaaaguuaaaaaaaaaaaagcaaccaaugcgcuuaacuguggagcuaucucuguagucuaacauguuuauuuucauuauuucauuuagagcuuuguguaucguaggcaagcuguguacuccugagcuauaucuaaagcccccaugaaacauucuugaguuaggauaguuguacacucacacacuauuauaggaaauagugcagaguucauuuacaugccuguaaauuuaguaauugggaggccaaggcagggggaccauuuuggaguuugaggucaacuuggacuacauagugaguucaagcauaaccuagcauuuauagugaaucuaucucaacaaacaagaacuaaaaacagaauacagggagagauugaguauacuuugccuugugucuguuaugguaagcuuacagagcuguacuauuacagccagauugcugauucaggcauucucuuagauucuguuagguugugguuggguacuguguaucuaguuuaucacuuguguggauuuguguguuuccacuacagucaagagacugaacaguuguguacagagaugucugauauucuuucuaaagucauaccucccuucaccggguguaccugaacccuuagcagucauuaaccuauguuaauuuagcaaauuauuucaaaauguuauauaaauaugcaaguauaugugacuuuuuuuuuucugucagcauaacuuuugggaggcccaucaaaguguuucuuguguaucugaguagucuuuuagaguauaucagauacgccauuauucauagguugaagcauauauuuuuaaguuuuugacuauuguaaaugaaacuauuauaaauacuugugcaaauuauuauuauuauuauuuuaugucuuugaguaugugugugugagugugcagguggaggucagaaaggacaacugugauuuucuuuuuccaccguguggguuccugggauugaaugaacgaaggcugucagacuccaugugugugcauagauauauauguauauuuacacaaaggccaggaagauugcucagcaggcaaaggcuucuuucccuucccuucccuucccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuuccccuucuagagagacaacucacuauauagcuguggcuggccuggaacuugcuguguaggcaagggcagucacuuuucagaucugcuuguuuuugccuccugaauacugauuaagguguggcuacugugcuuggcacucugcaaauuguuuaugugaaccucagcuuucauuucuuuaauaaugccuagguucuuguuuggcuauuugguaguugcauuacuuguuugaacaaacuuccagaguguuugagagcauguauaucauccagcaauguguguaaauguuuuaauuucuguucucaccaacuguuaauauuuucacuguaguugucuuuuagaagugcuuaggguugagcuugagguuucagucaugcuaagcaguguucugugacaagguuauauuaucagccucuucauuauuuguaaauuacaauauauacaaauuaaaaauauuuuuugaaagugucucauguaucucaggucagccucaaauccccaucuugcugugcagcugaggaugaccuuaaacuuccaacacuccuuacuggaaaugcaggccugcaucgccugccugguuucugugguauugaggguggaguccuuagccuuaugcacucuaggcaagcacuuucccaacugagccaacccugauauguguauaguaauaucuucuugugguuggaauuucuauuuuccuaauggcaaaugagguugaaccuuucaugugcugcuuugccaucugcuguccucuucaggguaaaugucugucuaugucuuucauuuuuaaauugauuuauuuuuuuacuugcucuuccacucauccuaggaguugaacucgaggcuuuguccauggcacaguucuuuacugcugagcuauguccuaauuuuuuuuugggaggggagggggaguugguggugguggugaugguggugguauucaagucagggugucuguguaucccuggcuguccuggaaugcucucuguagcccagguuggccuugaagucacagagaucugcuugccucugugucuggagugcuggguuuaaaggcauaagcuaccacuguuuggucccuagugugucuagagagugcuuuguaaauucuggauguagcuguguugguuuggcuuguaaauauucucacuguguagcuuguguuuuuaaucccuuguaagaaugaaauuccuuuucacagagcaaguuuuauauuuuuuaugacauuuguuaaguauuuuaauaagauaacaugacuaguaguuuauuuuagaaaguucaggguaaaaguggauaauuagucagugagauucugagaucugaaaauaggauuugaagauggaguaugaguggagcaucagccggaaggcggaaaugaaaauucuugucuuguuucagcagcuagaauggaguagugguugagauggaaaagauugaaggagagacaguugaacuguaggugcauaugggcauaguaacacacacacacacacacacacacacacacacaccccuuuaaucucaucacucaggaaucacagguagauagaucucugcaugugugucuccagccaucagaagcgguucaugugcuggcuggagaaugacauuguggagacauauggauagugcugaaguuaaaacuuugggagcgagcggugguggugcacauccaugacuccagugcucuggaggcugaagcaggaggaucauguugaguucaagucagccugaguuacauauuagguuagccugguuauucagauugagacuuucuuguuuguuuguuaguuuuugagacaggguuuucccauguaacccuggcuguccuggaacucuuucuauagacuaggcugaccacuaggcuggguucaggacauuuucuuaauuagugauugauggggagggccaccccugggcuguguuucuggguucuauaaaaaaggaggcugagaaagccauggggagggagcaagccaguaagcagcacucauggccucuguaucaguuccugccaccacugccuggcuagauugagacuuucuuuuuuuuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauacaaaguuuacguguccaaugggccucucuuuccaaugauggccgacuaggccaucuuuugauacauaugcagcuagagucaagagcucugggguacugguuaguuuauaauguuguuccaccuauaggguugcagaucccuuuagcuccuuggguucuuucucuagcuccuccauugggagcccugugauccauccauuagcugacugugagcauccacuucuguguuugcuaggccccggcauagucucacaagagauagcuacaucuggguccuuucaauaaaaucuugcuaggguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaccuuauaucuugggaauccuagguuuggggcuaauauccacuuaucagugaguacauauuaugugaguuccuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaauauaguggagcauguguccuucuuaccaguuggggcaucuucuggauaaaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucauuuguucugagccccauuuuuuaaugggguuguucgauuuucugaaguccaccuucuugaguucuuuauauauguuggauauuagcccccuaucugauuuaggauaggauugagacuuucuuaaacagacaaacaaacaaacaaaaauccaagcugauucugaguaaggguugaagauagcugauguccaaaggcuaaucacguccaucuccacuuagauagaaaggacaaaaggaagagccuucaacagacagaaggcucuugggugugcuucucuuuacauuuuaaaacaauuuuguuuuuguguagacacgugcaugucauggccuguguuuggaggucaguacagcuucuuucccuuuaccguaugaagguccaugguuagaauuuagguugcuacuuccauuaugugguuucagagagugaaugcaaguaauacccaguacccagugagccaucuuacggcaggcggugguggcacacaccucuaaacccagcacuuggaaggcagaggcagguggauuucugaguuugaggcuagccuggucuacagaaggaguucaggacagccaggcuacacagagaauccuugucuugaaaaacaaaagcaaguuuauuuuuacuucucauuaaguguagguaucugugacaguuuguauguuuggugcuaguguagaucaccagagggcacuggguccccuggagcuagacuggugguagucaguugugagcuauuugagauggauguugggaucugaacuuaggucuucuguaagaaacugauaucaugcuguuaaucaccaagucacuucuccugcccagguucuuauuugaaaagagauaaacuagugcauuucuguccuuucuguguaugcguauacuuuguaguacacacucauaguuccccuuuaaauguuuuagcacucaucccuggaaaguaaggguaacaccuuaggugaguguaguacaauaauauuaauuccaaggguugccaagauaagagcauuugcugcucuugcaaagacccagguuuaggaccagauuugguucccagcacccauguggcucacaaacauucauaacucuaguuccaggggauguguaauccucuucuaaccucugcaggcaccaugaacgcauauaugcauauaaaacccugguauaaauaaaauauaaauauauaagcagacaugggcuugagcaauggcuuagugguuaagagaacuggcugcucuuccagagguccugaguucaauucccagcaccuucauggcagcucacaacuaucuauaacuauaguuccaggggaucugguacccccacacagacuugcagguaaaacaccaaugcacaugaaauaaaaauaaaaaauuaaauauagaaacagauaauuccauacuaacaauucaauuuagauucagauuuuuuucaguuguguuaaagaugucuuuuauauuuuauuggauuuaggauauaauauaacuucacauguuauauguaaauuguuuuaaacuuuuuuuuccuuguuguuuccuuucuuuccuauguaugugaauauacucucuucaaacacuccagaaggggggguuuaggcucccauuacagauggcugugagccaccaugugguuacugggaacuggacucaggaccuguugaagauuagucagugcucuuaacugcugagccaucucuccagccccuguugcuguuucugaacaggguuucuauguaauccugucuuuacuagaccugaguagaccaggcuggccuuagauucagagaucuaccugccugugcuuccugagugaugagauuaaaggucucuguguguguuacuguguccagcauuucaagcauuuuuagugauggauuaugaacuuaauaauuuccccaauauugaauacccuuugcugcuccuuucccuuucuuuuugagaugaagucauccauccuguguagugcacacugagcucacaccugagauucucacgucucagccucccaggugcagaaccugcacguguguacucacgcauucucuccauaguccccuugccuccccuuuuuuugguuuuuugagacaggguuucucuguagucuuggcuguccugguacucacuuuguagaccaggcuggccucgaacucagaaauccgccugccucugccucccaagugcugggauuaaaggcgugcgccaccaccgcccggcgagaucauuucuuaauagcuaaaaacuuuuuggaaguaaauuuggguauaugccuguaaucccagcucuuggaggcaggaggauuccaaggucaaggccauccugguuacauacuaaguuucaaaaagagaaaacacugaaauuguugcuuaugaacuuuuuaaagcucuugaaaucuuucugaauuauuuuccagaaauaauccuuuuguacucaucauaugugagauaggaagccuauaucuaucuaucugucugucugucuaucucuuuucucuccuuaguuguguaguauugagcaauaguauaguauuuaauauguaugcucuauauuaaauauauguggcuuuucccccuuuguccuuauguuaguuagcccugacugauccuaaguuuacuguauuuagcagaagcuaaccuucuggauucuuuuuuccacuuucacaguguuggguuuaauaggccugggcuguaauuauaaugccuggcuaaaucuucuuucuuuuuuuuuuuggcaguaaauuuuuuugugguuuuuuuuuuuuuuuuuuuuuuuuuuuaaagauuuauuuauuuauuauauggaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccauuuuugugguuuuuuuacaaguucaaagauacuugugucucugauuuuagagcucauuauuacuauucauaucuuugguuuucuuuguaucaauucuuuaucuuuuauguaguuuauguuguaugugucacuaaugguuuugauuauuuuuugucuuaauauuaugcauugugacgauagcauuaacgucuuuuaaaaaaguuguauuuuugccagacagugguggcacaugacuuuaauaaaauaauaagauaauauuuacauaauggauaauaagauaacauuuaaguauauuuaugcuuuuggucucuuuaguuuuuguuacucacuuugguacaguguuuugaaaccuuuuauguacugucuacaggcagcacuaaaaucaugaggguuuguuuauauuucuaauuuggauaagggguaauuggugugugaggauaguccgagcaaaauccagugugcuucuagcagacuuggccucucucuaccuggggacaugacaugauugugcucuuucucugcagugcucuggcagugacaguagaagcugcuucucucccagaggaggagaaggaagaagaggaguuagaggaggagaaggaaggggugggagcaaacgcucccggugcugacucccuugcugcugaagguagccugugcccuuucagaauaagagucuucucgugccccuuuacuaugaacacacagggagcucgacugcuucaccaugucauagauuuccuacgauuaagcugagaaucacaaguaauuuaagaugucucaauuaauuugauaacugaauuuucuuugcuaagcggccuuccaaaguuaugaccgaauacuccagaaaauaaacagucguggagaguccccucguuacuuugggccugugacuagacagaauaucauguuugggugcugucuuagucaggguuuuuauuccugcacaaacaucaugaccaagaagcaaguugggaggaaaggguuuauucggcuuauacuuccaugcugcuguucaucaccaaaggaagucaggacuggaacucaagcaggucagggagcaggagcugaugcagaggccauggagggauguucuuuacuggcuugccucaccuggcuugcucagccuggucucuuauagaacccaagacuaccagcccagagauggucccacccacaaggggccuuucccccuugaucacuaauugagaaaaugccuuacaguuggaucuuauggaggcauuuccucaauugaagcuccuuucucugugauaacuccagcugugucaaguugacacaaaacuagccaguacaggugcacacagagcaaagcugcuucaccucgcaguaguugggaaacaagggagagacagaggggagaugggguggcccugccccucucaacccaguuuucuuccacuaggcccucuucuuuuuuauagaugugauuuuuuuuucuuuugaauuuuguuuauugggcaugugaguacacugucacugucuucagacacaccagaagaggccaucagaucccauaauagaugguaaugagcuacuaugugguugcugagaacugaacucuggaccucuagaaaaguaguuggugcucuuaaccacuacaccgucucuccaaccccuaggcccucuuaaagggcuugguguggugcucagcugugauauuagcaguuaggaauggagacagaguugccuugcauuugaagccagccugggcuacagagugagacccuaucaaaaucaaaacaauauaaaaaggucccaccacuucauaauggcaccagagacggcggguaaacuuucaauucaugcccuuugaggcuaggcauggugaugcaugccuagagcucuagcucucagggaggauuacaaguucaaggccaggcuuggcuauauaauaugaccucucaaaaccaagaaacgcacaaaugagucauuacauuacucauugaccaguuugcuuucugcauuuuguguccuucuccuuuugugcuugcuugucagaauaccuuugagugugguuuugauguaucuauagauuauagacauugucuaccauauuaaaguauuuauaaggcuucauauaucuaaguuuuugcuuuauuauguaccucccccuuuuaaaaagcuacauuuuguuaauuuauugggguuuuuuuuguuuguuuuguuuugguuuugguuuuucgagacaggguuucucuguguagcccuggcuguccugaaacucacuuuguauaccaggcuggcuucgaacucagaaaucugccugccuuugccuccugagugcugggauuaaaggcgugccccaacaugcccagcucauuuuguuaauuuaauuauguguuuguagucagaaccaacuugugggaauuaguuuucuucuucuaccacauagauuuuagggaaucaaacucagguugcaugucagcccugacagcaggaaccuuuaccuucugagccuuuuagcuggucccucccccauauuucaguguuuguuuguuuguuuauuuauuuauagcagggucuuacaagaucuaggauggcuacuaugcagcuaaagauggaccugaauuuuugaucucccugcuuuuccuucccagugcugguauuauaagggugcaccaccaauacucuggucucaucucaggucauuuaagugugugcuaccacacccagucugauaguuuuauuguugauuuuuuuuuucuuaugaugcuugggauugagccaccccauguccaaucccuuaaugcaucuuguuuuggaaaauuuaugugugccaaagcuuugauaugaagcauucagugugauccuuggagcuggcaagauggcuuagcagguaagaguauuugccagcuaagcuaagccugacggccugaguuuugucucuggauccacauuguagaaggagaguacugacuucugcaaauugacuucugaccuccacacuucagcugugacuguguguacucauagacauauacacacaaaugcaaaaagauuguuuuaaacacgauccucuuuagauaaaacagccauuugcacauugauaauguuguggguugauaacuaacuuuuggaguuuuguuccuagauucugcuucaucacaguugggcuuuggaguucuggaacugucccagagccaggauguugaagaacauacagugccauaugaugucaaccaagagcaucugcaguuggugaccacuaacucggguucuagcccgcuaucugauguggaugcgagcacugguaugaaauguguuuucucacauguggagcugguuauaaguuguuuucucucccuuaggacaaguuucuuuuucuuuuuuuuucuucuaagguguuuuuucuuuuguuguuuuugugugugugugugugguuuuuguuuguuugagucuuccccuugcaacucuggcugaucuggaccuuguuauguuaccagaauggccuuaccuuauagagaugcaccagcuuccucuucaagcuuagaaacauuuauuuauuuuguuuuauuuuauuuauaugacuguuuugauuuuauguauucauggguacaacauguuugucugguacccauagaggucagagggggaaucagauuugaacuguaguacagaugugagccauuguugugagugcugggaaugaauccuggguccuuugccagagcaagaacugccaaguuaugucucucucuuuuuugggguggggguggggcuuucucaagacaguguuucucagugucacucuggcuguccuggaacucacuuuguagaccagagucaccuugaacucugggaucugcuugccucugccuuggaagugcugagauuaaaggugugcaccaccauguuuggcuucccacuaaguuuuaaagcgauccagguuaaugcaucccgaguuugcagaguaggcaguaaguacuugucaggugauggcuugcagauugauuuuuuuuuucuaaguaggucacugauuaccuucuuuuugggugauaacauuuuuuuuuaaagauuuuuauuuuuaauuuuuaaagauuuauuuauuguauaugaguacacugucacugucuucagacacaccagagagggcaucagaucccauuacaggugguugugagccaccaugugguugcugggaauugaacuuaggaucucuggaagagcagucaguucucuuaauggcugagccaucucuccagccuccuuauuuuugauuuuagugauuuauuuauuuuacuugcauuggugguuuuccugcauguauguuugugugagaguuauggauccccuggaacuggagauauagacaguugugagcugacaugugucugcuaggaauugaacccguguccuguagaagagcagccaugcucuuaacugcugagccaucucuucaaccccaguacuuauauauuuuuaaaauuaauuuuauauauaaauggugucugugaggccaaaagaaggugucacaucuagaguccgaauuagugguuguaagauacuuaacaugugugcugggaauugacugcugguucucugaaagcagcaagcccucuuaaucucugaaacucagaaauccaccugcuucugccucccuagugcugggauuaaaggugugcaccaucacugccggcugucucccucuucuuaaauaaaacaaaaacccaugcuguccccuuugugauagcugacuguuccugagcauguggccuuccuuguaauguacuuuauauacuagcugucacaggacuaaagaaacugacuuuacuucucccaguagcaaucaaaugucuauagcuucuuaccucgggguaggacuuuauguccaccuucucccuccaugcuaagaugucugucugguuugauguuguguagaucuuguguauacuuuaacagucccugugaguucauguauauguuugucuguugguuuuggaaaacacuguuucugugaaguuaucuaccaccuuuagcucuuaauuuuuuuaaccccguuuuuuuguauagauccuugaaccuuaaagacagauguaagcaucccauuuaguucugagaauuccgaaacuugucauucuuugcauguugcccaguuguuaauugccaucgacuacaggaagcagcuucuuugaugaggacugagugaugcacugauguguugcuauagugauacgucaguaggagucauggucguugcuguguccauucagcagagugacaguagguuuuccucuguggcccaugaucugucuagcuucagguucuugggucauggcaauuuuaucucaugaaauaggccuugaauccauguuuuguuuuguuuuguuuuguuuuuucgagacaggguuucucuguguagcccuggcuguccuggaacucacucuguagaccaggcuggccucaaacucagaaauccgccugccucugccucccgagugcugggauuaaaggcgugugccaccgcucccugcuugaauccauguuuuaaagaaagaagugguuuacucccauaccaucugugccaucacugcaccaucgggcacaacuuuccaggcugguuguguaacucagggacacaacuaggugaaacugaugaccacuuuuucucuaguugcacgcauggccuuuuagcacuaugaauaccagccauagggaugacgcuuccagcugaguauuagcucgauuucuccguguucuaagacucaaguauguaguguuuccagcaauagggucuuauccucaaaagcugcgggguaacugauagcaguggcaguagacuguaauguuugagaggucugugggaccucauuagccaacaacucaaaaggugauaacccacucuugguacugggggguuuauuugguagaguaugguaucuaguuaggauaucaucccucuauaauaucacucuugauauuuuaaaauuagacuaauuucuguuaauauuuuuuugccuuugagaauuauuugggcuggcucugauacuuugaagaguuaacaucugcuuugugucuuuucuccccauucuuauauuuuaagcaauuaaaugugaagaacagcccacugaagauauugccaugauagaacagcccagcaaagacaucccuguuacaguacagcccgguaaagguauccaugugguagaagaacaaaaucuaccacuuguaagguuagucacgcacucuuuaaaagugucuguggaauuuuacuguggggcuauaggaauuucauuuuggcuauggaaacaguauuagaaacugcugauucucccucucacauauuacagauacuggcauuuguuuuuguccaauagaaguacugauuauuuauacauauggguugcuuaugcagucuuacugugcgugcgcucucaucuuaauucaggccuauuacuaaaggcgcauuauugcuucuguaacuauaauccuugauaccugucugggugaucagucacugucgguagcagauuauuuugcuucucuggggcuaguaaagauguagaugaacguuauaucagaaaacuuauuucuauucuugagcacccaccuugcuuuggauuguuaaguuucacccuucuguuaacuuaugauacaacgagauccagguauuuuuccaagugugucuggaucuuaguuuggcaggaauagggaacggacacucugcuuggccugugguaguuuuuuguuuuuguuuuguuuuguuuuuuuguuuucuuuucgagcuguguaguuuuuguauugacuggcucguagcagaggaaaacugggcugcucucaauuugaggagagaugaacaacauucaguauccuuuuauuauuuccuucaauagaaguugggguugggguccucagcaacagugauugucauggcuuuuaggcuuuuuauuuuuuauugagauagugcuuugccaugugaccccaggcuagcuuugaacuagauuguagguuugugucucaucaugauccguuacuacuuuucuuuacaaaguucuuuuuucuuuuuuucuuuuuuuugguuuuucgagacagguuuucucuguguagcucuggcuguccuggaacucacucuguagaccaggcuggccuugaacucagaaauccaccugccucugcuucccaagugcugggauuaaaggugugcgccaccacugcccagcuuuacaaaguucuuauuucagcuuuauuauuauuaugauuuaaauaggcucucacuuuguagucuugguguucuuuugacuuaguauguaguccagguugaccuugaacuccuaauccuuccaccucaaccuuugaaacacugcaauagguauggccacaugccuggcuuuccuguuagucuugcuuuuuccauuuuuucuuugggaauauuagaguaaguaagucucuaggaaggggucaagaaugugaguccuacgugguuaagcaauauauguaaaggaguccuggaaaaggucagacggcaacaaauauguuuguggcaccagugaagagaaaagccaugucaagucuguauaaggacuucuguagcagguuuuaaucacuugucaguguucagcagacaggaaacugaugagaggcugguugagggagacaggcuuugaauggccgaggacuuuacaguguuguuucacuuuucauagggcucuuggaauuuuugaaauuguuagaagcuuuuugugaaaagagggaaacauuugaauuuagcaaucuucaucauuguugauccgaaucuccuagguccgaagaccggccguccaguccucaaguuucuguugcugcuguggaaacaaaggaacagguaccugcccgggagcugcuggaagaggggccgcagguucagccgucaucagagccugagguuuccucaacccaggaggacuuguuugaccagaguaguaaaacagguagggaggcugauugcuccacagcuccucuucucacuuguucuacauuuuuauuuuaguucugaggcuacuguuaaaaagcacuuuuaaaaauagcuaugauuuggaauagcuaaugauauagaaggaaaauauaucucuagccagucaguaaugagggcugucagagaguguuuacuugucagcguucuguguagcuuucacccuuuuggaaguugaggugacguaggagugcaucuaggaaagcgugggauuacggacagaguugccauuucuucuucugucucgugcccugugguuuucuugcuuacuuggguaacgguuuacuuaucuaucagaugacauagcagguaaguuaaagucuagaagagaggacacaaugcuuagcuguguagacuggaauguuucacacuccuggaaucuuuuccccuacuccagucucagaaagccaggaguuuagugaaaggcagggagcaggcaggcugugccccuuugccuucugcuguacuuggugugucagacaucaacaggcacccacuauagcuaccaggguguagauaagucauuucuuuacaccuagggcuaacauaguuaauauucagucugucuaaguugauauucuccauucauggagaacuucauagugugagucauucuggcugcucguauauuuuauuaguaguauuaguauuucugucuccuuugaggaggcucaaguucuaaucaugaaaauugcugcauucauaccaucagguucaugcgcauuguuuugacuccucccaucugcaccauggcaugagcuuuaccucacccuagguagaccugggaguaaaggcucgcuugcuguucuauuauagaagcaucacaagaaagaagagcagccaagcagagguauaaggauucuggcuuuuccucucuauaguaguuacuuuuaucauugcuguaacaacaacaacaacaacaacugacaaaagcagcugaaagaaggaagguuuuggggcugggaaagacggcucagugguuaagagcacucacugcccuugcagagguucaguucccagcacccacaugauggcucacaaccaucuguaaccccaguucccuugucucgccucugaggguuccuucaggcauguaguaacauaaacucuuguaggcacacacucauaccauaaaaauaauaaagacaugaguaccuuguuuaaaacaaaaaggguuuuuuguuuuuggucccacaggcugagaguucuagucuucauaucagggaggcugugagaaacugcccagugcccacacucaggaagcagagaucccuguugcucagcucccucuccuuuauucauggaacugggauuccagcccaugggguuggugaccacauucagagagggugcuucauccucagcuaagccuuucugaaaauacccucauacacacuauguguuucuaugugacucuaaaagcagccaagcugacagaauuaaucacguuagcuccacccucugucagcuugacaccagcacaucacuuuagaucauaacauuucacuucucaccucuaaaauaucauucucaucucauaaugugacugcauuuaguuguuugaaaaguccccauaguccgaaacaacaccaauauugucuaaaacuuaaaguaucuaaugaaccauaucuccuaacuaugauguucuauaaagcugaaaagcaggucauauauuaagagagggaugggggcagaacaagugcgacauccagcagagcaagcaccaaaaccuguagcccaugugacugggcccugggcuuguucucugggccccagcagccuugggugcccuguccccccuucccgaugcccucagcacagaugaccucuguuuuggguuagcuccacugcaguuucccuuggcagauuucccaugguuuuggcaucucugaauguuccuggauucuccauugugacuuaaauuucaccuuccaaacuucaugcaguggccuugaagggccuuguuucagggagcuagccacuccccccccccaaugccugcacucagccacuucugaaacuuugguguccccaauuucagugccccucuuguuuuuacaucuuucaugccuacaaaaacagugcuguguggaugaugcucccagcucuguuggcucuagauguagcuugucccucuuggaucccaguugcaguggccucugugucuuugagagugcccuuggagaaacacaucccuuggcagccaauuugcagcagggaacccuugugguggcaaugucaguuuagccucuuuuccuuucagaugaguggguggguuuuuuaccugcuguugucccacugaagaacaugaaagguuucucuucaauggugugauuaacaguuagagauacguucccuguacacucuaucuacaucuuuaaacucagcugcacauuuucauaguuuucuauucuuccacugcugauaugaaucggaacagugaacagagugcuuuccugacaugcagucucuucuguugaacaaauuaguuuauuacuuuuucugacuuccuuagugacauguuuauaguccugacugugcuggaacuugcuauguaguccuggcuggcauugaacuuacauagaucuaccugccucugccucucagaugcuggugcuaaaggcaugcaccaccacauccagcuaguccauuacuuaugaauucagccucaaguucuuaggacaugaguagagugcagaucuuuucuagacuguauuaugaguggucuauauucaguuguagaaugucaugagugguugaucaugcaguuuuagaaucuaucaagaguggcucuauuucuaguagagcccuuuuuacucuaaagcuuugugauccaggcuucuacugugugcacuuuuuucugcauccuggucuuacagacucucaguguuuuaaaggcuuuaucuugcauaugcaaaugauucuacauuucucauacaaaccagcuccaaaggcugugauccaaaagucagguucaugacuggcuggaccccaauucuuggaaccaauuuucaggauuauuuuucucauuuuugaaauagaaugucugauaagcauuagugagagcauagacaugcccagagauguguuuugaaccauuaccuucucuaagcuuagauugugguagaaaggauaaaggaacucuuuuaaccaauucuuuauuaaauaaaauaugacuggguggugcuggcucacgccuuuaauccuagcacucagaaggcagaggcaggcagaucucugaguuggaguccagccuggucuacagagugaaaucuagggcagucagggugacauagagaacccuaucuugaaaaauggaaaaaccaaccaacaaaccugaaauggaacaugggguuauuguuaacucaaaauuuuuguccuggugaugucccacugaguugugcuucuacagaaaggacuucccccuggaguguggcagacuggggauugcuguuuuugcagcacugaguagguucuuccaugcagugaugucaguccgagauguaaauacaacucuaacuuuucucccccacuagcuucugaugguuguucuacuccuucaagggaggaaggugggugcucuccgguuuccacaccugcuaccacccugcagcuccugcagcucucuggucagaagccccuuguucaggagagucuuuccacguaaguaagcccgagcuguuugcaaagcuaaaaguuggaauccaggcuuuaggaauguuggagugagaacuuagaggaacuguuuaaagaauguacauguauuuucccauuggcgguuuuauggugguaaccaaagguuucacuagaaaaucggugccuugcgguuuauaaaugugaugcacgagaaccaaguguuugcccccucuucuuucuaguguuuuauugucacuuaacaauauaggacagaauggauucgcuaggggaaaggguuucuguuuuguuuuugugcuuaaauaaaaaugugcauacucuucaugguauguaaaaugagguaauuuuuuuuaugucucggaacugugaauguccuguuuauucauuauaccuugugucuucucauucaguuugcccuuacuuuuuaaacacuuaguguuugagagcuguuugagucucagauugcuguugaggagaaacguuacguauguguuuuggauguuuuuguuacaaagucaaagcacauguuaaacccuuggcugcagugaauaaccugugauucucucuuuauauaaaggaauuccucagaucuuguugcuccuuccccugaugcuuuccgaucuaccccuuuuaucguuccuagcagucccacagagcaaggagggagaaaaggugagccgucgugaucugucuguucaucuagcacaggagacgagcagugcuugcucuccagcuuugccaaaugcacgcuuccuugagcuucaucugagacacugccccugagacucaugugucuaggacaaaccacucgagcucuuugcuuuuuaagcauagaucaucuacucuuuuaauuuagaaaaaaaaugcucuggugaaaauauuuuguuuuuaaaauugaacccaaguaaauuaguuuggggaaguacuggauuugcuauuacuugccaaguacauuccggguacaugcuagcauguuucuaagugagagaaagccagcaguuguuucuagggcucuuuauuuuuguuauuauuaagauaaucgagugugccuugaaggagcugauaaaaauuuuaacuuccuuugucuuaugaggacuuaguaucccccuuaccccagagaugucucucuguagcugagagugccuugaauauuggaucccccaguuucuaccucucucuacuauaaauaaauaaagaaauaccccucuacuauauauauaaauagaauuguaauacaauaauacacaauuacagaugugugccacugugccuggcuuuauaugauguuggggaucugaucuugggcuuugagcauggugggcaagcagucuacacauagagcuagaucccuagccuguggauuucuaaauguccauguauuucuaaacaucugucuuuuccaaguuuuuccuguaaauucugucaguuucuucuuuuuccucuguuuuguuuuguguuugagacagaguuaaagacccucucccuuccccuccugagugcuaggauuucagcuuuguagcaccguacuucagugcucuuuuuauucauguaucaauagggcuggauaauuuuacauuauuauuauuaaauacauuucugaugccaggagcuguaagagcugcuuuccauuugcucaguuauuucucugccccucccccuccccccagagaauccacacaaaaacccuaagcaguaguuaaggguuuuuguuuguuugguugguuggguuguuuuguuuuguuuugagucaggguuucucuguauagcccuggcuguccuagaucuuacucuguagaucagguuggccucugaacucagagauccacuugccucugccuccccagcacugggauuaaagaugugaguuuuauucccacguugcauaugaggggaugaagucacaaauuucacaacuaguaauauaguuaggaucugaacgcaggcauuugcuucugaaacauuugcuuuaacuugucagauguucuccugugacagcgugcugucuaugcuagugagcccuggggguaucgagaaguacuaaugugcaggguuagccucagacuucucucugugcuugucugcucaguuguagauaccaauagcauuggugcaaauaguguagagaccaauagcauucuaacuguuugcauaauuaguggcaucuuuagucagaaugaugggauuucauucuacaaaaccauacuuagauuauuugguugauuucuuaauuuuucuaucuguaaugugaacauauaaaaagaauuauauuaaaauguuuuuucuucuccuuguuuauaaucaauauucacuauauaaaauuuggaagagguauaagaguaaugugaagaaaauaaaaauuacccugggucacagucuagauuuaacuacaauuaguauuuggauguauuuuucagagcauuuucugugcauaugaaaacguauuuauaugucauuggcaucauuauauauuuaauucagccuucuuuuuuucccauguaacccugaaucaugugcacccuuguuugugaagucucaaauguguuuuagaucuauuuuugucaucuaucuuagauuauuaaacuaaaucaaaguuuguagcacuggaccuuaaaaucucaucagucugguaugugagguugaggccaagccagcagccagggcacugauguuuggauuguaggcaguugguaacaugaauguaagcugggagagcuaaauagaguaaguagguuuugacugguuugguugggaucaaguuguaaaaauggggucagaagccugaugaauuaaguagcuaccuaggcuggcucuggggaugggcuugguugccuuaaggcagguaguauaucaugcagaaaccaugguuugaagauuuauaugggaauuugccugcauguguguugugcacuaacuacuuguaugcaugccaagauaggauugauccccuggaacuggaguugcagauggcugugagcugucauguggcuguugagaauugaaccuggguccuuugaaagaucuguagccuguacucuuaaccuuugcuccaucucccagcuccaugaacagugauaguguuuucuguguuuucuugagcagguuguguuagggucaguguuuugguucugagauaaauccguguugauuggcauugguggcucuguauuuauacuggugucaaucucugcacuuagcaguauuuacugcaggcauaaugacuucauacagacuuagauaaucgacuuggagugaugagcugguucauugcuuucauggucugggacagaguauguuguaguuaaauuagguggcucagcaguugaagugcuuacuguguaaacaggaggacuacuguugggaucccuagaacccauguaaaugcuaggagagcauggggacgugcuccuaaaucuaccuucagaaggucaaggugggcucccaggagcacgcugguuagaaauguuaggaagacucaccaaggaagauucuccacaucaaccuuggguuuccauagguaccaccccacauggacaccaccuacacacauguagacauucauauacaugcacgccuaccacauacauauacagaaacacaggaaaaaauggaucuggcuauuccuacagaagaugugaaaaugagcuaggauaaucugggaguguuuagaggagauguaacuuacauuucuuauggaugggugggcauucucaaauggaaaaccacuuuaaucuaugucuaaaauuagaugugggcuucugacaugauuaacaaaugccuggcugggaagcccagcaaccuaguuagcucccuggagcccacaguggaaggagagaaccgacuccugaaagcuguucucugagugccauaugugugcacacguguguacucauacacuuuguccucccacaggguggggcuggugggguacaaccuacuguuguuucagguuucugaaaauuaggacauuguguuuuggaauggaaauuucuguaacauaauugcuguucgugguauuggagcaugaguaauaucggugagugcugauuuuguaauugauuuuuucgguguggaaccagaugagcccauggauaugucagugauaccuguaggaggggagccuuuccagaagcuucaugaugacgaagcaauggagacagaaaaaccccuucucccgucucagccugcugugucaccgcaagcaucaacaccagugucucggagcacgccaguuuucacuccuggcucucuucccaucccgucccagcccgaguucucucaugugaguuuugcaggaagacuucccaucuccugcugcuuuuccuuuccucccuucuuucuuccuuccuuccuuucuuucuuucuuucuuucuuucuuucuuucuuucuuucuuucuuucuuuuugauugauugauugauugauugauugauugauugauugauugauugugguuuuagcccuggcuguccuggaacucacuuuguagaccaggcuggccucgaacucagaaauccgccugccucugucucccaagugcuggauuaaaggcgugugccaccacacccggcuuuuccuucccuucuuacuuugugggucagggauauauagauucuaggcaagugauuugccacagaacuacauaucuagaccaaucuuuaaaagguauucuaagccagguggugggggcagcacucgccuuuaauccuagcauuugggaggcagagacaugaacccugugaguuugagaccaaccuaucuauauaggggcagccagggcuacacagagaaacucugucuccaaaaaaccaaaaagaaaagaauuauauuuauugggcaugcauguaugugugucauguauguccuugcauguguagauggagguuagaggauggcuuugggcaucaggucuacaccucaccuuugcuugcuggcuuguuugguuuaggucagugguuuucaaccuuucuaaugcugcaaaccauaaauacaguuccucauguuguaaugaccccugaccauaaauuuuuuuccauuucuauuucaugacaguaaauuugcuguuaugaauuuuaauguuaaauaccugauaugugacccugugaaaggaucauuugacccccaaagggaucacaacccauagguugagaaccacuacucuaguuccucaggcugguuggggacauuuccuaagagccuuuuuuaacccucuugcucauuuuauaguuugaauguuguggaauuauagauugggaauacuuacccuuaaagguuuggaagacauuucgcuguugucuuggaauuucuggugcuucuauugaguagcacuaagccacucugaucuuguuuggguccugugacuuuuuuuuuccucgagacaggguuucucuguguagcccuggcuguccuggaacucauucuguagaccaggcuggccucgaacucagaaauccgccugccucugccucccaaaugcuaggauuaaaggcaugcgccaccgcgccugguuuuuuuguuuguuuguuugugacuuacuuuuuguuacuguaaucucacaggauuuucucuuugucucccaguguuuguacucugaacccucagaugucuggauugugucaaguugacagcugagcagauuaugacagcaugauuucaggguucaucuguguuacuucauggagcaaaauuugagaugauuuuauuguaacugauacuguuuguguguauaugacauuuacgcuuuaguucgucagaugaccauugcaguucuuucucuucuguugucugugagucaugcugccaagguugauguacaggcuugugaaaggguguguuuuguuucccuuauguaaaguguaggugcaauugcugagcuuuaccaucuauuuuacuccucugaauuacuaauuucuaugccuuuguuuuuaauucuugaagucuuuuuuuucucugaauauuuuugucuuaagucuauguuucucuuuaauaauauuuuuuuggcaaguuuucucuuccccaugagucacuauucucaguagccuuucauagugucuuuauuuaaguggugccaggggcuuguauccagagccuuaaacaugaugagcaaaugcucaguuacugagcaccuguucuuauuuguugauuuuugagacugagucuugcuuuguaacccaugcuagccuucuacuugucaucuuccagccuugguuugcuagcuguuaggauuacaggcaugugucaccauaccaguguugggagucagaccaacugggugggcgaaugaaguggauauacugcuuuaaccacacuguuuuuuccuuuuuuuuuuuuuuuuuuuuuuuugagguaggaucacauaguaguaacugaggaugacauagaacuucugaucaucuugccucuaccuccugagugguggaauguuguuuuuuguuuuuguuuuuguuuuuucccgaagaauguguucuucaucacacaguuuugcugaaucucaucucuucucuucuccccuccccuccccuccccuccccuccccuccccuccccuccccuccccuccccuccccuccccucuucucuucuuuccuuuucuuuucuuuagauuuauuuauuuuaugugaguacacuguagcugucuucagaaacaacagaagggcgucagaucucauuauggauggcugugagccaucaugugguugcugggauuugaacucaggaccuuuggaagagcagucagugcucuuaaccacugagccaucucucuagcccaggcuuuuuuuuuuaauuagauauuuucuuuauuuacauuucaaauuuuauccccuuuacccauuucucuucugaaaacccccauauuccauucccccucccccugcucacuaacccacccacuccugcuucccuguccuggcauucccuuacacugggacaugagcauucucauugaugacagacuaggccauccucuucuacauaugcagcugaagccuugagucucuccuucuguacucuuugguuggugguuuacccugggguacugguugguucauauuguuguuccucuuacggggcugcaaaccccuucagcuccuuggguccuuucucuagcuccuccauuggggauccggugcucaguucaauggauggcuaugagccuccacuucuggcagagccacucaggagacaacuauaucaggcucuuuuuuuuuuaagauuuauuuauuuauuuacuauauguaaguacacugcagcugucuucagacacucuggaagcuggcaucagaucucauuacagaugguugagccaccaugugguugcugggauuugaacucaggaccuuuggaagagcagucagugcucuuaaccacugagccaucucuccagcccuauaucaggcucuugucagcaaguacuuguuggcauccacaguaaugucuggguuugcuaacuguauauggguugaugaaugucagaauccugauuaucuuggguugguccgaucccuaggaaagucuaaucuccugcuagcuggguacagggcugguugcuauuguacagaaguccuuuaaaggaaagagguuugaaaugaaagucaugagacaccgggguagguuucccucaguauguaggguuucucgaaucccucuagcuucaggauggugcgcucaucuccuguccuccuauccagggcuuuguguuuuauuuucuccuggguagaggaaggacagggaaagaggauaugggaguugaacugcuucuuaaauagacuuccaggcaguccuccuguuuuuagcagcaaccucaccaucacuuuuaaaauugucugaucuuguugccaaguccuaaguccuuuuggggggggggacgugggaguagugugguguuaucacccugguaacuucuuggccuucuuuuguuuggccuaacaauuaccuuucacuugucugucaaguggauugccacacacacacacacacacacacauauacacacauacauauauauaaguguguauguauguauguauguauaugugcauugcauguguguauauauauaugugugugugugugcaugcaugaauaugaauauauauguauauauucauauauguguguguguguguauuucuuuuuugagaauuauauaugcuagaaaacgugcuuuaccauugcuuagcaggguuucagaaauaaaguagauguugacucuaccauucuaauuugugaguucccuaaauuuuucauuaugugucaaauuccuaaauuuuuuugaauuuuuauuuauuuuauauauaugaguacacuguaguugucuucagaccagaagaaagagggcaccagaucucauuauaaaugguugugagccaccauguggcugcugggauuugaacucaggaccucuggaagagcagagaggugcucuucugaaccaucucuauaacccccuaauuuuuuuuuuuuuuuuuaugagcauacuguagcugccuucgaccagaaggcauuggaucccuuuacagaugguugugagucaccaugugguugcuaggaauugaacucucucuggaagaguagucagugcucuuaaccgcugagccaucuuuccagccccgccuacagguuauuuuuaaagaugaaaagagagagcugacuugugaggaucauuccgaccaccacaugugcuaugguacagauagauggucauaugcauguacuaugucuguacacacaugcagcaauaagaaauuaaaaauaaacaauaaaacaugucaauuuaaagcaaagcauggcagcacaugucuguaaauauagcacuggaugguagaggcaggacggcagguauucagagucagccugggcuacaugagauccuauuuuaacacucacccuauucccaucccucaaaaaaaauaaaaacauaaauaaaaaagaaagaaagaaacagcaauuguggcagcaggauggcuuguugacagugguauuugccucaaaagccugauaaccugaguuugaucaccaggccaacaaugaagaaaggauugacucuuaaaaguuaaccucugauuuccaaaaaguauuucuuuggaagacucucucucucucucuucucucacacacacacacacacacacacacacacacacacacacacguuuguuauuacuacuacuacuacuacuacuuuauuuauuuugagacaaguucuuugguugguugguugguugguugguuuuuugagacaggguuucucuguguagcccuggcuguccuggaacucacucuguagaccaggcuggccuggaacucagaaauccaccuaucucugcucccaagugcugggauuaaaggcgugugccaccaugcccggcuugagacaaguucuugcuguauauccuuggcuguccuggaucucacuauguagacuaagcugguccuaaacucauagagauccuuuugucuuuccuuccaaaugcugagauuaaagguguaugccuuagcauagugugcauggguguguguauuaauacauuguagcccuagaugguuuagaacucacuguagaucaagcuggccuggaauuuacaucaaucugccuacauccaccuuccaagcgcugggauuacuagaauguuuguuccaaggugcccagggcuuuguguagguuuuuuguuguugcucuuuuauuuuuucgagacagggucuugcuguguauuccuggauggcauggaauuuucuauguagaccucaaaacucaaagauugauuccucugccucagccucaggagugcugagccagcuuuguguauguuaggcgagcacuccaccaaauucuggagccguguguguaaucaggaggugcuaccugcuguggcuauaugucuugcuuuuuccuggcagugugugaggauuacagguguuccaugaaguuauugcuguuugguuuugugaguguuuagaaccuuaaucauuuuauggcuugcucugucugucugucuuucucucucuuguucucccucucucccccucccucucucucucucucccccucccucccucucucucucccccucccucccucccucucucucucucucucuacucucccucucuccuucucucuuucccucucucuccucucucccccucucccuuccccccucucucucuucucucucccucucucuccucccucucucucucccucucucuccucccucucucucucccucucuuucuccucucucucucucucuuuuucucucucucuuucgacaggguuuuuuucuuugugaaacccuggcuguccuggaacucacucuguagauucaggcuguccucaaacucucagagauccugccugccuuugccuccugagugcugggacuaaaggcguacgcuaccauugccugacuuauugugguuuuaauuacauuucucugcugacuaaugaucuucuaucuuuacauuuuuaaaaaauuauuuauuuuuacuuugugugcauugguauuuuggcugcagguacaucuugugagguuguuggauccccugaaguuggaguuagagacaguugugagcugccauauaggugcugacaaaugagccuaaguugucuggaagagcagccaguguuuuuaaccacucuuuagucaucucuucagcccuguaucuuugcauuuuaacaucugcuuuaugauguuucacaguggugcagugaagcaggaugaguucacagucauccuuugugaaauuagagauggcucugcaagcguaugucgggucuauuauauaguacaggcagaauuuuaauagugugaugaugaaguuaaauuuggaucuuccuguacuugauaaguuaguacuguuaguacuuuuaggguuuuguuuuggauuaugcuuauucuuuuuuuguuuuuuguuuuuuguuuuuuuuguuuuuuguuuuuuuuuuuuucgagacaggguuucucuguauaaccuuggcuguccuggaacucacucuguagaccaggcuggccuugaacacagaaauccgccugccucugccucccaagugcugggauuaaaggcgugugccaccauugcccaguuaugguuauucuuuaguagggauuuuauaagaaaaacacugaacagagugacuuauguaguugaaggcauguuuguaauguuuggaguucuggaauuacaguucuagcuagaguucuuuaauuuuugauuaauugguuuacaaaugaugaauucaagguuuagcaauaaaagaaacuugauauggacagcugauagcuugauucuuuucauucuuccuuaggacauuuucauuccaucaccaagucuggaagaaccaucagaugaugugaagaaagguggagguuuacauagcucaucucuuacuguugaguguuccaagacuucagagagugaaccaaagaauuucacugaugaccuugggcucuccaugacaggggauucuugcaaacugaugcuuucuacaagugaguauagucaguccucaaagauggagagcuuggguucucccaggacugaggaagacagagagaacacacagauugacgauacugaaccuuugucuccaguuagcaauucuaaacuuccugcugacagugagaauguccuggugacuccaucgcaggacgaccagguagaaaugagucagaauguagauaaagcaaaagaggaugaaacggaggacagaggugacuguaaaggcagagaagacgcgguugcugaagauguuugcaucgaccucacuugugauucugggagucaggcaguuccuucuccagcuacccguucggaggcacuuuccagugucuuagaucaggaggaagcuauggacacuaaagaacaccauccagaggaaggguuuucgggaucugaaguagaagaagucccugagacucccuguggaagucacagagaggagcccaaagaagaaccgauggaaaguaucccacugcaccuuucucugacugaaacccagucugaggcauugugucugcagaaggaagcccccaaagaggaaugcccagaagcuauggaaguugaaaccagugugauuaguauugacuccccccagaaacugcaaguacuugaccaggaauuagagcauaaggacccagacaccugggaagaagcuacuucugaggacuccaguguuguuaucguugaugugaaggagcccucuccucgagcugauguuuccugugaaccuuuggaggagguggagaaaugcucugacucccaguccugggaggguguggcuccagaggaagaaccaugugcugagaauagauuagauacuccagaagaaaagcguauagaaugugauggagauucaaaagcagagaccacagaaaaggacgcuguaacagaagacucuccacaaccuccuuugccuucagugagagacgaaccugucagacccgaucaggagacacagcagccccaaguucaagagaaagagagcccagugacuguagaugcagaaguggcugaugacaagcagcugggaccagagggcgcaugccagcagcuugagaaggccccugccugugccucacagaguuucugugaaaguucuaguggugaguggaaguggguuucauuuggugcuauccagcuagguuccgauuuggaaagggaggaggagagcccacauacugucaggacucaggguuaacuugaaggaacaguauuugggaaaauuugagauuaggguucuaguuuucuuucguggucguaauuauuuguaugacuagagaucacuugagguuuaugagcaccauaguucaggaguagucaacacaucgaauuagggauugcacagguuacuuucuucugcuuaccuagguccuacgccuacgccugaaguccccaccccacucaugugaacuaggcaggugccaccagugaguuguccaucugucugucugucugucuguccgucuaucuaucuaucucuugucuuuuuggguucaagguuucauuuuuaugguccagacuggucucacauuuucuuuuuuccugauauuuaacaacuuuauuuuaaaacaauauuuuaaauuuauuuucugauacauuuguucaguauauuuugauuauaucuaucuacuauuacuucccuccaaaugccuccuggugcuucugacccaucacccuuaccacuucauguucuccuuuuauuggcuuguuauuaaaacucagccuccugugucugaccagugcuguucauugugcacggcuuugaggccguucucugggguauggguaaccuuccaguagcuauagcugcaaaggagcccucccccuuagcaucgucaacugcuaauagccucuuccccauuugugcuagaauuuugccuggcucgaucugugcagguccaguggaggaaguccuaggggcugugcauugcugugugcagcaaccaugccaugcccggaucagcguuucccagcucugcccucauccaccaacucucacucuuugugccuguucuucugcaaaguccucuaagcuguaauggaggcgauucauccucagcugagugagcacucauggccacuucuacuuguaacuugguagauaggagucucuguaguaacugcuguccgcugcagaaagaagcuuuucugaccaaaguugagagcaacguaagucuguagguauaaacauaaguauuuagaaggcagguugacaguuugacuauccaacauaacagcaguuaucccagccguggccguugaccucccuggcucuggcuugugacaggguuuggaguaccacguucuccugucucuguaucucagacccugagauuguaggugugugucaccuuacagugccuggcaggaauaccuuuuagcuauuuuuuuaauuguuguguguagaagaauacucuaaaauauugagauauuaguuguuaugguaauaguauucuuuaugaauuaacagauuauucuguuaguuggcagaacaaacuauuuuuuucucauagacucuuauuaaaauuuaauuuacuaauauucauuuggauuucuuuccuucccgcuucccucucuguucaccuuucugcccuguccuuccucuccccaacuccuccacgcccuuucacaucccccuucccuccuccaucuucuccccuccucccuuuccucuuuccucuucuuuccuuugacuucuccuuccugcuuccuuucucucauucucuuugcuuuuccuuuuccccucccuuucucauuuugucaagaaguacagcagcagcaggggaguauccugaaaacggguuccuuccuuuucuucuuuagaagugauuuucuuuuaggguuuggggaugcaguuugaugaucuugguuucaguaucugaaaaaaguuauuuuaugugauuuuaaggccagccugguuuauagggaauuccaagacagccagggcuacacagagaaaccuugucuugaaaagcaacaacaguaacaacaacaaaaacaaaacaaaugagaggaauuaaaaauggugucuggggggauggaucagugguugagaaugcuuacuguuguucuuccagagaaucaaaguuugguugccagcaccgacuuugggccacucaaaauuccuguaacuccaccuucaggggaucugguacgcucuucuggcuuccauagguaccagaccgugcacauagugcacagacaugaggcacaguacacauacacauaaaaauaaauaaaacaagauguacguauuuuaguuaaggcuaggccugauuaguuuugccacugucuaugacaaagccucuagagcuaagacugcccaguguccagcucaagagaaacaauagcucugccagucuuagggugacuggacucuauaccuacgccugggcacaagaauuaaaaauaaauacugguuaaaaaaagaaaaguuuuauuuagaaauuaggacaugaagaauaauaguuucugagucagagaauuagucuaaaagaagaauguuauuaaaagaaaaguuauuauauguuuaaaauauaguucauggguuggagguguagcuccuuuuuagggaacuugcuucaauuuccuaaggucuagguuugauccugucuuaguuaggguuuccauugcugugaagagauaccaugacgaaggcaacucuuagaaagaaaaacauuucacugggacuggcuuacaguuucagagguucaguccguuaucaucauggugggaagcauagcagcaugcaggcagauauggugcuagagaaaaccagagaguucuacaucuggauccucaggcacccagaagagacuguucaucaggcugccaggaggagacuggaauucuacacuaggcagagcuuaagccugggagaccucaaagcccacccccacagugacacacccccuccaacaaggccacaccuccuaguaguuccccucccugugggccaagcauucaaacccaugagucugugagggccaaaccuauucaaaccaccacagauucccucacugcaaaaacaaguaguagcacaggauacaauuguuuaguuccuaauaaguaggaggauuaaaaaagaggaauguggagaggugaugauuguuccguuuaaaaagaaugagggcuagggauguaguucguuugguagagccugcccagcaugaugaagcccuggguucuguuuccagcacugaaauuuggugugguggcuacaccuguaaucauagcaucuaggagguggacacaggaagaucagaaagccaacgccauccuuggcuacagagguaguuugagucuagcuugggccacaugaaacucugucucaaaaauuaaauaaugggcugaugagaugguucacuggguaaaaggugccuacauccaagccuaacgaucugaauuccauuccagggacccacuggagagcacugacuuccuagacauuauucucugcccuccacauggugugccauggcacacucaaggcaaccccuuccccccaguuaugcacauuaaauacauaaaugaaaugaauuauaagauuuuaauaaagcaagcaagugagugagccauccuggacuacugagagcuugucucaaaaauaaacacacaaacaaacagaauaagagguaucaagugggugaguuggcugggguggagcuuaguguuagaguacuugaccaguauauuuaagacacggguguuugaugucuagcacugcaaaacaugcaagcuuuuguuuguuuguuuguuuuuuugagacugggucucucuauguaguucuggcucuccuggaauucacuauguaaacuaggcuggccuugaacucaguucauuagauuucuuaccaaaauuaggauacuuauuuuuucauuuaaauauauuuucuuuauuucuuuuuuucuguuuccucuccccauccaugaguguguguguuugugagugugugugagagagagagagagcaagagagagagagagagagagagagagagagugugugugugugugugugugugugugugugugugugugugugugugagagagagagagagagguucucucuguagccuccaaagcagcucugcucuuggcaucaguuacagaucuguccaccuggcuuguagacuuuuuguuguuuuuaaaaaacagaaacagggucucuucuagcccagccuggcuugaacuuuauguagcugaggcuggcacuggccuuuugguccugucccuacuucccaaugcugauacugcugugugcauugaguaguucaugugccaggugagcacuugaccucugaguuacagcccagcccugacaguuugauugauuuaaagacaaaaccaaaaccaugcugaaguauuaaaaacacucaaguuguucaagagagggaaagaagccagucuaaauaccuccacugaugguuucuggccaccacugacaguuuggcagcaucuucacacgccugccaguggaggaugucucuaacaaggugguacuggaaagcugcucagcugacaacaggcuccuacagcugaugauggaaaagccuuaacuacauucuuuuuauuuuuguuuuuuguuuuccuuuuugagacagagucucauuauuuaggucugguugguccauuacuuaacucuguagcccaggcuagccuugaacuuaggacaaucuuuacaccuaagcuuccugagugcugggauaacagcauaccuuaucuuuuugguuagauggcuuuucaucaauuguaagaagugaacaguucuuucaaguacacaugaagaccguugcugcuuuacagcauagcaguuuaggagagaucuuccuuguauugaguuuuuuaagacagagcuuuugaauuucagcccaguuaugccucacuagcccucuucuguucuugagagugcuuuucucuucuuuaauaaguugucucuguuucugucauuuaugaaauucucaggaaaaaaaugaaaaacuuuaagacuaauuggaaaaauuuuuuagaguggguguggcggcucagacccauagcuagcacuugggaaacagagacaggaggaucaaugcauguugaaagucaucuuggggugugguggcgcacgccuuuaaucccagcacaggcggguggauuucugaguucgaggccagccuggucuacagaguaaguuccaggaaagccaggguuauacagagaaacccugucucgaaaaaccaaaaagaaagaaagaaagaaggaaggaaaggaaggaaggaaggaaggaaggaagucagucagucagucagucagucagucagucauccugauuuauguacugaguuacaggccaggaugggcugccuuugaaaccuaaccucaaucccccuccuaaucauaaagcguuuuaaguaaugaguccugugaauuuuuuaguagugagaccaauuuuuauacacagguguuuugauaauugguguuguuuucuuuuaucuuuuuauuguaucuucauugauaugcugacaugcaauaggguaaccuaugauaaucuaguaaagaagaaaagauuugauaauuuaaaagaugagcuaaauaugagagaacugaaauguguaaaauugugguuaacuuaaaaggauagaauaugacaaguguuuuacagaagucggugauagucugacuguauuaaugaugauucagauggcugguaagcacagagaaauggaaaagcauugggggggccauugaacaugaaugauuagggaucauuaagaaagacacuggaaacaguuaagugcaugcugauugaagaguuaggauuuacuuuuuuuagguuuauuuuaugugugugagugcauguaugugcaccaugugugugccugguacucacugaagucagaggucaucagaucccuagagcugggguuauggaugguuauaagccaccauguuuguucuuggaauaaaaucugaguucuuugcaagguccucuuaacugcugagccaugccucuagcccaaagaguuaggacuuuuucuuguguugguugguaggcuguauaguccaaggacagggacauugaagacuggacagaggccuggaaaacgcuucaacucucucucuuaaguuauauugaugaaaucagauguuuguaaacuaucuguaauaagguuuaccuaguauugugcaaagcaaucuugcaccaagaagcaacaacaguuuccacuaauaaaugcuuacauguuacgcgugcauguucauuugucugccuccuucugcccuuuaugugcugggagugaaggugugagcugccacaccuggcuaaaauguacuuuuaagucuucagaaauauguaguguuuguaguaauuuaauagcacccaacuacaugugcacucuugggacgcuccuucuuagggauucaccaggaggcagaagcugcgugcugccacucugcucaccaucuagaaugugugcuguucagcacagcugaaggaaagccucugauuggcuguuagaaucggugaccaguuugaaguccuuuuugaccuaugagauucuuugucaccuuccagagaggaccauaugucaggcuuugcuuuggaagucuaggagaacgcaaugcugggcagcacuucccaaaugaugccugucuagacacagcaguguccagcucuguguugcuagguguaucuacaugcaguauuuuggaagcagaugaugacuuagcguugcucaguccucuuuccuuuugugccccuguugguguccuuuuuaucagcgcugcuauugauggcuaagaccugcugucuuucuagcagcagggaccugguuuggauggcugugaagcugauaggacuaagaaacugggaaaggagcaacuggaauuuuuuuuuuuuguaguuucucauuuuuguguaauguacacuucuaugugguuuguguuuuuuucaauuguguuuucauuuuuguuuguuuguuuauuucagaaacuccauuucauuucacuuugccuaaagaaggugauauuaucccaccauugacuggcgcaaccccaccucuuauugggcaccuaaaauuggagcccaagagacauaguacuccuauuggugagugauuaaaaacaaagauauuuaaggcauuaaaauaaaagcuaccuaaagcccuucuaagauaccauucuucaugcaaguggaacuuuucugucugaggaguuggccugacugagagggcugauguuugguguggagcagcaggguuugaccucacugccaagagaugagaggaguugagaugauggagagagaagguggagggaaggagggaagagcgucaagucugucuuaucacugguugaacuggaacuaugcugagauaugcaacuguuuugcaagaagagacaaggaguauggagaagugcugugcucagugugcuugccugaucaggcugcagcugcauagggcaagaaaacuuagguccuccguccuuggagcagcggguggaugucuacauuaaccuauuuguuuucucuagucagugcugggagguaacagucaugccgccuggagucuccuguuuucguaugccugaugcuggcagauguggguuggcugagggcucaugcagcauccuuuguccagaugcagaaguggaacugaauccucuuaagaccaggugucaauacuaguugguaguuguugauucuuauaacaggaucuauccuagggacccucuuuaaucuugcagagugguggagccagacagcaaauugaucauuucaaguugcuguuuuucauguuuguauuuuaguguucuuucuuucuuccucccugcccccuuucuuucagggauuagcaacuauccagaaagcaccauagcaaccagugaugucacaucugaaagcaugguggagaucaaugauccucuacuugggaaugaaaaaggggauucugagucugccccagaaauggauggaaaacugucucugaaaaugaaacugguuaguccugagacagaggccagugaagaaucuuugcaauuuagccuggaaaguaaguuuuauguuuguauuugguaauuaguuacuccagguuauccacaucaggggggguuacaaaugacuguggauacaccaccucuguggcacccacacgaacaaguacauauccuacccccauacacauaauuuaaauaaaagagucuagaguagaaaauguaggauuugcacuauaaacuuauguggacacuuccagguaaacgcaagauguuugguuagaauaaaaagagggggcuggugagauggcucaguggguuagagcacccgacugcucuuccgaagguccagaguucaaaucccagcaaccacaugguggcucacaaccauccguaacgagaucugacucccucuucuggugugucugaagacagcuacaauguacuuacauauaauaaauaaauaaaucuuuaaaaaaaaaaaaaaaagaauaaaaagaggaugugagaugcccuggaacugguguuacagaugguuguguguugccaugugggugcuggaagcaaaucuggguccugggaaggaauaggugcucuuaauugcugaaacucuccaggcaccucucccagccccagaauaauuuuuacaaaauugcagugucaggugguaggagcugagguauaguaggauaagucagacauugcuaguuugaagaguaugggcuggugccuagcaacgugaggccuuagugugggccagagagaagacaacucugcauguaucucauccuugugcuguuugcucaaggcugccaauugucugaagucuucucucuggaguaagcugaagccucgggucgugguguuggagcucacugagaagccgguucuggacauggagucacccccuccccuagagcagauccacacauguuuguuauugucuuccaaaacucccuguccuacuugggaggcagaggcaggcagaucuuugaguucaaaggucaaccugaucuacagaguaaguuucaggacagccagggcuuauagaaagacccuuucucaaagcaaacaaacaaacaagcaaaacccaaaaaacccuguccuggggcaggcugcauccuaaguauguaaaagggagagagcauuagacaguuaaggguguuaacagacauugcagccuuagaaauagcugcaaggcgagguuaccauugcucaucccaucaucaaaguccugcaguggaaagaagaagcaaguuugucauggagagagugcugugcucugucuggguggucucaguggaugccuuagucaccugcuucuguggggcucucccaguuuaugucugcuggguguguucuguaccugacugggugguguuuuucuaucugcugcuagucacuguuucuuuuuauuuuucuugcuguauacuuaguaagcucacucauuugaaacugaagaugugacuguuauagaucaguccccagaccaguuggaacacagggcuuauuuauuugaaccuagaaugucaaugggaaugacaguauuacaugauuucacccuuauuguuauuuuggggaugaaauaagagcuuacccagagagagucuugagaaaggggcugguguuggccuacaacaccucaaguucucagcacaaaggagacuuacuucccccagagagacaauggacaaguaauaagagacaaaggauggggugaagagaagaaaaaggaauguuugucuccauggggacaaaggacugucucuggauagagaggagacagacuggcccuuaggcaagugguggucuauaaaaguaaaaggagaaaccccuuguuaggauaugguguuuaauuuuaacugggcauguuaggugagccaaagaggguuuuugauuucuggacuucaauauuuuaauagccagaccuuaguagucagccucaggaggaggagguagccggauuagggaguagaucuugguggcuagcuuuaggaauggaaucuaaugguuuuuagcauggaagggaggacaggggagaagggcauggccagagccaugguugccaagccuggacuggcuagggugucuucaauaugcugauggugguaguugggagucuggaauaggaggaccucaaauucaaggccauccugagcugagaaaauggagguaggagggggagagaggugagggucauguuagcacugaauucaacuugaccuuuagauggaaauuguaccuagagacgagaaggagccaaacuaaggucugucagucacagugauacauaguacuccccucuccuuuauuuauuuguuuguuuguuuuucuacaaggaagguaauaucaaucucuggggcucacaaauucauugacuuaauuucacccucacagcaguuuaccccuacuaccguuucccaugguauuuuaccccuaggcugguugacgaagcucagguccagccaccuuucuguuccugaacaggagggcucuagcuacugaacucugcugccuccuugauagaugguugagcauauguugagucuugagugcuuugugaauaucugaaacacuuaagaacuguguuuuucugagacuggaauaaauugcggaugaaaugaacacaauuuaaucccuugacacuuagugacacgguuaugaaaauacuguguucucuuagcuuugcacuuacaguauuguugcugacucuucugugggaaguguccuuucaaauaucuguccuuaaaacauuuuuuaaagugaauuuauguguaugaguuuuacguguguguguguguguguguguguguguguguguguguguguguguguguguguguaauguuuaugcguagaaccuaugaaguucagaagaauccuuuagggcuggaguuacagaugguugugagccaccaugugggugcugggaacugacugaacccagguaguccccaagagcaacaaguuggguaaagccuugggugccuucuacaugaguguuucuaaaaugaaucauuuauauauuaauuuauauauuaacuuauuuuccuauauguuuauuuauuuugacauaguuucuuuauauggcucagacuguucuaaaauuauuguguagcacagauuagccuugaacuuaagcgucccaaaauguugauauuacaaggguguguuuuacuucaccuggcuugccauguaguuuauucagguuuuuuguuuguuucuuuuuuaaauaaaguguuagcucaacauggugaugcacaccuuuaaucccagcacuugggaagcggaggcaggugggucucugugacuuugagaccaaccuggccuacauagacccugucucaaaaaagguuuuuuuuuuuuuuuuuuuuuuuaaguuuaugaauauuuuuaaaagguugauuuauguacuuuauguauaugaguguuuugucugccuguacauuugcacacuagaagagggcaucagaucccauggggcuacaguuauagaugguugugagcuaccaugugggugcugggaauugaacccaggaccucuacaagagcaggcaguacuauuaacugcugagccaucucuccuuucccuaaccccaccauuuuuagguuuucucuuguauuuucucaugugaauuuuaaauuucuuguaugggaaggugagucauaauucagaugguucaguuuucacugacauauuauagauuguaguucuggcaaaguacauacguuuucuauaggaaaucugaaaugaaauaaaacgguugagaugaguuagccugugcugcugugcaugucuauucuguuggccuuuagcucuucuuguuuccuuguuuguauuucuguuguugcugguguggcaagcaggcagaggcauuagacuuggggugacugaugucugcuuuucuuuccuuucucucacugcuuuuguuuuuguucagagccuacaacugcugagagaaaaaauggaucuacugccauugcagagccuguugccagguaaccagggcuuguuguuauuuagagaaguuuaaugcaaaggugcugcauaaagagaggaacacacuaaaacacucaaagcccagcauaaagaauucugcaguguuuugaauuacaggcuuccucgguaauuuuaaauauaacaaacguuuguuauucuuacuguuagaauaccuacuaguuuuccugccauucaaguucuuacuguuagaaucuaaguacuuguuuucccaccauucaagccuuuucuuuuucuguugaugaccaaggugggggaaacaaagggccaaaggagaugguucuagauacacuguccugggcucugugcucagcugcagccucaggacauucugccuuuucuugccaaauuucuugccaacugcuaugcugaguuguuuuugcuuugucaggaaugcugcaaagccuugagugaaguaugcugggauaugagguuuuggugcugaggcucugccaucuggcgguugggagaauaggcuucuugguuucuggugugagucaucccagugggaaaacccaagccaguuggugacauacaggugauggcucuaaggccagcacaggcaggcacugugaguaaagccaauuggaugugagagugcgcagggcugaagauggcagccacaccugugcuccauucacaguucuuugucucugccaguggcugucaauuuuuagugagcuagcugggcucgagcccaguugucaugcuugccuaagugaggacugucguucagccccuacuaugacaaauaagugaugcuuuaaaaagaaaggauucaagcuuauuauugccaaaucuuuaaaaauuugaagagaauuuuaaauuuuuuaaaaaacauaaagugccuacugacuauaaaugacccucuuugugccuucugaacuguuggggagaauauagggagggacgaugaggaaaaaguaaaggauggcggguuaugggaaaagguggaagucauugguauugccacgaagcaguucuuuuuaaauuuaaaaaucuaugcuuaagacuucuguuaauuuuuuugaccuuuggguucauauuaagaaguuauugagccgggcgugguggcucacgccuuuaaucccagcacucaggaggcagaggcaggcggauuucugaguuugaggccagccuggucuacaaagugaguuccaggacagccagggcuauacagagaaacccugucucgaaaaacaaaacaaacaaacaaacaaaaaagaaguuauugaaagaggauggagacuuggcucgguggcuaagagcacuggauguucuucagaggaucuggguucaguucccagaacccacauggcaugcagcucacagcuaucuguaauucccgucccagcggucugaugccuucaucuggccucuuugaguuucaggcauuugugugguacagagacauacauacaggcaaaauaccuguauaccugaaaagguaaaauuaaaaacaaacuauuaguaaaauaagacauuucaaaugagauuuguauuguaaaugguugcugcacucucugcauuuagguaaaguauugcguguccaugaaagaccccuggacucuguucagagcacuugaugccaucuuaguuuuuuagucauuuuacugugggaagacaacaguagagaguaguguaauauggacaaccguauuguaaguggccaguccucuuugauuauaaaaucuuggaguucccccccuuccacuaguggguuauuuugaaggagauucuauuucauaccauuuuauguaauuauuucaagcccuaaaagauaaagacucuuauuuuaaauuaagcaguuguuacuauacuuuugacaacagugauuucuuaaugcuaucaaguauuugguguuaucaagaucccaaaucuaaaaccccauucaauucauauauuuaacuuuguuugcuuuuaaaucaaaauuccucuuuuuuguuccucuuccaaguuaccuucuaaagggacuagauuguucaucuuauuuauuucugauuuuuuucucuuuauauccuuuucgucuuuagagucucuccagugaccucacugaagguuuuuacuguguguuuugccugcaucugugugccuguaccucacaugugccuggugccauggaggccagaagagggugucacacacucuggaacuggaguuacagaugguucugaguugucacgugggugcugggaauggaaccuagggccuuuggaagagcagccagugcucacaacugcagagauaccucuuuaguuccuauacugagagauuuuuauugugcuaauuugaaacauaucaaagaguuggcuuuugggguuuauguagguuggcauuugggaugccaaggaacucuaugucuaaauagagugaucuccagagauacuuuaccauuugaaauucauaagaugcauugcuuuaauguauuauguuagucuccagaagccggugccuguguuuggcugcaucuaugaagcccagcaagagaaggaggcucaaagugaggcuccucccucugcacccgacagguaaacauuuugcuuuucuuuuuuggggaugagguuucauuuuguagcccuggcuggccuugaacuuacagaguucaacuuguugaaguugaacuuaccugccucugccuccugagugcugugauuaaaggcuugugccauacugucugguguauuuucugcagcauugauucauugcauggcugauuccauuucaugguauugauugacacuguugugugaaguuggcuguuuauguauuuuacuugcuaugcugcuagauguuguuuugcccaggcuugcccuagcuucugggcuuaagcauugcucguccguuagcuuccugagcaggugagaccacagcugcaugacuuuguuuguuuaguuuuaucgagauaauauuuuucuguguagcccuggcuauccuggaacuugcucuguagaccggguuggccuugaacucauagaucugaaaggcaucauaucugguuauuuauuuguuuguuuguuuuuuuauauuuauuuuuaaagauaaauauucuuuuguaauuuuauauuauaaaaauuuacuuucauuacaacugaauuuguaauguaaaaugaauuuuguaauucauuuguaauguguucuuuugugugaguauauaugugagaggcugcagugugcucuccauccacuagagcaguaugcacccuuacccccaccccgcacccaccgccccuguuguuucuuugguccuccuucagucuuucagugccucucgcugagccuggagcuccucauguucccaccauuucccuacaagcacagagauuacuaacacaggcuuguuaaccacaccuaaguguuuacaacuacauuuuaguauugaucauuugucaagugcuucuaggagaaugagaaguaccaaauuccugauguuugguaguaaucugcuaacccugccaguauuguaaugagucacugucaccccacccagaacuuuuugagucauggucucacucuggcccuggccuagccuggaacucacuauguagauuaugcugaccucagacagaucuaccucauucuucugggauugaaggagugcuccaccaguccugcccaucacuuuuggucuuuuuuuuguuuuuguuuauuuguuuuuuugagacagguuaucccuggcugucugggaacugacuuuguagaccgagcuggccuugaacucagaaauccuucuccugaaugcugggauuaaaggcgugcgccaccacgcccagcucacuuuuggucuuuaaagaauaacaguucugauuaauucuuuagaaacaggguugggauuggugagggggaaaucuuaauauccuuuuagucuuuuagaaaaaaaaaaucucaaacaaaacauaacuuugcuuuagaaauaaaguuauauccacggccucuacccugaauaaauaguuucugggguguuuuaguuuuuggaccacaauaaggcuggguacaagugcacuuacaguugacagugucaggacaacaguuccuucaucaugugauggcgucccaaagcucucgccucucagugcagcucugugggcuguugggcuuuaugaguuuugcaggcucagcuucauucuguggugugagguaaauguacauaaggauggaaaacaguuguagucuugacauuagcuuuugaguccuggcagccugcauggcagcuuguuugcuuguguguugucuuaaagcuuaagaugaaucuggagguggguuguuucauuauugcuuuguuuugugcagcugggagugcuuaugugucugcugagcucagcacuuucacacuuuaugguaauucauagaucaugaagauuuaacugcuauucauggauuuccuuguaguguguucuguccuugcucuuaguggccugugcauucagccaauguuccugacaaauaggacaugcuccaacaacuaagaugcuccuuuuagguggaaggcuguucaagcccauugccuguuagagcugagugcagagaccugcagaacucacugcccaagcagggcgagcccuaacaaacucugcucaccugggcgacuuagcuuuguuuuucucuggucaaacaacgugacaaucgccaugauuucuaagcuccuuggaucuguucuucagggccaggacauuguagacucaaaauggacuuuuauuugcuuguuuguuuuaaaaagccuuagucuguagcucagacagaccuagaauucaguugugacacccaaggcagcccuugaagguucugcaauccuccugccucagaauuccuaagggcugggauuacaggugugauuaccuggucauuuauuucacuuuuuucugucuauuuacauuugacauagccuugaaaugcauucauuuauguuuauuuaauaugguaguagcguacugauuuuuguaguuuauugauuuauggaauauccauucuuuuguuuaaagugcaaauauuaagcaccuuugucacaguuaacuuuagauaccaacuugauacaaacuuaaggucaccuggaaaggggacucaacucaagaacugcugagauuagguuggucuggggccaugccugugaggcauuuucuuaauuguaaugcauggaggagggccugugggugggaacauuucuaggcaggugggccugagcuguauaaaaaagguggcuuaggcaacccagaggaagcaagccaacagcauuccuccaaggucugccauuaguuccugcccuggcuuuccuugucaguggacuguaaccuguaagccaaacaaagguaacuucauucuaucaagcuuuauguuaagcauuucagauagaaagauaaggcagauuuguguguagccugcuuagagauagucugcauuucuuacucuagagaacucuuagcauguaaagccuccagucauuuuggaagcuauauauauuuggcuuagaggcaguaccuaccuaaugcuuauaugauaaauaagucagaagaggggaccucagcugaggaacugccuccauuagauggccuguaggcaagucugugauucauuguggaagggcccccagcucacaguggguggugcuccuaagcaagugguccuggguucuguaagaaauggggcugagaaagccaaggggagcaagcacuaagcagcauuccuucucaggucuuugcuuugguuucuguuuccaguuucugcuaccaguuccugcccuguuuucccuugauggacgguaauuuguaggccagauaaacucuuuccucccaaguugucucuuuuuuuuuuuuuucuuuugaaaauuuuuuuuuaaagauuugaguacauuuuugcuaucuucagacacaccagaagagggcacaagaucccauuacagauuguugugagccaccaugugguugcugggaauugaacucgggaccucuggaagagcagucaguaaccgccgagccaucucuccagcccacuaaguugucuuuagucaugguuuuuaucacagcaauagaaacccaauuaagacacacugguucuuaauucccacaaaugggaaauuaaugaacagcuggggccauaucuuaaguaaugucuuaugguuuuucugagguguuuagguaucaauauagccaggaaggucagcccugacacacuggacacacgcugugaucaccaaauggccuucuggccuggaaagaccuucccuguaacuuucuuccuugaagauuauaugucuccuccucccaaauuacuguucaggugggagcagaccacgugcauaguguccgggucagucaagaagguuggagcguucgucaaaccaaacgagacgcaucagugacugaucggcuucuucuuguuuucucuucuuuuuucuuucuguuucucucucucucucuuuuuuuuuuuccuuuuuucuuuuuuucuuauucuuuuggagaccgagucucacuuucuaccccuggcugucuuggaauucacaauguagaucaggcuggacuggcacucaccgugguuggccugccucugcauccugaguguagcaguuaagcuuuggaaguggauugcugagcugccuuggauggcucgggguuuauaggguuuaccucuuguuacugaccucguuccugugugugcuguuggaguugucuuaguccauugagugcguuguuguguuguuguguugcugaggacagagcccaagccaugaggaggggguuaauucgcucacugcugugcucgaggauuaagggugaugacugucuugucuuuguuguuuuuguuuuuguuuuuguuuuuuuuuuuucuuuuucauuuuuccaaagcaggguuucucuguguagcccuggcuuuccuguaacucacucuguagaccaggcuggccuagaauucaagagauccaccugcuucugccuccugaguucugguaucaaaagcgugcaccaccaccgccuggccagugaagacuuucuuaaugguggauucccaagucaauguaagccaucacauuuaagagagagaauauguguggcuuucuuuugagacaggcucucauuauacauauugagauauauucuggcuggccuggaauucucuagugacccaggcuggccucaaacuccuagagaucuacuugcuuuugccuccugagugcugggauuaaggugugcaccaucacaccucacagaucuuuuuuaugaagcuaccaggauuuauucauaaaugcccuaccccagugaccuuguuagaucuuaauuacuucccaaaggcaacucuaaaauacuguacacaauuggaucuagcuuuuauccuuuuaauaucacaauggggauuauuuuauuuuuauuauguuuugagacaguuuugcuuuauagcuuuaguuguucuugaauccaugcucuccagccuccugaguacuaggauuauagacauuauagaccaccacacugccuuagaggaauaaacugcauucaaaccaugacauguggugucuuugucauuuucagggcgaauuugcuccauuuuccaagugcucaagaagaagacaaagaaagaccagauguuaccccaaaacucaggcagagugaacagccugugaagccuguugggccugucauggacgaugcugcuccugaggacucagcuucuccuguuucgcagcagagggccucacaggagcagagggccucacaggagcccuucaguccugcagaggacgugauggaaacagaccugcuggaaggacuggcugcuaaccaggacagaccuaguaagauguugauggacaggcccacccagaguaacaucgggauccagaccguggaccauucccugugcgccccagaaacugucucggcagcaacucagacugugaagagugugugugagcaggggaccaguacagcggagcagaacucugggaaacaagaugccacugugcagacugagagggggaguggagagaaaccugccagugcucccguggacgacacagagucccuccacagccaggugggggcagcugggcgccucgggcccgcuacagacugcauucucugaaggucucaguucagugcuucucaaacaauuguauguuuuuaguggugugcgugcccaugccacuuggggcuugugugugaaagucagaagacaacuucagguguuaguccucagguaguuuccauuuuuuuuuuuuuuuuuuguuuguuuguuuguuugaaacaggaccucucauuggucagaaacuuccccagauaggccaggcuagcugaccucugacuuuggggucaugucucuucccaucuuaccauuguugggaguagaucuaccacuguacucagcucuguacuugguucuggcagucugaacuugucuuaacgcuuuacugacugagugagccauccccaccuccaaugacauuuguuuuguuuuuuuguuuuuaucuuguuuuuugacaccggguuggucucacuuggcuggccugaacucaaauacuucugauucuauugauuguuauggguguuauuuuagcuaccacuuuugauagauauuaauacgaugccaugcagagugagagaauguguuuuagagcuaguuucuccugcugagaaagguguuggggucuggagagcugacucagugugcuaagagcccugcuguuguucuagaggaucugaguuuaguucucagcauccaugcugggcagcucacuucugucugcaacuccagcuggccucugaggcccaggcccucacaggugacaugugcucgacauugacauaugcacauaaauaaaaugaaucuuaaaacaggugccaggaaaaccagcugguggaggggcaaagaguguugaggaaaguucaggaaaguggaguguggagaacuugaaacugguguggccuuuuaaaggacguuagagagaaacgcugauggaguuuuucugagugucagagcuuuuaaaaaaaucucucugcaauagcuuggacucaggccagugcuuggugaaaguccaggcugccacucucaggcucccuaaacuugugugugaaguauauauggaacuagguuuuguguugggaaaauaauuuuccccacccaguaauaauggacuauucacguuauuuaacuuuggagauuguucucacauagacuaucugcuuccuucugacucuugucauacuuuaucaguuaagucugucccuugaaggguucacuuuaaugggcagaaacuguuuagauccuaggaugcaagauggacccgcuaguggggaacagucaggcugcacaagucgcuugaggcugucaugguucugguacaggaugauugacaugcaguagcugugcucuagccucauuaaguagaguuggauauauggaaacaguuggaagaguuggguuacgguccauguuuaaauuugaugucucuguuuuacuccauagcuaaagucagaguuagaauuguucgguuauaucauugaaggcuuuggguaaauuacuaccugcuccuccauagagagcagagccagugggauguggaugggcgaccgcgaugagcugugcuagagguguuagcuaccagcaaguccuaaguaguaaacacugguggguuauaagaagccaaugauuaggacuagugagcaaauagggcuuggaaaucuaguuugcagacagucuuuaucaaaauuauccaaaccugacuagagcauaaucuuggggcccauuuggcaauagaaauugugaacaugagugcucagugcucaaacgugagggcuggaguuccguacccuagagcccccagaaagaaaccugauggaggagugugcacccugugaucuuagcccugggggagcaaagacaagaucucuggggcuugcucagcagcagucagucuaguugaauuggcaaauuccagguucaagggaagagaguaauuauagacacauuaacucucaggccuucaugaacacucacuagacacaugugugugcacauacauacacacacagauuuagaagacauuuuuaucaugaaugcugugauuagaaaaaguuaaaagauuaagauauguucuaugggggugugaugagguauggggaagggggugccucagcaggcccaugcugaggcaucccuuccccggagcgaucagccacaugacaguauaguauagaauagaguuuauucagggcauagggaggggaguuaagaggguagcagaggcagggaaaggcagagagagggagaguagagaaguagaggcagccaugaccacauggagaggggggggaagggaaucgggggagagggggagcaaggaggcaagaggcaagggagagaagcaggaguaagagagagaggaagggacaagcagcuccuuuuauaguggccaggccuacuuggcuguugccagguaacuguggggguggaguccagacagaacaccaaaaaugaaacagccugguuuguguuuguugucugcuuguuuguuugaauaguggucuaaaaauucugaguuuguuauuuuuauauuaauugguauuagugcauuugaauuugucuaguccugaaugaauuacaccugcccuggucuuuuccagcagguguuuggauagugugucauccaugcuucacagaagcuagucgccaaauauuugcauaaugcuuuuugaaugaaagaagcuuaguguucuugaaauaugauguucucagaaaaaauaggguuuuuguucaaacuguuuuuuaaaugguaaaucuuaaaacuauuauuuucuuuucugugucugaauguuuuacaugcauauaugcauauauuuaagagcacugaguggaguggaugccuggugcccauggaagccagaagggguacuggguccccuaccuagcacugggauuuauagacaguugugagcugcuauguggguugugggacuugaacuccagggcccucugcaagagcagcaaauaugccuaaccacugggcuaucucuagugacauugccucagguuaccuaagagcuagccucacacuauauagucuagaaauggcuuugaacuuccgauuuuccugccucuuccuccaaguguugagauuauagacugccaugcccagcuuucuaacguaacccuuuaguuaaaaaucuauuccuuaggucuuaagugggauuucugugacaaaacaugaugaccaaaagcaacuuggggcugaaaggguuuaaccuacaugggccauugaggguggccaaggcaggaacucagacaauaggaaccuggccggccggagacgggcccaggcauggagggcucuaccuaguggcuuauuccacguggcuugccuggucuccaguuguuuuuguuuuguuuuuugguuuuuauuuuuguuccuguggucuuguuuuguuuugagacaguguuuuccuguguugcgcuggccuuucuagaacucccucuauagaucaggcuagccuccaacucagaucuaccugccuccugagugcuggucccaccacugccuggcucagccugauagaacccaggaccuccagcugagggguguuagcacccacugugggcagagcccucccacagccaucacuaaguacggaaaugcccuacagccagaucucauggaggcaugagugagguuccauccucugugacgacucugugacguuaacuuaaaacaggcagccaggcaguguacauuggugaguaagcgaaggcuggccaccuguauagggagacacuguaucuaaacaaaguaacaaaacccucaaaacuauuccugggaacagauggucuuuuguugcugaacuggcuuugacuaguuaacaggugcugauucugggcuucucuaagagucaaagagcaccugguuuuuagguaaagcaccguuguuaucagaauuaaaggguuaacuggcugugguggcacauacuuaccagaguccgaggcaggaggaucaugaguuggagagaucagccugggguacacagugaguugaagacaagucugagguguacaaugaaacaaaaaguugaaaagauuuagaauguuuauuuuuucaaaauaauguauuagcuacuaugauugagcuuugucauuucaggucaaaugaggcagacacauucuucucugugaauaaauggaucacuuaucaugucugauucaugaguguacaguucccagugaaaacugugacucuauuccaccuucuguucgcugguuuuguucagucuguguugugguuuuuguuauagggggaagaggaauuugaaaugccccagccuccgcauggccaugucuugcaucgccacaugagaaccauucgagaaguccguacacucgucacccgcgucaucacagauguuuauuauguggaugggacagaaguggaaaggaaaguaacggagguaacacugcacccaccuccuccccgccccuccuaucccugaguccuuucccucaccccucuuucaacccugggucauuaggugcuggcacucagccucaguuucuuuuugaaacuuuucuuugagacagggucuuuaaacacagccccggcuguccuggaacuuacucuguagaccaggcuggccucucccuccugagugcuaccacugccugacugguuuguuucuuagcauagcucaagcuucuuaacugguguguagccauacuugagcuucucaucuuuccgucuccaucucugcuuacguuugugacaaaccuagggccacaugugugugagggagcacuccaagccugugggguuucuuuccuuuuaacauucauucauucauugaguguguguauucaugugguuguguguguauaguggcccacgugugacaucuuuuggaagacagcuuucagagucagcuguccuugcauccuauggcucuggguuaucagaauugggucauaaagcaucuuaggagccauuuugcuaucuauccuugcccucccucaaacuauacauucucaaagcagaaauucuccaaaugggagaagucaaaaccagccauuuguuuaccuuuuaguauuauauaaauguguauggcccauccugucucuguggagagccugggccugcugaggagucuucuuucuccacaccaugucaguuagccugaugcgcuguaaacauuucagaugagggagacaaaauuguaucauguaugcccauuucccuaugcugugccuguuggggguguugugucuugauccuagacccuugccauaccaugccugggcuucagucuuacgagaugacuuacagcugagcucuagcacccaaguguacauauguagugaagccagcuugguauucuagugguuuguauuuaucaaaaguuguucaucguugucgucgucaucgucaucaucaauagagacagggucucauuauauagccauggcugucuugaaguuuagcauguagaccaggcuggccuugaauuaagagagagaucugucugcauccgcuucccagugugugugacuacacucagcauauacuuucauuagaaugugagcccccucugcccauggauggaguugaaagcuguaaacucagggcucucccacgaagcuacauccucagcucugauuauguuuuuugucuucauuuuuccaaaccaauuuuaguuauuuuugcuuauaauuuucuguuuccauggauacuuagaaaagaccuaauguuaaugaugugcccagaauggcuccugccugcuccucuccguaaccuccuuagcucucuucucuccacagggaacuccuucugucuucuagguuaaaguccuugcuaguagcuuaugcacuuucccaguagaaagauaauuucaugugccauagaaaggguucuuucuucuuguucuuuuuuguuuguuuguuuuguuuuguuuuuuuuuauucuuuuuuucuuuucuggguucuuucuucaauguuuugcuacauguaauauguugguuuaguagcuuugaacaaguuuaaaaacuauauuuauuuacuuaauuuugagucaggguuucacuggcuugacugaaauuugauauauggauccaggguagccucaaacucacagcuuaccugucucugccucccaggauuaaagauaugugccaucauaccuagcuaugcuuugaaauaauuuauguagccauggcgcaaaacagauauagaauuauuuccaugcuucaggaaguuccuucccaauucccaccuggcugauaggacauuuccugcagucucugggauuucccagccaucaccuuagcuuccuguuagugugcuuucuuuuagcuucccuaucuguuucuucccuucaggagacugaagaaccaaucguagagugucaggaaugugaaacagaaguuuccccuucacagacuggagguuccucuggggaccugggggacaucagcuccuucuccuccaaagcuuccagcucacaccacacauccaguggaacaagucucucagccauacacagcaguggcagcucagggcgaggagcugggccacucaaaggaaaagccagugggacagaagcugcagauuuugccuuacccaguucccgaggaggcccaggaaaacugaggugcagacagguucuccagagagaacccagcaggggcagggcugcuaauguuuucauaucacaugagaagaaauauuggggaaugccccaccuugagcuggagaaacagugccucuuccucauugugggcaaagaagccccuuaggggauguugggaaugcuggguacauucuccuaccaucccuauguucugcagcuuauccauauuuugguugggaguacagauuuggaauaggccccccacugugcucuauguccuugguuuuuggucggcucuguggguauccagagccugaaguagaauagaagguugggcagaaauggguguggcaucgaaaauaguaacagcaggaagcuaugucaggagggaguagacuuucauacaggaaaaaguccuuuuucccccaucccccuugcugagguuuuggugaugaguuuuaaugggugugagccaaguucuguugcccuggaggagcagcgcguguugccugacauauaguuggaagguccuggggagauguuaaaggauguacuccuuagcagcugcuaucaaacuaaccugucuucauucucuaguccuagaaaagggaucagucagacaggggcaccggugugugaggaagauggugaugcaggccuuggcaucagacagggagggaaggcuccaguuacaccucgugggcgugggcgaaggggccgcccaccuucucggaccacuggaaccagguaccuggguagugccaaaaaaauaggaguagagggaagaggagaauagagaguguguaagguacaagagggagaggagaggcccacacugaugccugaggccacugagaaauugggcucaugccugugauggggcuaauaaagaauggggaagagaucuauaagggaaaagagucagaagguagguccugucuugcucucacuuccuucucuacccgucuuuagagaaacaguugucucugguccguugggcguagaagauauuucaccuagcaugucaccagaugacaaguccuucacccgcauuaugccucgugugccagauucuaccaaacggacggaugccaguucuaguacuuugcggcggagugauucuccagagauuccuuuucaggcugcuacugguuccucugauggcuuggauuccucaucuucaggaaacagcuuugugggucuccguguuguagcuaaguggucauccaauggcuacuuuuacucugggaagaucacccgagaugugggggcugggaaguacaagcugcucuuugaugauggguacgaaugugacgugcugggcaaagacauucuccugugugaccccaucccccuggacacugaagugacagcccucucagaagaugaauauuucagugcagguaaugaaacaagcagaucccuacagauggacugugccugcuggucccuccugucagcaguuaccaggacagucucgucuuccccagccucacuguugaucuggaucucacaagucagagauuccacuccuauuacauugcuuacccuggccauugacuguuugguuucuaguuugguuuucaguaaacuuauuuuggaauaguuaaaggcuuaaagaaaauguugccaaguacagaaugguguuagggaggaccccuguguccuccucgccgagcacucccuauccguaguguccuaaauuaguccgauacuuuugucagaagcaagaagccagucucagucccugauaacuaaacuccaaacuuuauuuggauuuuaccaucuuuucuauaauguacuuucucuguuucaggauccagucgaggauaccacauuacauuuagucaucauguuucguuuggucuccucugguuuguggcaauuucugucuuuuguuuuuucaugacuuugacaguuuugagggauaauagcuauuuuauagaauggucucucagaucaggucugauguuuucacauuagacuggaguuacgauuuuguuuuuaguucauuguaaagaaugauauuaggggugaagugcccuuccuaucauauuauauauauggggcugagggaggcaugugacaucacccuacaucacuggugaugugaguuuuuaucacuagguaagagacucuccaggucuuuccacuucagcauuaguguuuuccccuuuguauucugucuuucacuccugccuuuuaugcccuggcuguccuggaacuugcauuguaaaucaggcuggccucaagcuaacagagaucccccugccaaugucuccugaguccugggauuaaagcugugugcuacugugccaggcuucacuucugacuuuuaugcucacugacuguguugauaagaauucagcuggagacugguggugcacugagauauuuuaauguaggaagagggcgugcugcgugucauccucugauuugaauaaugaugcccuuguuuugucuuuucgggggugggguguccucaggucacuggccuuuuuguaauagccaguguuggcaauggugagguauuugugugugcuuuuacuuuuucauauaugaauucugugaauauagcuucuuagcuauaugguguugacugucuuuuagaaauauccuuucuggauauuguauugcacauggauagaccgggaggacaagcuuuucuguugggcgcuuccgggcuuuuuuguucuaggguuccccaaguaccugcuuuuugcucccuuguuuugguguuuuggggccacuuuaccuuguaauacuagauaacacuauggguuguguggcauuacuuaggugcaguacauggagcugguagcuuaugguuuguauguauugucuucaucugguaugaagccaucuuagagguugacauuuggcucuuucaagauagaucaguaucagcaguaaauugugcaucaugggauagggauucagcauuccacuuguugaggcuguuuaccagugucaguaagcagcacacugcuucuaguuauuguagcuauuccauagugaugaguguccuucuggccuugggcauaugucagucugaggucuucaggauuuaguuuggugguagauuuaagcuaggagacaagcaagccgaguaaaggaguugguuguaugacccagcaaggagaacuaggaccugcuuccuccuccuugcucuucccugcuagggauagcuaggucccuuagcccuucauugaaaacaagcuaauggaaaugaaguguaacuuuuuguucaccagaaugaaaaaaucaguagugaugugccauuuuuauguuguaugugagauacauguuguuuauugguugguaggaaggagugugguuuuuuuuauuuuuuuucccuuuucuuuuuuucauagaauuggacauagaucuugccuacccaauccucacauaacagaacuaggccuaaacucagguuugcugaguucuaacucagccacacauugugcugcuaaccuaaaggacugucuguagcuguguaucaggguaagagcagugggguagacaagagcaggcaagcaggcuuuaucuccccuuucuuugcucucuccauccugacuuuguguacaguagacaaaccuacaugauuucuuagaauugucauuuucaccugucauuuucauucauacuucaaagaaaccacaaugggaaagcuuaggagauugcuauaggaucguuaaaccuugccauucacuucaggagauccaucugagccacuaauaaucccucaguccggucuugggaagcuugcuuuuauagcuaaaggcugcuuucucucagaagaccuugucuaauccuaguguauuagcuacauauaucccaaguguuguaaaccacuuggcagggacagccaaguucagcccaugguuguuggcucuuuggguucccugccucagccugcuuuugcagagcccuucugagaggcugcucaacagccuacaauuaugguaucuuuuauaaugucaucuccaggaguggugaaaggacauaggaaggagucuggggagcuguauuacagcauugaaaaagaaggccaaaggaagugguauaaacgaauggcagucauucuguccuuggagcaaggaaacagacugagagagcaauaugggcuuggcccauaugaagcugucacaccgcucacgaaggcagcagauaucagcuuagguaagacuuuccugaacaacugccuguggauccaggcuucgcuuaaagggaggaaugguucccaggauaguaggaaugauugccugacuccuuugaguggcuuaguggauagcaaugacuguccuuuucuaguaacagccacacuuuuuccccuuccaaauaacaaaugagaagucucuaggauuuuucuggccuuucuccuccuaucggggagcaaaucuaucuccgucauggcaguguuggaaaacauaaaaugcguggcuuuaaaaggacauuucaugauuggggagguugcgaaaagcacaguacuguccaugucagguuaaguucuuccuuaaccugaucucacuaguauuuggcuuacucaccagacaauuugguggaaggaaagcggaaacggcgcaguaacaucagcuccccagucacccccacugccgccaguagcagcagcacaacgcccacacguaaagccacggagaguccccgugcuuccacgggagucccaucaggcaaaaggaaacuuccgacuucugaagaggaacgcucuccugcuaagcgaggucgaaagucugccaccgugaaaccugguaagaugggagccgaguacaugcagauguccugccuaugcugucacagacuggugcuacaaguuauaggucaucguauuauaagcuccauucccuguccucucuucagggcccagcaggagggcaggacuugaucacagacagacuaugugugggcucuggggaggaauauaagcauggaaguuuaaguaggaucaaaauggguagaauuucuuagauuuuaaccucugccaucuccugcuucuugguagaccuuauuuccacuaucuuuccccccacuaucuugugcucacacuuucucaagcuuccuauagaaugcuuaugcuucagccugcaucuucccuuuccccuacccauccuuuucagucacuccuauucauugugaaaaaaauucagucagauguucaagugucugugguggcccagacuuggccacgguggcuucuguagauagagguaaaguccugucucuauggguagggucccucaggcuggcaccgugauggcauuccauauuccuugucccagaaccagaucuuuguuuuuccuauuagaguugugucaucugcuuaccaccuaauaccacugccauguauuucagguuauuuaaaaacagcaauagcuaaccuuuauuaaauauuuacugaguuaggcaugaggccuaaauauuuucacucauauucccuuauauaaucucuuaaagcauauuugcuagaauucacuuucuauauuuuugaagagucuaagauagaaaaguuagguaacuuucucaacaaucucaagguagaucucaaauugagguagaccugacccuuuaguccagugccaaaugcauaguauuacugccucuugacuguuccugauccugguuuuauuucaggaggcaugcaugaccugccgucaucuuagccuccuagugaaccugauucggcuucaguagguauccauuuccuucuggaggacuuacuggggcacaucuuagcaugguguuguggaaugguggcucacuuaccuccccagguguugacagcuggguguugaguugggguauuuuguuguggcuucaccuccacauaaagacucugaccaaguauuucgcguugcucuggugagagucugguauggugggagaaucugauugggacaguucuuggcagcaguaaaguuuucuuuuuuuccuuccucauuaaagauugcuucaaaaugucagagaccuggguggugaaugugguugaagacuucccaacacuacauuuuccuguucuagagccaccuuuggugucagguggccuuagaaauugauguuauugaaguacuacuaguucauuuccauacaugaaaacaacagacugcccacuguaauggucacgucagauuuaaauguuauuugucuucauuguaaauuugguccuagcuuguuggccauuuagagugauuggcuguauuaauggucuuugggucauagcuuagacaaagcuuaccaggacauggccuauccggucccacuggugcugggccuuuguucaaguagugaucugugugcaucauuuugguaacuguuuuguccuuccuaggaacagugggggcagcagaguuugugagucccugugagacuggagacaacauaggugagccuucuguccuagaagagccaagagggccuuugccccucaacaagaccuuguuucugggcuaugccuuucuccucaccauggcuacaacuagugacaagcuggccagucgcucuaagcugcuagaugguccuacaggaagcagugaagaagaggagggugagucccuggggugcugaccuaugcacucuuugcuuuuacuuugugaagggaugcuuuuuucauccagguagaguagugcaccaggcaggugguaacugauucuggccacauaaguaaaauuaacuuguacccuauuucugguuuguagacuuuucacaaaaucguucucagugagugguucucaagauggucuugguaggcagcugagaaaucguuaucuuuuuguuaauuuucauacuacagagacacaggugugcaugcuauagaucuaugcauggauguauauguaccugugcacagguguggcagucaugggacaaucuggaagaguauuauucuuccuccuaauguaaggggucccaggggaucaaacucaagucaccaggcuuggcaacccagggagagaguuccccuucuuacauaaagugaauguuaaaaaucuguuaaucuaucagaguuaaagggcuucaacagugacagacuuggauuugaacaguguuggcuuaccuuccuguaacuauccacauccagcaggcuucucguguuuggccaccuucccccuuuauucucuaccauuuacuuaagagaacccauguggaggaugcauucucuucugaguguaagaagggaacuguggugucuacagcccagaauaguuuggcaagaauuaguuucuaggcccuuuuauauuaaaauaagucuguaugucacauacauuagauuuuuuuuuaagugauucuuuauuagacauuuucucuauuuacauuucaaauguuagccucuuuccuaguuuccccuccaaaaauaccuuauccucuccccugcucccaacccacccacucacauucuugguucuagcauuccccuauauuggggcauagagccuucacaggaccaagggacuccccucccauugaugacugacuaggccauccucugcuagaaaauauaauuagagauacuaguuccacuaugugauuucuuuaccuggugguauaguuccaaggagcucugaggauacugguuaguguauauugacguuccuucuauggggcuucaguccccuucuuuucccugggauuucucuggcuccuucauaggggaccuugugcuccguucauuggaugacugugagcauccacuucuguauuugcuaggcacuggcagagccucucaggagaaugcuauaucaggcuccuaucagcaggcucuuuuggcaucugccuagugucuggguuaggugguuguuuauggggugaauccccaaguguggcagucucuggauggucauuccuccaggcucugcuccaaacuuugucucuguaacuccuuccacacauauauuaauuuaggucuaggugaagucuuuggucaggugguagaauguauuucagaggucugacaaaugugugguauaggggaauguguagaucaaauguauauagugcgugacaguagucuccagauaucuguccaagcuugagaacuagauuguuguuuuguaaguuaaagaguucugacuaauguugagucuugcaagaaggaauuaaaauaaggaaaaugugauugucauaaaaugguauagcugaagauguaugaugacucuacucacuaguuacagccauucaaacauguacagggcacaggaaagugaucugguguugcccuuagauuuauguuuggaaggugcauaggagauguucuggugaugggcagcuggguuuugagagcaagugugggacguguggcuugucaaacagaauucagauauguauaguggaagaaaaagcagugaccuagccugagcucagaauuagcagucccuugaauuccaugcagcagucuggcaucacaguaaagaugguuugcagccuauuuugcuuuucuaguguugcuuuaacaacuuagugcuugaaaccagacauuacaaggcaguucuacauaggcguuuguugcuuggaauaguccagaaagcugacugagugagagugaugcaggcuguucaguuccucagauacauuaguaaaucugcaucugucuaaucaccaguagcugaagaauuaagaggaagcaguuacaaauaggcauuaaaguacuuagauuuuauaauaguaaaaauaauuauuuuuguuacauauacagaauuuuuagaaauuccuccuuucaacaagcaguauacagaaugccagcuucgagcaggagcuggguauauccuugaagacuucaaugaagcccaggugaggacuuuauuuuguggcuaccuucuuucuguauugagaaaaggcccaagagggguuugggugguuuacugaaaugcaggguacugugccagugugcuacuccagcccagcauuuucaguguacacagagaagacacgcuagagcuuguguuaggugguagugguucuguagagacagcaacagauugaacuuauacaguagaaagccuauuggugguaguguuucccuagccggaaggugggguacuggguaugguugaccuuugagauuuaggccuuccaaaagauguaggugaaacaaacugucacaggaagcaguuugggcuuuucagugagccaacacaaccuuugguacaaaaacagauuagauaguauuuuuugauaccaguuggaagucauuacaccuguucucgagggcucauuaggugcagcuaaucagcaaagguuuuccuaaacacuaccagaccagucagcuggguuucuuuucuucuaguguaacacagccuaccagugucuccuaauugcggaccagcacugucgaacccggaaguacuuccugugccuugccaguggcauuccuugugugucucaugucuggguccaugacaguugccaugccaaccaacuucaaaacuaucguaauuaucugcugccugcuggguauagccuugaagagcaacgaauucuggauuggugaguguuuggaagcccauuuagagcugagacaacaggaagaauggcauuugggaagaaagucuaguugagaaauuuaaguguuacuagaaacuggaaugucuguagacuaaaucagaauuugaaugaauuugaaaugauaucagcaguuaaaguacuuuauugccagagccucacugggaaccuucugaauguguggaaagauuaguguauguggucaguguuccccaguaggggaagcauugaaacuaggauuaaguuucaauuuuaaacuuagagagggaaggggacuaaccugauuuguuuacuagcaaagucugggcuccuggaaugcauaccuccuccagaagcgaggcagagcauguucaacacauggcagagcuaggaaagcgcagacaaggacucccuuugcagaguuguuagauaugaugggccauacuaaguuccuuuccaguuccuaaauauugucuccaacuccuucacaggcaaccccgugaaaacccuuuccagaaucugaagguccucuuggugucagaucaacaacagaacuucuuggagcucuggucugagauccuuaugacuggaggggcagccucugugaagcagcaccauucaagugcccacaacaaagguacugggaagcaucuguguuucauagucauuccaggguguccuuagacucacaccugucagcauguguauuccaagucuguccucauuuuuaagauaagucccaccuucaaaaaggguagguugacguaagugaaggauaacgcuauucaggcuucuauagucuccagugguauuuccauucaauaguucuacaaggccagacguggugauugcaacuuuuauuuuagauuaugaacauacaguaccuagaguagagggcuuugguuuggcagaguagggaauaccuguuagaaggcacaccugucuuguuuuaauaggagcuaaacugagugucccucccucauucacuuccccuacuuuuuacagacauugcuuuagggguauuugaugugguggugacagaccccucaugcccagccucggugcucaagugugcugaagccuugcaacugccugugguaucacaagaaugggugauccagugccucauuguuggggagagaauuggauucaagcagcauccaaaauauaaacaugauuauguuucucacuaaagauacuuggucuuacugguuuuauucccugcuauuguggagauuguguuuuaaucagguuuuaagugugucuuguguguaauuguauucuuugcauggaccuuguacauaguuuuauuugcuggacuuuuaugauaaaauaaauguugaaucucuuugguuguaguaacugggaugucuucaucuguuucuuugagcuuaaucucagaacaugauaaacauaggaucuucucugaaguugucagcaggcuugucacuuuagcaguacagcaaacaaagggagauaaaaauagaggagugagcuuuauuuuguggcaucacugucaagguuaucccaggcuaccuaaaauguuauacuuccaaaaacaguuuaaaguaggugagggccuggguaaacaguagugcuaaaguugagugggacugggaacagcucuggguaucaggaguuuauugacagaugaccugcuacugggaacaugaacaugaccaguuguuaaugaauggacagugacuauaaauuugcugggacgguuuucuauaaaauaagcugucacaacuguuggaaguuauuccuuccucacacucaucaucaucaucccuguuagcgaacggcuucucauucucuaaauaaagccagcggucucauuuuuucuauagugccaaauaguaaauacuuuuaggcuuugugaccacacuugucugucucaacaacuugucuugucugugagcaaucaccgacaauagcuaaauugaguauguguggcuguuugaauaguacuuuauuuacaaaaacaagcagcaggcuguuaucugcuuuuagaggugagguaacaaggugggauaauccuccuggguaguugacaaguacgggcucaggcuuucauagugguugguagacaguguagaugaagagaggacucagugacuacagacugaggcccggauguuucauucuuguccagcuuggagggaaagaugucagugaaguguuuuguuuaugcugaugagaacauuaguauguucucagcccgugguggcuaggcuaucugaccauaaaaccuuaacucauguggcaggucuaaggugggaaaacuggguugcagugaaaacuaaauuguuucuaaaucuaaacaauuugaccucuauccucuuuagccagaauugcccuuuuacuagucugaaagaauuagaacucacuggcucaauucuucagauaaaggauacucaaaucuuaaauuuuagggaaggauaaagauagucuguguaguuacaagguacagaaagagggaaagcucacaggcucucugaaggguuuucucauuugguggugacacagaagcugaccuguucaggagcgugauuccguucuuacaugagccaacccacuguuuacugugguuaucuuccauaggaauauaguaaguguucaauaaaccccgguuacacaaaugaacccacccaacagaugucuucaaaauccuucguguggucagcagagggauaucagaccccaguuccccuacaggaauggcagggaggauuuuuauaccucugcauuucuucuagaagacccuuucagcagucugcaggcauuugaugaaugauuugagagauuuguuacagacaucagaauguggcagggcuguuucauuuuuugaaccagaguuuucuuuuacaucccaaaacuauaaaagaaaaaaaaaguuucauuaaaugccaugccuuccaaagaaacauggcaaucugagauagagcuaacaccauggcaacaacacagcucucuuaagaagccgacgaugaccacuggauaucaguauuagauuuaaggaaguuuagaagagagcauggcaccacagccacacugcugcuaguacaugucagagcaggcaguggaagccagacugcccccagaacauagcaguacauagccuaacacagaccuuacccucagcuuuaguauuuuaauaugcugaugaacuucacuagaaaauaaauuccaguaaaauuguagaacaugaucacccuacucccauacccccaaccccuuccugcaucucugagccuuguuuauaaaaugaggguaaucuggaggugauggccagaguugcauuuuggucuucuauuguucauuaacccccuccuccaaaucuaguaagugccccaugaauuguuccuaccugcccagagucccaccagccuggguauaguauuuauuauagucuagccggagcaguaacugagccaaaucugaguugaucuggugauuccgaacacuggaaagaaucuugaacaggagugaagacuggcgacuaaagcccuguugagagacccgagcugucagugaccaggcuaggguacugggaaccaagggggucuuuggaaaagcuuugcuuaaauguuugcaggaccaccuggccuucccauauucccauuucuaucagcuccuaacaugacuucuuaguacauguccgugagaugcaugacucccaugaaagugcuuucucguuaguaggaauuuaacagcucauuuaagauuaauauauuccaucacauacugggauugcagugauccugcuuuguuacaaggagauaaauauagucugagauuauaauuauaagugagauaggaggcugguucagggaaggaagugggaugugagaaaaugagcacaaagccagugcauacuuggugggcugaagaaacuauucagggcugaacuauuucugaacacugugaggcagcacauuauauauucaccgauaccagcgcuuuuaucuuuuuaucucgucauuucuaugucuguucuggaaaacgcuuuauugacccggagcagacugccugcuccacagcuggggggagagguauguauuuucaguggcuaggcagacucaccuucacgagaaugcucagcugggccgcuccgcgcucauccaguggaccuagguucugacugaccagugaacaaaaacugugacagagaucuaggauuucauucaggcagugaaacaccuauccaaaaauauagcuggcguuaagaaaugaagaaaucgcugagaaaugcaagguuugggaaaauaguuuuuaacagccuacuaccucccaugucugaucucagcagagacaccgcaaccuucaaagcuguuuggcccucccaaguaacacacagaaugaacaucccuucuugggacagcuggcuucucugacucccugcacaaaaccucugcucuagucaccauuaacuccuccuuccuuagacccacugagaaugcucuugccuuugagcucugaguguuguucccugagauucucuucucuuuacuaacaguucaagccucauucucugugaacuacuccuuccccacugcagccuuuagcggucuccacccuucuucuguuguaguaccuguguuguucacuggugauugucgggccacccgugcuguugcugacuuuuguauguacaugucuuguuguuuuccaacuagauugugagcuccuuaagggcagagccaugacuuauaccucuuuguauccccagugccuugcauacaguaagcacucaauaaagacuucaauuaugaugaccuguuguucuaacgugcucuuccucaaggauauacccaugcuaugcaagaacagugccaaccacugagaguggcagcugcuuaagucacuccuucuagguguagcaaguaacagccccaaauaccagaguucaaagaagccccauaccauuuaugguuggugcccggaugaguacagcuugcucaccacagagaugaaagcauaagcacuccaggguuaucugaguugcacgcucaccuugggauuggggccagcuugugugcuugcaguuauuggugcugagaccccaaucugcacguuugacuuaagugauuucuggccuuagauuuuuuucacaaguuccaauauguagucaauguugaguagcugucagaagagcuaaauguguguacuugcagauggacguacacccagagcauuagacacgauguaccuaugagaacaacuuucaaaugacugguugauccugguccaacagauuucuaagaaagugagcucuguuguuuuccuguagagucagggagauuccugaauuucuguaggucacuugggguguguguguguguuaaacauaaaguucuuuuuaucucuaucuguuuaccacacucuuacauucucguucccuuuaacacuguauuuuaagugucagaaauguaaagauggacuugaacaugcgaugaauaacagucucauaucucgucaaguccaagagccgacagggacauauuaggcuaagcaaccaaucaccccuacuuacaggcuucagcaaaauaaaggauugggccagcagauugcuuaggaaguggucgugugccaaucggaugcuuucaaagucccucguagaauugaucugaugaagcagcugugagaacugagacuccagcacaucuaccugauagauaaaaaaaccuuuuuuuagcaccuggcacauucugaguguuccauuuuaugguucuucucauguuuuauuuuuaguaugugugugaauugcucaugccacagaggcauguggagggcaaaggacaacuuuucaggguuggucccaggucaucaggcuugguggcuccagccuuuacccacugagccaucucaccagcccucaucuuccuuuuagccacuuuaggcugaccagugacauguuucaguugcucugagucuuguagaguguguguugcuugaggccuguguauucaggggaaggcuguaacaaugaauuacauucccugacuuuuguuucuuuuuauacagggucuugcugcagcucaggcuuugcaauucuccuuccugacacuucccaguguggauguuacaguugugugucaacagaacugguuguauaauuucuguuuuugagacaggguuucauguaacccaggcuggccugaagcucacuguguagccaagaaugaccuugaacucccgguccucuuccuucuaccucugaaauguuaggaucacaggcuagugccgccacaccugacauuuugcagugccagagcucaaacccuuucugaaugcuauauaaguacucuaccaacugaccuacauucccagucacaguuguuacuucca

SEQ ID NO: 1030 - RNA, 22838 nt, Mus musculus
uccuacuacaguagauggaaacucacacuuuggcuucagugaucaguccucuguaaauauacauaugacugaagaaaagcaaggcuuuggguugcuccaggagacuccuggagauggaacacgagagcuccauauagaaagacagcaagagcuuguugagccagcucaguccccucaagagcuaccuguggaaaucugcccuucaggaagucaggguguuaccaaggucagccagacaugccaggaggucccggacaucguccagccgugucacaacauccaugaggagauuggccagccucagcaggaggucccugacaucagccagcuguugcugaaggaccaugacacuacuaccaacacgugccaccugugccaggccagccagcugucucagaaaguuugugaggaaauuugccagcuuugucaagacaaccaugaggagaguaaccaacuaugccaggaagucucaguaaagcugggcaggaugguccauggauucccuguaaauguugauagcacggcccaggaaacccuuauggaaauuggcagaccaacccaagagaucccugaagauccauaccaggaguucucugugaagguuggcgugcuggcucagaaggccccugccaucagugagcuaucucaagacaucccugaggcugacaaaccaucccaagagcucucugaggagacugagcugcaggcucaggaggucucugaggagauugaucaggagucugaggugguugaugagcugccuccugaggcuaucuccuaaguucaaugucuacccagugauguaaacacugaaaaccagucucuggccaugaccagcacucaccccuccacuagcaccaugugacuuguagucuugucguugguuucccacucugccagcucuuugagccagcagccuuucuguuggcuaacacacagaaagagccccacgcaaggugugggcucacagcagcaguaucugagaaagcaggccuuguggcauggaacuuacuucugccagcgcuuauacuuacggaggagcuguugauguucagagacauuguuggcucuucacuuagccauggagugggaaucauagauuguuuggaggaaaugccacuuaacugcugaagauaccgugcugagggaacagcagauauaacauggaagguggcagggucucuucuuguugacugaaauauucacagcuuuuuaggguauccucaguccauaugugcauucaaggaaacucuuaacuucacuagcacaggcuagcacaggggaaccaccuaaaaugucuggaaaauagaguuccaaucucaaaaacaucuguuguggcuacucaugguuuauacugagcucauggguguuuccauguaauugccaagugcuccccugccuaguccugcuucuguggacaucagcucaagagaaaaauagauauuagauugccaugcaacuucagagugacuacuuagacugcucugggagauuugcaucaaucuaugaagccaggccuccuuuuguuguggggcuguugggcuuagaagaugcuguaauagagagaaucaaguucuauuuuaaacaauuagcagagaucaauguuguacagauaugagcaaagauuuaauauauauauauauauauauauauauaaacauauauauuucuguaguuugccagggacagacuggccaaagaucaaacacuccaggguccccaagagguuuguccuuauaucaugugucuuuaugaccauaugugauuacaaagcuuuucccaaagaucuagggaugggaguggguguggguaauguugucauuggagucuggggccggaacaugacaagugcucaauaaacacaaaauaaugagaacgagggggugugacuccuuugugaccuuugugaacucaagaaugaauauguaaucccauuguguccaugacugaaccaaucacauacuggagaugagcggggauuggcuuuaaagagucccuguaguggucagucuaccaucccaaguguuuuuacugagcagaaugcuggguaguuucugagcagcagccucugaugccuuccucucuggugccuuggggugugagucgggagcugacaggaagaggcacugccuggccucugcucuguugacauauguacaucaggaaagcuccagacacugggaugacuacaagguucccuucucauauacacauuuauaaccugaccacucaugacaugccuaagacuacaaaggguuuuacuauggggacuuaauguagcuuucauccauugggcaguaaaugaaaagauuuauuaagaguuuucugggaaaauacagggacuacuuuugaccccauagaaugcagauugcacucucuaaaccagauguuuauguuccugcuacaggcucccacauuuuagacuauuuuuauauuuuuuuuguuuguuucuugcuuaaauuuuuacuuuauguguaugggcguuuugccugaauauaagucuauauacugcauguaugccuggugcccacagggaccagaaaaggguguugaagccacaggaaguggagauauagaguuguaaacugcuaugugaguucuggaagagcagccaguguucuuaaccacuaagcuaucuccagcccuuguuuuuuuuuuuuuuuuuuuuuuuuuuuugagacaaggacucacucacuguguagcucaggcuggcccaaaacuuucuauagcccaggcugcccucaaacuccuaauucuuccaccucuacccugaguguuaagaucacaggcaugcaccaucacacccugcuucuuuucagaaaugaugaugguucucucaucucauccuccuuucacacaggcuggcucucccgaguccugggauggguuugaauaauggagagucuuccaagauaaaugauaacugaaccagagggauggaaaccaggauagcuuacugucuggaggagccuuggaaagccuaggcagcaccacaccaucugcaaugaacuugguuuauuguuagagguggagguggcucuguuacagcagcugggaacuguagcaaggaaguguggggaggagcggagcacagcggcagggaggggagcuaggaagaacaggaagugagcuccuuuugguuucccauuggcuuggcaaagaaggcaagccccagggacugucagcggcugggucucucaguccagcagggucuggccgggcugcucacuggcuugcuuggggcgagguccuguccuguaguagaaugcucagccucuccucacucuggaggaguuaagcuauagcucaccuuccucucuucuuuccccuccucccucccucccaucuccccucccccaguucucuaguccagccuccaccucccagaaacucuauccaagaguuuagguuuagagaggcagccaguguucccauuucagcugcaggaugguagaggauuggaauguuagggagucacacauggcuaaaguggaugugggugucaggcaguggcuuauuguuuaacccauuacacaccaggccauagcagaugaccacaugcagagaagccaagcaggggaugagaagaaaugaggcuuauuggaaugggguaggugaagacuaagugauuggggagcuuggagcaacugggguuggggcucuccuugcccuuugugcugcccagguagccuggucuggguacagcccggggcuguaaaugcuaugaagaaggggcugagagaugagcuccuuuuuccucucccuaguucuuggucuaaagagcuucaaguuuuggauugagacauucagauauugugggacgcaguaagacaauagagcagccacauguccccagguagcugcuggaacccagacucuaguggcuagggcauggcagauggaggaaagggcgcagcucuggcaccuuacuaacaguggccuucccugcaucaucuaaauuaucagcaauccuuucuggaaugccaaauaaauaaauaaugagguucugggggagagacuguuguuaaucuuccuccaccgggaggagugugcuguuugaaacccauccucaccaagaccagcauuuggcaaugcuaggagaggggguugcucuagggguuucaggcuucagaugaccuuucagaaucguguaucuccucauugccuuuggucuugaaaccccaggaagagaugaggggaaggacaggaccucccacuuagccccaagucccaauaacaugacauggccccugcccggcucgccuucccucaaccccagaggacucagcaguagccauucucuaaaugaacuguaggaguggauccuuagggaagggagcgcaggucauucagaacucaaucuugcaggcuggaaaggacucguccugcaucaccacagugcugcugcuagccaggaccaggacguucaguugcugcuguugcucgugugucugcugauaccacucacgagucaccuccguaucaugagugggaaucagagucaccuaagaggaagaaaacaugccugaggugagaaucuggaggaaagacagaugagggggaaggagaacugauggucucaaacaaucccccuccccauacaaaggaccuugucuuuuugugaauaggggcuguguccuacuguggccuccucugacagagcuuugaccagauucuaacuuugugucuccugcuacucaccugaagguucuccccccauugggccuugccuuccagcagggcauccagcacagcccggcuuggcucgccauuggcagggucauuuccacugaccacauaguaggaugcacgcacucggcggaagaaguccugaucagcagucuugccgcugcagugauuugggauauaggcaagauccacauacacaggagggccagagcuacccuuggaccccaaggcugcuguagagacaagcagaaugcauuguaaaaacagcaaagcagacaaaacuuggucaccuccccacuugcuuaaacagcuggagcccuuggcuagcccacaccuacaacaacccagugucucccacuuuccugauauacucacuggauccugccuugaggccauugacuaagccuuuagacauggggcugugaccauccuuuucuucugaggugaccuggcuuggggugcuccguggucgggguagggcccgggauguucgaucuacaggcccuuugccaggaguaggugaccguuuuccccgaauauccagacgccgagcaggagaugcaggcuuggcccguccaggggccuuacggccaggucgucccugcaccuuuucccguagucucucaacucucccagacucugagcugagccccucggggucagccaugcaaacauccggucggggagggggugggcggggguccgguaggggggcugggggugggucauggccaggucugggguggugaguuccacuaacucccccagcuuuguccacaggcaagaaguccccaucuucaucugagucaagggcugccucagcugugauggauggacacuccucaguuucuggugggacaucagaaucugauugugaggagccugagucgcuggcugauguggggggugucucaucagccauagggcauggaccuccuguggccccuggccucccugcccggcgccgcccuccuuuuccugccagccgagccucuuccguugaaaggucacugucaucuguggaugggggcaaaggaggguucaggaaugaaggggaaagcuccccgcagugggggcgggggucuguagcacaucccugagguccagccucgacuucagaagaaagacugcaggguggacccccggagcucuucccaggacgcugcucagaugagagaaguguauccggccgggagcuccucuccgcucccucgggccaggacccucguucccaagcaugaagggcuucagccucuucuuuuucugcuguggcuguggcaaacccugggggauuaaggcugguuucuccugggccauuagcuucaugaucuccagaguggcucagaaaggggcuuggcuucuuggugaguuccccugagcacuccgggcggcaggacaggguaccgucacccaaguuuccaggcaggcuuggagcuggagcuggagcuggagcuggagccaagucccgggaagcuaaaggggcugggcucagaggagugaggucccagaggcugugggcagcuggcucguucccugggcccaauucuccugaacucuguucagccaccucuagaccuggagggaagcguucagccacacuugaaaucacaggcgugguagccucagaagaggacccuucagacaaggcuggcgaggcaggucgggguagauuggagagaagaggggccccuggcgagcugggugaugggaguuggggcagugaggaauccaggcugggugccuuggucacuuccaaguacucaucaugucggguucugguuggaguuccuggaaccagggccagagcucgguccccagagaaggcaagagagccacagggugcggagcgggguucagccggagagggcagcugagggggagcaggcugcaaggaggagaagccaaaggcugaagcagggaaguccaaacuuggucggacagguccuaggugagagucugaggaaaggcugcuaugcgccucaguuucaggccacagugaaggguggcccacaggcauggggugauggggacuuggggacugggucucuuucuccggcuguucccgagcccccuucuccaggucugagucauuaguaccaucaucccagugacuucggccugcuuccuuuggggaugggguccuccugucugggccacagcucguagugcuuccauuaagagggggacuugggucuuggcucagggagauaggggcacgagggggcacugcaggaggggugaagcugggcuccacauugggcccuggcucagguucuugccugggagguauaguggguccugccagagaugcauagcuaaacguuggagugucagaguggagguuugggggcgacacagcggaugaaagcuccuucucugcagacuuauugcggccagcagccuccuccuugguugagaggugugggggccaauccccagaugcccccaguggaggcucccugguggggcaagcagggcccaacccaguaagcaucaucuguucguagaugucugcauacugaaagcuccucucgucgggauagggugugggcucccucugcucuggcucagucugcucagcaucccugguggugugacucuccguaaccucugggaccuuugaacugaaggagcugcugucaggagcuccagccccacccucuccuucccuuuccccuucagcuuugcgauaguccuucccuaggggggaguauggaccaccuuccaacucagcugcccccuccugcaccgcagccaccacacugucauauucagcgaugccccaggagaagggcgcaggagcaugugggucuggggccggggucgggggagcuggagcuggagagaggggugcaggaggcaggggccuguccuuagguacccauggugggaucucagcuagccaugauggggugguagguucauuccucgugggugguguggacuuagugucuggaacagggcuuuccuguccuggagcugagggaacccucuguccagucaucucagguggggaugcuggaggggagaugaucucaaagggagagcgagucaguuuguccuccuccucugguggcaagccaacuggcgacucagcaagccagcgcucuacuuccagccccuucuguggcaggggcuccuggaaauccuugaaauccgaggcccagggacuccggggagugugcugcagugggguuauuucuuguucauuuggccccucaucaagaaacguacuuucacguuccucagaguaccguggacgggcuccuuguccaucuagcucaugggggaaccagaccuuccucucacagcuuagcuccuuccaguaugcauccugcuguaggguuaugucucugucucuccaauaccugacuuccugcucaggagacuugcccucccaggcuggaacaggcucuccucugguuggagauguuucucgccaucccuggaccacauccugcuccuuccaguauuucucuuccugcucucgagccuugcccuccucuucugggcucucuuccagccccaaagcucuggucuucuccgggacagcuccauccugcugcuccacaccuuuggccuuuucuggagacuuuuggucaagggucaucucuuuugguguuguacuuuuaucuuccaggaaagagcucuucugccccugaguuuugucuucuuuuagggucccaucuuucuguccagcagcccuguugucuugguccaaggcagcacccucuuuuucucgggcccagucuuuuuguucuaaaaccuguucuuucucuuccgaggccucauccuucuguucuuuaucaaccuugcuucuguguucuggagcucugucugucuguguugguugggggaugaugugcucuggagcccugucuuccaguacuaacacuuuaucuuucucuucaggagucuuaucucucagcucuaaaugcucguccuuuuguucuaaaucucugugcucuugugcucuggcucuugguucaggggccugggucuguugcagggcugcaccccuuuguucuaaggccuuguccuucucugccaggcccugguccuccagauauaagucuuugccuuuggguucugggccuuugcccagcuccacagccgugucuuuuuuguccaagucucugccuuucuguucugaagucuuauccugcuguccuccaggcuuguucucuucaucuagagccucguccuucugaugcaugacugagucccgcuggacaagagcagccuucuccgacagaaucugguccuucugcuguaggguuucacucuuucgcucgaguuccuucuccuucuguucaguggcucugucuuccgaccccggagcuuuacccccccacuccauggccagguccuccauggcgggacuugacaaagacucgggacucuuggugagggagcuauccgaugucauaaaguguccaccagggcccgugaucucuccaggugaguguuuccugucaccugacagugcagagugagagaaagagcugccagguaaauuuccagcagggcucucaucugugagaccugccucuccagcagccucaucugugggaggugacacuguggcuguguggggcucuggaauagacacaggagcuagguggcaagaguugucuucugccuucaccagaggccccuuuucuuccuuuccuaggcuuaguucuccaaacuggagggugccaaggcuuucuggagagagcugcuuagaagagauauccagagaggucuccuugcuaggacucucuuccgagaaagaaagugacugggugucuucuggggacaccauuggccaaaggucuuuguguagcugcugcucuuucgggguacagggagaccuggggguggccucuuguuuggcagugucuggggagaccacacugaggacagacagggacucugcaucuucaggggaaaagcuuugaucaguaaacccaagcagcucaucuuucugaggcucagcgggcuccugaguccucacuucuccaggaaggcugccugcuccugaagcugcgccugccucuccagucucaaacacuacugcuuugucuuguucuggcaacaguugaauaguacagccagucugacccccagcaaggcucccaaguguguccugggcuugggggcuccuggaaagagguacuuugcccucuucugacauggccuccucaggcccuggcuuaacugucugcucuucagcaucuuccuugcucacaccaggagcgugcuuugugucuccccaggaaucuucuuggaagucuugaggcucagacuuuucuuccacgggggacugaugaaagggcgugugggcagcacugggugggccagaugguggaggagacgccaucuucacggugcuaucaucugggcugaggcaccguuccuccacuucuccgagggccgguucccccggauguagggcauguccaggggcaccaaacacggcagcauacugacuggacaguuucucagacguuguuacauucuuuucuuccuuuccuacagccuucuccccggucaaaccucuccccacagacucuccuuucuucuccgacuccccggucacagagaaauccucacagggcggugacuugaagcccuugucuucuuccagggaagaggugggugagauggugccugcugacggcacauaguccaagcccugaguggcuucagugcgggaagagggaauacuugugacagugucgagcaacagggagcucuugccugucuccuccgucuggggagcugugagugaagccacagauugguccucagccaccgauguggcaaaggaggagaguuugucacacuccgugauugauguggcugaggacacauguuccucuucagccagaggggcagcgaccauguugggaggguaggugaguucagucucaggugccccauaaguuuugcucgagcuggcuggaacagcacucucugcagacuggcuggcuucaaagggaccaggaccuucaggcccagagaggucauagguacucguggggaaucgggguggggcugggcguucguccggcucgucgugaaucuccucgucugagauagucugcucagucucugaguagccagggaucgucucauccugaauguaggagacaugcucagcggcuccugcaggcguggccaagcugcucaggaaggaugcugucuccuuuucaggcgccuugcccuggaaucccaguucccggccgccaagagccucucugccuuuugggauuaccuuuaaggcuuccugcauauguuuuugauaaaaacucucagccuuugucucuuccucuuccucaucugagggauggaccuccuccaucuccucuaacucagccuuuucuaucacauccuccuuuaccucagguucacucuccucccuggccgcagcaauguucucuggggucagcucugcuucucucggcuuccuuuccucccagguuucuuucucucucucuaccucagcaccugagucuggggcucuguucuugcucccuuuauccucgggaaagucugggacaaccucuuucucccuuucuaccuguucuugcuccaacacugaagcaggggguugggucaccuggauggcugugcuugggcgucccugcucggaggcaucugcagggagcgguuucucacccaguuccgugucccuugguucagccaacaaaccucucuccucacgcuucaacuccucaaaguccugugugagguccucuggugaagacaaggccaacucucugugcccacuggcagcaggaggcggugcagcccccuucugggcuggggguguccggggcucagaagacaauucuuuuuccccacgggcagcucggccuuuguccaccuugagccuuccaggggccuuggcuuuguagagggucuuacggaccucagggguaaaaggcuucaggucugguuuagagaauuucuugaguuccggcuugguaucuuuccucuuuucauccuucuuggcguccuuuuucuccuccuuccuucccuccuccuucuugaguuccuuccuuuccuucuugaucuccuucuucuccuugucccucuucuccuccagcuuugaaaucuuuuccuucaggugcuucuugcccacuuuauccuugaucagcuuccgcuucucagccuucagugcuucgcuggacucuguccucacccucucuggcuuggaggguuuuucugggggcuucucggacggcucuuuugcuuucuuuucugacuuggcuaacuccuuggccagcucugagcgggccuccuuggcucccucuucuaacaccuccucccguuuggcuagcuugcucauugcugucuugggggcagcuuugaggcucuccuugcugucggcccgauguuugauuuugcuggguuucaaguuggcaggcacggccccagcagccagguccuucugugucgccacaggauagcgcaggaaguccaggugccgcagcuuuuccaggcccuccaagaucuuguucuggggagcauuucccgggaaaagcacucgcacaaucuucucaguaggguuggcugggagccauaccaccaaggcagugauggaggucagguaggggacggagaucucugccuccuucccauuggccagcacuaugccugucuuggcuuuacuauugccugcccacuucugcaugaggaacugcaucuccuuacuguccuugacaggguugaggacauacauguccagccuccccacacccauuuuguggaagagggucagcggcucgaugguguugcugaccacucgguacagaggcucggcuuggaugccgaggcgguucaggugcugaagggugagacaggccuccucgaugcugcgcuuggccuugcgggaggcgucgggcagccggagcuuaucaggcacauugaagaacacgacuccgagcucaggggagaugagguucuucacccagucgcuguagcugcuggagcccugggacugcuccuccucuagcucugccaccuugcgcugcaggagcccauugaugccuggcagauugucagccccaaugugcgugagcagcaccgagucaaugcgguccaggugccgcaccagcuuccagaagcaggacuugcggucagaaccgccguccaccaggauguuaaagccauugacagcaaagagagcagaguccccacggccaccagggaagauguaacagcaaggcuuggagagcuugaggaagccuccugagguggggggcucaagcaggucaaagggggacggcacauccaccgucucagagacauacucggagaacucggccacuccauccauggugggcagcacaggcucaggauuuagccggaggugcaaggucucuugggaacuagacagucccagguggcuccagucacccuccccuaagcaggaaacagugaggaaggccuggaucccagggucucuauugcuaagcaacugggcaaucuagaggaauaggaaagagaagcugaucaaaucauugggguuaucuuagucugacccagauucagccccuacucuuuaccuuuuucugagguaaaaugccuaccuccugucaggguuccugauagucaguguuuauaagacuuccccucccuugccuuucucccuacaacuuaaguccugccuccuguccccuucuuccaagacacgcagcagggaacucaccucagguuugugaaggaccugggcgaaguuuugauaugaguaaguaccacucuguaggauaaggucucccucggguucuaaaguuuguccacucaagaugaggaguuugugagcugaugggcuacuaagaagauggugaaccugaaauggagggcagagaaggcacagguauggggcacccagggaaaggcacugaaaaucccugcccugcccccuucagugauauaaggacacauuccucacuccguauuccccagaguggggcugaggaucacaagucaguucagauaguagcccgagguauaguggcgccgccaagggucgguuauagcacucagaacaagcgaggcgcaggcacuggccuuaccucugagcugaugcugucugcagugggguugacuaggaugauggucucgagggucucacucugguggcagaggguccucuggccugagggagagauguaggcauguguacugaaaucaguagguauugauuuaaaaugagaaguacugggggggggggcacaggggaggaaaaacaaaugaucagaaaaugggguacaggguacccagucaucuaggaugccacuaagggaggccugggaacugccuccuccagcccuucccuuuccaggguucucccuccucucccccacgguagcagacuucucccuucccuccaucugccacacccuccgaugcugcccaguccccgcccuuuugccuagaacuucagccccagacagcucuguugacaaggagcuuuuugucccucuggagcacuaaguuccuggugcugccuggggauuggggguggggggagggcuccagggauggcggucuuuacggagcuuucucugccuuugcccgcggcuggcaguaaggaguuaggcgcuucugucucagauuccccuuccuuuccaccccaaguccccuacccaaggacagaacaccuguaauagaagaugauggagacacguggcaacugguuucuuggaggggacagaggauucuaacuugcuauuuuguuuucugacucugccaagccuuccgugucagagccgugcucccaccaccgugcucccaaguauuucacagcucccucuccucuaucucccucacgugcccaggcucuagggacacccagcucgcugcagaacucaucaucccugcgaccaguucccugccucagaguacagaaaguaaguggcuggcucaaaacaagaaacagggccagcgaugcucucugccaagcauccuaggacuggagguacaaagaggaaugacuccugcaagcuguuuuuugaccuaccuauacacgcacacacagacagacagacacacagacacagacacaaacacagacacacacacacacacacacacacacacacacacaccacagaauuaaaaacaauagcaagcagggcauggugguggcguacaccuuuaaucgggaggcaaaggcaguuggguuucuaugaauucaaagccaguuaaguuccaggacagccagagccacacagagaauucuaucccaaaacaccuagccaaauaaaaagcaggaccgccaacaacagccaaggcauugcuuaggaugggggggggggggcagauccucuccccagggcuuucuccagacccacauaaaacacuaagcagugaaaguaaagaacacagugggugagaaagaggcuaagaaggauggacccgacuucccagguuccugccuucccaucugccuccucuuccagcacaguagcagucaccguaggguuaaccuuaggggcagcuggaggauacuggggaggggaggcucagaguccguucccuggagcccucuucggcgacuccaacucccuuuucuuuucugaggcugggacaagggugacuggggccagggccuuuguuuagaggaagagccuugaugccaaggagcaggcagcagaugcaacuauggggaagaugaaggugucagagacccaaauccuaugcagggccuguuggguccucuucugugaacuugggaguggagggacacuuuggcacaggcaggcaggagcagggcuuacgcagccugggcuaucuccauccucugccagucuuaagucagacuuagaagagccaggacucccccaucacaaacaaggucacacuucaaucuagguagaacagaaagacacguccucuccagcuaccaucucccuacuccagcagcuucacgguccccaguguauccucacaagaccuuugaccccacuuccuggccugacacaggacccccagccccacuccuggggagcuaguccauuacaucgcuccuuauccugggagaagccugguuucucucuucugccccccagcucuuccaaugaagggaauugccggguuuuuuuuccccuuuaucuuugcagaagacuaucuuaagagauuggggcgcuucccacagccagugcugugguugggggugggcuucgggugugaagcugagugggcaggagggcaggugucucugcagugaggcgggggggggggugcucaggcagcugcagucugccgcagugugugagugugugugugugugugugcgcgcuaagcucagccuccagcuccagcuccgcccccaccccccaccccagcaugacaagucauuuucuuggcugccucugcauggggggugggggguagggaugggggugcaugcagagcaggagaagaaacuggcuucuguuggaagagcccccaucuugggaaggaaagcacagaugaggugaggguggggccgaggcagggaacccgugggguugacaggacggagaaugcagggcagcugcugaagagccagggcucucaagcuccugaguugccucagagaggccacagaggggggcuuaaagccccaggcucaagcuggccacagggaauggggugcggggagccaaaaccaaaccaguuagccuauacggaggcacaugccacgucucagugacccauuccuccguucucuuccagagugucacccccuucccuuacuuggcaaaaacucgcugccacacucaccccagaauagggagcagcugaacaaucuaguagcugauaacccaaggacccucccaguagguaaauucccccuuccucucagcuucuucuguuuucccuuaaagacacagcccccaaauuccuccugugcccuggcugccaggcaaaaccgguggcaccacccucuauugcugccucucagcugaugguccccacccccaccuaguacagagguggacugucacagccccuguugguuccacuggcuguggauccaggcugaaccccaagucaguaauguucaccuccucucucccuccaucccaggcugccuuccuaccaggcuagcccagguccagaugcaucagauuuacaagguaccagauaccccaucccagcuccuuaucuaccacagcauccccuaauccuucugccuugccgugcccuuugguuaggcucuuacccuggggugugggagggagccccucauggaggcgucggcuccggccucagccuuagccgggcagcuucagggaagagucugcggcacuuggggugggagugagggggggcugcuugacggggagggcggugccagggcggggaagaggggcugguccgugacgaggcacuagagacuuaacuguuucuuggccuuuacagucugaaugaucuggugccucugcuuggcuacugggaaggggagggagcuaagggguucucuaucaguucaaagagccagggugaccuccagcagcucuaaggaccuucuccccaaauccuguuuaguaaagaaauacucucucggcaucaaccaaaggaccacagccccacaccggggcacagagccagcuauaggaggcaagggcugcaugggcccucccccuuccucuuagaaaccaucugcugccucuccccucagauggacccagagagugaccuucagucacugcaagagccgaagacaaagaggcuaaggggccauaaauguaagggagcagugugaggguagugagugacguggauagcuggacccuguucugcaucgcagcaauggggagcuggggaggacauuuuagacuggagaguagugugaauguucuggagcagucccccacugggguggggcacagggacccugggagcuucaugcaggucugugcuaaugcagccuggcuguaagagcacccacacacguugcuucugaguacuggcuguuaggaggcagacguggaaggguaaggaagguuucugccuuccauugaacaaguuaacgaagaccaaggaccaucgucgccaggagcccaggcucaagcaaagcuuucucacuauagaacacucuaacauaaaguacucuuagggucagagaugaucuuacaaugacucgguagaguguuugggucucaauugcugcuccucuccucucccuguagcugugcugugucucacuugaucuugaacagucuuacguugaccuugugcccucccggcucagccucugucuccaccucugcuaagugcuccaggacuaaaggaaagaucuggagagcuggagcccugugagguucauacucuuacauccuguccucuccacaguaacccucccuggguguggucagcuccuuccgcccacucaccagccccagccccaccccugcuccaggcugccaagggcugcuuuugaaggucagagaagccaaaauagucucugcucucagcaaccccuaccccgcuuuagcuacagccagaggagagaaguagcugagucaccaguacucugggggacagggggaacaggaugcaaaguagcaacaugccauaucccuauuugaauaggagcggccaucggcauagacacacacauagauguaaaccagcucagcagcauggaguaauacucuaccuucugcaaugucaucacucuuauuucacccugccuccagccuccugacuccucuaugcuuuuuagggaucucucaguguuuggcgggggggggggggcacaaccuuaguagacauugggauugagaacaaaauaucauccuccaacugagaucagagcccacccuuguucucagccauacacccccauagcacaccuuggcccggugauuccaggucacaguugguuuuccuucccuccccaucucuaagcuaccauuugugacagccuuuaacccuuaaucccucucucaugcagugaaauggugagaugccaaagaagagagggaggucugagcagcccccgaauucacacccgaugccaccuucugaaccaugccacuaaaugauaaguuaaacaaucucagagcuugcuuucugaacuagugaguucguacaucagugccaccugugacgacugaccuuaucugaagaaaacguuccuuucugccuacaauccuagccuugcaaugcauaaacgugauauuucucucauuguggaagguuucagaauuacccuaaaucaggaucccagucuacacuaguacugggguauccuaaguucucagacaaaacccaaacuggggaugcuugcaaaaugaggcuuaacuucuguucaucucucucugccuucacauuuccaauguaaaccucuaauucaggauccucugagcacaugaauguaacaaagagucagaaggacuuaaaggaauuccuuagccuucuccucuccaccucucucaccucuuuccaguucuccagggucuuggguagcccagacuggccauggacuugcuauguagccaaggaugauccuaugccccuacuucccaagugcugggauggauuaugggccuaugccaccacacuaggcuagcccauacuucuuagucuuagaacaucaauccucccuucccuauaggagcucaacagcaaaugccuccguuuuauugaaucucaguagugaugugucaguguguguguguguccaccauucccuacccccacuguagauccagggccuucugcauguuaggugggcugcaccccagaccuuaaguacaguuuucaauuacccuaaguuuuccuaaagcuauguuaaaaaugcuuagaugcuucagagaucuggaggaggagugggagcuauaaaggaaggccccaaaucucugcugcugauugguaugaaagcuacccuuuacauuuauuuuauuuuauuuuuuuuaccagacgugaccacuagaaggagcugggccacugacuaucugagggccccuucuuuucuguaugugugggggugggauuguaaauguagaggggguaggccuaaaaauaaucacgcucuuccuaucauuguaagacauauuuuguuccuucauuauucuggccauaguggucuacccuaugaaguaggccagaaaggucaaaccauaagaccguuaguguaucuccuucaguucaccccaacucuuggguacccuaaccuauccacucaaaggaggcuggaaggagaaggcagugccugcagcugcuuugggcaggcuguguucagagacagcugaaagagaaacuagcagggguggagcuauggcugccuuaagcuuugugccccccugcccccaggaaauucuccacuguucuucagggacagaggccaccaugacaaugucuaaaccuaaaacaaauucuguaugcuaaaaguacguuagcaucucgaguggauggcuucaagccccuugaggacaccauagcaaaacugauugaggacaucaguggguguuucuauuccagugccuguuucugagaauaugacacccugcaaaccucuucccaagcauuuccuuagucucaacuggaagaacagcuagggacuuugccucagauauuguucauuucuuacaguacucaaagucucuauggccagaaggacaagguuagagaaucugguuugaauuccuaguaggacccuagauaacacucaauccucaguaaucaguugaacccccagccaucccuuuauucagccuuguuucuaggagugucaaguggcaaaacugucuuuuggucauagggaauaguggaggaugucaugacaugggucauugucaaaagaagguaaucuccaaggagcaaauggcucguuuuccaggaagccagucccaucaggaagaugccagcgucaugguauuuaagcugcugcacauacucuaaguguaauagagcuuuagccaugucaaccucacuuucuccagccucuccacagcagcucaugagaacucauugaugaggaacuggccagacuggcggagcagaaagucuaucugcuguacuggacuguugagaguuaguaacaugugaagucuguuauuugguagcaaugacuauugaguacauggaagucacauccuauaaaacuauacggaagcagguacggugguacaugccuacaacucuaguacucaggagguagaggcaggaggauaacaaguuugauugcauccuagacuacauguggacuauagagugagauccugguuuuuuuguuuguuguuuuuuaaaagaaaguuauauugauuggugugucaacauuuacaauaauauggccagaugcccaacaccuuuaucaagggacguaggacuuucccaacucucuccguagacaccugcaguagaaugcuaauuaagcuuuuaucgcacauuucuagacgaguucucccacccaucagaccugaucucagaaucaagccucacaaaucgaggagaccuuugucccagccuggcucccugggugcugaucugaucagcccuagguggcagccuucuguucugcucugaagaucugcuggcuaagccaggaggaaacagaaaagaauccuggaaggugggcugugagaaauaagggucuggggaggugaaugaggcauucugggauguuuauaaagagaagcaagaaagcugggguaugcagaaagggaacacagaggaaaagcuuuuaccugcgagugguuugaucacuuucuuagugcuugucagcugcuguguacaacaacguuuuuccugacaaaauuaugcucuaccaucauauugagugguugcaguguguacugggcauuauccacagcauguguaaauagcuguggagccaucaaaagucccucccuuuuuaccuacccaauccucccauaaggccaguucuggccuggauacuggacccaaaggacugagacaaauaacccuaguccuaaccuuugaccucugaggagaagugagcuaggugccggguaaugaagagucucaacuguugguucaagucaaaggaugauaagucaauauuccaggagagaaucccuguaaaagaaaagggggaaaaaaaauaagaggguucuagucaaagucacccacagaaagcauugccaagcuccugggagaggaaagaaaugggaggugaugccuccaagaaggauagcuaguaccugcuuuuuccccuuuccagagggcaaagagcagaguuuagaaugggcuuacuaauaaaugagcuuggaguuuuuguuuuucaaggcaaaacaguuacgguagaagugacacgcaagggucuauuuccauauacuguagguuuccauaaugaucccucuugcuaaaucagauucuagauucuccuaugcccccucccuugccuccauccccugcuuccacccgcagguggcuccgcagcacugcgccacaggcacggcugagggaggugagcugcagagccacgaaggucacucucuaaacuuggcugccagcauucagagauuugagauguguaccucgcguucaaaaaccuccccuaaagaagaaauuguaagguagggacauggacuuuucagggucugaugaggacuuucggauauaugguccaguggcuucgggaaaggggugugaccagagggaccccagggucuccacggagcuucuccugcuccugcuccgggacacugcggaacagaaugggguaugcagaaaggaugggcaagcaagguguuggcagcucgagaggacagaggcacauucauggaagaugcaggugacagggucgcagguuucgggaagugcacauagagauagaggagacagaaaugugcacugggagaugaaugcagauggcggagaggcauggauggaguacugcguaaaagccaggagagcggcucaccuuguucaaggugggcccgcacggcccucagcugacucucuguaccgauaucgccgaucacgaugagcaaggaguauuuccgcaggucccagcgcgcugccgcuaccgcggcaccggccucgcaaagaggcuccgccggguucugagcuggcggugcaccgaggcucuggagccccagcuccggaguugucuccauggcaacgcugccaggccgcgcggucccggcuucggucgccauggaaacucccgcggaguguuaggcuagcugcguccg

SEQ ID NO: 1031 - RNA, 24915 nt, Mus musculus
ccggcgggcguucgccuaagcguccgccccgccucgccccgcgcgcccgccaaucggcaguuaccagcuguuccgcccgcccgacgcugcgugacgcagccaaucggcggcugccacacugcgggccccgagcaggccuaggggguugggaccucggcagcgggucugcccgggccagacgcgcgagcgcaggcaagcggcugcagauugcgggcucucccaucucauuucuccggucccggcccuccgaccgcgacccgccgccaugcgcuucagcugccuagcucugcucccgggcguggcgcugcugcucgccucggcccgucucgccgccgccuccgauguguuggaacugacggacgaaaacuucgagagucgcgucuccgacacgggcucggcggggcucaugcuagucgaguucuucgcccccuggugaggccacuuugcgggaucagggccggaggaccggcugggcgcgggagcgguugggccuacgcagcgcgggcgcccuccacuaucuagcaggccuggcugcggcugccucauugccagucgguggggaaccgggaggcgcuccgcccggggugggggguggggugaggacgagguaggguggggacgggggcagauccggaaagcagaaagccuaaacuccaggguagggccacguccuuaccuccgcguucuugcagcacuuccuauguggaggguucucccauccccucccccuccggucuaucuuucaguaucuaggugagucaguguauguguccccaggucugcagacaaggcuggcaucccaaagccuucagagaggaggcagagguccucuuuuaaguggugagguucugggguuuuuuuuuuuucucuuuuugucuccaccccauuagagccauugguuucuaaccaaggucacucuguagcugcagaaagauccuaagugcuuucuugagacaggccauuaguugguucauggcauggcuuacacuauuuuacauuaagcugcagaggccucuuauuaaaagaguaaaccaacaagaauuauuucacuaggaccuaucauaauuucaguauuaaauaauucuagaaaaugauaacauucuggauaagaaaguuaccacugcuuaaccuaagaaaaggguaaguucuaucgagugggugugaccccaaauaaaaacuuugcuugggaagggagagcaaauaggauuucuaguuuugucacuuagaguaguggauaggauaauuuaccaauuauuuauuacaagggcauacaguuuagaggaugucaauauuuuuucccuccuagcacaaugacccuuaauucaaaccuguucaaaaguaucaguaagacagagugugauaguuacacuguaacuuaccuuugcuucugacccagugggauuguuaacaucucuagcuucucugacuuagauggucacacucaaaaguccuguagugaagacugccuaaagaggcaggaagcaaauuguguuucaguucaggcuucugugguugacagucacauugauuacacauuauagauagcaucuauaugucucuagaauucguguucucuccgaauuuaucauaguuacauaauggugcuguuaacugagggggugucgcuugggucuggcuucuuugucugaaggaggucauacaauugaagaauugugggcucuuacacaauuagaguuuuuagucaaggcuuuggaauaugguucagugcuugccuagcauguccaauccccauugaaacacacacacaugagaacauauauauucuuaagaaacaagucucuguacacucuaggcugaccucuucuuacucuagccucuuuuuuuuuucuuuuucuuuugagauagggucuccuauugccuaguuagccuucauuucaugauccuuuuauucugaaugccccaggcaccugacuucagacuugucuuucuacuaaaaauuguugugccugcuuuccacaagacuacauaucccaucguacauugagcgauuuaagaguugcguggauuucugcuguggugucugcuuuuaguuggcugagaagauaaagucaucuuccacauugccaguaggaaagauugguuuucugaggaggcaguuuaaagugaaggaagucuccuguuaguaauuucauuauuucuacauacucaucuauuuuaacaguuguaaaaauuuuuuuaaauuuguuaguuugcuuguuuuucugagacaaagucuuaaguagcucagguugggcucgaauuccuuacccuugagucuccccaaaugcugagcguauagccaccacaccaagcucuggagauugauuaauugauugacugauuuacucuuuucccuugcauauaacagcaguaccauccccuguuagcaaauagaaauuuuuuuuuaaggaugugcaaccacuacccaguuuuuuuuuuaagguuuauuuauaucuaaguacacuguagcugucuucagacacaccagaagagagugccagaucucauuacggaugguugugagccaccaugugguugcuggauuugaacucaggaccuucaguagagcagucagugcucuuaaccacugagccaucucuccagcgcgcaaauagaaauuuuugagauaggguuuuauuguauagcucuggcugaccuggaccugauccacccgccucugcguacugagauuagagguguguaccaccacaucaaucgagaaauguaauaguaaaauggggacuggaaagcuggcucagcaguuaagagcacuggcuuuugcaaaggaaacugaagaguguggccuuuuggccuuccugggcacucgcauucaugugcacacacccauaacuugaaauaagugcucuaagugguaggggucaaaauggagucuggaacuuaguacaguagacaaagagcuuggguaccucaaccugggcucuagguuccaucuucauguagaucuaccucuuuaacuuuguaagugaaagugaaagauuucuuugcaggccacuguuaagguuaugagguuuuguuuuauuugaaacaagauuuuauguacuggaggcuggccaugggcugucauccugucuucaccaccuaaauacuuggauuacaggugugaauuacacuguuugcuaaccuguguauuuguagagauaugaguaucuuaauuucucugugagaaauagcgguguuuaaauguuuuaagucuuaaacaucuacuuguguuguagauuuuuaugauacucuuuuccccuguaguacuaaggaucaagcauaugacuuuaacuugugcuuggcgcugaguacuaugcuacccucuacaacaguaacaauaaauaacacuuguuaugcaguucauggugcuagugauucuugccuucccagggcuuuagaauuacagcugggugaccauuacugccuaggauuuacauuggaugcuggagauugaaacucugguccuuagugucugcaguacaagcacuuuacccagugagcuaugucuccaaccucuaaaauuaauguuuaaugcuuuuuuuuuuuuuuucgagacaggguuucucuguguagccuuggcugucuggacucacuuuguagaccaagcuggccucgaacucagaaauccaccugccccugccucccgaauacugagauuaaaggcgugcgccaccacgcccggcgcuaauuuuuuuuuuuuuaacuuaucuguuuugagacaugguuucacuauguagcucuggcuguacuggaacucacuauguagaccaggcagguauuaaacucacagggauucaucugccccugucuccugagugcugcaauuaguguucuccaucacauguagccuaguguuuguuauugguugguuggcuggcugguuuuagucuauucuucucuguaucuuaacuuggaucuccuuucuuauucccagucaucucuucagcauuugagauuucauuccaacuuuguccuauaucuccaucuugaauucauucucuuuuuccucgcccuucccuuuuccucucucucccucucuuuuaucccuccccccagguaaaggggugguuuauaagccugguuuggccuuaagcuuaugagacugucucaaaaugggcuggugaaauggcugguauuauggguaugugccuuuggggauucucaucaucagccauacauaauuuguuuuaaugcucuuuuuucuuuuuggaggcuagauaucacuguguagaccaggcuggcuucaaacucagagauccaccugccaucacaccugguuuucccugacuauuuuuauguguauuuauaaaguggucaauuuuuuucucuuauuuuucaggagaggugagguaaagauguuaacuuccgcuuuacugcuacaauagagaaaaaacggcaacagccaggcuuaguguuaugccucuuagcucaggguuucagaagcugaggaaagaagacugaaaguuugaaaaagauccugccccaagaaaagaugaaaucaaauucuuuugauacuuaagcauuaucugcuaugugaaucuagaugacuguuaccucucuguuuccuuucaagugcuauauguuguuaacuguaaucauaacacguguuucuugcuuucaugauugucugaaaacagacuuguuauguauuagcucugcuauucaccuuacuugaauaagcuuuccucucugaagccuuacuuaaagacgcaaaccagauaacauagccuuaaauguaugcuuuuuuaacccuuggaaacuggguuuaaaacacuuaagagggagaggaagaaaaauugcuauaaguucuacgacagccagggcuaccuagugagaguaugucuugagcaagugagcugaacacaugaaucaucgucaagugccuucucucuccuuucaauauaacucagccuaaccagcuggagggcuacauagaaugaaguguacaaggugcugauuuaauaauagauacacuaagccaagggagaaggaguaucauggccuguugggcuauauaguuucaagauagccuggagcuacugagugggacccaguguuuaaaggaaaacaaaacaaaacaaaaucuuaccugaguuagaaaacaggugguagaaagcuuaguuuacaguuaggugguucacuugaccaugagaacugaucaaagcauaggcgguguacuuuccccagagggcucagagaaacaccugcucuucuauccagaauggccuaacagucccauggguguacuucccgugcguuuggguguaugacauguucuugucaguauacagcuagcaccagcuguauauuaucuccuuaaaggcccaguggcuugcagagggaucucuuugagaagguugaugaguucugccuuccccauaggcagcgaaacuagaaaacagaaggaaaaaagacaggcgagguggugcaguuccccaaaauuugggagaugguggguggaucuuuggcuucaaaguauuacucugaaaaguaaucuagauaaagaguuuuaagagacugucucaaaaagcaggcuggugagauggcucagugauuaaaagugaaugcugcuuuugcgaggaccccaauuccauucccagcauguguauuuggugcuucacaauugccuguaacucuaguuccaaaggaguuacacaaaauuuuaaaaggaaaaaacaaaacuucaaaacuguaaauguguauuuucucuagggucuuuaggacaccuguugagaaacugucaaaguuuaaaugaagaaccaaaguuuaaauaaaagaacuacuuuuaguagugcaaaagaaacagcauaccccgggauuguuuacauuuaugggugugucucagaggacaaccuuccagagccaauuuucucuuugcaucauacuggaagcaaacucuggcuuaguggcaaguacauuuaacuuacuaagccgucuugcacgcacaaauagacauuuauuaaaaauguuauaggaccaugcccaauaugguugcucaagccacccugaacuguagaguccagcugcagucacacaaugagaugcugucucagaagggaagaauguguaaaaggaccaaaugauagacgccaaauucaagauggaagaguauauaagcaggaagggguacaggaagguuucagcuccauugacuuucgagacaaagaguuuucuguguggcccuggcuguucugguacucacucuagaccaggcuggccuugaacucaggauaugccugucuccugagugcugggaauaaaagcaugcacugccaccacccagcuaacauaucuuuuucuuuucuuuuuuuuuuuuuuuuuuagaauuauuuuuuuuuauuagguauuuuccucauuuacauuuccaaugcuguccaaaaaguccccaauacacuccccuacccacccacucccacuuuuuggcccuggcguuccccuguacuggggcauauaaaguuugcaaguccaaugggccucucuuuccagugauggccgacuaggucaucuuuugaugcauaugcagcuagagucaagagcucugagguacugguuaguucauauuguuguuccaccuauaggguugcagaucccuuuagcuccuuggguacuuucucuagcuccuccauugggggcccugugguccauccaauagcugacugugagcauccacuucuguguuugcuaggcccaguaucuuuuucuuaauaagauauaaaguaacgguucuucguugaaucagugacaucccagaugcauucaaaauaugguuuauauauuuuuaaauguauuuauucuacucuaauacgauacaucccaaccauagccucccacccuccaguccauucaguuauccccccaccucccuccccuuuccucguccuuucagaagagugggccuucagggauacuaaccuaacauggcauaacaagauguaguaagacuaagcagaagccuauauccagguugcuguuuuucccuguauucuccaucugucccucccucccucgccugaccccaccuguucucaugcccaucugccccaguacacccacaaaaucuauuuccccuucccagggagagccugugguccuuccuagagcccuucuuguuacuuagcuucucucaagacuguggauuauaguuugauuguccuuuaauuaacaacuaauauccauuuauugaaugcauaucauauuugucuuucugggucuggauugccucacacgggaacagcugaguaauaauacucuguuauauaaaccacauuugccuuuuuuuuuucuuuuauaauauuuacuuauuuaauguaugugaguacauugucgcugucuucagacacaccagaagagggcauuggaucccauuacagaugguugugagccaccaugugauugcugggaauugaacucaggaccucuggaagagcagucagugcucuuaacuucugagccaucucuccagccccacauuugccuuuuuuaaaaaauauuuuauugcuuuuuuuuuuuuuucacaugacagauguggguaugugcaugccacaaugcaucaggggaccuuuuuuaggaaucagauuuucuuuugcccacagagaugggcucaggucaucggcaaguaccuuuaauugcuagucaacucagugguuccaugauuauauuugaacuguuaauaagauacagauuccaauuauuuuaauauaauaaaaauaauugccaugugugcgcaccuucuuuuuuuuccuuuaaauaucccagcacuugugagaggcagaaccaggcagaucuuugagcccaagaccagcccagucugcauagagaguuccaggacagucagaacacccuaaccacuaucuaucucaagauagagaaaccuaucuugaaaaaaacgaaaaggaaaagaaacacugaguuguuccuuuggccccaaaaaugcagaucuaugaggauuauauuguagacuaaacaaaauggcacuauucaaaaaggaaugcccuguaaugucacuauggcauagugucacaugcugucuguagcuaagcauguuguuggcauuguuauaaacaagcaaguuaagagcuugugaauucuugugaagagaauucauguaugcauugagcauauuaagcacucuuaauuuaaagcugaugauuaacagaagccaaagagagugauacugugaucaccugaagcgccagccucuccauuuagagagagaagcacacaugagaugaaggaagaggagccugaguggcuggagucuauucccuguguguuaauucauggguuagcguucaaaaagaaauaacaggucuagacuuuaauaaucaggaagugguggugcacaccuuuaaucucagcacuugggaggcagaggcaggaggaucucuguaaauuccaggacaggcuacagauuaaaacccugccucaaaaaaacaaaacaaacaagucaugacucaaauaucagaagucucagguauaauuugguaguagaauaauugauauagcauccuacagucagugcaauagagguggaaaagggugaucacagccuggacuauguaacaagacccugucuuuagaaaaaagaaaaagguauaugguaguaugauaugagaaucaaaauaucaguaaguuuguguugaacuaagaaucuggcuuuuuuuuuuuuaacauagguguggacauugcaagaggcuugccccugaguaugaagcugcagcaaccagauuaaaaggaauagucccauuagcaaaggugagcaucgguguguucacgaggaagaaauauggaauauauuuuacuacauguuuauguggguaggugugcauggaccaaugugaguccuuaggcuuagcaguaagccccuuuacaugcuuagccaucuuacuggcccaaguacuuaaaguauauaaaaccaguaugggggcaaggggacuugagagauggaucauugguuaaaagcacuuggcuguucuuagagaggauggugaauucauuucccaguacuuacuuggugucucaaaaucauucuuaauuccaguuccaggggacagaugcccucucugaccucuacaggcacugcaugcaccuacuacauauacaugcagacaaaacauuuauaccauaaauaaauaaauaaauaaauaaauaaauaaauaaacaaauaaauaaaguaaauaauaauagagcauggugaauaagaaccaaggggcaaacaaagacaacagagguacagcuuuaaggaugaagaaagacagcuacaguguacuuacauauaauaaaucuuuuuuaaaaaaaggaugagaaggaaaauaauuacugaguucuguaaucuacccugauaauggccagugaugagaucugggaaaaaagaggucggauauuaaccaaaugguuaauuguaaggcugguauuuguuuucauaguguuuuaagagucagcugagguaguggcccaucaugccagcauuuggagguaaaggcaagauuagaaguucaagaccagccugagcuaccugagaccuugucucacaaagagaaacaggcaaagauaguaaugucuaauaaacuuggcauuccauaacauucguugcccaaacucuuccagucuaaagggcauuucucugcuaacuucagauaaguacuuuguaucuuagaacuuuuuaaauauuaauucuaauguaguuaagcaacuugccauagcaaaaacaaaucauuuuguaauuuuuuguuucaugugacugugggcaugaaaauagcacaaagcuauucagacgauuggcuguacacugucuaaaccucacucuacccaccuuaggacauaaggaucaaaccucagaacccuauaagguuaaugcauuuccugugguuuuaaaccaaguguuugcuuuuauguaacaaauauugaugcauuuaccaauaaacuaauuauuugcaaaaucaaguuauauccuaucccagcuaaaggguggauggauauacuaaguacauaccuucaguaaugauuguuaccaagcaaguuguugucaggacugagaguguacccuagugguagaguaguggguuugauguguaccaugaaacaggggugggugaguguacuggcuaguguugugucagcuugacacaggcuggaguuaucacagagaaagaagcuucagugggggaaaugccuccauucucagcugugaggcauuuucuuaauuagucaucaagggggaaaggccccuuuugaguggugccaucucugggcugguagucuuggguucuauaagagagcaggcugagcaagccaggggaagcaagccaguaaagaacaucccuccauggccuuugcaucagcuucugcuuccugaccuguuugaguuccaguccugacuuccuuggugaugaacaacaguauggaaguguaagcugaguaaacccuuuccuccccaacuugcuucuuagucaugaugcuugugcagaaauagaagcccugacuaaaacagggagcauuauugaaauaauguaaaggaauaguaguuuuagaauuuuuauauaaagucaaggaauguaaaauguaaagcaccucuugggcagucauaaucuaguuaccacccaaacaucuuuaagguccaaugaccuguacuguaguacacaugccaagaaguacugauccacuauggggauaccagucuuaauauuugggacuauuagaagaacuugcagcagguacuuagauaacaaaauaacucuuguucuaaucuuuagguggauugcacugccaacacaaacaccuguaauaaguauggggucaguggcuacccaacucuuaagaucuuuagagauggugaagaagcgggugcuuaugaugggccuaggacugcugguaaggauccuggauuucaucugaccuaggcuaggcuuaacuuucuuuucauauuuaugagacagggucuuacuguggagcucuggcuguccuggaacuuacuguguagaccaggaugaccuggaauuugcagagaucagcuugccucugcauuccaagugcugaaauuaaagcuguguaccauuuccacacaguuuagacuuaaauuucuuucucucuuucuuucuuuuuuuguuuuguuuuucugagacaggguuucucuguguagcccuggcuguccuggaacucacucuguaaaccaggcuggucucaaacucagaaauccaccugccucugccucccuagugcugggaauaaaggcaugagucaccacugcccagccuaggcuuaaauuucuaauccuccugccucuauuuuacauaacauuuuagagguaaacuuguuagguaacaaaaagcuuuuuugaaguaguauagaaaauacuugaacuucaaauacaagcucagccaaacauguuucauuugauaaucauuaucaauuuuaucuacuguauguuagauacucuggauaguagguguugguguucauaaauaaagcacugguccugcauuucuggaguuuguuuucugucugauagaaggagggaggcaauuauuauauacauguuaccuacaucucaugaaaacagcuuaacagguauaaauuccuguauuuuuuugacuauggauuuacuuuuagaaaguuacccugaagauguauugugcaaauuuaccugcagacaaucuuuugaaaaagcaaaagacuagaaauaaaugucucaguugucauugguuaaauaaaucacuguauauaaauccaaaaacgagucugcagcuguaauaaaugauugaaaggcugucaggguggcucaguggguaaaggcaccuacugcuaaauguaauaauucccagaacagccgggcagugggggcacacgccuuuaaucccagcacucgggaggcagaggcaggcggauuucugaguucaaggccagccuggucuacagagugaguuccaggacagccagggcuauacagagaaacccugucucgaaaaaccaaaaaaauaaauaauaauaauaauccccagaucccacuuggaaggaggaaagaacuaaguucugcagguuuccuuuugacuuggacaaaguauugucauacuucacacacaauaaaguuuccuuuuuaaaaguggggugggagugggagaguagagaugucaucgcucauuauuugagguauggauuacuucuguguauuauacuuuguuaauaugccauguugaauaaccaaaaccacuugaauugggcauaguagugcauccuuguaacccuggcacuuggaaagauggaggggguguggggaggcagauacuaccacccugaaaaagaaagagagaggggguugguuuguuuguuugaaguauauaguaccauguuaagauaaaaggaugugguauuuucucucucucucucucucucucucucccucucucucucucucucucuguauuuuagaaagauacacugauuacuacuuagccguuuuggcuacaauaaguagaaagauauacaaauggaaguugaacuuucauguauaggaaagaaacuggguuuuugggguuuuuuuguuuguuuuuugguuuuuugguuuuucgagacaggguuucucuguauagcccuggcuguccuggaacucacucuguagacuaggcuggccuugaacucagaaauccaccugccucugccucccgagugcugggauuaaaggugugugccaccaugcccaaugaaacuggguauuuugaggacaggaaauggaagaaaccuuaauugaaaacauguuguuuuaccuuuugaauuauucuaauccucaaaaaauuguuuauguguuaauauaacuuuuaucuucuaagauggaauugucagccacuugaagaaacaagcaggaccagcuucaguuccucucaggacugaggaagaauuuaagaaguucauuagugauaaagaugccucagugguggguaaguagcagguguuugucuaugccauagaauugauuggauuaaaaaaaagaauugauuggauuuuuuguaaagccacaaaguuaaagcaccuuaggcaaacgaacuuaaaugauacugacaaagcugagucagcaugcuacaacagggaaagaggaugguaucuuguauggguuuauauucuuauaaauauaaggguuuaaaaucacuuaagaguccagaauaggggcuggugagauggcucaguggguaagagcacccgacugcucuuccaaaggucaggaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaagaguccagaauaguagccgggcaugguggcgcacgucuuuaaucccagcauucgggaggcagaggcaggcggauuucuuaguucgaggccagccuggucuacaaagugagugccaggacagccagggcuauacugagaaacccugucucgaaaaacccaaaaaaaaaaaaagaguccagaauagcaauguuagcuuacccucugcccccagcccacagugcugacaauuuaaccugucuccucacuccugccagguaauugcucuaccauagagcuguguucuugcucugucccuuccuuaauucagagagcuaaagacaguguguaguuaacugauaauaaggcuuaaggcaagagaauacaaauuaaauagucaacuccugugucuauuaucaacuuuuauagcuaucuuugugguuguauuggucaaauuucuguagcuauaaauacaugaggcuggaucauaugcaaagaaaagagauuugccuuaaaauugaauguucaaaaaaagacaaugguaauuuuaaguucuggugcaggucucuuugguugcaucucauagaaggaaugcaugcaacaaggaaagauuuauuugauugugggcgggaagccagagagcaaggaggugccaggcuuacuaccauacccaaaugaauuaaauucuguguguguguguguguguguguauaauauacacugagguuaaaaccuuggccucagcugguuugugggaggcagagccagguggaucucugaguuccaggacagccagaucuacacagaaaaacccugucucaggaaacaaaauaccuuagccuccggugggugugguggcacacaucuuuaacccuagcuuuugggagaagacaacaggcaacucuuguuuuaggcaggaguacauagcaaaagcagaccuuuuacccucucuaaaaaaaaaaaaaagaaaaaaaaaaaaaacccaaacacuuaaauauaaacccuauagcugauguuugaauuugauagucuucuacguuaaagcgguuucucugggccuggagagauggcucagccauuaagacugcucuuccagagguccugaguucuauucccagaaaccacauauuggcucacaaccaucuguaauggggucuggugcccucuucuggugugucugaagagagcaauggugguguacucaugcauaaaauaaauaaaucuuuuuuuuuuuuuaagcugauucucuguaauagauauuuuaccauuuaaauuugacuuaucuggguuuaacaaauucuuuguuacccugugugcuugaaagaugguguagugcuuaaaaguauuuacugcuuuaggugccugacagacaccuaccuguaacuguagcuucagggguacugauguccauuuggcucucuuaaguacuugccaaaacaagucauucacucacacaaaaauaaauauuuucuuucuuaauaauuaaccauaaggagccuuuuuauucaucuguuuaacuuguacgaguguuuuguuuccauguaugugcauguaccacauguaugccugagcccaaagaagaaggcauaggauccucuggaacuaaaguuauagguggcuuaaaauuuuauuuuguuuuauauguguauggauguuuuuccuacauauaugugucucaucuucuggagcuaggacaguuuugagcugccauauuaugaguaugggaacugaacccagaauaacccugagccagcucuccagcccccuuugccauguuguuuaaauuuuuuuugguuuuucgagauaguuucucuguguagcccuggcuguccuggaacucacucuguagaccaggcuggccuugaacugagaaauucgccugccucccaaguacugggauuaaaggcaugcgccaccgcacccggcauuuuuuaaaucuuuuuuuauuuguuuuuuugauuucucgagacaggguuucucuauauagcccggaccucgaacucagaaaucugccugccucugccucccaagugcugggaucaaaggcaugcgccaccaccgcccggcuguuuaaaucuuuuaauacccuaaauauuuccugaaauuuaaggugugaggcaguuucccagaucuguuuuggagaaguagaggaaagacuucugguucuaccagaccucucccuuaacuuucucuagaggguagagggggaguauugugucauuuaucaaagccucaucuuagccugaauuacauuguuuauccaugauagacugaaggcuuugaaaacuaaaagaauaagucuugaauaauguaagucacggcauugauuauuccuuguguuugacauuuucuaugcagguuuuuucagggauuuauucagugaugggcacucugaauuccuaaaagcagccagcaacuugagagauaacuaccgauuugcacacaccaacauugagucucuggugaaggaguacgaugauaauggagaguaagugaccgaauagaagcaucuaacaaaagcaaauauguauagaaagauaaaugcuguguuaugcauuugcuauaaaaauauauaaagugaggguguuuuuaccuuuuuugugagcugaguaguauuuagaaagggcucuaggggcuggagagauggcacagugguuacugcucuugcacuuuuguaccagaauuuaguuucaagcacccacaucaugcagcucacaacuacggauaaugaucccagggguucuggcacauuuuucuggcuuguguggggcaugucacaagaaaaggcuucauagacagagaugguugaccuuauuuugagaaaagaucuugcuguguagaucaggcuggacuugaacuuucagcaguccuaucucuggacaaugcccaguaaggaggugauucuuaguagaagagcucuugcagguagaguauggcaguuaaacugaggauuuguucuagaucagagcucaucaguaaaguguugcugugcaccaauauaaaaagcauguaggcauauacuugcuuuguuuuauuuauuuacuuaauaauuugugugugggggaguaggguuucucuguguagcccuggcuguccuggaacucacucuauaaaccaaacuggucucgaagucagaggucugccugccucugccuccugagugcuaggauuaaaggugugagccacaaaacaacaauauaggaaaagcauuuacuaucaacuguggugcaaggaacguuuggcaacacaacuuucucuccaacacuaagcugguuuaccaccuuaacuuugaguguaaucacuggguauuaaggauuuaauaaaucuuauguugaaauuaaagagcccaugcuucuaauguuaguuuuguuuuguuuaaaagggaguuaagaguagauaaugaauuucuuuuuuuuuuuuuaaggcuuuuuaguauuauuacuauuaguguguauguguguguguuuguguuuaccuguaugugucucugugugccacauguaugccuaguguucagggaaguggugagauucucuaugggugcuggaaauugaaccuggauccuuugccaauaacaaaugcucuuagccaccaagccaagucuccagccuccauauuucuaauuuuuguuuaucuuuaauuuuguuuuuuauuguuuuuguuuuguuuuucgagacagaauuucucacuguaacagaguccuggcuauuuuagacucccuuuguagaccaggccuccccugagaucucuacagagcugcacugcuucugccugcagagugcugccaccacgccuagcagcagcuguauagccacccuagaauuuagcuuucagccucugcugaucuugccucccaaauauugcaauuacaagugucuaagaccaccugggucuaacuuccagaucuuaaaaaacaggaugaaaccaguuccauuuuacccugguuauaggugauaauauaugaugcccuugucuaaccucuguaugggucaggcauacagguagcauacagagacugcuggguuguuuuuuuuuaaaugcgugcagagcccucagaagucagaguucccugaaacuggcauuagauuguuauuagccuccuggaauccagaacuauuaacuagugagccaucucucuagucauacauuuauuuguuuauuaaaaaagauaguuugaacuuuuuauauuaucucuguuuugguaccaggaauugaaccuaagguaggcaagcacucugaacuacaucagaauguuuuaaacuaaaucucuuuauagugaucuugcugccucuaccucccaagugcagaaauaacagguguguaacaaugccugucuugucuugaguuuguguuuuuugauacagggucuccuauguugcucucucuggcugauuuguagaucaggcuggccccgacuucauagagguccacuucgccucuguucucugacugcugagguuaaagaugucuggcuccucccgugcuuuaagagaaauaugagagacaauucugcuacuuguugcuaaagcacuuuuugguuuuucuucuauuuuaagggggaucacuauauuccguccauuacaucuugcuaacaaguuugaagacaaaacuguggcauauacugaaaagaaaaugaccaguggcaagaucaagaaauuuauucaggauagcaugugaguaucccuggucugggauuucuuuccuuuugauuguuuacuucagcuacucaucaaucuauguuuuggauuaaauaaaacccauacaagagguuaugauuuuacaacauaauauuaaaccuauaauguguggacccauuacaucuuauaaagcuauaaugugggcuggagagauggcucaguggauaagagugaugacugcucuucugaaggucccagcagccacaugguggcucacauccacccauccaccuguaaugauaucugacgcccucuucuggugcaucugaagacaacuacaguguacuuauuuauaauaauaaauaaaucuuuaaaauaaaaauaaagcuauaauguguggacccauuaccucuuacagugguccuguauguugcaguacuugcauuguguugauaaugacuuccucuuauagauguuaucacauuaauaauuccagaauacagcuagaaaauaacaaagcuaauggaugacucuauuucaguuuuggucucuguccucauaugacggaagauaauaaagauuugauacaaggcaaggacuuacucaccgcuuacuaugauguggacuaugaaaagaaugcuaaagguucuaacuacuggagaaacagguaauuaaaaaaaacaacaaccuguguuuucuuuugugcagacacguuuaccuguuauuaacaguuguaacuaucuuaucuuguaacccugggguauaggauugaauggaaauggaaaggugauguggcuugugguugguacagugguuaucuguaugcacaaaagcccuggguuuguuucccaagcaccaaguguguacaugcauacacggcccauguacccauguauagaccaaaagacaaauugccuguuguuaguucuucuaccuugugaguccuuggagucagacucuggguugucaggcugagucaucucaccagccaugguaccacauuuaaaacaaaaacugggugugcuggcacggggcugugacccaagcauugagagguaaggaaggacaaccagaaguuauccaugcugcauacugaauuuguggcuaaucuggacugcauaagagucugucuuuaaaagaaguuggggguggaggguagaagggaacacauagcuccagaaacugcauuuaaagucuaagaacaaguaacauacacuauucacagaaucuucugggcgugaauuuugugcucuuccuuguacugcagacucuaaugaaagguguaaaccguguaagcgcuuaaaccguuguacccacuugcuuaccaguucucugggugcguuuuacccuuacuaauaaauguucuuuucagguuaguuuuuaugcuuguaaggaacguuacaguuaaguaguagaggaaaauuccuaucaaauggauuagguuccaccacacuucagaaugaagcucacuaagccacucaauugagacguaauugguaccugauguuauaaaugcaggccaauuccagaaggcugaguagauugaagaacucuuugcuuucuagcuuccugcuucuugaguucaaagacuuagccuagccuggugauacaggccuuuaaucuuagcacuauguaaguuuaaugccagccuggucuacacagugagcuccaagacaguuaggacuacauggagagauugggucucuuaauuuuaaaaaaggcaggggaagggggcuuugucacacuguuaugauacaaauauucuucguauuuauuucucacagggucaugaugguggcaaagaaauuccuugaugcuggacacaaacucaacuuugcuguagcuagccguaaaaccuuuagccaugaacugucagauuuuggcuuagaaagcacuacuggagagguuccuguuguggcuaucagaacugcuaaaggagagaaguuugucaugcaggaggaguucucguaagugcugcucagugcuggcucagccauuggguggggagagagagccuuccaggcaagaccugugauuaucauuuuucucaguuuagguacuuugaaagauuaaugacugacuuuugcagacuaacagagggguugcagcuuggaauucuuaauuacuuuauuagaaacaguggguagaggcugggccuagugauaugcucuuauaaucccagcaugcacuuggaugguggaacaggagaaaaggaucgagaguuccagucagauucugucuuuccuuugcaggcgagauggcaaggcucuugaacaguuccugcaagaauacuuugauggcaacuugaagagauaccugaagucugaacccaucccagaguccaacgaagggccugucaagguguguugacaucucacuaccuguaucucuaccuaaauccuaacugauacaccgauacaaaaaccauauugacuuuuguuugucucuaaugcuggaacucaaaccuauauuaaaccucacugagcuacauccccagcaaagcaagcccuuacagacagguccaguagguggcucaguggggaaagcacuuguugcaaaaaccuaaagacccauuagaucaucuugaucccguguaacaauggaaggagagaauaaacuauaaagccuccacauuuaugcauauauacacacacaaguaauuggggggggggguguuucgagacaggguuucuccauauagcccuggcuguccuggaacucacuuuguagaccaggcuggccucgaacucagaaaucugccugccucuaccuccuggguacugggauuaaaggcgugcgccaccacgcccagcuuacacacaaguaauuuuuaaagaagaaaggaaagcacuggguagcauuugguuuuuuaucuccucugacugcugaacauaguuugacaggaauagcugugaggguaaguuggaucaagggaaauaacaacguguugaggaauguugugauacaaguugaggugauuucaguccagaacaguuagagcuuguggguuuauuuuccagcuuccuugugacuagugagucuccuguguuuucuagguugugguagcagagaauuuugaugacauagugaaugaagaagauaaggacgugcugauugaauuuuacgccccuugguguggccacuguaagaaucuggaacccaaguauaaagagcugggagaaaaaguaagucuaaauccucuucugaauaugaguuugagcuggaaguuuauauacauauuaaggguagacuucauuaguuacuauacuguuauuuuuuuccccaacuauuguuuacacacuuggucuugacugcccccuagugucuauagcauacagagauguucacagagaccagcuaaacacauaccaggcucauucuacuucaugguuacaaauaucugggaucuucugaauuuuggugauggcuuaugaauucauaagccaucauuuuaaaaugcuugggaguuuugcacuuauaauccaagccaguuuuuuguuuuuguuuuuuuguuuuguuuuguuuuguuuuuuguuuuucgagacagaguuucucuguauagcccuggcuguccuggaacucacucuguagaccaggcuggccucgaacucagagauccaccugccucugccuccccagugcugggaucaaaggcgugcgccaccacacccggcucaagccagguaauuuuaaagguggcuauguguagucuuuguauuuuguuuugagauggugucuuaguguauagucaagagcagccugaguauauacucagucucccacguggaggacugacccuggccuuauauauagucuuauauaggagucaguauagaagagagaagcuaggagguuaggaacuaagucuaugcucuucucauuuaggcaaaacccuuaaauaaaacuuacacagguaaaguccuaagucagcaaguaccuguuagugaaagcuuuaccagguugguuucuaacucugaaaucugucugauuuugcuucugaagaguuaggauaaaggcaugggccacuagaucuaggucgguaguaaauacuuuggcuagccuagaacuugugacaguccagcuucuguuuccaaguguaguagucagagcauguucucaggcauguuuauuugugguagaguuucaugcgaugauaauaaguuguuguugacuuuuuuuuauuaauagcucagcaaagauccaaauauugucauagccaagauggaugccacagccaaugaugugccuucuccauaugaagucaagggguaaguugauuagaggggcgggggcaagggggguugagauggagucuauuuuguugcuuaggcuggccucaaacuuuuggauucagacuaacuuagccucagccacuugaguagccuccaagaaacuauuuccuuauugagcauaguuugagaaugaauuacuuagauuucuguaaugagugaucccaaaauuacucaaauuucucauaauuugagcauaauguagauacucaaggaaaguaacaucugaucauauuagaaaccagaaagaaaaaaaaugauucuauaacacuauuaggcaguauauguuaguaaugcuugaagauccaacugugggcucuuuuccuuuuuucuaguuuuccuaccaucuacuucucaccagccaacaagaagcuaacuccaaagaaguaugaaguaaguguguuguccuguguccccaaaguacacacagauacauguaugcacacaucauauugaugcugggggagugggggucuuuuccuccuuccuucucccuccuuuuuuuuuuuuuuuuuuuuuuuuaagauuuauuauugggcuggugagauggcucaguggguaagagcaccugacugcucuccgaaggucugaaguucaaaucccagcaaccacaugguggcucacaaccaucuguaacaagaucugacucccucuucuggagugucugaagacagcuacaguguacuuacauauaauaaauaaauaaaucuuuaaaaaaaaaaaaagauuuauuauuauacauaaguacacuguagcugacuucagacacaccagaagagggcaucagaucucuaccuugugguugcugggauuugaacucaggacauucagaagaguaguuagugcucuuaccugcugagccaucucaccagcccuuuuuuuuuucuuuuucuuuuuuugguuuugguuuugguuuuucaagacaggguuucucugaguagccuggccauccugaaauucacucuguagaccaaccaggcuggccuggaacucagaaauccgccugccucugccucccaagugcugggauuaaaggcaugcgccaccacacccggcuaucccuccuccuuucuuuuuuuuauuuuuguuuuguuuugguuugguuugguuugguuuuuugagacaggguuucucuguguaucccuggcuguccuggaacucacuuuguagaccagucuggccucgaacucagaaauccaccugccucugccucccgagugcugggauuaaaggcgugcgccaccacacccagcccuccuccuuacuuguucauguuuuuuauaugcauugguguuuugucugugaggguucagauucccuggaccuagaguuacagacaguugugagccaccauguacauuguagggauuagaccuggguccuguggaagagcuuaagacuacuucauuuauuacaguggauaugugugugaaagucaggugacagcuuugaggagucaguuuucuccuacuauuugggaucucaggaucaaauucuacugagccaucuuauuggcccuuaacugguauucuacagaaaguuaaaauaacuuuucuuuuuucaggguggccgugaauuaaaugauuuuauuagcuaucuacaacgagaagcuacaaaccccccuauaauucaagaagaaaaaccuaagaagaagaagaaggcacaagaggaccucuaaagcaacagccaaaugcaccacuuuauaaaaggacucuuacaccagagaaggcaaaaccagagaggacagaauggauauacucugaauccuguuaaauuuucucuaaacuguuucuuagcugcacuguuugaaaauacaaggaccaguuuauguuugugguuuugggagaaaauuauuuguguugggaagaauguuguggggguggggggaauugaguugggggguuauuuucuaauuuuuuuuguacauuuggaacagugacaauaaaugugcccccuuuauacugucguuuuuuuccccucaugggauggagaaucagggucucuaaacuguaauacaguaauagauagaaguguuugagcuaugcuguucaaugcuguagcuaaaccagauauguuaucuccuauaaucgcaacacuugggaggugcaggcaagagaucucaaguucaagaucuuccauggcuacauagcagguuuugaggcuagcaucuuaaacagguuugaucuuucaaaaacaaagaaaaccagcuaugcugauuccuguaacuugagacugaauagguccaguuaccaucuccaaauuguauaauuuauuaguuucuuucuguagcucaagcuguccuugaacuugugauggucucccucccuggcccugagauacugagaugacaguuguuucuagccucauucauguccuaaaggugaaugcuuacucuugccacacagccaagcuuucugcaugugcaugccuccugaggaugguucucugcccagaaaugcccugugugagugacagcaguuugggguuccauccaauuuuaggaauuauugaaacugcugggugcagcucuccccaaaucauuggguguagccauuuacuucccuccagugaacagggaaacaguaucaaucgcuggcaagaacaagaacccacagagauguuuucuuuugaauggauuaaaguauugcccuccuuuuauagcuaaau

SEQ ID NO: 1032 - RNA, 5271 nt, Mus musculus
uaaugaucgcacaaaagacagaagcaaucaguuuuaauuuuucagccauguuacauaaagguacacuauaaguucaaugaguucugucaucagaaguucucauuuuaucccugcaaggcaacuccccucaaguugcuuauuugucuaauauucucaagguuaaccuggaaaugucacuuuucaggaucuagaaaugacuuagcuaaaguaaaguugaagaagccaagcaccuccuacuuuccuagucuccuggcacagcugaggagaugauaccaugcccacacccuaaaaaaaauuauggcaacaucaaaaaucaaacugcaagaaccuaggauggcucucuacuuggucacuguggauguaagggacaaaaucagaaaagcagcuguuguguucaucaccggggaagauccgagcccucuggacagucucagcugccccuguucuucuccucaaauuccaggaugagaccuuuaaugugggacaguuucugaugcagguacucacagcgaugcuucuccucccuguaacuuggauaccgcugcagagaaaaagcacccuugucaaaaaguaaagcggcuucuaccuuaauacuacugugcucacagccugucuuaccuuucugaacuuuuuauacuccuggacuaucuugucuuccagcaccugaaacacaguaacacaaaacugaagggaagggcaaagaggacagaguaaggaaugggagugacuucuguuuucauucuaccaaauguuacaacagguuugcuuguuccuuugcuuagucacauuacauguuuagggguaauuagcaggaugaugauggccaauccugccuuuaccuuguguucuggaguuccucgcugaagucucuugaucucugcccccagcucugugaaccucuggcuugcagccccaacucgagcaugcagaaugcgguacucagcauagucggucucaaaguccugcucauaggccuguugcugcucugugcuguggauggcucuguauugccugccaggggugugacaccuucaauuucauugucccuaaaagcacuuggcugcuuacaaguacagacuaugaaauugaaaguguggggaaacucacaggagauaaucugguaccuccucagggcuuggggauucagaggcuaggaaggaagcaagaaaacaaguaauucuugguccuuuuuccaugaguauuuacccuccucucaucaguucaccugauggagcugagaggcucugcucaagccuggaaucuccaucuucaucucccucuucaucuucaucuuggccccagucuucucccucuugugaguccugauuugcuagcccuuguaguggacuugaggcuagaggcagagcucugagccucuuuuccucugguucuucagugguuauaggugcugaacguuucuguugggggaaaaaauauguauaacaaacaacaagcuagaagguucuuuggucaaaaacugcuaucccaucagcuccuagguuuaagacuuagccuaauuuuuaaagaguauucuuuuguaugugcugguaugcacacauguggaagacacgggguauccuccauuguucucugccuuacucuuuuaaggucucucacuaaacugaaagcugguuuuccuaggcuggcuggguccuagguacauaggugcugggauucagacuaaguucaaaccuuaugcuugcacucacuugauaagucaucucuccagccuuuuuguuuguuuuguuuuguuugagaccaguccuuagguagguaguccaggcaggcuggccucauacucaugcugugcagcagagcauagcccuauccuccuaucucuggagaccuucagauuauaagcaugggccagauuuuaugcuguaucaguacugugucaacccaagauucacccugccuuuuaaacuacucuuugaacagcucuugccucucuggacaucucagcacucagaaagcagggacaggugaaaggaguuugaggccagucagugcuacauaaggagcucccaggcaugccaggauuacacagugagaaccgacuccaaaaagagacuaaaguccuugcuuaccuuguccaggcguuucuggcuagcaggggaaagcagggacugaucaggcucucugcuuggaagauaagugugguuccuaggauuuuuggaaggaaugggagaggccaaggugagagcuuauuaaagaaauguaaggguagagaggagacccagccugucucaguaccucauuucccauugugccaugggcucacuggaggauccugggagugacuguucaugguggcuugccagugggucagacaccugucaggggaaguuauaggaaaacuuggcucccuggaccugggugucccaccuuaugaugacuaccugcuguuucuagucucaccucaucuggugccagcuggggauggccuucagguucgucuccaguguccugccagcucucagacucucugguaccuucagucagguguuccugagcuaacaguggagcugggauaguauccauggcugcccaaauagugagucgcucucuaagggagcccaggcaguggagacaguucggcccagaucuugaaagaagagugggaaagacaauagaaaaaugaguuggagaucuucugaacacuucuucccauuuccugcaaacuucucuuaccuuguccuuaccugccuaagcguugguacacaagguccaagccaccauuagugcccucuuggccacacugggauacuaugaaggagaaaaggcaggaccaucccgggccuggaaaccuuagguacugggguagggaaugguaaacccaguuaagccggccccucuuccuccuguccaugccacuccuccccaaacaauucuaagacugaagacaaauccccaaggggcucguuagcacaccaggugcagcugguucagaguucccccaagaggcugagacugcacagucuccugggaccacagccccacaucuucauaggguuuaguucucauaacuugcucagacugugaccucuggcaagcuccggcccagagcucaccuuccuggagcccacgcuuacgcucucucacccccaaccucccucgcacauccggccagcacuuaccccucgguggccuuggaaagcgaucacuggccguaccugcaggaagagcccaaacaccagcugaacacaaaggaagcaaaguccccaggaucgaggaggcuggggacaccugccuggccggcuucacuuggaggcggggggacuggaaucugaaaacccgcacaaccccaagucccuucuccagcauagccuugggaggccaaggucugguuggccgggaagggaagaaggggccgggggccagucucaccuguugcugcugacacucuugcaaugcccgcagcgccgccucguugagccuuagcaucaggaggcugguccgagcagcgggggugaagaggagccgcauuuucccacucagagcuuccuggguccccuccauggugccaaagucgcgcacaugcagaaccgggaccacaggugagggccaccucugcugugcaagccuaggcuggcacucccgcccuccgggucugucccgcccuccaccaugaccccacccccggcaccgccccaaaguuucccuggccuugugggcgguaccucacucaccucagcugcuggccagaacccaagcgguuucuucuugauuuggcuugggcaguauuggacacuaugaggagcauuccaggucuaaugagaaaggaucugcuucgagggucugaccugucacccaggaugucuuguucugccucaguuuucccaguuuccccauucuggauucaaaaucguugucuuuaaguaaaagcugaaccugaaaccacuugaggguuucagucucacaggggagggaaucgagacugguugauagucggauugagucauuuaugccuccgaggccccgaaguaccuaagggaccagaggauggcagaccccaagagggaccagugcaauccuuuuucuuuuuccgcccgaguugcugcgucugcugaggcggaucccaauuugguuucuaaaagggacuugaugaggcuguaaggccaggugggugggugccucgcagauuuggaagucuggcuaucugggacuggagccaagccuaucgguggauggggguguggggcgggcguaguuguggcaauaaauaaauaaauaaaauaauaaaucagagagcagaaagccguaacucacucccagguguuacuauguagccuaauaaacauaagagaaaguggcgaaaccacagcuggcuccuuuaaaggcacucuccccuccucuuugagucuuuuguuuuuucuuuuagacaggguuucauucacuauguagaucacucuugcugaacucacuagcaauucuccugccuauauuucccaaaugcuaggauuacauguguuagccucuacucuugacuaaaaggugccugcaaguuucccagcagggcuacagauccuaugguuuugagacccccacccccaccccaccccaccccacccccgacaaaucucaggccaguguuuccugucuuuauuuauuuguguuugguuaugucucucagacucucuuaucuccuuuuuuccuaacugggaucgaauaacugggauauauauuuuauauuaguguguguguguguguguguguguguguguguguguguguguaauuccaagugauuuuaaugcuguucaucucaaaacaaauaauuugucuaaacccauugaacaaugcacucagaacauguacaauauguguauaagaacaauacacuccuauaugcagggaaauauucgcaguaaugcugauuuuuguuuguuuguuuguuguuguuguuuuucgagacaggguuucucuguauagcccuggcuguccuggaacucacuuuguagaccaggcuggccuugaacucagaaauccgccugccucugccucccgagugcugggauuaaaggcaugcgccaccacggccaggcuuacugacuuuaaaaucuuggcaacaaguugccaacagcaaccacagauacauuuaccuaccuauugagccauuccauuucuguggaggacaguuuauuaacuuuauaaauagugguagcccucuauuuuucuuucuucuuccuuuccuuuucuucuuuucuucucuuucuucuucauuuuagagucagggagcucacucuguagaacaggcuggccucaaacuca

SEQ ID NO: 1033 - RNA, 5271 nt, Mus musculus
ugaguuugaggccagccuguucuacagagugagcucccugacucuaaaaugaagaagaaagagaagaaaagaagaaaaggaaaggaagaagaaagaaaaauagagggcuaccacuauuuauaaaguuaauaaacuguccuccacagaaauggaauggcucaauagguagguaaauguaucugugguugcuguuggcaacuuguugccaagauuuuaaagucaguaagccuggccgugguggcgcaugccuuuaaucccagcacucgggaggcagaggcaggcggauuucugaguucaaggccagccuggucuacaaagugaguuccaggacagccagggcuauacagagaaacccugucucgaaaaacaacaacaacaaacaaacaaacaaaaaucagcauuacugcgaauauuucccugcauauaggaguguauuguucuuauacacauauuguacauguucugagugcauuguucaauggguuuagacaaauuauuuguuuugagaugaacagcauuaaaaucacuuggaauuacacacacacacacacacacacacacacacacacacacacacuaauauaaaauauauaucccaguuauucgaucccaguuaggaaaaaaggagauaagagagucugagagacauaaccaaacacaaauaaauaaagacaggaaacacuggccugagauuugucggggguggggugggguggggugggggugggggucucaaaaccauaggaucuguagcccugcugggaaacuugcaggcaccuuuuagucaagaguagaggcuaacacauguaauccuagcauuugggaaauauaggcaggagaauugcuagugaguucagcaagagugaucuacauagugaaugaaacccugucuaaaagaaaaaacaaaagacucaaagaggaggggagagugccuuuaaaggagccagcugugguuucgccacuuucucuuauguuuauuaggcuacauaguaacaccugggagugaguuacggcuuucugcucucugauuuauuauuuuauuuauuuauuuauugccacaacuacgcccgccccacacccccauccaccgauaggcuuggcuccagucccagauagccagacuuccaaaucugcgaggcacccacccaccuggccuuacagccucaucaagucccuuuuagaaaccaaauugggauccgccucagcagacgcagcaacucgggcggaaaaagaaaaaggauugcacuggucccucuuggggucugccauccucuggucccuuagguacuucggggccucggaggcauaaaugacucaauccgacuaucaaccagucucgauucccuccccugugagacugaaacccucaagugguuucagguucagcuuuuacuuaaagacaacgauuuugaauccagaauggggaaacugggaaaacugaggcagaacaagacauccugggugacaggucagacccucgaagcagauccuuucucauuagaccuggaaugcuccucauaguguccaauacugcccaagccaaaucaagaagaaaccgcuuggguucuggccagcagcugaggugagugagguaccgcccacaaggccagggaaacuuuggggcggugccggggguggggucaugguggagggcgggacagacccggagggcgggagugccagccuaggcuugcacagcagagguggcccucaccuguggucccgguucugcaugugcgcgacuuuggcaccauggaggggacccaggaagcucugagugggaaaaugcggcuccucuucacccccgcugcucggaccagccuccugaugcuaaggcucaacgaggcggcgcugcgggcauugcaagagugucagcagcaacaggugagacuggcccccggccccuucuucccuucccggccaaccagaccuuggccucccaaggcuaugcuggagaagggacuugggguugugcggguuuucagauuccaguccccccgccuccaagugaagccggccaggcagguguccccagccuccucgauccuggggacuuugcuuccuuuguguucagcugguguuugggcucuuccugcagguacggccagugaucgcuuuccaaggccaccgagggguaagugcuggccggaugugcgagggagguugggggugagagagcguaagcgugggcuccaggaaggugagcucugggccggagcuugccagaggucacagucugagcaaguuaugagaacuaaacccuaugaagauguggggcuguggucccaggagacugugcagucucagccucuugggggaacucugaaccagcugcaccuggugugcuaacgagccccuuggggauuugucuucagucuuagaauuguuuggggaggaguggcauggacaggaggaagaggggccggcuuaacuggguuuaccauucccuaccccaguaccuaagguuuccaggcccgggaugguccugccuuuucuccuucauaguaucccaguguggccaagagggcacuaaugguggcuuggaccuuguguaccaacgcuuaggcagguaaggacaagguaagagaaguuugcaggaaaugggaagaaguguucagaagaucuccaacucauuuuucuauugucuuucccacucuucuuucaagaucugggccgaacugucuccacugccugggcucccuuagagagcgacucacuauuugggcagccauggauacuaucccagcuccacuguuagcucaggaacaccugacugaagguaccagagagucugagagcuggcaggacacuggagacgaaccugaaggccauccccagcuggcaccagaugaggugagacuagaaacagcagguagucaucauaaggugggacacccagguccagggagccaaguuuuccuauaacuuccccugacaggugucugacccacuggcaagccaccaugaacagucacucccaggauccuccagugagcccauggcacaaugggaaaugagguacugagacaggcugggucuccucucuacccuuacauuucuuuaauaagcucucaccuuggccucucccauuccuuccaaaaauccuaggaaccacacuuaucuuccaagcagagagccugaucagucccugcuuuccccugcuagccagaaacgccuggacaagguaagcaaggacuuuagucucuuuuuggagucgguucucacuguguaauccuggcaugccugggagcuccuuauguagcacugacuggccucaaacuccuuucaccugucccugcuuucugagugcugagauguccagagaggcaagagcuguucaaagaguaguuuaaaaggcagggugaaucuuggguugacacaguacugauacagcauaaaaucuggcccaugcuuauaaucugaaggucuccagagauaggaggauagggcuaugcucugcugcacagcaugaguaugaggccagccugccuggacuaccuaccuaaggacuggucucaaacaaaacaaaacaaacaaaaaggcuggagagaugacuuaucaagugagugcaagcauaagguuugaacuuagucugaaucccagcaccuauguaccuaggacccagccagccuaggaaaaccagcuuucaguuuagugagagaccuuaaaagaguaaggcagagaacaauggaggauaccccgugucuuccacaugugugcauaccagcacauacaaaagaauacucuuuaaaaauuaggcuaagucuuaaaccuaggagcugaugggauagcaguuuuugaccaaagaaccuucuagcuuguuguuuguuauacauauuuuuucccccaacagaaacguucagcaccuauaaccacugaagaaccagaggaaaagaggcucagagcucugccucuagccucaaguccacuacaagggcuagcaaaucaggacucacaagagggagaagacuggggccaagaugaagaugaagagggagaugaagauggagauuccaggcuugagcagagccucucagcuccaucaggugaacugaugagaggaggguaaauacucauggaaaaaggaccaagaauuacuuguuuucuugcuuccuuccuagccucugaauccccaagcccugaggagguaccagauuaucuccugugaguuuccccacacuuucaauuucauagucuguacuuguaagcagccaagugcuuuuagggacaaugaaauugaaggugucacaccccuggcaggcaauacagagccauccacagcacagagcagcaacaggccuaugagcaggacuuugagaccgacuaugcugaguaccgcauucugcaugcucgaguuggggcugcaagccagagguucacagagcugggggcagagaucaagagacuucagcgaggaacuccagaacacaagguaaaggcaggauuggccaucaucauccugcuaauuaccccuaaacauguaaugugacuaagcaaaggaacaagcaaaccuguuguaacauuugguagaaugaaaacagaagucacucccauuccuuacucuguccucuuugcccuucccuucaguuuuguguuacuguguuucaggugcuggaagacaagauaguccaggaguauaaaaaguucagaaagguaagacaggcugugagcacaguaguauuaagguagaagccgcuuuacuuuuugacaagggugcuuuuucucugcagcgguauccaaguuacagggaggagaagcaucgcugugaguaccugcaucagaaacugucccacauuaaaggucucauccuggaauuugaggagaagaacaggggcagcugagacuguccagagggcucggaucuuccccggugaugaacacaacagcugcuuuucugauuuugucccuuacauccacagugaccaaguagagagccauccuagguucuugcaguuugauuuuugauguugccauaauuuuuuuuagggugugggcaugguaucaucuccucagcugugccaggagacuaggaaaguaggaggugcuuggcuucuucaacuuuacuuuagcuaagucauuucuagauccugaaaagugacauuuccagguuaaccuugagaauauuagacaaauaagcaacuugaggggaguugccuugcagggauaaaaugagaacuucugaugacagaacucauugaacuuauaguguaccuuuauguaacauggcugaaaaauuaaaacugauugcuucugucuuuugugcgaucauua

SEQ ID NO: 1034 - RNA, 4231 nt, Mus musculus
aagaauguccagugcugagguuuauuuaaacuguagagcaagucuagaaccagaaaagcuccccacgaacagggacaauuucuaagaauagcacuuugucagaugaucugcaugagaugacgggggcaggaaagaauguuuaaaaugcacagacuuuaggggccucugagugcacaauacccuccagaaggauguugacaguaaaugcuaccaaucuuucacauuuggcccaagguuuaaaaaccucuuucuuucacagcaacgaggcuuccuaccuggccgaguuauuuggacccuuguggauuaucaagguuuacaaguaugaguuccaggugagcaucaagagcucaaaaccccaacaacccucccccaaacacagagacacacauccuaccaacuucuacccagaaugcucagauucuagcugcuguuuccuuuuauugaguacccacaaugugcuaggcacugugcuagauacuuuacauacauagucucauuucauuucauccucacaacaacccugugagguagguauuuucuccauuucacaaauggaggaauugaggcacaaaagauuaaacaucucaccaaaguuugcauagccaguuauaugcuggagcaagaauuugaacccaggugugccuccacuucuuacaccaggucaaucuuuucaaaggggagauuuucuaaauuagcacccucacacugucuuaaagccauuucaaaacguguugccuuguuuuacagaagcccucagucuguuucugcugcccccaaacaguggagccagaggauggugagucacaugcgcaaucuagccaagcugaacccugugaagggccagagcccucaagagccuucacaauaguugggggaagggagugucagcaacauugcuccccaucggcacuucucucucuagggcaaaggagcagggccaggucagcugaccaagagaccccuccagcugcucaggugcagagccagcaucuuuccuacagcuacucuggcuuccacuucgccuucuuccuugcuucacucuaugucaugguuacccuuaccaacugguucagguaagaagaaagcagacauaagauacucuccugaaaaucuagcaauuuuaaggaaacacuuuaaggccauuccaaaaguucuugggagagacacacaaggaucugcccugguuaugaggaaguagggagguucaaaagcuaaggcccugcaucaucucuaaucagccuuugguuucacagcuaugaggaagcagaacuggagaagaccuucacuaaggguagcugggcuaccuucuggguuaaaguugccucaugcugggccuguguccuccucuaucuggggcugcuccuggcaccacugcuggcuccccacucagaaucaccaccacccuaguauauucaggcaacacugccauggcaucaguacugccacauaaaaacuggcucuugaucuguaguaacaaacugggagacagacccuuuagauuaugcucuuaaucuuagcuccaggaacacccagcugaacucaauaccucaaggacaaaugagcaguuaucggugcauaggcucaguaaguaucuaaauuugaagaagcagacaaacucacuaguucauuaaagcucaagagucuaacucccaggaaguaaacccaggagccuuaccugauccuagcaguguggcacaagacccuuucugguuccagggcuggagauaaggucagggaaagaccuacagagauugaagauuugggucugcucuuagcaaucaaaaggaaaugaguagcucagcccuaagcagugguggaagaagcccagaccacagaacaaaccagggcaggggaagaagggagcagaggcuaccauagguuuuaauccuggucuugaggucaaaggaaauggaagacaaaaaccaccuucauuccaugaggauugacagaacagaagagaaugugagcauccagaguggcugaccaccagaaguuggugagcagcaggauuuuuuuuuuuggccaacuuucaagcaaacaaagaaugaagagacauaaauuugggucuuagauccuucccucuuaugacccucaauaccauccuggggaugguguccaaggucggugugggggauaaaaaucacagaaaagaagucucuauaguucuuagaggacuccucugccauauaacuggagugcuuuuccgguugcaauaguuaaaauaaaggcuucuucugugauguuuuccuuaugaagucuacaaauccauaaucucuuaggugccuaacaaaacuccccccuuuuaguggggaagggcagucacuccuccauccccaugcccccaauccccagucaaaccaggcgcucaaggaauuacaaagcuacuuuuaauacuuuggggugugccccacaggaauaaaaaacacugggaagggguaacccccucacccccaggaguggcccagagggagagaggcuaccugaggggaaggaagcacaaaaggaacccgcugcagacucagggcaaagggaaugccaucggugcugggaccugugagcacuacaggaagaaacucgagcauggugggacuggcuccaggcacacaggcggagggcaagaggguuggacacgaagccacaaggcuacuuggguuccuccuucuucucguuugccuuuuucugcuucugcugcaugaucuccgagucccuggggguagagaugauggggcacugggagguaccagagggcaaaaaggacaagaugcaggggaugaaggguacagaggauaagauggaaguggaugggacaaaguucagcauauggcugcuauauucccacccuaggagaacaagaggaacagagcuaagggucaaaaggcaaucaaucagucuccauauggcuguugcccaaggggucagaagucuggccgcucaggcccaaggcucucuauucuguacuaaguaccacaccccaacaacacuagugagaaagucgggaagagggaggagagacaagcagcaaggagggucaaaaguacugggcugucaaaacaacuacacuugauaugugaagccccugcccuugcccuuaaggucagaacuaaggcccgcagaaaucagccugcggacagggacccgccccagucccuuccuguauggcugugaccuaacaauuuagaguggggaggaaauaaaacccuagaggaagcaaugcacucugccccucacaucuaaccuagacuuggacccugcaauagcucucucuccugguacaccccuuucucuaacccaggucuccccguccagucccggcccgacccuuccuuuucccucccuggggcuaccucugcuugcgggcggcagcagaaagcccaucaucucggcgcuuucccuuaaccgagucgcucugcuucuucauguucuucuggcgggcgagcucucgcugguuaccgccuaagaagaagagaagguacaaagugagacgccggagccgcuccacguacacaccagcgccccuccuccccgcaacugggaccccgaccguccccccaacccccgccgcagcgccgaccccaucgcggggcuucggcugcccgggguagguuaacuugggggugcgggaggacggugcggucgagacugcuggcggcgcgcgucaaguuugaggcggcgcgggggcccagacagcugcugcggugugugggacgcgccggggccucacgggcacgcgccggggcccaccacucagggaacccggcuuccccagcgcggaaagccggcggcggcccgcgcccaacacaggggucuccgcaaguggcggcgugcagagggcugcgcuuccggcugggcgggaggcagcuggagagcgcucccuaaagacccuuccgcccgccggggaagccgaggggacgcacacgccggcacccgggcgcgcggggagcgagagcagaaagaaaagggagagaggaaaaggucccagcacucacgggucauggcgacggcagcggcuccaaccugccuccguugcgucccccucguucgggccgacguugcaggccccgcccccuucgcgcgacgccaccaagucgucuucuuccucccgccccuucacgcccgggcgcccgcuuucauugggcagggggaaacacguggagugcggugccacgcgccagucccggagggcgaagagcggagcucggcgggcggagcgcuggcacggggcggggcuucc

SEQ ID NO: 1035 - RNA, 5849 nt, Mus musculus
auaaggaaaacaucacagaagaagccuuuauuuuaacuauugcaaccggaaaagcacuccaguuauauggcagaggaguccucuaagaacuauagagacuucuuuucugugauuuuuaucccccacaccgaccuuggacaccauccccaggaugguauugagggucauaagagggaaggaucuaagacccaaauuuaugucucuucauucuuuguuugcuugaaaguuggccaaaaaaaaaaauccugcugcucaccaacuucugguggucagccacucuggaugcucacauucucuucuguucugucaauccucauggaaugaaggugguuuuugucuuccauuuccuuugaccucaagaccaggauuaaaaccuaugguagccucugcucccuucuuccccugcccugguuuguucuguggucugggcuucuuccaccacugcuuagggcugagcuacucauuuccuuuugauugcuaagagcagacccaaaucuucaaucucuguaggucuuucccugaccuuaucuccagcccuggaaccagaaagggucuugugccacacugcuaggaucagguaaggcuccuggguuuacuuccugggaguuagacucuugagcuuuaaugaacuagugaguuugucugcuucuucaaauuuagauacuuacugagccuaugcaccgauaacugcucauuuguccuugagguauugaguucagcuggguguuccuggagcuaagauuaagagcauaaucuaaagggucugucucccaguuuguuacuacagaucaagagccaguuuuuauguggcaguacugaugccauggcaguguugccugaauauacuagggugguggugauucugaguggggagccagcaguggugccaggagcagccccagauagaggaggacacaggcccagcaugaggcaacuuuaacccagaagguagcccagcuacccuuagugaaggucuucuccaguucugcuuccucauagcugugaaaccaaaggcugauuagagaugaugcagggccuuagcuuuugaaccucccuacuuccucauaaccagggcagauccuugugugucucucccaagaacuuuuggaauggccuuaaaguguuuccuuaaaauugcuagauuuucaggagaguaucuuaugucugcuuucuucuuaccugaaccaguugguaaggguaaccaugacauagagugaagcaaggaagaaggcgaaguggaagccagaguagcuguaggaaagaugcuggcucugcaccugagcagcuggaggggucucuuggucagcugaccuggcccugcuccuuugcccuagagagagaagugccgauggggagcaauguugcugacacucccuucccccaacuauugugaaggcucuugagggcucuggcccuucacaggguucagcuuggcuagauugcgcaugugacucaccauccucuggcuccacuguuugggggcagcagaaacagacugagggcuucuguaaaacaaggcaacacguuuugaaauggcuuuaagacagugugagggugcuaauuuagaaaaucuccccuuugaaaagauugaccugguguaagaaguggaggcacaccuggguucaaauucuugcuccagcauauaacuggcuaugcaaacuuuggugagauguuuaaucuuuugugccucaauuccuccauuugugaaauggagaaaauaccuaccucacaggguuguugugaggaugaaaugaaaugagacuauguauguaaaguaucuagcacagugccuagcacauuguggguacucaauaaaaggaaacagcagcuagaaucugagcauucuggguagaaguugguaggaugugugucucuguguuugggggaggguuguugggguuuugagcucuugaugcucaccuggaacucauacuuguaaaccuugauaauccacaaggguccaaauaacucggccagguaggaagccucguugcugugaaagaaagagguuuuuaaaccuugggccaaaugugaaagauugguagcauuuacugucaacauccuucuggaggguauugugcacucagaggccccuaaagucugugcauuuuaaacauucuuuccugcccccgucaucucaugcagaucaucugacaaagugcuauucuuagaaauugucccuguucguggggagcuuuucugguucuagacuugcucuacaguuuaaauaaaccucagcacuggacauucuucagugaguccuggguguccgcucacacuucccauugguuggcaccuuuacauaccaagcaaagagcacacaagcauacaugaugccagcacuaaacacugcuacugagguauccgguauuugugguuccauuuuauuccggccaggcagacacaaggugugauucuguccuugaaagguuacugccaaggggcaaugagagaacaggguuaugaacaaagcuggguauuuugaaggcucagaaaaggucuuaagcacuauacuggcagucuggguccucacuugucucugggggacggcuggacagugcagagaaggucagauacaugauauagcagcugaugauagaggcuuguaggaggccagaguuugguugcucuagggagaacaggaguuaguacuccacugcaccuguucccccccccuccccccccauauacucugggggagagacaaaagcagcagagguacuuuagauagcugagacugggaaggccaguaacacuggcuauaauucucaaagggacacaccacacccccaaaucugcaauguuaaauagcauauacccacugcggcggaugcaaggugcgauggagaggagagacaggaggccacagaagcaaaggugcagacugaguaacaucuuguugagcaggcaaccgucaggguguguguacugguggaacagcaacacagcucccacacccgccaugcuguagaacccuaguguggccagugacacaccuaggagccagcuacagucuugagcugcaccagucugccuaaagacaagugguuaggggauuagaacuuuaacccauuacugguuagucagccuacugguccgcacaguacauucuugagcuuuugguucauuuguugacaggauuguaccuacacuuaagacugcccuugaacucuugccucugcauccugagucuugagauuauggguauuuaccacuuuuuguuuguuuuuggggguuuguuuguuugagacaggguuucucuguguaucccuggcuguccuggaacucacucagaagaccaggcuggucuugaacucagaaaucccccugccucugccucccaagugcugggauuaaaggcaugugccaccaugccuggugccucuuuguuuuaagaggcugacuuuggaacucccugcucugcuuguguuuuuuuguggccuugaauuauuggcccuccuguuucuuuccuccuccagugcugggaucacaaguaaaugccauuaaauaucugauuuccugaguauuuugguauucucugggaggccaugggagcaaacgugcuauggccuuugccuagccuuucuguacugaguaaugucugccaaccuccuuggaggagccuuuaggguuaggugcuucuuacaaaugugugugugucaugugugguuaugagccaccaugugguugcugggaauugaacucagaaccucuggaagagcagucagugcucuuaaccucugagccaucucuccagcccaaccuuaccaauucuuguuccaggacugggcaaaggcugugauaagcaccagcuguaauaggaugaaugugaagccuccacagaugccaauauaaugccaggcugcaagacaggcaccauugggaacuuuuagcucuggcuggucaugauguaucauauccccccaaacccccaccccuuuugauuaaaaugcugcauagccuaggcaggucucaaacucaauccugcuucacucuccugaaugcuaggauuacagguguguaauguaaguccagcuuccugcucuuaaguaggaaguuguagccuacucuugcugaucacaguguaagaugaagaguaccugggaagagauccucaucagggaugcagaaggcaacgacacagagaccuaacaggaacaacagcuugaggcuccagaagcuaguuaggguagagagaaaaccagauugaggagaauaggcaaaggagagaaagaaaaaaaguauggcagguggaaccagccccaacccauuguaguccaaguucuaacucggaugccacagucacaucugagcaacacuacaguuagagaagguuugcauauaacuauuacuuaaaauuuagagcccaggaguuuauaaacauacuuucuuuauuacaguguucuuucuucauccuggaguuucuuuuagccagcuugugucuacuucccucuaucccauccccauccaaaaaauuaaacacaaaccuguuaugcagcugugcccgaggguuggugggggaguggaggcgaacuagcagcacagccugcagcagguggaagguggcaguuccugcacacacucgauacacagcgccagagccacugagaacugggcaguccgagcugccaaacaggugggcacauagcacugagggcaucuggaucugcagggaguugguugugagaaaagucagggccagccacaaucuauggacagucucaacuuuuuacugguagguugacuccuuugcucccugucccaaaucuuaaagguuuuuuuuuuucccucacauugcaacccuugccgacuuaccccaugugcuuugccccagacccuuucuaccacugucuucgaaagcaggaggcagcagauugcugaggcucccacguggaggaggauguagagcaggcggcuacaccuagacucugucagagaguggcagccacugguccaagaaacagguccacagcaggaugccuggggauagaagcaaugcagaguuuuucaaagggugugggguuaaccaauggucaaauucccaaacccuccauccuucugucugguuaugagccucuuaggauuaccuuccacaaagcacuaguaagguuuucauugcaagaacuuuaaacuuugguguauucuugaaccacuuaacuuuuuccuaaugaucuauggcugggaauguggaaugagauguuuaccuauuacccaggcaaagaaccagguuucucaucccaacuccuagcuuuuuagcuaucucuucccaaaugucucaccugauugaaggggguuuccacuacauuacugacuccaccgugcugcugugcaagacccuggguggugcuccggccggugacaacuuuugcacccaucauuuuuguuagauguagauccaguauuggaaaaacugacgagaaacagcagcuucucgggauuuucgcccauuggacagucgcuuugcuggccuaaucauucgucuuaaggcagcauagacaugucauaaaaugaauacagguuaccaggaagugguagauagaugcaaauagucuugugaagaugccuucgccgggcuuccuauucgggaucauucggacuguuauucugagauuaggagcaguuggccuaucaggucuagggauuagguuuuuuaauugguuuaggauuagccaccuugauuggacagaauuccaugugugugucucuaugugugaaaggauugcucuuaggaacaaugugccuuggugguguggguagugaacagauagucgaaggagacugcagaaaacaagcuggagaggaagucaaaagcgaaccucuuugcuagcugaagcuucucaagacaggca

SEQ ID NO: 1036 - RNA, 1817 nt, Mus musculus
uguuucccaugugguaguuauuagaaacacuauggcaguagaggaaucacacacacaauauaagagccugcauuugaacauuagguacuucuuuauacugauuguucacacaguuucaucaagguccaacauagaaacugacaauaaaauagaauauauaaugcauuugaucugagaugaaacugaagaaaaaaaaaaaacagcaaaacagaacacuuuauuucagucagucagucaguccagaaugucuaaaaaagcacauuaucaguugguuagggcaauaagagccuccaccacauugcccauguguucccucaagcuccuuucugcugcugcucgagagaucuccauuuccgucaucugcaaaagggaaaaucacgucaccaaagccucuucuccacuuguuucaggagcccaaauuagguagcacuucucuugugaauccauuaaaaaauuaauacucacuaucaacuccagaucuuccuucuugauagugaccuucgccaguuccuucucccuguaaauauuuauacauuucuuuucauucucugccucugcuauaaacucccagaaggaacacucccagcuacucacugaaaauggguggaacaagguuuacugaaaauagcaaauaaacgcgccaacucuuuccccuggagguuuuacaguaagguauccuggaaucuuuccuuccacuaacaaaguuguaaucccuagaucuguagaaauugguuaaagacguaaacuuuuuuuuccccuggagaacgaggaccuaccgguagugcugguggugugcuuuaaacuuaccgcucuuguuuggccuuuuguucccuggaccgucugucuccaaugacggacauagccuguagaaaacacgagucaaguuaucuaccaccgugccacgcaaauuuucugaucuaaaacgcaauaccaaaaauaaaaaccacgugguuuucagguauucacaacuacgaguguucucaggaccaaaggacuacgccuaauuucgugcacaugagaucuauuuaggcccaaucucuaucgaauucuuaagcaaacagcagacugggugggugcugucgcuuagccccacccuacugccaaaucccaccauugcuaucagccuucccggagccccagugagcagcaaaccggucagucucaccucucucccgccccucucucaaccccucauacaagcucccagccaacuucaccguuucaagauucgaacucuggaucuccuucuccuccgcauagucaguaacccgcucuaggucagcagcaccacugucauguuuccuuggcuucucgggaggccgcuccgggccgcuggucucggucucuaacuccaacuccacgucucccucggucgccauuucgaucucaccgcgccgccgcauaggcugccgcuucacaacuuccggcaacccucacagcuuccgcccagauaaggggcgggguaggcguggaccacaccuuugugccugucuugagaagcuucagcuagcaaagagguucgcuuuugacuuccucuccagcuuguuuucugcagucuccuucgacuaucuguucacuacccacaccaccaaggcacauuguuccuaagagcaauccuuucacacauagagacacacacauggaauucuguccaaucaagguggcuaauccuaaaccaauuaaaaaaccuaaucccuagaccugauaggccaacugcuccuaaucucagaauaacaguccgaaugaucccgaauaggaagcccggcgaaggcaucuucacaagacuauuugcaucuaucuaccacuuccugguaacc

SEQ ID NO: 1037 - RNA, 509 nt, Mus musculus
ucuuuugaagagucuucucuuguugccuaagcuggccuacaaaacacggcaauccucuuucaccuucccaaaugcugggauuacagacgugacccacguauccggaugaaacacuuuacacuucuagcuuuuuauuuuuuauuuguuuuuucuuuuuuguuuuuucaaaacaggguuucucugcguagcccuggcuguccugaaacucacucuguaaaccaggcuguccucgaacucagaaauccgccugccucugcuucuuacugggauuaaaggggugcaccaucauuuucggccacacuucuagcuuuaaacaguaugcaccaacagucucuccuaaaauguaauaaauaaaaucuuuaauccgaaccuuccuggaccuuaccaaaaccaaaagaaacaacugucagacaggaggaccuuccaguucuugagcgguugaagacgagaaaauugccuuaggaaagcgcacaaauuucaagcuagcccuuuaagcgaucagcgcucag

SEQ ID NO: 1038 - RNA, 39465 nt, Mus musculus
cggcugagcgcggaucgcuuaaagggcuagggugagauuugcgcgccuuucgagcaaguuucccgccuucgacauuuuccagaacuggaagguccuccugucugacaguuguuucuuuugguuuuugguaagguccaagaagguucguauuaaagauuucauuuauuauguuuugaagaaacugaguauauuaggagagacuguuggugcauauuguuuaaagccuagaaguguaaaguguuuuauacggauacgugggucacgcauggaauuccagcauuugggaaggugaaagaggauugcaguguuuuguaaaauuaaaaaaaaaaaaagaaaagaaaagaaaaagaaaaaaaaagaaagauaaagaauuaaaggaggaaauccguuaggggucauuuguugguuuggacacacacgcucucaauuuuagcacugggaugaccgaggcaggugcaucucagaaacugaggcuagucggucuacauagugaaaauucuaggaguauuacauaggucuuugaagguuaauaauuauuaaauuauuucacuuggguccuugcugggugaagacaggaaauugacaaacuuuaaguagcgaggguuuucaaugaacgaaagaaggaggacgcuuacaaccagaaaugccuuaaagucuaaaguagacagaaaucuuuuuuucuguuauuuuuauuuuggagcuguguugaacaggcaaguuuguuuuugucucuacuuuggugguuguucacuuauuuccucccugaguagcuaggauuaucucccggugugccucuucacuugacacagaaauuuuauauuacaaacucaucagccuaagaaguuauguugcugagcuucgggugccauucagcaguggagcacuugccuguucugagcucaguguaguauggagcagggaauuccauggagaguaaauguuuugggaagauaauuguuuugauucauggcaagucaagagaguguuuggaaaaggauuaagaagguccugacucgaugaaagucgguguggggaaaucucaguugguaacgccgguuucugaggcggucaguuuuuuuuuuuuaaccuugcgacaguguuguaaguaaucuggcuuguaacucagaguaauagaggaugaucuggaaguuuugaucuuccuguguugauugccuaaagcugagauuacagguguggguccccaugcuuuaguuuaugugugugguacuggggauagaauucagggucuuuguguauucuagguaaacuuucuacugaguuauguuccuggucuguggcuuagcuauuaaaguccucuucugccacugcugccagacacaguucugguguuguagcccagauugacugaauugcuacuuguuguugucuaucauccguuaaaccuguguagaggaugggucacaggccuuggccaacacuggccauccauccgcagauuuucuuuauuuagaagcagguggacagguagucaugugcaacuuaaaccagcuuuuucagcacuuagaacccaagcaacaugaacugcuuacuuuccuuucucucucucucucucucucucucuuuuccuuucuuuucuuuucuucccuucuuagauuuauuuauguuauuuauacaaauacacuguagcugucacacauaccagaagagggcaucggaucccauuacagaugguugugagccaccauguaguugcugggacuugaacucaggaccuuuugaagagcagucagugcucuuaaccacugagccaucucuccagcgcccuccuucuuuucuuucagugcucccuuucucuuggcgacuggaguucauguacuacagguuucccuugauuuaccuauauagcugaugaugaagacugaauuucuagcccaccugccuccaccucccaagucuggggugacaggcaggcgggauucaccgugcuuagcuguucccuuuauuaugauugaaaacuguauagcaguggugaggcguaauuuucucauaguuguauugcaagaaagugggcagaaguaacggcugaauguuucuuguuggugugcacucggggugagugcacaccucgguggugguggugguggugggaguucauuuguguacauacaugcacauagagguucagagggcaaucuugaauguccuuccucaggagcuaucuaacuuuuaaaaauucuuauugauauuguuauugaggugcucuggugcacauaugaagaucagaggacaacaaugagaaauggagaaauggcccuuauggaggcucugggaguaagauaaagaugcuaggcuuggguggcaagcauccuaaccugugcaucaucucccuuguguuugagacagcgucuguuggaccugggcucuguguucagguuagucaguuuggccauggagcugcagaaguccacuugucuugcaucaccugugcuugaauuugggugcugggaaucaaacacagguccuaaugccagcaccuguguuauuucuuucaaguucugccuauugacuuuuaugcuuauuuuucuuccaauccuuaugauauuuaugaggauauggaucuuuuccagaggucaugcugcaaaacagcaguauuuuuaaaagcaagaucucgagguguacaaggcucaauauuacaggauccaguguaagugcugauuuagauccugcacccccucauuccggaagcagagcaguaggauuacggggcuagcuagggugacauagagagauguagcuggguuuaaacaaaacaaaacacagccggguagauggcucacuagguagguaagagcuguagccgcgcaaauuugaagcuugagaucaaauucucagcaccgguaaaagccccggcauugaggggauggacacaggcgcauccuuggagcuggcuugugagccaguccugcccgaaaggugaccugcagguucagaccuagaaggugcagaggggugagcuauccagaacacaaaacaaaacaggcgccagaagccuuaauggcccagggaauccacacagcucuuccgugcugaccgcggaggcuccucccucgggcccgcccacaucccucgggccccgcccaaucucgccuuggucgcagcgggaagagcucagcagcugaguggcagaaauaugucuggguccaaggcugaaucugaggaaaaggcaggcuccaaacaguguccccuugugcaggugagaccugauucggcccgggagggaucugcuagucacugucaccuggcgccaaggaaaagcugugauuucugcuuuuuuuuuuuuuuuuucaaauuuaaacagacuauuagguacuuaaauuuugaggaaaauuuacuaacaacuccaggaauuaugguagguuugccuuuaaucccguaacucacaaggcagaaacagguggaaaucuguuagaggccaccaugucacuggucuacauugugaguucuaggccaaccccaagacuguaguguaggauuguaggacuuggggcccuuucuccuggcuccccugcaguuguuuugaagaguuagugugagcuuuaagcaauuacaacuaaccugaaucugaccuuuguuguaaucaccucacacugaaauuugccuucagaauuucuggucagguuagagauuuuuguauccaaauuuuggaggagcaaaaaauuuccuaacaagccaucaauuugaaucaugugacuguggaauaggaguuagacuuguuuaagcagauuuguuucaugcuuugcuauggaagagcauaguccggcguuccuaauacucuuuuccuuuauuucccgaauaggugaaugaauauaaagaaaaugaacauauugcuuauacuucucugagaccgauacagauuacaacuuuaaggaaaacagcuaagguuuaucuuuacccguuuucacucagcaauuccaagcuaggccuacuuaaguuguccaaauccccgguuguaaauaauucuagcaaaucagugguccauaagaagaaagaucggaagaagacucguagaaagguuuuaacuucaaaaaugaaggccuuaucuuccaaggcagauucccuucugcugaaaucauccguggaugcuuauacugaaaguaccaggcugggacccaagaggaccucggauucagcgacucucaguguggacgcggaaagcagcgacgaagacagugcaccaggccuggugagccuucauuagcuguucuacuucucauuuugaaacuagaagcucugaaagcuaagguagugaaggaccuccagcaaaaucuguuuuaucaucuaauauaaacagaaaagacuuuguguauccgugugcuugcguguguccaaacagcagugcgaaugcauguaugugccugacacagggguggguggagguuauagcaaucagaaucagguucucagggaugacagcaggccccuuucuguuaaaaucacuuauucaccugauguaauuguccucucagagacuuacuaccuccaucugcuaaccuaggccuacaccuggaagcuuccggucuccuuaccaucuagucuaggccuagaaaguucuuagccugucagacuuacugcuguaaaagcucacccuuucuaguucuuucugaacuuuucuggcucaaacucugcucccagcugacugcuucagucuggcuucuuucucagccucugacugaaauguucugcuuggccucauucuaacuuggcaguaugccguaaucgucuggcuccuucucauucugucuucaccugagucuagcuuguucucuucugcagccugugucucuaugacggugucugucgguaaagcugccuguucucucucugcccugccccuugaguagguucgccuuccuuucuguuugcuugagaguugggcauauccuguucagucagaucuuucucugauuugucacuuugucugccacucaaucagauaccacuuucaaacugggugcuuccuucuagaaacggaacuauuucuucacugucuggguuuaaauaaaggugugugcuuaggacaggucugcauuccaacgcguguagccauguuggcuacuggauuacaaucccucuacaccuuuaccuguugauucaucuuguaaaccuuuuaauuuagucuaaauuuacuuuauauuuaauauuaucuuuaacauuucuucauguuguucuucaaaacagggucucccuguguagcccugguuguccugcuugucuacucuguagaccacacuagccuugaacucacagagaucucugugccucuucaugccuaaugguaggauuaagaugcugaccaccauagcccaccuucuauaauaucuuacagcacugaugcuauuggucugaaacuguacauugagaacuguuggauuagauuaugucuuaagccaagacuguuggcuguaugagcugauuuuuguuugcauauaauaaauagaaauuacaacuguauagauguuuaagugguguuaucccuaaaauaauauauauauauauauauauauauauauauauauauaaacauugcagcauuuauuuaucuuucuguggugcuagggccucacacaugcuagagaagcacuguucuaaggagacagauuuccagccaccuuuucauguucuauuuugaaacagggucuuacuuuguuggcuagguuggccaugggacuuuugauccuuuugugucauccucauuaucugggauuguagcccuguacuccggggucuggcuaagauaacuuaaucagaugguucauuaguuuguucucuuuacaucaucauuacuguuuuuuauuguggugcuugguaugauuucacagacgcauaggcuggccuagaacucaucugucggcccaggcucuuggcaguucuccugcuucagcuuccaagugcuuggaauuacagaaauaccaaaccugacauucccgcuuuucauuauuuuguagaaucaccuagaaauguauuuuaauaaguuauaaaguaaaucccccucuuguuucaagagccccaguguguuccugagauggugucaggccuugggugugcuguuggagguugucuuucuugcaauucauuuuuuguucaucugagauuucaguuuguagcucuucuauaagaaggugucuuagacgaacagcaaaauauuuugugagaaccuggggguaguagcauauaguuguaaccacaacauuacaggggugugacacaggaggaaugagaagcuagccugggauaaagacagaguuuucuucuuauacugccuccuccaagggaugguauuuugugagaaccaggcauagaaacuuauuuuaaaaugucuucucauuuauaugugugaggaucccagaagagggcguggaaucuccuggaguuggaguuaccagcagcuaugagauagucccagcuggccuuguuaguuauguagauagucacagccccucugcagccacuccuugucacuugcggaaugaaaccuuguccuaagugcaggaagcugucuggaccagcuagagucuagguagacuagugagaaggcuucucuaguugaaggcuguuggccuucuucuggggcagucucucagcuagucucuaacuuaagcugacuugugccauugcgacucuccaugugguuuucagugccugcuucccaggucugugcugccacagccucccgcaucugaguccaccaagcucuucugcucuagcucuggucgcuuuguuauucaaaaagauauuuuccuuacuuuacuuguuggcuuugggagcugcuuuggagaaggucaccuuccucuuggcaggucaccuuccccaaggcagcuugcccuucuuuuacaggcaauugaggaagugauauuuacacauccuucuagucuggugcuucugacccuaaguaacaauugaaaacccaagcuauugugcacuaauguuugcauggucccucccucuuucuuucuuuucucucucucucccucucucccucucucuuguuuuguuuuuguuguuguuuuuuuuuuucccccagacaggguuucucuguguaacagagcccugguuuuccuggacuugcuuuguagaccaggcuggccuugaaccuccaaaugcuggaauucauggugugcaccaacacauccagcaaggacacaauauuacauagcuagaaaauacaauauucaugggucauaacaacagcuggguaaaggucuuuccugugugggguuagcaggugaacaccucuucguccgugcucuggacagagguucuccacugugaacugugaguagauauuggcgaugcuucuucuagggcccgacuuuuagcaucaaugguauauaaagaauuucuaacgacuuuuuuuuuaaaaauaauuuuuaaaauuugggacagggucuccuaccacuuggcugucuugaauuucuuaaaaguucuuuacuuuuauuccauacuaauuuauuuucuuuuagcuuuauuuggcguauauggguguaaguguucugccugcauguaugaaugugcaccgcuugcaugcuuggugcuuguggaggucagaagaggguucucagggccuagugaaucauuuuacacauggcugagagccacugagaacugaacucagguccucugcauuagccgcaagugcucuuagccagugagucaucucuguagcuccauuuuauaaucuuugugugaguggaugcauguagggguggccugagugcccuuagacuagaggacuucugauuuccuggaacugaguuauagacccucgugagccuccugauguggguacugagaacacaacucaggucuucugcaagagcauugaggucagaggacagcuuauaggaguugguuuucuuucuacuucugggaaucugcucuuaggcuucguaggcaagugccuuuacugccugaguucucucuccggcccugcacuuuauuuuaagucuucuuuuaagauggaaucuuaaaucugaugcccuggagcuuucuguguagaccaggcuaaccuggaccucagcucugccuuccccugccuccuguguucugggcaugaagacaugugccaccaugcuugggcuaacucauauuuuuuuuuuuucaggauuuuuuuaugacuuuagauugugugucugaggggguaugugucacuuaugugugcgagugcuggauuauggcugucugauguaggaauuaagacuugaauucugauccucuagaaaagcaguaaguacucuuaacugcugagccaucucuucagcccucagauuuuauuacuuacuuguuugaugugugugcuaucagaaauugaacacauggucuuuacugugguacgcaaguguuaaaccacaccgucagccucuguuucgagugucuuacuauaccuagguuauguuagagcauacuauaggcauaauauauguaugagaaaaauuauauguaaaguuuaugguguucauaguuucaggcagccauuuaggagucuuagaauaugucccuuggggguagggagacaugauaauguguuuuguucaguguauaacauuucagaguugugagauuuucuuuuuuuuuuuuuuacaugcuucucugaaaagcacagagcuuaaaacuuaugaauuguuuauuucugaaaguuccaguggaugcuuuugaauccugguugacuaugacugaaacuguaggcucaaggauagugcuugugacacuccugagaaacgacauaaaaaguuauucuuauguuuauugauugauuugauugauuguggguucauguaguuggaaaucaaagcacaacuuuugagaguugguucuuuccugcccaccuuguggauaugggggaucaaauucaggucaucaagcuaggaagccacaguuauaaggcaguggugacaaaguugggcuuguuggcgugugcugagacugaaaggagcacuaagagugugugaucagccuggacuuagugaguuccaggccagccuaaguagcaagauccugaccccacgggagaaugaaaguggaugguggagggaguagggaucaagcagaguugguagaguggccccucccuguagaagcucuuggauucauuaccagcacccaucagcagcugagguaguguauacacuugggauggugcuagcacuugggagacaggucgauccaaaguuaaagggucauucuuggccauauauagguucaagccuagccugggaugucugaaacccucucuugggcuggagagauggcgaaggaaugaagaacaauugcugcucuuccagagguccuggguucaauucccagcccccaaguggcaguucacacuugucugugauugcagucccaagacuucugacacccucacacagacauacaugcaggccaaauaccaauauguguguguguguguguguguguguguguguguguguguguguguguauauauauauauauauauauauauauauauauauauaugauuuauuuauuucuuuuaugaaugaguacacuguagcuguacagauuguggugagccaucauaugguugcuggggauugaacucaagaccucugcucgcuccagagccucgcucgcuccagcccagagauuuuauuuauuguuauauguaaguauacuguaucugucuucagacacaccagaagagggggucagaucucauuauggaugguugugagccaccaugugguugcugggauuugaacucaggaagaacagucaguucucuuaacuucugagccaucucucuagcccaauaaaguauauauugagaaaagacucuuccagaugucuugaguucaagucccagcaacuacaugguggcucacaaccaucuguaaugggaucugaugcccucuucuggugugucugaagacagcuacaguguacucguauacauaaaauaaauaaaucucuaaaaaaaaaaagaacauguguacauauauacacauguaugauguaacuauuguuuuuuuuaaaaaaagaaaaaaaagaaaaaaaagaaacccugccucaacaaaaccaaggcaaugccaaaugcaaacauuccacuuucccuuggagaagauuauuuauuuggucaaaguaauaaugcacauguucuuaguaagauaaucccacacauauauguguacacauacacauaauucuauuuuggagcacauguucacaaaaauaaggcacccagcacuuugcugcuuguaauccccugaccccugguuuuuaaauuguggcccagggaaauggcucaguagguaaaggugccauuugcuuaggccgacgcugcauugaaucucuaggacccacauggugagagagccagguuuucagagcuguccucugaccuucauauguggaugcacacacauuggcaugcacaauaaauauaaagaugugagauuuaaagaaugagccccaggaauccugccuuugucauccaggggugggauuugcaagugugaaccacccaugcauguauucauugauugcuuguguuucaugguugaugaugauuaaaaauaucuuucaccugcuggaaagaguuugcuguaaugcaugacauuugguucccaguaucucauuacuuuuuuuuuccucgagacacaggacccuggcuguccuagaacucacaauguagaccagauuccgagauccauugacuucugccucccaagugcugggaucaaagguguaugcuaccaugucaggcagauuacuuccuuuuuaaauggaaaaccauacagucaucccaggauaggauucucccacuaucccauccagcaaagacugugaacuguuuguugagauaauaugaaauaauuagugucugugugcaguuugaaaggaaguaucuggguagagagugagugucugguuuuacauguucuugcuaucaaugaggaagugacugaucuuuuuuuuuggguggcugucgcuuauuuuauaggaugauuuuucaggauugucaccuuaugaaaggaagagacugaggaacaucagagaaaaugcaaacuuuuuugcuucccuucaguuagcugagguauguaugaaguuuguaaugaaagugaaggugaugggcuggagagauggcucagcagguaagaacacugacugcucuucagaagguccuaaguucaaaucccagcagccacaugguggcuuacuacaguguacuuauguauaauaauaaauaaaucuuaaaaaaaaaaagaaaagaaacugagagugagcuaauuagauucuaaucuuccauaguguccuaugagggaaggcaaaauucaagcagugugugacgcaaggugguuuguggucauuguccuccugcuuugguacucacugcagagaccaggcugguuuugaauuuacaguggcuugucugccucuaccuaccacagugcuuggauuaaagcgugugccacagugcuuagcugcuuguuuuucuuuguauguccuguuuuagacacuugugagccugcugguggguguugcaugcugccccucccugaacguaaguggaggcuggacuguaguauuucaaggucaucccuaagcuacauaguaaguuugaggccagccuggguuacaugaaacccuaucucaaaaaucaagaucagcaaaagaggacugcaaaccacuugggaaaguuuauuagccaguagguucccagagggucuugauauuuacuuacugggcuccucuucuaagcgaugucugauggcagcccgauccauguuuuuaauuaccguguuuaauugagucuaggcauuuuuuuuucuuuuuuccuuuuuuuuuuuuuuuugguguguguauauuuggaggccaaaggucaaucauggauaagucauucagguguuugccucaggagucauccacuuaggguuuuugagacaggguuucucuguguagcccuggcugcccuggaacuugcucuguagaccagacuggccugcagcucaaagaucagccugccucugccuccugagugcuaggauuaaaggcuugcaucaccauggcugacucuuccaauuucuugacuacauuuauuuugagaaagacaagugcauucuauggcacauguguggaggucagaggucagcugugguccugucccacguggguccuggagcccaaauccagguugucaggcuuggcaguuuuguuuuuacagagccaucucacuggcucuuuuauuuugagacagccuugguagccaagccggccgugaacguacugcauuugucuucagacuccuaaauguuggguuauagauaagugugagccaccucacuccacauaauagguuuuacaguucucuuuugcaguguugugaauacaggcacuccuaugcaugcugagcaggugcugugcuucagagccacacugcccguccugugguaguauguuuacuaaauacuguauuuaauccuguaaacucauaagcaccuugguucaggaaccagaaugccaguauguuagauggcgauauauacucgcuuuuguuauugacaggcgguauauuuaucuacuaacaauaaguaucacaucuuaagacucuauauuuucuaaauaaacguagcuauaguagcagacacuuaauggguaaacaguguagcuauaugguagcauauuuauguguacauauauguugugugcuuuucagucggcugcacggcuccgugggaugauaaagaagcgcgagucaccugagucaaagagguaaaacagaagaggaugugcuuaacauccucuggaccgagaaauguugcugaggguuucaaguuggaccgagaaauguugcugaggguuucaaguuugcgacagggcucaggccucaagcuucuuacugucuucucaaguguuugggucaugggcgugugcccuguugccuagcucacacauuuauuguucacaaagauuggugauuccuuggaagucaugugagucugaagguucuggcauuuaguguuuguagaggcagagguaucagguugguagcguggggguuguaguuggauaguaaagaggacagagccuuugaaagugaacaaaucugggcugguucagugguuaacagcucuucagucgaccuagguuugguaccuagcacccucauggcugcuuaaacuuacugccagggaauuugaccccucuucuggucucuggggacuucugcacaauguagagauuauaagcucacacauacacucacaaauauacauuaauaauaaaauuaaaaaaaaauuuuuaagguagaguuucuguggccguucuggaacuugcucuuagaccaaagccagguuuaaauuuguuaaagaauuaauuuucguguuuuucaagacaggguuugucuguguagcccugacuguccuggaacucuuucuguagacuaguguagccucgaacucagagagauccuccugcuucugccuccugaguacugggauuacaggucugugccaccagcccuuuuuuuauuuuuuugcaucucaugcagaugagacacaccuuguaacacaagcugucuugaacuugugaaccaucgagugaugcuuauaaucugaugccauuuucauauuuuuuggggauuaucuuuuaaaguuucauuaaauuuuguguuuauggguguguacauccuacagcaacuugugggaauugauuuccuuccaccaugugggucccagccuuggcuacaggucccuuugacacugaaccaucuuggugacccagauuuauucuuucauccccccaugugggguguguagugugugcuguguguguaugugguguaugcaggugagugugggcacgaaggcugugugaaugcaugcacagguguguagugugugcuguguguaugugguguaugcaggugagugugggcaugagggcugugugaaugcaugcacagguguguagugugugcuguguguaugugguguaugcaggugagugugggcaugagggcugugugaaugcaugcacagguguguagcaugugcucuguguaugugguaugugcaggugagugugggcaugagggcugugugaaugcaugcacagguguguagugugugcuguguguaugugguguaugcaggugagugugggcaugagggcugugugaaugcaugcacagguguguagugugugcuguguguaugugguguaugcaggugagugugggcaugagggcugugugaaugcaugcacagguguguagugugugcuguguguaugugguguaugcaggugagugugggcaugagggcugugugaaugcaugcacagguguguagcaugugcucuguguaugugguaugugcaggugagugugggcaugagggcugugugaaugcaugcacagguguguagugugugcuguguguaugugguguaugcaggugagugugggcaugagggcugugugaaugcaugcacagguguguagugugugcuguguguaugugguguaugcaggugagugugggcaugagggcugugugaaugcaugcacagguguguagcaugugcucuguguaugugguaugugcaggugaguguguggcuaugaaugcuugugugcaugcaugcacacauuggacauagucgcucucuuauucucuaucuuauuuucacugaacuggaagcugucucuuuugagcgaggcuagucagcuagcucuuagcauccuccucauuucaccuucuaaugcuggccuuaaaggucugcaugucuacauccagcuuuuuacacgguguagcaacugaccaccugcugagccgucuccccucccaguuuguuuucugagauggguccccgugcagcccuguuugccuguaccuauuccacuguguagcucagacuggcuucagacuugugguucucuuggcuuuguguugucagugcacacugccucauugcagcacccacugccucaguuuauucuaugguuaauguccagauuuuuaucauuaugaagagugcuucucuguaccugcuuuaauuaucuaauauuuauaccuguaaagagguggagguauaaacugagauaaaaaccugcuaccucagggagguaacuuuauuuucuuagcuauacacagaauaucuauuuagaagcaugauccugcuaccucuuuagaaaucucuaucuguccucagauuuagagggcuucuaagcucucuuuccuagaagacuguuuuaguguguccugcccacugcuucucugcuguuacugaaaguccgaagagacaauuccugucucuuaccuugagcuccuuucauaacugagaaaagggaagucagaggagagagaagguagggaugugaggaaggagagagggagagagauauaucgaagguccuguugcuuauaaaaagucucuugcuccucccacacagucuuggcaggcugcgccucauuaucauuguggguggugcugccagccaagucuguaggagugaacuguuuuaccuuuaagguggggauagcucaaggccacccaauugucuuugccucaggucauagaccucucugaagcuacuucccuuaauagggaggguugggguuaggguuuaggguuaggguuaggguuaggguuaggguugggguuaggguugggguuaggguuuaggguuuaggguugggguugggguugggguuaggguuaggguuaggguuaggguugggguugggguugggguugggguugggguugggguuaggguuuaggguuuaggguuaggguugggguugggguuaggguuaggguuaggguuaggguuaggguugggguuaggguuaggguugggguugggguugggguugggguuagggguuaggguuaggguuaggguugggguuuaggguuuaggguuuaggguuaggguugggguuaggguuaggguuaggguuaggguuaggguugggguugggguugggguugggguugggguugggguugggguuagggguuaggguugggguuuaggguuuaggguuuaggguuaggguugggguugggguugggguugggguuaggguugggguugggguugggguugggguuaggguuaggguuaggguugggguugggguugggguugggguuaggguuuaggguuuaggguugggguuaggguugggguuaggguugggguuaggguugggguuaggguuaccgccuuaguaggcggcaacuuuccauuccuuagcauucguaucuauggaggcuuuuagaggcacacccaaacugaacugucuccaggaugcaccuaacugcuucugaagaagucauuaucuaucuaagcuuuuuuuuuuuuuuuuuuuaaagauuuauuuauuacuauaucuaaguacacuguagcugucuucagacacaccagaagagggcaucagaucucauuauggaugguugugagccaccaugugguugcugagauuuuaacucaggaccucuggaagagcagucagugcucuuaaccacagaaccaucucuccagccccccuaucuaagcuuuuauauuuugcuaacaguuaaguuuucucuguacaguaauuaaauguccuguaagaauugugucauggggcuggugagauggcucagcagguaagagcacccgacugcucuucugaaaguccugaguucaaaucccagcaaccacaugguggcucacaaccaucuguaacgagaucugacucccucuucuggugugucugaagacagcuacaguguacuuacauauaauaaauaaauaaaucuuuaaaaaaaaaaagaauugugucaugggagaucccuggggguuggaacggcgcaauaggcaagugguuuuuaaccacugagcugcacucuagccacuguucagagcauucugaagucugagcaguugugggugagugggggucucuggaaauagauuccuaugcagcuuguaugagcagcguguaaaucauuaccuaugcuauuaccuuuuuuuuuuuuuaaaaaaaaaaaaacauuguuggugagcaaauccagaacuucaccauugagcuacauuuccaaccuuauccauuaguuuuuggaaguacucuaagaggcaucucuuuccucagcuuucucucccucugguuuuuuuauuuguuucaccgcauguuuuuagugguucacugugugugugugugugugugugugugugugugugugugugugugugugugugugugugugauggccaggggccagaggcuuucucucucagagauauacccuaagucauauuucauuuuuauagacgcauauuauuuuauuagauaugguuuuucuuuucuuguuuuaauugcaaaguuucuuagauuuaguuacuuguguguaugaauguuuugccugcauguaugucuguguaccacaugcaugcuuggugcugagcagaccaggagaggguguggguccccugaggcuggaguuacggaugguugugagccaggccuccugcaugaacaaaugcucuugaccacugagccauuuucucuggcccuaguuguuuuguuuuguguuuuccucgagaaagggucucccgcagcuuuguaaagauggaacagaccuuuaaucccaggaagcacucaggagagagaggcaggcucuguaaguuugagaccagccuggucuacagagggagcucuaggacagcaaggcuuacacagagaaacccugucucaaggaaaaaagggcaggggccuacaauguaucucaggguguuuggaacucaccauguagcuuacaggcugguuucuaacuaauggaaaucuuccugucuuuaugauugcuggguuauaagugugagccacuaugcauggcauuguuugagauaaggugucucuguguagccuuggcugcuagaacucccuguguagaccaggcuggccuggaacucucagagaccugccugccucugccuuccaagugcuggcugggcuuaaaggcaugcaugcaccaccacugccuggcaucugacauuauucuauuagauauauaugguauguuuuguuuaauggcucucaacuucauugugcuaagcuuuuuaguuuagguuauuuugagacuuuauuaaaaucagugcugcccaagagauagaucagugguuaagaguacuugacacuccuauagaauacucagguuugauucccugcaauuacauugggaggcuaacuacugguuguaauuccaguuccaggauauuuaacaaccucuucugaucucuuugggcaguguauguauaugguucacguacaaauaagcacacacacacacacacauacacacacacacucgaguaugacagugcagcuuuguauauuuauauauaaaaugugugauuguaccucugguacacauucuuagauguucauuccuuuaaauuacuaaguauaggacuggagagagggcuaaguugucaggagcacacauuguuccucuccaguguccuggacuugguucccagagcccacagaagugacucacuagcaucuguagcuccaauuccacaugacuggaugccccuggcuuucuugggcaccaggcacacucaugguauacaucagcuuccacaggaacacccaagauagccauaaaaauaaauuuagaaagauuuuuaaaaguugcuaaaugcauuuuacuauucagugagaaaagcaugcguauuuccuccacuccuuuagaaagaggccuaagaagaaagaaaaugaaauuggaugucgaagguccaugcgguuguugaaaguagacccuuugggaguuucauuaccagcaucuccaacacagccaacauuaguagaagaagaagaaaauguaagaagaaauacaaaugaagugcauuuagcuuaagcagaaucugaagaaugguguaaaguauuugaaauuauacuaguggaucuuuguuuuguuucaauuuuauugauucaauacuugaauauuguauggcuuaauaaggcuuuagaguuguuaguucuggguaauaguuuguuucucugcaggaauuguggaguuuugggcaaaucacuugcucuucgugagcuucaguuuucagauuuaaaaaaugugggucccauguguaaucuugguguuugggaggcuaaugcaggaggauggucacaaguuuaaagagaguugaguuucauaguuccaggcuagccugaauagagaguaagaauauuccuagaauaaaagaacagaaguuccaaaauguuauaaaaggaaauuaaguagaauccauaaaggucuucauaagaauuaauacugaguaauauaugaccaaacugauaaaggauugagcugaggagcugucucaccggguaaagugcuuccuguacaaaugugaguacccagcacccacagaaagcuggguguggcaccguguacuuaauuccauagugagguggacagcaaacaguagagacccuguuucaaaucaagauagaaggugggaccaccaacaccagaggcugucugauuucuacauauuucuauaugggugaugggccugucccuccacauucacucgaacacacacgcacauacaucacacauacacaaaaugaaaaaagaggaucccuugacauagcuuuuuuaaagaaaaaaaaaaaagugaacucuugcaguccaaauaguucagggugaccuugaguuucugauccugcuuccaccuucccagugcuggggucagaggugaaauccacaguagccgguuugugucaggcucacuaggcaagcauucugccacaugagauucaucuuaggccuuccuuggcauuaauuuuggaagauguuuuucuaggggauuacuauguaacugaggcuagccugaaacucaugaucccugcuucauccucuugaaugcugggauuacagguggguaccauagugcacugugugacacccaaccauuuugaaugacugguguaccacaguuucuggugcugaaaggaaguagugacaaugaggacugagccccuagcccuucucaguuuacauucuaggacaaaccaugguuugccuuuucuuuuugauagccuuuguuaccuccuggacccuuagaaaugauuccugaaaaccaagaugacagcagugaacuguugaaagcaucuuugaagacaugggcagagaugagccagguaucacuugggaugguuuacggcuuuuaggaucauguacuaaggaaauuucauguaugcauauucacuuagcccuuuggucucuucuaauguuguagacaaguaaugagaagaccaagaaggggcugucuaguauuaaaagguaaguuaaaauuccuuggcuuuuacuuuugaccuuuguuuuauacuuugagaugcuugcaauauaaaagguguaauggauacuauuauaggaaaccuugaaaagugaaaaaaaaucauccguacuauuucuaugcuaacaaugguuugcuugcuugauuucuuuguagugucagggauugaacuaaagccuacaguguacuaggcaagugcuguaccacggaacuaugucucuagccuuauuuuaugcauauuuuauucauuuuuuuaccuuuuugagacagucucauuguguauucuggcuagccucaaccucacagagcucucucugccucccuccccucugcucugucuucugagauuaaauguguuugucaccacaccuggcucuauguaucugaaauacuuauguguaugaauguuuugcccaccuguacauaagggcacacugcaugugucuggugcccacagaggccggaagaguaugcugcaucccugggaacugauuguaagcugccuugugggugaagaauagcaacugcccuuagccccugagccaucucuccaucucucuaugaaguaccacgaaguuguccaggccacauuguacugugcaucaucauaccccgccuuuucucuccucuuacacaguucaggauucucugcuuagggaauagaucaaacuacagugggugcaucuucccaccucagucaagauaauucucuacagacauuccucagaccuacuggacucuccaagugauucuugacaagugauucuaaauugugucagguuuaaaucaguauuaucaccugaaagcagucaggccuuggcuuugcaguccucacuucugaaguugcuaagauauaaccuucagcaauaggccuggccugacacuggguggaagcuuuaugaaggcagaguuuaucucagcccuaugacagcuuggcauaugguauauacucagugcugaguacaggaauucacauuuuauuuaaauacauggugugcguucuguguaacucuaacguguauauacuuccacacugugccugugucgugcgugucugcacaguuacuacaucgcacuuucucuugcccuuuugguguuuggaguuaguuucuguuuaguuugugugugcguguguaugugcauauaugcuaauagccuguugguuagaguuccagacaugggacucaugagccaugcauuggggacauccuuauggcuuuuacuauacaccauugaaucaguucccugaacuuuuucuaaaaaucuuuuaugcuacuagcaggacaagggccaggagugcggauccucuguggcugccucugccaagcugugucuccaggacaagcauaucagauuuaacuguagccuccuaaggcuugcugucaucauuaaaaugaucaaaguuaauuuuauaauugaaaaauaauuaccuugaugacuuuguuuucuguugucaccugggaguuggauauuugccaguauuuaccuuguacguuuuuucauuaucauaagcaaagaguuauuuuuuacuuucuuggacuguugagguuguuuuauuuauuuauuuauuuauugguuuuucaagacaggguuucucuguguagcccuggcuguccuggaacucacuuuguagacugggcuggccucgaacucagaaauccgccugccucugccucccuagugcugggauuaaaggcgugcgccacuaugcccggcugguuguuuuaauuuuuaacuuaccaauuuuuguagcuauaaagccaauuuaaguggcauggucaucagugaggcuacuguucguaaggugaccaaaggagcaaucuccuccguggcccuccacccaucagaagugagaaccuugguagcagcuggggccaagucuggacaaauuggacuuugggauuugguaaguuguuguacuacuaccuuuuggaaguuaucugaagucugccugacggaaaugugugaaagaaauagccuagaacauuuauuuauaaauguuacuugagauuuguuguuuugugcuuuaugauuuuaaauuuuagaaaucugguagaguuuaaaauuguuuuauagaacucuagcacuuuuagcuugaauaucuuuagccaucuggguauaauuaucuggcagagacauuaaguguauaugugaaaaucacaugaaaacucugaguuuuaacauuauguucaaaauagugucugauaggaucugaauguuaaguuuuccuccauauuuguggugaauuuuuaaagguuuuccuuuucuuuuucuuuuuccuuuucuuuuuuuuuucuuuuuucuuuuuuugagacaguucuguagaccaagcaggcuaugaaaucacagaguucugccugccucugcuucccaagugcugagaucaaaggugugugacaugcccagcuaaaagauuuuauuuuuuaacuaaccuucucucucugucucucugucucugucuguuuuuuuuuugagacaggguuucucuguauagcccuggcuguccuggaacucacucuguagaccagguuggccugaacucagaauucugccugccucugcuuccuaagugcugggauuaaauuaaaggcaugugccaccacugccuggcuuauuuuuauuuuuuaauuaaaaacauuauauauauguguguuuuuccuugcauguaugucugaauuguuuuccauaacuggugcucacaaaagccagaagagcguguuggaucuucuggaacuagagugucagacaguuuugagaggacacauggguacugagucaucucucuagacuguuuuauuuuuuaauguucaugcgugcguacacacgcuugcgugugauguguguguguguguguguguguguguguguguguguguguguguguguguguguguguguagagcuuggcaaaagaauugaugaucuaggucuggacacucccucagcuguuaagagcucuuacuguucuuccagaggacauggguucuauucccagcauucacauggcagcucacaacaucuguaacugccguuccagaggauacaauaccuccuggcuucccccuguaccagauacucacaucaacaugcaugcaggcucuuaagagucuuuuucauuccagagcuuccagcaugcgaggcaaauacucuaccaacugaacuacagucacagcacuuacuuaugccaaguaacuuuaaauuucaacuccugagucuagaauuucuuuugauuuuacauauacauauauauauauauauauauauacacacacacacacauauauguauguauguauuauguaucuaaguaaauggagggguuggugaugaaucucaguaggaugcuugccuaacauguauaguucuuggaugucccuggacuugcuguguugaccagaccagacuggucuugaggugguauguugccauguugcuuugacuagcuuuagcagucccccuugccaccaauaagcuaaagugacccucuuuucucaguugucugcugguagaagucauagguuuuuuuuuuuuuuuaauuuuuuuuuuugcuccguuauaacuagcuggacauguggaauaugacugugcauuagcuuuuguuuuguuuuguuuuuuugguuuuuuuuuuuuuuuuuuuuuuuuuuugguuuuuugagacaggguuucucuguguagcccuggcuguccuggaacucacucuguagaccaggcuggccucaaacucagaaauccaccugucucugccucccaagugcugggauuaaaggcaugcuccaccacugcccagcugugcauuggcauuuuuaaacugaauguucagaagggaagaauuucaguacaaaguuguugguucuaguccugugagaugcucagagguaaagaugcuugucuaguggacucacaugcuugaacccagaacucaacaugguggaaggagugaacagacucaaggugucuucugacuuacguaugugcauccuggcaucuaugagggcauguuguugcacacacacacacacacacacacacacacacacacagacacaacacacacgcacgcacacgauuauaaaauguuacuggugcugccugucugggagagugaacacauugagaguuaguacggacagaguguaauuccgauguaaauccuucaaugauagcaagacagcaaccaucacuccuuucccuaguugugucuuuuccucacccccgacuuuguuccagacccagcagagugaagaugcgauguacguuuucuaugcucacagucgguauguuagcugccucuccuucucacccaccaacccagcccaucuacugucccugagcuaugacggcacacugcgauguggugauuuuuccagcgcuguguuugaggagguaauuaugcaaauguauuugcgaccugacaucagaugacauucuggauuaucaaucacaugccacagugauuccugugucauguugagagaagugugguucagcugagggacugacucaagucccagacugucugauaccaguugugugugugaccuucauaagucucuuaacuucugugccuuaguuuccuuagcuaugaaguauuauuuucaguuaucuuccuuacaguguuaugaaaguuaaauuuaauuaguaugaauagguaauuauuuuuaauuuuuguuuuuuugagguagggucugaccaagaagccuaggcugaccuugaacugauuggugauccuccaaccucugccccagaugucugcgacuauaguaugggcaugugccaccauauccuuguuacauaaccauuuuauuguaagagugcuguuguguuucuaggcuuaagcuuugugcauauucauuuugugcuagagauugcaucuagagcgaagaguauguuagauaagagacauacuacuguugagccaaaccucauuuuuuaaagucucauacauucuugcuggccucaaccuccuuacauagucacgaauaaccuugaacuuuugagccccuugccuccauuucccaaaugcucugaaucuauagguaugcaccauggugacuggcuuaugcuguccugaggaucaaacucagggauuuaugcauccugguaaaugcucugccaacugagggacacucccaccucugcccucccagcacagcuuuaacacacauccugaagagauuacccacacuaagaagaugaagcagaugcugucugagacuauuuggagcuugcucaaugugcaugcauuccugugcuugauuuccaacauggcagaaaaggaacagaagaaagaagaguugaaggaaucuuuuaggcuucuuuuugagacagguucuuucucuguaguccugacucuccuggaauuuacugugucaccugucucugccucccugagugcugguauucaaaccuugcauuaacuauuuuuaaaagauaguuuacuuguaaaaguguuugcuguauaaccaugaagaccugaguucaaucccuaggacccacaugaaaaauugguaugcagaggcuggagagauggcucaauggucgguggcugcccuuccagaggacccagguuuagguuguuguaccuacaugguggcucacaaacaucuuaccuccacuucuaggagaucggguaccaucuucuggcaagcuuggguaccaggcuugcauguggucuucauaaguccauccaagaacaauacccguaugcagaaaacuaauaaagcuuuuaaucaaagaauaaagcucuuuaaguuugcacugguuuuugagacagccuugccaugcugcguauguuggcuuggacgugugguuucucucagucuuugaagccagggugacaggcuuguacuucugaaccuguuagccaucaccaacauuauuguagcaaacaacuugccucagugaaaucagaauugaguaaaacaaauauuaauuaagacaaauuuuuuggcauuuuugagacggucucacuauguaguccagguuguccaggaacucacuauguagaacuauacuguccucaaacucucagagauccaucugcuuuugccucccaagugagguguaagccaccgugcccagcuuugaaaaugaaacauuuugauauagcuuuaugaacugugaagaauuuuaaucuacacuagggauguagcucaguugguggagcagggacaaggccuugaguuccauccucagugccacauagauugguaugguagcauaugcuugugucucagcaguucaagguucuccucaauuguguaucuuggguuugaggccagccuaggcuacugagggaccauuuuucaaaaacaacaaccacaacaacaaaagaaauuuaaucagcuuauuccucuaucaacaauaguuagaauugaacaucuagucauauucuuagacuucacuuggaaguaaaguguuccauaacucccucacuugggaugugagcauugguuuucuuuuuucuuuuuuuaaaaaaauaagaaagaaaaaagauuuauuuauuaugugagcacacugucacucuucagauacaccaggagagggcaucagaccccauuacagaugguugugagccaccaugugguugcugggaauugaauucaggaccucugaaauucugaaagagcacuaugugcucuuaaucacugagccaccuccccagccgagcauugguuuuucucuaaaagaauguuuucuguaauaccagcaccugggaagagaauguaggagggucaggaguucaaggccagccuaagcuacuuauagaggugugaggacaucauuggggagucggucguugcuguccuacuuuccagguagucuuucugcuuguguuggugugcuggcaagccaggcugccugcuggagccuccucuccacccucugccauaguaggggugccaagccggggguacagaugugugccucucaucaucuuuuucugggguuccagggauugaacucagauugucagcuuguguguugaguacugaugcaucgaaccaccuugcuagucaguguuuuaaggacugcugccucucccguagguguacaggaaugagggaaacagcccguccuccuuugacuucuugaacgauuccuccagucugcuagugggacacugggauggacauuugucacugguagauagacggacaccuggaacuucuuaugagaaguuuuuuaauucaucuuuggaaaaaauaagaacuguucauguccacccacuauccagacaguauuuugucacagcaggauugagguaugcuuguuuucuuacagguuuguccguuuuuguguuuugagacagggucccacuuucugucucagucugcuuugaaaucugcugauucuccugccuuagcuucucaagguuuauagcucugugaccaggucaggcuugagaugugcucugcagacaauguuaggauuuaauccuuuucauguuacaacuaugugguuuaguuucauagauccuuggccagcuuucugugucucugucucugucucucuuuucuucuuucuuuuguucguucguucguucguucuggaacucacucuguagaccaggcuggccucgaacucagaaauccgccugccucugccucccaagugcugggauuaaaggcgugugccaucacugcccggccucuuuucuuucucuugagacaagaucucacuauguagcccuggcuggccuggaaaucagaaauccauaaaccucuaccuucugaauguugggauguagagcaugccacuugauccccaucugacuuuugugccauacaaguaaauuucuuagucacacugauagaaauguuuugaguguaaugcuuuuuacaggaauucuuuugguuuaauaaacagaaacuguuggagaaacacacaucucugccuucacaccugucccuucacgucugaccccucacaucugucucuucauaccugucccuucaugucugacacaucugucucuucacaccugucccuucacgucugaccccucacaucuaucucuucacaccugucccuucacgucugaccccucacaucugucucuuuggcacugaaugugcuucugucuacuuuuaugagaagaaaacuuauaauaaacagaaaagcugugugugaccuauaaccucgcucuuguuucuuuguauuuauuuauuuauuuauuuauuuauuuauuuauuuauuuauuuauuuauuuauuuuucuaugccguucacugccugcaaaguuauagauuagaggguuuugucuuaaaugcucuuaauguaguaggcuucugcaugucuaacuugggcuuagcuuugcuuuauaggcuggcuacaugggcugauaauuucucuuccugucccagggacguucauguuuacgaugccagguuccugaaguccaggggaagccagccucugauuuccuugacugagcacucgaaaagcauugccucugcauauuucucccccguuacugguaacagaguggugacuacaugugcugacuguaagcucagguaaacgaagaagacugaaagugugucuagaggaaccucaaguuuagagacugcagcaauggugucuuagacuagaaguuauguuuacccuguugcuauggaaucacuaguguugcaguauuauagucucucccuuccucauuacccccucccccuugcaccuccagugucuuacuguauucuagguuggcuuugaacuugugacccuguugcuuuggcuuccugagcacugggauuacagguguucugggucuaccuuaauaguguguuaaauggaagugggagagccccguucaggcauguggaaaacagcaaaaaaugaugcuuuugcauaaacuaguaguagauguuguuuuaggguuuuugcuuugguacuuuucuauagcaaccuuccccaaaccgauuuaaaucaguugaacuuagauacagaaaauaaugucaaguuaaagaggcuuuuguauucccaauuucucgacagcccggaaaaaagaugugaagacaguuaaugcagcuauaagggaagcaauucuguucccuucaagaauacacaaucuuguuuuagauuugcaacuucuuaagaguuggaauucuuuccuucaacaagugccuacugaauguaucccauggguguggcucaggaguggcaagcaggucuuugggugcagaguuagugucuagcagagugugugagcacucccaggagaugagucagagugcuuaucagacugcuucuacucccaugguuuaucccuuuuuauucauuuacacuccggaguuuaucuuacuauauaaaccucuagucauuaaguauuaaucaaaccaggcaagcucuugugccaagagauugauugcucugcgucagcugggcgagcauggagggggauaugauacagaaguuggcuucuuucuaccauguucccuacccaguagaggagucuggguccuccucuugcaugcugccaucacuaccaggcuaucacugagucagagaaagauugcuuucuguacaugcaugcaaaguguuugugcuguucccucccacagcccucauguauguugcuuauuugugaaucugaauauaguuuuucugcaaguacauacuaagcugguguggcaguaccuaccuguaauuucagcucuuaggaggccauguaggaaucgacaguucuaggcauacauagugagauaccuuuuggggaggagggucgcauugggcagaguuucucuguguaguccuggaagucacucuguagaccaggcuggccuugaauucagagaucggagugucccgucucccaaguucugggauuuuaagugauaguguuuagauaugcuuaugauacagucugaauuucauagcagucaguguacuuauuguuaaagauggcaccugagguuagagucugaucccauauaaaguaacaauuauauuuccuacugugaaucauggguaucuuaaacacacacuauuucagaaagauuugagaaucugaguaccaugacuaauuguuuucaacguuuauuuugcagggucuuugacagcagcuccauaucuucccagcuuccucuccucaguaccaucagguaggccuccgugcacagaacgcccaugguccuggacgcugugagcagcacagcacauagaaggugcacgcuaggcacguggcuguccaggggaggcucuaggccuggauuuguguugugcugugagcugacuuccaguccuguccagaggagcucuugcuuguaggccucaguggcccgacucuuguuuggcacgugcucucugagguucuguucagucaacgcuaaggacuguauugcccuugaguuacacuguguuucuacuucaagaagacugcgacuucuugaugggcccguuuauucugggcuuccguggccucugcaccguuccgcccuguggucugguugccucuuucuucuugaacccacuccuuuaugggacuuuaguccacacgccacgagucucucuccacauugcuuuaucauuuuugaaguugguuccugcguggcguggcuuugucagugucaguuuucaggaccugcauuuuaagcagguuuguucccguucuucauagcuuuugcccauuuuuuuuauuuuucauauauuaugauuuaguuuaucuguuuguuuuuguuuuugauuugagacagcgucucacuagcucuucaggaguucccuguguagaccaggcuggccuugaacucacugacauccucugucucugccuccugaaugcugagauuaaaggugugugccaccaugcccggcccuuauuuaacuuacuaacaaauaaaaauguguaggacgcguauauagcauguuuugaaauagaauggcuaaacuauucuguuuaacguccauuaccucucauuccuuccccuugguuuucucgaaugaguucauuuaaaaucuacucacugacuuggggaaacacugguuuggcaagugugcuggccuggaacucccuccacuccuauuggugguugucaggguagcucaugacugcugugacuucagcucccugcacacacauggaaaacuuuuuuuuuuuuuuuuuugauuuuuugagacaggguuucucuguguagcccuggcuguccuggaacucacuuuguagaccaggcuggccucagacucagaaauccgccugccucugccuccccagugcugauauuaaaggcgugcgccacuacgcccggcucagcaugggaaacuuacacugacauacacacacagguaaaaguaagucuuuacaaaguuuaaauauaaaaccuauuauuaacucuuguucuagaauagauguccugaaucuuucugcucucugaaagcuuagucuuucacaaaugucuccccagcacucugguaggaaccagccucugggaagguucuuagccuuuccuuuauauucuacaaggaagugaggucaugucuugccuguuuuucuauguccugcuuauuucaggcucaucuguguuguuacagaugacaagauuccuuaaagcuaaauaguuuuccugugugugucucuguguguguguucuacauuuagucuguuuaccuguugauauuuaucuagcgccggugccuugaaaaucuauauguagaccaggcuggccuuaaauucauagagaucugucugcaucuguaucuugagugcugcgauuaaaggcaugugcuagaauaaaaccacagaucugaagcucucuauauaguggcuagauagcaccugccucagcucuagaauuaacaggugugauuacuugaaauuaacaacaacaaaaaaagcccuaauagcacaaccugcaagagagaaagcucugccaggcaggguuaaugucuagaauauaagaacuaaauaagcauaaaaacuguacacaagagaauaaagcagaaagcccacaacaauccuuccaguaauaagugggcuaauaauggggaguucucaaaaggacaaauuuaagaggccauaaaauugacucaacagggguuggggagauggcucagagguuaagagcacugacugcucuucuagaggccccgaguucaauucccagcaaccacacgguggcucacaaccaucuguaaugggaucggaugcccucuucuggagugucugaagauagcuacaguguacucauaaaugaaauaaaucuuuuuuaaaaauuggcucaacaguuaagaguguugcguagucaugaggaucugaguucaaaucccaacaaacaugcuuaaaacagagccagguagguacccaugugcccuuagcacuguuggguggaggcaggaggauggccugggacucaguaagauuacauguuuaucuuuggagaaaacucucuaggucacuugucguauuuguuugugucucuucauugccaggugguuuuaauuucuauugcuaacauccaacuuucaugaaaacauugggcuaacaggaguucagaggcuuguaaccuuguugcaaaaacauaauugugaaaaucauuuuacuaaaaaugaguuauuguuauuuuacacaaauaacuggcuuuuccugauguuguuguuauuuuuuuuuuuaaagauguauguaugugaguacaauguagcuuuacagaugguugugagccuucaugugguuguugggaauugaacuuuuaggaccucugcuugcuuugguuggcccacucgcuccagucagauuccgcuugcucagucccugcuugcuccugcccaaauacuuauuuauuauuauacauaaguacacuguagcugaaguacacccgcugagccaucuugccagcccgagguuauuuuaaguuugaugaaauuccugcaugauuucuuuacauacugauuucugagugcaaaugaucacaaacaaggcauagaacaucccaccgcaccuccuuuuaaaugaaaacaggcauaauugguucauuuaaaaucugaggguuuucuuuuuuuuuuuuuugguuuuucgagacaggguuucucugcauagcacuggcuguccuagagcucacuguagaccaggcuggccuugaauucagagaucagccuuccucugccucuugagugcuuggauuagaggcauguacagccaacaacuggcuacauuuuaguuuuuauuauuguguguguacagacagguuggugcacaacaugccacguguguguagguuagaacgauguucaggaguggguuuuccgcuguugcggggccuggggacugagguccgauggucaggcuggagcaucugaagccaugaagugucagguucuuguuauuuucuucaguauuauuuuuggcuacuuagggucuuuugaauuuugguaugagucuuaagauuuuugauucuauuucugcaaauaaaagauaacauugugauugcauugaauuugucgauucccuuggguagugugaauacuuuaguauuaaguuuuaagccauaaacacaggaugucugucccuuuauaucacugcuuuguuuucugugugugcagugugugcuacuguguuuguguguuugaugcugacuauuuuccucuuugguugguugguugauuggcagggucuggauauuacuccccauccuauccauccgucugucuguccuuccguccauccauccauccauccauccauuuaucuuagaggcaggcuggcuuggaacuugcuauguagauaagagcuccgccuuccccugguuucagugcugaggucccacaugcagcucccaucuuaauuuugacagggcuucucauugacuuggagcaugcuguucuggcuagaguggugggccagcaagacccuggagucauuccuguuucccccucccagggcugggguuacaggcagucgcugguauuuuaugugguugcucagcccccauuucuuuuaacaguguuuugugucuuuuuguauacaaguuuuucauguccgagguuaggauuguuucugaggcaucuacguuuuaaaaucaucuaucccccugucucaauguagcccaggcuggaucaacucagcuucccugaugcugggagcauaggugccuaccaccaugccugguugguggggccucuuuuuuuaauucuguuuuuggauguguuaacuaugaguguuguagcaacugcuuuuaaaaauaguuauauguauauuacuuauauauauguuuauguuuguugauauuuauauccuacauuuaaaaacuguguaugauacauaagcacucuaccaagugagcuacacccccagguugaagauacuugugucuguguucauuaagaaagcugaguguggaggugcaacccagguaguuuccgcauugggagguugaggagggaagauugcuacaguuggagugagacugagcuacaugccaauuuccaggcuacagagugaaauccugucucaaacagaaaaagaaaaacuaauuuuauggaaacuuauucuuaaaucucucucucucucuuccucucuucccuuaguguauauguguuugaguccucuuaacuaguuaucaaugaauuaauauauuuuaauucuuuagggucagucuuggcaaguuguguuccuaggaguuuguccucuucuucuagguuauucaguuuguugguuauguaauuguucuuagauucucugugugugcauagagcagugacuaggaaagguacuguuuuagggauggugaugcggcucaguugguagagcacuugccugguaagcaggagccgcuggcuuugauuugguuugauucccagugugguauaugccuauaauaucguuaccugggagguggaggcagggggaucagaaguuugaggucauuuugcuacuuagugaguucaaggucagcuuggacuacauaagacccugguauccaaaaaaaaaaaaaaaaaaaagggugggguggggaaucuguuuacaagaaucuuauuuauauguaugagucuuuugccuguguguguaccaugagugugccugaugccugcugaggucagaagagggcauugggucccauggagcuggaguuagggacgguugugagccaucauauggguccugggaaccaaaccaguaaguguuuuuggcuacugagacaucucuccaggcccagaaaaaaggguaccauugucauaggcugagagucacugcccucuaacacauaaaaguaaacacacuguuuuuuuguuuguuuguuuguuuuucccuacuaggcacaacacugucacugggagguggcuaacgagguuccaggcugugugggacccuaaacaagaagauugcuucauaguugguagcauggaccacccacgacggguggaagucuuccacgagucgggaaagaaugugcauucucuuuggggagaaugucuuguaucuguguguucccucagugcugugcauccuacgcgauauauccuggcuggagguaauuccaguggcaaguuacauguuuuuaugcaucaagaaaccugagucauuggauagguucaacaaauuguucaacuuguucugcagcuagggaaccuagagacucagcuuagugcaucuguuuggucacguguuauauuuaguaaauauaacacugcuuucucagugagaccuccacacagaauguaauauuagcaagggaggaacuugaaggccauuucuagaggaugagggagagaccuggagcagaaacggguguuuucauguacuuuuugauuguuuugaguuaggaucuuguguagcacaggcuagccucagauucuguagccaaggaugaccuagaacugagccuccugccccgaccuccugagugcuaaugucucaggcacguuccaguacacuuggcaucuuucaacacuuuuaauuaggcuguauuuugcaaaauucuaacaaauuauaaagcuuucaguggucauuauuaaucuuuugugacagaaugaaacuauuuugaugcaauaguaaucuauagaucugugacuuauuuagcuuggggugaauaauuauuucucaacacuggacuagguccugaaagaccaucuaagacuaauuaugaaacauuauugaaucccagagacugucacaugcuagacaaguauucuacaauugacucauaccccaccuuugaaacuuaaauguuuguuuugcgucauucuugagacuggaucuugcuauguagcccagguuagcuuugaacuuaguccuucugccucacuuuuccaagugcugggaauauagguguguacuaccaugcccagccagaacuuaguuuuauaagcuaagaacuuuuuuggggauccuuguaucucagcucaguuuuacuugaaaucucaugauauucacuggagaacaguuggcuucuuugacucuggucugcuuggagcucgcucuguccccugccucugggcagcuccugaaaugggccaggacagcacuguuugaccuugcgccauuaucuuguuuucuagugacuagcuguacagacugggcuccagaugagggguuuguaguuuuucacaugaaaauuuuggaguuuugauuuauuuaaaaacacagaaauauaagacuuuuuguuuuaaucccacaauauagggcugcuucauauuguccgcggcaggugacugugauuugccccaugcuguagcaggggugugguugugccagcugcagacaguuucugcaaaugcgugacauuuggaauucugggaacuuuucagagguuauauaaaugcuagagcccccaguagacgggguggggugguuguugguuguucagggggauuggcugugauuuguuaguaguugugcucaaagaagcagcaaaaggaaagaaauuagauucagggaucucccuucccccuauuucuuucccuucuaucucuauccuccucucucuguuaucuaguguuggggagaguggggggcgggggggggggcugggcggcguggauaaaggguggcaagaaaaaauccacaaaguaguaaagaccagcuacagcccuaagguggaauuuaaaauaaaaauugagucccaguguuggguaccacuucuauccagucuaauucuuuuuccuuuuguuucuucuuugaucaugacuauuaacaaacaguaaccaaccaaacccccccacccccagcagccaauaaccgcuaacaauccuucuuggggcccccacauuugcauacccucugaaaaguucccagaguuccaaaugacaugcaauugaagaaauuaucuauagcuggcaaaaccacggcucugcuagagcacaaugcaaaucauagucagcugcuguggacauaucccacaccugggauuagaacaacauucuuauaguucuguggguuuuuuuuuuuuuuuuuuuuaagaaaccaaaauucuagaauucuuauucuacccuagcacuugagaaguagaagcaggagaaucaggaguucaaggccaaccucagguaauaguaaauucaaggccaauguggcucaccuucccuucuccccagauuaauagagcacacaaaguaaaauuaugguaguuuuauuuuuuagaguacuuuaaaauaaaacuuaucuucauaugcauauauguauauacgauauauguuuauauauauucugcuggaucauaucugccuggugucacaguguauucaacauuuuuccauuguuauuugccaaaauuacuacugaaggauuuauaaauaaauagcuuaagcaguauguuuggauuguaaaaaggaauacuuaauuauaugucagagaaauaaagugauguggauuuuccuuaaauaaugucuuugaguaaucuuuauaauuaaaaaucuagaggcucagccgugaagagcgcuaguuacuuuuucaaaugauccaaauuguauccccagcaugguggcucagaacccagugcaacuccaguucucagggaugcagugccgccuucugaucucugcagguauugcauacacaugguaugcaagcagaacacucauaacacauaagauuaacacaaagguuaaaaaaaaaaaucuaagaauuuaguguggugucacaggacuuuauuccuaucacuugggcagucuggucuacuuagugaauucuaggccagccaaugagaccucaucuaaaaacaaaaagugugugucagaggcuuagcuuuaauaaucaugauauuuguaaggaaaugguaguucuguuucauagcugauaguuuauuuuauuuuuauucuauguauguccacugcauguguguguugcccaggaagucagaggguguccuauccucuggagcuaaguccuagccaguugcaagccaccaugugggugcugggaucugaaucuggguccuuuccaaguacugagccauccuucucgcuguguacuguuaacuugauaaagugaaaccaguuacaaggguuuuuuuuauuuuguuuuuguuuuuuuaaaaaagacccauucucuuacgguauuuaaauauuuauuggauuuaaaaauaaucuucauggcaccaaugauuuuaugcuaacuacauacuacauauguagaaaagaguacauugcuuugaaggaaaacguaacuuagauuuggcacacgaaagguuaacagguguauacuuuuaagugaaacuaagaaauucacauuuguagguaguuuauccucuacugcuuaaagaugcaguccacuauucaguaaguauuuccucugaucaauaaugcuaggcagaucugcuuuucuacagugagaucaauaauucugagaggaaagaagagacacagaauacggcaaaaccagacgaaaacagaaacuuuuguaaugauggggaaaugaugaaaaacacuagucaccaguaaaggggguuuguuacugaacuauugaaaacuauuuggaaaccgaaucgaagggagccuuuucuguccuuauuuucugggcuaagccuugagggagaaaaugaccugaagauucugggucagauguuggaaauggcacggaucgcagcacuguuaggacucuagacacaagaaacacaccaggcaauggcaggcugccucucucgaggcuaugaaaggucagaggcgagacuaccacucacugcauagacacuguguucuacagacugag
